United States Patent 12,397,048 (BUNYAVIRALES VACCINE) - sequence listing, part 8

SEQ ID NO: 10055 - RNA, 3408 nt, synthetic construct
  misc_feature 1..3408: note = derived and/or modified CDS sequence (opt3) from HTNV(JS1)__KP970560.1__GP
  source 1..3408: mol_type = other RNA
atgggcatctggaagtggctggtgatggccagcctcgtctggcccgttcttaccctgagaaacgtgtacgacatgaagattgagtgccctcacacagtatccttcgggggaaattctgtgataggttatgtcgaattgccaccggtgcccttagctgatactgcacagatggttcctgagtcaagttgtagcatggacaaccatcaatccctgaatacgatcgccaagtacacccaggtgtcttggaggggcaaagcggatcagtcgcagtcaagccaaaacagttttgaaacagtctccactgaggtggacctaaaggggacctgcgtactcaaacacaagatggttgaagagtcttatcggagccgcaagtccgtgacatgttacgatctgtcatgcaatagtacctattgtaaaccaactctttacatgattgtccccatccatgcttgcaacatgatgaagagttgtctgattgccttgggaccttatcgagtccaggtggtgtacgagcgtacatactgcatgaccggcgttctcatcgaaggtaaatgtttcgtgccagaccagtctgtagtgtccataatcaagcacgggatttttgatatcgcatcagtccatattgtgtgcttctttgttgccgtgaaaggaaatacgtataagatcttcgagcaggtcaagaaaagttttgaaagtacttgtaacgacaccgagaataaggtgcaaggctactatatatgcattgtaggcgggaactctgctcccatctacgttcctacactggatgacttcagatccatggaggcatttactggaattttcaggagcccacacggtgaagatcacgacctggccggcgaggaaatcgcttcgtattctatcgtggggccggccaatgcgaaagtcccccattccgcatcaagtgataccctcagcttaattgcctactccggaataccttcttatagctcactgagtatccttacatccagcaccgaggctaagcacgtgttttctccaggcttgttccccaaactgaaccatacgaattgcgacaagtcagccattcctctaatctggactggtatgatagacctcccagggtactacgaagcagtccacccctgtacagtgttttgcgttctgagtggaccgggcgctagctgtgaggccttctccgagggcgggattttcaacatcacctctcctatgtgccttgtgtcgaaacagaatcggtttcgcctgactgaacagcaggtaaacttcgtctgtcaaagagtggatatggacatcgttgtgtattgcaacggacagaggaaggtcattttgacaaagaccctcgtgatcggtcagtgtatttacacgataaccagcctgttttccttactgcccggcgtagcgcactcaatcgccgtggagctctgcgttccagggttccatggatgggcaacagctgcccttctggtcactttttgtttcggctgggtgttgattcctgctatcacctttatcattctaacagtgctgaaattcatagccaatatctttcacactagcaaccaagaaaatcggctcaagtctgtcctgcgcaaaattaaggaggaatttgagaaaaccaagggtagcatggtttgcgatgtgtgtaagtatgagtgcgaaacatacaaagagcttaaggcacatggggtgtcctgcccccagtcacagtgtccatattgcttcacccactgtgaacccactgaggccgctttccaggcgcattacaaagtatgccaagtcacgcaccgatttagagacgatctgaagaaaacagtgacccctcagaacttcactccaggctgttataggaccttgaatctcttccggtacaagagccgttgctacatctttacaatgtggattttcctgttagttctggaatctatcctatgggcagcctccgctagtgagaccccgctcactcccgtgtggaacgacaatgcccacggagtcggcagcgtgcctatgcatacagatctggagcttgacttttctttgacgtcctcaagtaagtatacctaccgcagaaaactgactaacccactcgaagaggcacagagcatagatctgcacatcgaaattgaggagcagacaatcggggttgacgtgcatgcccttggacactggttcgatggtaggctgaatttgaagacctcgtttcactgttatggcgcttgcacaaaatacgaatatccctggcatactgccaagtgtcactacgagcgggactatcaatacgaaacctcctgggggtgcaacccttctgactgtccaggagtaggcacgggttgcaccgcatgcgggctctacctggatcagttaaaacccgtcggcagcgcgtataagattatcacaatacgatactcacgcagagtgtgtgtgcagttcggagagggcaatctgtgcaagattatcgacatgaacgattgttttgtcagtaggcatgttaaagtgtgcattatcgggactgtatccaagttctctcagggagacaccctactctttttcggtccgctggaaggcgggggacttatatttaaacactggtgtacaagcacttgccaattcggcgatcctggtgacatcatgtccccacgggataaggggtttttgtgtcccgagttccctggctcattccgcaaaaagtgcaattttgctaccacgcccatttgtgagtatgacggaaacatggtgagcggctacaaaaaggtcatggccacaatcgatagtttccagtcttttaatacctccactatgcatttcacagacgaaagaattgagtggaaggatccagacgggatgctgagggatcacatcaacatactcgtgaccaaagacattgactttgataacctgggagaaaatccttgcaagatcggcttacagactagctcgatcgagggtgcatgggggtcaggagttggcttcaccctgacatgtcttgtgtctttgacggaatgccccacctttctcactagcattaaagcctgcgacaaggctatctgttatggtgccgagtccgtcacactgacccgtggccagaacacagtgaaagttagcgggaagggaggccactctgggagcactttcaagtgctgtcatggagaggattgctcccaaattggcctacacgcagctgccccacatctggacaaagtgaatggtatatcagaaatcgagaacagtaaggtctacgatgacggggcgccgcagtgtggaattaaatgctggtttgtaaagagcggcgaatggatctctggtattttctccggcaattggatcgtgctcatagttctgtgtgtgtttcttttgttctcactggtcttactcagtatcctgtgccctgtgcggaaacacaaaaagagctga

SEQ ID NO: 10056 - RNA, 3408 nt, synthetic construct
  misc_feature 1..3408: note = derived and/or modified CDS sequence (opt3) from HTNV(LongquanAa-08-150)__JQ912803.1__GP
  source 1..3408: mol_type = other RNA
atgggcatctggaagtggctggtgatggccagcctcgtctggcccgctttcacccttagaaacgtttacgacatgaaaattgagtgccctcacacagtgtcctttggggaaaattctgtaataggatatgtggagctgccaccgatgcccttggcagatactgcccagatggtccctgaatcaagttgtaacatggacaatcatcaaagcatgaacacgatcaccaagtacacacaggtgtcctggaggggtaaagcggatcaggctcaggcctctcaaaattcgttcgaggcagtttcagccgaagtggacttaaagggcatttgcgtcctgaaacacaagatgctagaggagagctatcggagtcgcaagtccatcacttgttacgatctctcttgcaacagcacctattgtaaaccaacactgtacatgattgtgcccatccatgcttgcaatatgatgaagtcctgtcttatagcactggggccttatcgagtacaggttgtgtacgaacgtacctactgcatgactggagtcttgctcgagggcaaatgttttgtgccagaccagtcagtggtcagtatcattaagcacggtatcttcgatattgccagcgttcatatcgtgtgctttttcgtagctgtgaaagggaacacatataagctgctggaacaggtcaagaaatcttttcaatccacctgtaatgacacggagaacaaggtgcagggatactatatatgcattgttggcggcaattcagcccccatctacgtgcctactctcgatgacttcagaagcatggaggcgtttagtgggattttcaggtctccacacggagaagatcacgacttagccggtgaggaaatcgcatcctatagcatcgtcggcccggctaacgccaaagtgccccattcggcatcttccgataccctgtcacttattgcttacagtgggatacctagctattcctctttgagcatcctggcctcaagtacagaggcgaagcacgtattttccccaggattctttccccagctaaatcatactaaatgcgacaagaccgccattcctctcatctggacaggcatgatagacctgccaggttactacgaagcaattcacccctgtaccgttttctgcgtgcttagcgggccgggagcttcttgtgaggccttctcagagggcggcatctttaacatcacgagtcctatgtgcctggtcagcaaacagaatcggttccgcttgactgaacaacaggtgaactttgtctgtcagagagtggatgttgacattatcgtgtattgcaacgggcaaaggaaggtaattctcacaaagaccctggtcataggacagtgtatctacactattacatccttattctctctgctccccggtgtggctcactcgatcgccgttgagctttgcgtgccaggctttcatgggtgggcaaccgccgctctgttggtcacgttctgttttggatgggtgctaatccctgcgctgaccctcattatactgacaatccttaaattcattgcaaatatctttcacacttgcaaccaggaaaatcggctgaaaagcgtattgcgcaagattaaggaggaatttgagaaaaccaagggctccatggtgtgtgatgtttgcaagtatgagtgcgaaacatacaaagagctcaaggcccatggtgtctcatgtccccagagtcaatgcccatattgtttcactcactgcgaacccaccgaggctgccttccaggcacattaccgagtgtgtcaggtgacacacagatttagggacgatctgaaaaagaccgtcactcctcagaacttcacgccagggtgctatcggacattaaatctgttccgttacaaatctcgctgttacatctttaccatgtgggtttgcctactcgtgctggaaagcatactttgggccgcttccgcctcagaggtgccgttgaaccccgtatggaatgacaacgcacacggcgtcggaagcgtgcctatgcatactgatctggagctcgacttctctctgacctccagtagcaagtatacatacagaaggcggcttaccaatccactggaagagactcaatctatcaacttgcacattgaaatcgaggagcagacaattggcgttgatgtgcatgcgctcgggcactggtttgacggacgactgaatttaaagacgtccttccactgttatggtgcttgcaccaaatacgaatatccctggcatactgccaagtgtcactacgagcgcgattatcagtacgaaacatcatggggctgcaaccctgcagactgcccaggggtcggaaccggctgtacagcctgcggtctgtacctagaccagctcaaacccgtggggagtgcttataagatcataactattagatacagcaggaaagtttgtgtgcaatttggcgaggaaaatctgtgcaaggtaatcgatatgaacgactgtttcgtcacccggcatgtgaaggtgtgcattatcggaacggtctcgaaattttcccagggcgatacccttttgttctttgggccgctggagggaggtggcctcatattcaagcactggtgtacatctacttgccagtttggggaccctggagatatcatgagcccacgcgacaaaggcttcctgtgtcccgagtttcctggttcattcagaaagaaatgcaatttcgccaccacacccttatgtgaatatgatgggaacatggttagtggctacaagaaagtgatggcaactattgactcctttcagtctttcaacaccagcacgatgcattttacagatgagaggatcgaatggaaggacccagatggaatgctgcgtgaccacattaatatccttgtaaccaaggatatagacttcgacaacttgggcgagaatccttgcaaaattgggctccaaacttcctcaatcgaaggagcttggggcagcggtgtggggtttacactgacctgcctaatcagtctgactgagtgtcccaccttcctcacatctattaaggcctgcgataaagcgatctgttatggagccgagtccgtcacgctgacccggggccagaacactgtgaaggttagcggtaaaggcgggcactcgggatcaacatttaagtgctgtcatggcgaagagtgctctcagattgggcttcacgctgcagccccacatttggacaaggtgaatggaataagtgaaatcgagaacaataaagtctacgatgacggcgctccgcaatgtggtgtgaagtgctggttcgttaaatccggggaatggattagcggaatcttttctggcaactggattgtgctgatcgtcttatgtgtattcctcctgtttagccttgtgctgttgtccgttctctgccctgtgcgaaagcacaaaaagtcatga

SEQ ID NO: 10057 - RNA, 3408 nt, synthetic construct
  misc_feature 1..3408: note = derived and/or modified CDS sequence (opt3) from HTNV(LongquanAa-08-157)__JQ912804.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgaaaattctgtaatagggtatgtggaactgtcaccaatgccgttggcagatactgcccagatggtccccgagagtagctgtaacatggacaatcatcaatccatgaacacgatcaccaagtacacacaggtgtcttggaggggaaaagcggatcaggctcaggcctcgcaaaattcattcgaagcagttagcgccgaggtggacttaaagggtacttgcgtcctgaaacacaagatgctagaggaaagttatcggtcccgcaagtctattacctgttacgatctcagctgcaactccacatattgtaaacctaccctgtacatgatcgtgccaattcatgcttgcaatatgatgaagtcatgtcttatcgcactgggcccctatcgagtacaggttgtgtacgagcgtacttactgcatgacaggggtcttgatagaaggaaaatgttttgtgcctgaccagagtgtggtcagcatcattaagcacggcatcttcgatattgcctctgttcatatcgtgtgctttttcgtagctgtgaaaggtaacacctataagctctttgagcaggtcaagaaatccttccaatcaacgtgtaatgggactgagaacaaggtgcagggatactatatatgcattgttggcggcaatagcgccccaatctacgtgcccaccctggacgattttagaagtatggaagcgttctctgggatttttaggtcccctcacggagaggaccacgatctggccggtgaagagatcgccagctattcgatcgtcggcccagctaacgccaaagtgccgcattctgcatcctcagacacactcagtttaattgcttacagcgggataccctcctattctagcctgtcaatccttgccagttccactgaagcgaagcacgtattcagccctggatttttcccacagttgaatcataccaaatgcgataagacagccattcccctgacctggacgggcatgatcgacctacctggttactacgaggcaatacacccatgtactgttttctgcgtgctctctgggcccggagcttcatgtgaggcctttagtgaaggcggcattttcaacatcacaagcccgatgtgcctggtctccaaacagaatcggtttcgccttaccgagcaacaggtgaacttcgtctgtcagagagtggacatggatatcattgtttattgcaacgggcaaaggaaggtgatcctgactaagacattggtaattggacagtgtatatacaccatcacgtctctcttttcgctgttacctggtgtcgctcacagcattgccgtggaactgtgcgttcccggcttccatgggtgggcaaccgccgctctccttgtgacattttgtttcggatgggtcctgatcccagcgttgactctaatcattctgaccatactcaaatttatcgcaaatctgttccacacatccaaccaggagaatcggcttaagtcagtgctgcgcaaaattaaggaagagtttgagaaaactaagggcagtatggtatgcgacgtgtgtaagtatgaatgcgagacctacaaagaattgaaggcccatggtgtttcttgccctcagagccaatgtccctattgcttcacacactgtgagccaaccgaagctgcctttcaggcacattaccgagtctgccaggtgactcacagattcagggatgacctcaaaaagacggtgacaccccagaacttcacccctgggtgttatcggactctgaatttatttcgttacaaatcccgctgctacatcttcaccatgtgggtctgtctgctagttctcgagtcaattctgtgggccgctagcgcctctgaggtgccacttaacccggtgtggaatgataacgcacacggcgtaggatccgtccccatgcatacagacttggaactggattttagtctcaccagttcttccaagtatacttacagaaggcggctgacaaatcctcttgaggaaacgcaatcaatcaacctgcacatagagatcgaggaacagaccattggcgtggacgttcatgcgttggggcactggttcgatggacgactcaatctgaagactagctttcactgctatggtgcttgtacaaaatacgagtatccatggcataccgccaagtgccactacgaacgcgactatcagtacgagacaagctggggctgtaaccccgcagattgccctggggtgggaactggctgcaccgcctgtggtttatacctggaccagctaaaaccagtcgggtcggcttataagatcattacgatcagatactccaggaaagtgtgcgttcaattcggcgaagagaatctctgtaaggtgatagacatgaacgattgctttgtaacccggcatgtcaaggtgtgtattatcggaacagtgtctaaattcagccagggcgacactctgctctttttcgggcccttggagggaggtggcctgatttttaagcactggtgcacctcaacatgtcagttcggggatccgggagacatcatgagtcctcgcgataaaggctttctctgcccagagttccccggttccttcagaaagaaatgtaattttgccactacccctctgtgcgagtatgacgggaacatggtctctggctacaagaaagttatggcaacgatagatagcttccagtcctttaacacatcaaccatgcatttcactgacgaaaggatcgagtggaaggatcccgacggaatgttacgtgatcacattaatatcctggtgacaaaggacattgattttgacaaccttggcgaaaatccatgtaaaatcgggttgcaaaccagcagtatagagggagcttggggctctggtgtagggttcactcttacctgcctgatttccctaacagagtgccctacgtttctgaccagcatcaaggcctgtgacaaagcgatctgctatggagccgaatcggtgactctcacacggggccagaacaccgtcaaggtgtcaggtaaaggcgggcactctggaagtacattcaagtgttgccatggcgaggaatgttcccagattgggctgcacgctgcagcaccccatcttgataaggttaatggaatcagcgagattgaaaacaataaagtgtacgacgatggcgctccacaatgcggtgtcaagtgttggtttgtgaaatctggggagtggataagcggaatcttctccggcaactggattgttttgatcgtgctgtgcgtctttttactcttctcactggtacttctgagtgtgttgtgtccggttcgaaagcacaaaaagagctga

SEQ ID NO: 10058 - RNA, 3408 nt, synthetic construct
  misc_feature 1..3408: note = derived and/or modified CDS sequence (opt3) from HTNV(LongquanAa-08-196)__JQ912805.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgaaaattctgtaatagggtatgtggaactgccaccgatgcccttggcagatactgcccagatggtccctgagtcaagttgtaacatggacaatcatcaaagcatgaacacgatcaccaagtacacacaggtgtcctggaggggaaaagcggatcaggctcaggcctctcaaaattcgttcgaagcagtttcagccgaggtggacttaaagggtacttgcgtcctgaaacacaagatgctagaggaaagctatcggagtcgcaagtccattacctgttacgatctctcttgcaacagcacatattgtaaaccaaccctgtacatgatcgtgcccattcatgcttgcaatatgatgaagtcctgtcttatcgcactgggcccttatcgagtacaggttgtgtacgagcgtacttactgcatgacaggggtcttgatagaaggaaaatgttttgtgccagaccagtcagtggtcagtatcattaagcacggcatcttcgatattgccagcgttcatatcgtgtgctttttcgtagctgtgaaaggtaacacctataagctctttgagcaggtcaagaaatctttccaatccacgtgtaatgggactgagaacaaggtgcagggatactatatatgcattgttggcggcaattcagcccccatctacgtgcctaccctggacgattttagaagcatggaagcgttcagtgggatttttaggtctccacacggagaggaccacgatctggccggtgaagagatcgcatcctatagcatcgtcggcccggctaacgccaaagtgccccattcggcatcttccgacacactctcattaattgcttacagtgggatacctagctattcctctctgagcatccttgcctcaagtactgaagcgaagcacgtattctccccaggatttttcccccagttgaatcataccaaatgcgataagacagccattcctctgacctggacgggcatgatcgacctaccaggttactacgaggcaatacacccctgtactgttttctgcgtgctcagcgggccgggagcttcttgtgaggccttttcagaaggcggcattttcaacatcacaagtcctatgtgcctggtcagcaaacagaatcggtttcgccttaccgagcaacaggtgaacttcgtctgtcagagagtggacatggatatcattgtttattgcaacgggcaaaggaaggtgatcctgactaagacattggtaattggacagtgtatatacaccatcacgtccctcttttctctgttacccggtgtcgctcactcgattgccgtggaactgtgcgttccaggcttccatgggtgggcaaccgccgctctccttgtgacattttgtttcggatgggtcctgatccctgcgttgactctaatcattctgaccatactcaaatttatcgcaaatattttccacacaagcaaccaggagaatcggctgaagtccgtgcttcgcaaaatcaaggaagagtttgagaaaactaagggctcaatggtatgcgacgtgtgtaagtatgaatgcgagacctacaaagaactgaaggcccatggtgttagttgcccccagtctcaatgtccatattgcttcacacactgtgagcccaccgaagctgcctttcaggcacattaccgagtctgccaggtgactcacagattcagggatgacttgaaaaagacggtgacacctcagaacttcaccccagggtgttatcggactctcaatctgtttcgttacaaaagccgctgctacattttcaccatgtgggtctgtttactggttctagagtccatcctctgggccgcttcagccagcgaggtgccgctgaaccccgtgtggaatgataacgcacacggcgtaggatctgtccctatgcatacagaccttgaattggatttttccctgaccagtagctctaagtatacttacagaaggcggctcacaaatccactggaggaaacgcaatccataaaccttcacatcgagattgaggaacagaccatcggcgtggacgttcatgcgctggggcactggttcgatggacgattgaatctcaagacttcatttcactgctatggtgcttgtacaaaatacgagtatccctggcataccgccaagtgccactacgaacgcgactatcagtacgagacaagttggggctgtaaccctgcagattgcccaggggtgggaactggctgcaccgcctgtggtctgtacttagaccagctgaaacccgtcgggagcgcttataagattatcacgataagatactcgaggaaagtgtgcgttcaattcggcgaagagaatctatgtaaggtgattgacatgaacgattgctttgtaacccggcatgtcaaggtgtgtatcattggaacagtgtccaaattctctcagggcgacactctcctgtttttcgggccgcttgagggaggtggcttgatctttaagcactggtgcaccagcacatgtcagttcggggatcctggagacataatgtcaccacgcgataaaggctttctgtgccccgagttccctggtagtttcagaaagaaatgtaattttgccactacgcccctctgcgagtatgacgggaacatggtctccggctacaagaaagttatggcaaccatcgattctttccagagctttaacacatccaccatgcatttcactgacgaaaggattgagtggaaggatccagacggaatgctgcgtgatcacatcaatattttagtgacaaaggacatcgattttgacaacctgggcgaaaatccttgtaaaatagggcttcaaacctcaagcattgagggagcttggggcagtggtgtagggttcactttgacctgcctcatctctctgacagagtgccccacgtttctaacctccatcaaggcctgtgacaaagcgatttgctatggagccgaaagcgtgactctgacacggggccagaacaccgtcaaggtgtcgggtaaaggcgggcactcaggatctacattcaagtgttgccatggcgaggaatgtagtcagatcgggctccacgctgcagccccacatctggataaggttaatggaatttccgagatagaaaacaataaagtgtacgacgatggcgctccgcaatgcggtgtcaagtgttggtttgtgaaaagcggggagtggatctctggaattttcagcggcaactggatcgttcttattgtgttgtgcgtctttctgttattctccctcgtactgctttcagtgctgtgtcctgttcgaaagcacaaaaagagttga

SEQ ID NO: 10059 - RNA, 3408 nt, synthetic construct
  misc_feature 1..3408: note = derived and/or modified CDS sequence (opt3) from HTNV(LongquanAa-08-235)__JQ912810.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgaaaattctgtaatagggtatgtggaactgccaccgatgcccttggcagatactgcccagatggtccctgagtcaagttgtaacatggacaatcatcaaagcatgaacacgatcaccaagtacacacaggtgtcctggaggggaaaagcggatcaggctcaggcctctcaaaattcgttcgaagcagtttcagccgaggtggacttaaagggtacttgcgtcctgaaacacaagatgctagaggaaagctatcggagtcgcaagtccattacctgttacgatctctcttgcaacagcacatattgtaaaccaaccctgtacatgatcgtgcccattcatgcttgcaatatgatgaagtcctgtcttatcgcactgggcccttatcgagtacaggttgtgtacgagcgtacttactgcatgacaggggtcttgatagaaggaaaatgttttgtgccagaccagtcagtggtcagtatcattaagcacggcatcttcgatattgccagcgttcatatcgtgtgctttttcgtagctgtgaaaggtaacacctataagctctttgagcaggtcaagaaatctttccaatccacgtgtaatgggactgagaacaaggtgcagggatactatatatgcattgttggcggcaattcagcccccatctacgtgcctaccctggacgattttagaagcatggaagcgttcagtgggatttttaggtctccacacggagaggaccacgatctggccggtgaagagatcgcatcctatagcatcgtcggcccggctaacgccaaagtgccccattcggcatcttccgacacactctcattaattgcttacagtgggatacctagctattcctctctgagcatccttgcctcaagtactgaagcgaagcacgtattctccccaggatttttcccccagttgaatcataccaaatgcgataagacagccattcctctgacctggacgggcatgatcgacctaccaggttactacgaggcaatacacccctgtactgttttctgcgtgctcagcgggccgggagcttcttgtgaggccttttcagaaggcggcattttcaacatcacaagtcctatgtgcctggtcagcaaacagaatcggtttcgccttaccgagcaacaggtgaacttcgtctgtcagagagtggacatggatatcattgtttattgcaacgggcaaaggaaggtgatcctgactaagacattggtaattggacagtgtatatacaccatcacgtccctcttttctctgttacccggtgtcgctcactcgattgccgtggaactgtgcgttccaggcttccatgggtgggcaaccgccgctctccttgtgacattttgtttcggatgggtcctgatccctgcgttgactctaatcattctgaccatactcaaatttatcgcaaatattttccacacaagcaaccaggagaatcggctgaagtccgtgcttcgcaaaatcaaggaagagtttgagaaaactaagggctcaatggtatgcgacgtgtgtaagtatgaatgcgagacctacaaagaactgaaggcccatggtgttagttgcccccagtctcaatgtccatattgcttcacacactgtgagcccaccgaagctgcctttcaggcacattaccgagtctgccaggtgactcacagattcagggatgacttgaaaaagacggtgacacctcagaacttcaccccagggtgttatcggactctcaatctgtttcgttacaaaagccgctgctacattttcaccatgtgggtctgtttactggtttttgagtccatcctatgggccgcttcagccagcgaggtgccgctcaaccccgtgtggaatgataacgcacacggcgtaggatctgtccctatgcatacagacctggaacttgatttctccttgaccagtagctctaagtatacttacagaaggcggctgacaaatccactcgaggaaacgcaatccataaacctgcacatcgagattgaggaacagaccatcggcgtggacgttcatgcgcttgggcactggtttgatggacgactgaatttgaagacttcattccactgctatggtgcttgtacaaaatacgagtatccctggcataccgccaagtgccactacgaacgcgactatcagtacgagacaagttggggctgtaaccctgcagattgcccaggggtgggaactggctgcaccgcctgtggtctctacctggaccagttaaaacccgtcgggagcgcttataagattatcacgataagatactcgaggaaagtgtgcgttcaatttggcgaagagaatctgtgtaaggtgattgacatgaacgattgcttcgtaacccggcatgtcaaggtgtgtatcattggaacagtgtccaaattttctcagggcgacactctactcttctttgggccgctggagggaggtggccttatcttcaagcactggtgcaccagcacatgtcagtttggggatcctggagacataatgtcaccacgcgataaaggcttcttgtgccccgagttccctggtagttttagaaagaaatgtaatttcgccactacgcccctgtgcgagtatgacgggaacatggtctccggctacaagaaagttatggcaaccatcgattcttttcagagcttcaacacatccaccatgcattttactgacgaaaggattgagtggaaggatccagacggaatgctccgtgatcacatcaatattctggtgacaaaggacatcgatttcgacaacttaggcgaaaatccttgtaaaatagggctgcaaacctcaagcattgagggagcttggggcagtggtgtagggtttactcttacctgcttgatctctctcacagagtgccccacgttcctgacctccatcaaggcctgtgacaaagcgatttgctatggagccgaaagcgtgactctaacacggggccagaacaccgtcaaggtgtcgggtaaaggcgggcactcaggatctacatttaagtgttgccatggcgaggaatgtagtcagatcgggctgcacgctgcagccccacatctcgataaggttaatggaatttccgagatagaaaacaataaagtgtacgacgatggcgctccgcaatgcggtgtcaagtgttggttcgtgaaaagcggggagtggatctctggaatttttagcgttaactggatcgtgctgattgtcctttgcgtattcttgctgttctccttagtgctcctgtcagttctttgtcctgtgcgaaagcacaaaaagagttga

SEQ ID NO: 10060 - RNA, 3408 nt, synthetic construct
  misc_feature 1..3408: note = derived and/or modified CDS sequence (opt3) from HTNV(LongquanAa-09-171)__JQ912824.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgaaaattctgtaatagggtatgtggaactgccaccgatgcccttggcagatactgcccagatggtccctgagtcaagttgtaacatggacaatcatcaaagcatgaacacgatcaccaagtacacacaggtgtcctggaggggaaaagcggatcaggctcaggcctctcaaaattcgttcgaagcagtttcagccgaggtggacttaaagggtacttgcgtcctgaaacacaagatgctagaggaaagctatcggagtcgcaagtccattacctgttacgatctctcttgcaacagcacatattgtaaaccaaccctgtacatgatcgtgcccattcatgcttgcaatatgatgaagtcctgtcttatcgcactgggcccttatcgagtacaggttgtgtacgagcgtacttactgcatgacaggggtcttgatagaaggaaaatgttttgtgccagaccagtcagtggtcagtatcattaagcacggcatcttcgatattgccagcgttcatatcgtgtgctttttcgtagctgtgaaaggtaacacctataagctctttgagcaggtcaagaaatctttccaatccacgtgtaatgggactgagaacaaggtgcagggatactatatatgcattgttggcggcaattcagcccccatctacgtgcctaccctggacgattttagaagcatggaagcgttcagtgggatttttaggtctccacacggagaggaccacgatctggccggtgaagagatcgcatcctatagcatcgtcggcccggctaacgccaaagtgccccattcggcatcttccgacacactctcattaattgcttacagtgggatacctagctattcctctctgagcatccttgcctcaagtactgaagcgaagcacgtattctccccaggatttttcccccagttgaatcataccaaatgcgataagacagccattcctctgacctggacgggcatgatcgacctaccaggttactacgaggcaatacacccctgtactgttttctgcgtgctcagcgggccgggagcttcttgtgaggccttttcagaaggcggcattttcaacatcacaagtcctatgtgcctggtcagcaaacagaatcggtttcgccttaccgagcaacaggtgaacttcgtctgtcagagagtggacatggatatcattgtttattgcaacgggcaaaggaaggtgatcctgactaagacattggtaattggacagtgtatatacaccatcacgtccctcttttctctgttacccggtgtcgctcactcgattgccgtggaactgtgcgttccaggcttccatgggtgggcaaccgccgctctccttgtgacattttgtttcggatgggtcctgatccctgcgttgactctaatcattctgaccatactcaaatttatcgcaaatattttccacacaaacaatcaggagaaccggcttaagagcgtgctgcgcaaaatcaaggaagagtttgagaaaactaagggctccatggtatgcgacgtgtgtaagtatgaatgcgagacctacaaagaactgaaggcccatggtgtttcatgcccccagagtcaatgtccatattgcttcacacactgtgagcccaccgaagctgcctttcaggcacattaccgagtctgccaggtgactcacagattcagggatgacttgaaaaagacggtgacacctcagaatttcaccccagggtgttatcggactctcaacctgtttcgttacaaatctcgctgctacattttcaccatgtgggtctgtttactggttctagagagcatcctctgggccgcttccgcctcagaggtgccgctgaatcccgtgtggaacgataatgcacacggcgtaggaagcgtccctatgcatacagaccttgaattggatttttctctgacctccagtagcaagtatacttacagaaggcggctcacaaacccactggaggaaacgcaatctataaatcttcacatcgagattgaggaacagaccatcggcgtggacgttcatgcgctggggcactggttcgatggacgattgaacctcaagacttcctttcactgctatggtgcttgtacaaaatacgagtatccctggcataccgccaagtgccactacgaacgcgactatcagtacgagacatcatggggctgtaatcctgcagattgcccaggggtgggaactggctgcaccgcctgtggtctgtacttagaccagctgaaacccgtcgggagtgcttataagattatcacgataagatacagcaggaaagtgtgcgttcaattcggcgaagagaacctatgtaaggtgattgacatgaatgattgctttgtaacccggcatgtcaaggtgtgtatcattggaacagtgtcgaaattctcccagggcgacactctcctgtttttcgggccgcttgagggaggtggcttgatctttaagcactggtgcacctctacatgtcagttcggggatcctggagacataatgagcccacgcgataaaggctttctgtgccccgagttccctggttcattcagaaagaaatgtaactttgccactacgcccctctgcgagtatgacgggaacatggtcagtggctacaagaaagttatggcaaccatcgattccttccagtcttttaatacaagcaccatgcatttcactgacgaaaggattgagtggaaggatccagacggaatgctgcgtgatcacatcaacattttagtgacaaaggacatcgattttgacaatctgggcgaaaacccttgtaaaatagggcttcaaacctcctcaattgagggagcttggggcagcggtgtagggttcactttgacctgcctcatcagtctgacagagtgccccacgtttctaacctctatcaaggcctgtgacaaagcgatttgctatggagccgaatccgtgactctgacacggggccagaataccgtcaaggtgagcggtaaaggcgggcactcgggatcaacattcaagtgttgccatggcgaggaatgttctcagatcgggctccacgctgcagccccacatctggataaggttaacggaattagtgagatagaaaataacaaagtgtacgacgatggcgctccgcaatgcggtgtcaagtgttggtttgtgaaatccggggagtggatcagcggaattttctctggcaattggatcgttcttattgtgttgtgcgtctttctgttattcagcctcgtactgctttccgtgctgtgtcctgttcgaaagcacaaaaagtcatga

SEQ ID NO: 10061 - RNA, 3408 nt, synthetic construct
  misc_feature 1..3408: note = derived and/or modified CDS sequence (opt3) from HTNV(LongquanAa-09-191)__JQ912825.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgaaaattctgtaatagggtatgtggaactgccaaggatgccgttggcagatactgcccagatggtccccgagtcaagttgtaacatggacaatcatcaaagcatgaacacgatcaccaagtacacacaggtgtcctggcggggaaaagcggatcaggctcaggcctctcaaaattcgttcgaagcagtttcagccgaggtggacttaaagggtacttgcgtcctgaaacacaagatgctagaggaaagctatcgcagtcgaaagtccattacctgttacgatctctcttgcaacagcacatattgtaaacctaccctgtacatgatcgtgccaattcatgcttgcaatatgatgaagtcctgtcttatcgcactgggcccctatcgtgtacaggttgtgtacgagagaacttactgcatgacaggggtcttgatagaaggaaaatgttttgtgcctgaccagtcagtggtcagtatcattaagcacggcatcttcgatattgccagcgttcatatcgtgtgctttttcgtagctgtgaaaggtaacacctataagctctttgagcaggtcaagaaatctttccaatccacgtgtaatgggactgagaacaaggtgcagggatactatatatgcattgttggcggcaattcagccccaatctacgtgcccaccctggacgattttaggagcatggaagcgttcagtgggatttttcggtctcctcacggagaggaccacgatctggccggtgaagagatcgcctcctatagcatcgtcggcccagctaacgccaaagtgccgcattcggcatcttccgacacactctcattaattgcttacagtgggatacccagctattcctctctgagcatccttgcctcaagtactgaagcgaagcacgtattctcccctggatttttcccacagttgaatcataccaaatgcgataagacagccattcccctgacctggacgggcatgatcgacctacctggttactacgaggcaatacacccatgtactgttttctgcgtgctcagcgggcccggagcttcttgtgaggccttttcagaaggcggcattttcaacatcacaagtccgatgtgcctggtcagcaaacagaatcgctttagacttaccgagcaacaggtgaacttcgtctgtcagagggtggacatggatatcattgtttattgcaacgggcaacggaaggtgatcctgactaagacattggtaattggacagtgtatatacaccatcacgtccctcttttctctgttacctggtgtcgctcactcgattgccgtggaactgtgcgttcccggcttccatgggtgggcaaccgccgctctccttgtgacattttgtttcggatgggtcctgatcccagcgttgactctaatcattctgaccatactcaaatttatcgcaaatattttccacacaagcaaccaggagaatcgcctgaagtccgtgcttcgaaaaatcaaggaagagtttgagaaaactaagggctcaatggtatgcgacgtgtgtaagtatgaatgcgagacctacaaagaactgaaggcccatggtgttagttgccctcagtctcaatgtccctattgcttcacacactgtgagccaaccgaagctgcctttcaggcacattacagagtctgccaggtgactcacaggttccgggatgacttgaaaaagacggtgacaccccagaacttcacccctgggtgttatcgtactctcaatctgtttcgctacaaaagcagatgctacattttcaccatgtgggtctgtttactggttctagagtccatcctctgggccgcttcagccagcgaggtgccactgaacccggtgtggaatgataacgcacacggcgtaggatctgtccccatgcatacagaccttgaattggatttttccctgaccagtagctctaagtatacttacaggcggcgactcacaaatcctctggaggaaacgcaatccataaaccttcacatcgagattgaggaacagaccatcggcgtggacgttcatgcgctggggcactggttcgatggacgcttgaatctcaagacttcatttcactgctatggtgcttgtacaaaatacgagtatccatggcataccgccaagtgccactacgaaagagactatcagtacgagacaagttggggctgtaaccccgcagattgccctggggtgggaactggctgcaccgcctgtggtctgtacttagaccagctgaaaccagtcgggagcgcttataagattatcacgataaggtactcgcggaaagtgtgcgttcaattcggcgaagagaatctatgtaaggtgattgacatgaacgattgctttgtaacccgccatgtcaaggtgtgtatcattggaacagtgtccaaattctctcagggcgacactctcctgtttttcgggccccttgagggaggtggcttgatctttaagcactggtgcaccagcacatgtcagttcggggatccgggagacataatgtcacctagagataaaggctttctgtgcccagagttccccggtagtttcaggaagaaatgtaattttgccactacccctctctgcgagtatgacgggaacatggtctccggctacaagaaagttatggcaacgatcgattctttccagagctttaacacatccaccatgcatttcactgacgaacgtattgagtggaaggatcccgacggaatgctgcgggatcacatcaatattttagtgacaaaggacatcgattttgacaacctgggcgaaaatccatgtaaaatagggcttcaaacctcaagcattgagggagcttggggcagtggtgtagggttcactttgacctgcctcatctctctgacagagtgccctacgtttctaacctccatcaaggcctgtgacaaagcgatttgctatggagccgaaagcgtgactctgacacgaggccagaacaccgtcaaggtgtcgggtaaaggcgggcactcaggatctacattcaagtgttgccatggcgaggaatgtagtcagatcgggctccacgctgcagcaccccatctggataaggttaatggaatttccgagatagaaaacaataaagtgtacgacgatggcgctccacaatgcggtgtcaagtgttggtttgtgaaaagcggggagtggatctctggaattttcagcggcaactggatcgttcttattgtgttgtgcgtctttctgttattctccctcgtactgctttcagtgctgtgtccggttagaaagcacaaaaagagttga

SEQ ID NO: 10062 - RNA, 3408 nt, synthetic construct
  misc_feature 1..3408: note = derived and/or modified CDS sequence (opt3) from HTNV(LongquanAa-09-350)__JQ912835.1__GP
  source 1..3408: mol_type = other RNA
atggagatctggaagtggctggtgatggccagcctcgtctggcccgctttcaccagaaggaacgtttacgacatgaaaattgaatgccctcacacagtgtcctttggcgaaaattctgtaatagggtatgtggaacttccaccgatgcccctggcagatactgcccagatggtccctgagtcaagttgtaacatggacaatcatcaaagcatgaacacgatcaccaagtacacacaggtgtcctggcggggaaaagcggatcaggctcaggcctctcaaaattcgttcgaagcagtttcagccgaggtggacttgaagggtacttgcgtcttaaaacacaagatgctggaggaaagctatcgcagtcgaaagtccattacctgttacgatctatcttgcaacagcacatattgtaaaccaaccctctacatgatcgtgcccattcatgcttgcaatatgatgaagtcctgtctgatcgcacttggcccttatcgtgtacaggttgtgtacgagagaacttactgcatgacaggggtcctgatagaaggaaaatgttttgtgccagaccagtcagtggtcagtatcattaagcacggcatcttcgatattgccagcgttcatatcgtgtgctttttcgtagctgtgaaaggtaacacctataagttgtttgagcaggtcaagaaatctttccaatccacgtgtaatgggactgagaacaaggtgcagggatactatatatgcattgttggcggcaattcagcccccatctacgtgcctaccctcgacgattttaggagcatggaagcgttcagtgggatttttcggtctccacacggagaggaccacgatctggccggtgaagagatcgcatcctatagcatcgtcggcccggctaacgccaaagtgccccattcggcatcttccgacacactgtcactcattgcttacagtgggatacctagctattcctctttaagcatcctggcctcaagtactgaagcgaagcacgtattctccccaggatttttcccccagcttaatcataccaaatgcgataagacagccattcctttgacctggacgggcatgatcgacctgccaggttactacgaggcaatacacccctgtactgttttctgcgtgctaagcgggccgggagcttcttgtgaggccttttcagaaggcggcattttcaacatcacaagtcctatgtgcctcgtcagcaaacagaatcgctttagactgaccgagcaacaggtgaacttcgtctgtcagagggtggacatggatatcattgtttattgcaacgggcaacggaaggtgatccttactaagacactggtaattggacagtgtatatacaccatcacgtccttgttttctctcctgcccggtgtcgctcactcgattgccgtggaattatgcgttccaggcttccatgggtgggcaaccgccgctctgctcgtgacattttgtttcggatgggtccttatccctgcgctgactttgatcattctaaccatactgaaatttatcgcaaatattttccacacaagcaaccaggagaatcgcctcaagtccgtgctgcgaaaaatcaaggaagagtttgagaaaactaagggctcaatggtatgcgacgtgtgtaagtatgaatgcgagacctacaaagaacttaaggcccatggtgttagttgcccccagtctcaatgtccatattgcttcacacactgtgagcccaccgaagctgcctttcaggcacattacagagtctgccaggtgactcacaggttccgggatgacctgaaaaagacggtgacacctcagaacttcaccccagggtgttatcgtactttgaatctctttcgctacaaaagcagatgctacattttcaccatgtgggtctgtctgttagttctggagtccatcctatgggccgcttcagccagcgaggtgccgctcaaccccgtgtggaatgataacgcacacggcgtaggatctgtccctatgcatacagacctggaacttgatttttccttgaccagtagctctaagtatacttacaggcggcgactgacaaatccactcgaggaaacgcaatccataaacctgcacatcgagattgaggaacagaccatcggcgtggacgttcatgcgcttgggcactggttcgatggacgcctgaatttgaagacttcatttcactgctatggtgcttgtacaaaatacgagtatccctggcataccgccaagtgccactacgaaagagactatcagtacgagacaagttggggctgtaaccctgcagattgcccaggggtgggaactggctgcaccgcctgtggtctctacctggaccagttaaaacccgtcgggagcgcttataagattatcacgataaggtactcgcggaaagtgtgcgttcaattcggcgaagagaatctgtgtaaggtgattgacatgaacgattgctttgtaacccgccatgtcaaggtgtgtatcattggaacagtgtccaaattctctcagggcgacactctactctttttcgggccgctggagggaggtggccttatctttaagcactggtgcaccagcacatgtcagttcggggatcctggagacataatgtcaccaagagataaaggctttttgtgccccgagttccctggtagtttcaggaagaaatgtaattttgccactacgcccctgtgcgagtatgacgggaacatggtctccggctacaagaaagttatggcaaccatcgattctttccagagctttaacacatccaccatgcatttcactgacgaacgtattgagtggaaggatccagacggaatgctccgggatcacatcaatattctggtgacaaaggacatcgattttgacaacttaggcgaaaatccttgtaaaatagggctgcaaacctcaagcattgagggagcttggggcagtggtgtagggttcactcttacctgcttgatctctctcacagagtgccccacgtttctgacctccatcaaggcctgtgacaaagcgatttgctatggagccgaaagcgtgactctaacacgaggccagaacaccgtcaaggtgtcgggtaaaggcgggcactcaggatctacattcaagtgttgccatggcgagaagtgtagtcagatcgggctgcacgctgcagccccacatctcgataaagttaatggaatttccgaaatagagaacaataaggtgtacgacgatggcgctccgcaatgcggtgtcaaatgttggtttgttaagagcggggaatggatctctggaattttcagcggcaactggatcgtgctgattgtgctttgcgtctttttgctgttctccttagtactcctgtcagtgctttgtcctgttagaaaacacaagaagagttga

SEQ ID NO: 10063 - RNA, 3408 nt, synthetic construct
  misc_feature 1..3408: note = derived and/or modified CDS sequence (opt3) from HTNV(LongquanAa-09-489)__JQ912844.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgagaatagcgtaatagggtatgtggaactgccaaggatgccgttggcagatactgcccagatggtccccgagtcaagttgtaacatggacaatcatcaaagcatgaacacgatcaccaagtacacacaggtgtcctggcggggaaaagcggatcaggctcaggcctctcaaaattcgttcgaagcagtttcagccgaggtggacttaaagggtacttgcgtcctgaaacacaagatgctagaggaaagctatcgcagtcgaaagtccattacctgttacgatctctcttgcaacagcacatattgtaaacctaccctgtacatgatcgtgccaattcatgcttgcaatatgatgaagtcctgtcttatcgcactgggcccctatcgtgtacaggttgtgtacgagagaacttactgcatgacaggggtcttgatagaaggaaaatgttttgtgcctgaccagtcagtggtcagtatcattaagcacggcatcttcgatattgccagcgttcatatcgtgtgctttttcgtagctgtgaaaggtaacacctataagctctttgagcaggtcaagaaatctttccaatccacgtgtaatgggactgagaacaaggtgcagggatactatatatgcattgttggcggcaattcagccccaatctacgtgcccaccctggacgattttaggagcatggaagcgttcagtgggatttttcggtctcctcacggagaggaccacgatctggccggtgaagagatcgcctcctatagcatcgtcggcccagctaacgccaaagtgccgcattcggcatcttccgacacactctcattaattgcttacagtgggatacccagctattcctctctgagcatccttgcctcaagtactgaagcgaagcacgtattctcccctggatttttcccacagttgaatcataccaaatgcgataagacagccattcccctgacctggacgggcatgatcgacctacctggttactacgaggcaatacacccatgtactgttttctgcgtgctcagcgggcccggagcttcttgtgaggccttttcagaaggcggcattttcaacatcacaagtccgatgtgcctggtcagcaaacagaatcgctttagacttaccgagcaacaggtgaacttcgtctgtcagagggtggacatggatatcattgtttattgcaacgggcaacggaaggtgatcctgactaagacattggtaattggacagtgtatatacaccatcacgtccctcttttctctgttacctggtgtcgctcactcgattgccgtggaactgtgcgttcccggcttccatgggtgggcaaccgccgctctccttgtgacattttgtttcggatgggtcctgatcccagcgttgactctaatcattctgaccatactcaaatttatcgcaaatattttccacacaagcaaccaggagaatcgcctgaagtccgtgcttcgaaaaatcaaggaagagtttgagaaaactaagggctcaatggtatgcgacgtgtgtaagtatgaatgcgagacctacaaagaactgaaggcccatggtgttagttgccctcagtctcaatgtccctattgcttcacacactgtgagccaaccgaagctgcctttcaggcacattacagagtctgccaggtgactcacaggttccgggatgacttgaaaaagacggtgacaccccagaacttcacccctgggtgttatcgtactctcaatctgtttcgctacaaaagcagatgctacattttcaccatgtgggtctgtttactggttctagagtccatcctctgggccgcttcagccagcgaggtgccactgaacccggtgtggaatgataacgcacacggcgtaggatctgtccccatgcatacagaccttcaattggatttttccctgaccagtagctctaagtatacttacaggcggcgactcacaaatcctctggaagagacgcagtccataaaccttcacatcgaaattgaggagcagaccatcggcgtggacgttcatgcgctggggcactggttcgatggacgcttgaatctcaagacttcatttcactgctatggtgcttgtacaaaatacgaatatccatggcataccgccaagtgccactacgagagagactatcagtacgaaacaagttggggctgtaaccccgcagattgccctggggtgggaactggctgcaccgcctgtggtctgtacttagaccaactgaaaccagtcgggagcgcttataagattatcacgataaggtactcgcggaaagtgtgcgttcagttcggcgaggaaaatctatgtaaggtgattgacatgaacgattgctttgtaacccgccatgtcaaggtgtgtatcattggaacagtgtccaaattctctcagggcgacactctcctgtttttcgggccccttgagggaggtggcttgatctttaagcactggtgcaccagcacatgtcagttcggggatccgggagacataatgtcacctagagataaaggctttctgtgcccagagttccccggtagtttcaggaagaaatgtaattttgccactacccctctctgcgaatatgacgggaacatggtctccggctacaagaaagttatggcaacgatcgattctttccaatcttttaacacatccaccatgcatttcactgacgagcgtattgaatggaaggatcccgacggaatgctgcgggatcacatcaatattttagtgacaaaggacatcgattttgacaacctgggcgagaatccatgtaaaatagggcttcagacctcaagcattgaaggagcttggggcagtggtgtagggttcactttgacctgcctcatctctctgacagagtgccctacgtttctaacctccatcaaggcctgtgacaaagcgatttgctatggagccgagagcgtgactctgacacgaggccagaacaccgtcaaggtgtcgggtaaaggcgggcactcaggatctacattcaagtgttgccatggcgaagagtgtagtcaaatcgggctccacgctgcagcaccccatctggataaggttaatggaatttccgaaatagagaacaataaagtgtacgacgatggcgctccacagtgcggtgtcaagtgttggtttgtgaaaagcggggaatggatctctggaattttcagcggcaactggatcgttcttattgtgttgtgcgtctttctgttattctccctcgtactgctttcagtgctgtgtccggttagaaagcacaaaaagagttga

SEQ ID NO: 10064 - RNA, 3408 nt, synthetic construct
  misc_feature 1..3408: note = derived and/or modified CDS sequence (opt3) from HTNV(LongquanAa-09-541)__JQ912850.1__GP
  source 1..3408: mol_type = other RNA
atgggcatctggaagtggctggtgatggccagcctcgtctggcccgctttcacccttagaaacgtttacgacatgaaaattgagtgccctcacacagtgtcctttggggaaaattctgtaataggatatgtggagctgccaccgatgcccttggcagatactgcccagatggtccctgaatcaagttgtaacatggacaatcatcaaagcatgaacacgatcaccaagtacacacaggtgtcctggaggggtaaagcggatcaggctcaggcctctcaaaattcgttcgaggcagtttcagccgaagtggacttaaagggcatttgcgtcctgaaacacaagatgctagaggagagctatcggagtcgcaagtccatcacttgttacgatctctcttgcaacagcacctattgtaaaccaacactgtacatgattgtgcccatccatgcttgcaatatgatgaagtcctgtcttatagcactggggccttatcgagtacaggttgtgtacgaacgtacctactgcatgactggagtcttgctcgagggcaaatgttttgtgccagaccagtcagtggtcagtatcattaagcacggtatcttcgatattgccagcgttcatatcgtgtgctttttcgtagctgtgaaagggaacacatataagctgtttgaacaggtcaagaaatctttccaatccacctgtaatggaacggagaacaaggtgcagggctactatatatgcattgttggcgggaatagtgcccccatctacgtgcctactctggacgattttagaagcatggaggcgttcagtggaatttttaggtctccacacggtgaagaccacgatctcgcaggcgaggaaatcgcctcctatagcatcgtcgggccggctaacgccaaagtgccccattcggcatcttccgacaccttatcactgattgcttacagtggaatacctagctattcctctcttagcatcttggcctcaagtacagaggcgaagcacgtattctccccaggctttttcccccagctgaatcatactaaatgcgataagaccgccattcctctaacatggaccggtatgatcgacctcccagggtactacgaagcaatacacccctgtacggttttctgcgtgctgagcggaccgggcgcttcttgtgaggccttttcagagggcgggattttcaacatcacttcacctatgtgccttgtcagcaaacagaatcggtttcgcctgacagaacaacaggtgaacttcgtctgtcagagagtggacatggatatcattgtttattgcaacggacaaaggaaggtgatcttgaccaagactctcgtaattggtcagtgtatatacacaatcacctccctgttttctttactgcccggcgtcgctcactcgattgccgtggagctctgcgttccagggttccatggatgggcaacggccgcgcttctggtgaccttttgtttcggctgggtcttgatccctgctctaacactgatcattctcactatactgaaatttatcgcaaatattttccacaccagcaaccaggaaaatcggcttaagtccgtgctgcgcaaaatcaaggaggaatttgagaaaacaaagggttcaatggtatgcgacgtgtgtaagtatgagtgcgaaacttacaaagagttgaaggcccatggggttagttgcccccagtctcaatgtccatattgcttcacccactgtgaacccacagaggctgcctttcaggcacattaccgagtctgccaggtgacccacagattcagggatgacctcaaaaagactgtgacgcctcagaacttcacaccaggctgttatcggaccctgaatttatttcgttacaaaagccgctgctacattttcactatgtgggtctgtctgctagttctcgaatccatcctgtgggccgcttcagccagcgaggtgccgcttaaccccgtgtggaatgataacgcacacggagtaggctctgtccctatgcataccgacttggagctggatttttccctcacaagtagctctaagtatacctacagaaggcggctgactaatccacttgaagagacacaatccataaacctgcacatcgaaattgaggagcagacgatcggggtggacgttcatgcgttgggacactggttcgatggtcgactcaatctgaagacctcatttcactgctatggcgcttgtactaaatacgaatatccctggcatacagccaagtgccactacgagcgcgactatcagtacgaaaccagttgggggtgtaaccctgcagattgcccaggagtgggcacaggttgcactgcctgtgggttatacctggaccagctaaaacccgtcggcagcgcttataagattatcaccataagatactcgaggaaagtgtgcgttcaattcggagaggaaaatctctgtaaggtgattgacatgaacgattgctttgtaacgcggcatgtcaaggtgtgtatcattggcaccgtgtccaaattctctcagggggacacactgttgtttttcggaccgcttgagggtggcgggctgatctttaagcactggtgcactagcacctgtcagttcggagatcctggcgacataatgtcaccacgcgataaaggttttctctgccccgagttccctgggagtttcagaaagaaatgtaattttgccacaactcccctgtgcgaatatgacggcaacatggtctccggatacaagaaagttatggcaaccatcgattctttccagagctttaacacgtccacaatgcatttcaccgacgagaggattgaatggaaggatccagacggcatgttacgtgatcacatcaatattctggtgactaaggacatcgattttgacaaccttggggagaatccttgtaaaataggattgcaaacatcaagcattgaaggcgcttggggtagtggggtaggattcaccctcacttgcctgatctctctaaccgagtgccccacatttctgacgtccatcaaggcctgtgacaaagcgatttgctatggcgccgagagcgtgaccctcactcggggtcagaacacagtcaaggtgtcgggcaaagggggacactcaggctctaccttcaagtgttgccatggggaagagtgtagtcagatcggactgcacgctgcagccccacatcttgataaggttaatggcatttccgaaatagagaacaataaagtgtacgacgatggtgctccgcaatgcggggtcaagtgttggtttgtgaaaagcggagaatggatctctggcattttcagcggtaactggatcgttttgattgtgctgtgcgtctttttactcttctccctggtacttctgtcagtgttgtgtcctgttcgaaagcacaaaaagagttga

SEQ ID NO: 10065 - RNA, 3408 nt, synthetic construct
  misc_feature 1..3408: note = derived and/or modified CDS sequence (opt3) from HTNV(LongquanAa-09-698)__JQ912854.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgaaaattctgtaatagggtatgtggaactgccaccgatgcccttggcagatactgcccagatggtccctgagtcaagttgtaacatggacaatcatcaaagcatgaacacgatcaccaagtacacacaggtgtcctggaggggaaaagcggatcaggctcaggcctctcaaaattcgttcgaagcagtttcagccgaggtggacttaaagggtacttgcattctgaaacacaagatgctagaggaaagctatcggagtcgcaagtccatcacctgttacgatctctcttgcaacagcacatattgtaaaccaaccctgtacatgattgtccccatccatgcttgcaatatgatgaagtcctgtcttatagcactgggcccttatcgagtgcaggtagtttacgagcgtacttactgcatgacaggggtgttgatcgaaggaaaatgttttgtcccagaccagtcagtggtgagtattatcaagcacggcattttcgatatcgccagcgtccatatagtttgctttttcgtggctgtaaaaggtaacacctataagctctttgaacaggtgaagaaatctttccaatccacgtgtaatgggactgagaacaaggtccagggatactatatttgcatcgtgggcggcaattcagcccccatttacgttcctaccctggacgattttagaagcatggaggcgttcagtgggatctttaggtctccacacggagaggaccacgatctggccggtgaagagatcgcatcctatagcattgtgggcccggctaacgccaaagtcccccattcggcatcttccgacacactctcattaatagcttacagtgggatccctagctattcctctctgagcattcttgcctcaagtactgaagcgaagcacgtgttctccccaggatttttcccccagttgaatcataccaaatgcgataagacagccatccctctgacctggacgggcatgatagacctaccaggttactacgaggcaattcacccctgtactgtattctgcgttctcagcgggccgggagcttcttgtgaggccttttcagaaggcggcatcttcaacatcacaagtcctatgtgcctggtgagcaaacagaatcggtttcgccttaccgagcaacaggtcaacttcgtgtgtcagagagtcgacatggatattatcgtgtattgcaacgggcaaaggaaggttattctgactaagacattggtgataggacagtgtatctacaccattacgtccctcttttctctgttacccggtgtagctcactcgatcgccgtcgaactgtgcgtgccaggcttccatgggtgggcaaccgccgctctccttgttacattttgtttcggatgggtgctgatccctgcgttgactctaattatactgaccatcctcaaatttattgcaaatatcttccacacaagcaaccaggagaatcggctgaagtccgtccttcgcaaaattaaggaagagtttgagaaaactaagggctcaatggtgtgcgacgtatgtaagtatgaatgcgagacctacaaagaactgaaggcccatggtgtgagttgcccccagtctcaatgtccatattgcttcacacactgtgagcccaccgaagctgcctttcaggcacattaccgagtttgccaggtcactcacagattcagggatgacttgaaaaagacggtgacacctcagaacttcaccccagggtgttatcggactctcaatctgtttcgttacaaaagccgctgctacatcttcaccatgtgggtgtgtttactggtcctagagtccatactctgggccgcttcagccagcgaggttccgctgaaccccgtgtggaatgataacgcacacggcgtgggatctgtacctatgcatacagaccttgaattggatttttccctgaccagtagctctaagtatacttacagaaggcggctcacaaatccactggaggaaacgcaatccatcaaccttcacattgagatcgaggaacagaccattggcgtcgacgtgcatgcgctggggcactggttcgatggacgattgaatctcaagacttcatttcactgctatggtgcttgtacaaaatacgagtatccctggcataccgccaagtgccactacgaacgcgactatcagtacgagacaagttggggctgtaaccctgcagattgcccaggggttggaactggctgcaccgcctgtggtctgtacttagaccagctgaaacccgtggggagcgcttataagatcataacgattagatactcgaggaaagtctgcgtgcaattcggcgaagagaatctatgtaaggttatcgacatgaacgattgctttgtgacccggcatgtaaaggtctgtattatcggaacagtgtccaaattctctcagggcgacactctcctgtttttcgggccgcttgagggaggtggcttgatatttaagcactggtgcaccagcacatgtcagttcggggatcctggagacatcatgtcaccacgcgataaaggctttctgtgccccgagttccctggtagtttcagaaagaaatgtaattttgccactacgcccctctgcgagtatgacgggaacatggtgtccggctacaagaaagtcatggcaaccattgattctttccagagctttaacacatccaccatgcatttcactgacgaaaggatcgagtggaaggatccagacggaatgctgcgtgatcacattaatatcttagttacaaaggacatagattttgacaacctgggcgaaaatccttgtaaaattgggcttcaaacctcaagcatcgagggagcttggggcagtggtgtggggttcactttgacctgcctcatctctctgacagagtgccccacgtttctaacctccattaaggcctgtgacaaagcgatctgctatggagccgaaagcgtaactctgacacggggccagaacaccgtgaaggtctcgggtaaaggcgggcactcaggatctacattcaagtgttgccatggcgaggaatgtagtcagattgggctccacgctgcagccccacatctggataaggtgaatggaatatccgagatcgaaaacaataaagtttacgacgatggcgctccgcaatgcggtgtgaagtgttggtttgtcaaaagcggggagtggatttctggaatcttcagcggcaactggattgtgcttatcgttttgtgcgtgtttctgttattctccctcgtcctgctttcagtactgtgtcctgtgcgaaagcacaaaaagagttga

SEQ ID NO: 10066 - RNA, 3408 nt, synthetic construct
  misc_feature 1..3408: note = derived and/or modified CDS sequence (opt3) from HTNV(LongquanAa-10-393)__JQ912859.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgaaaattctgtaatagggtatgtggaactgccaccgatgcccttggcagatactgcccagatggtccctgagtcaagttgtaacatggacaatcatcaaagcatgaacacgatcaccaagtacacacaggtgtcctggaggggaaaagcggatcaggctcaggcctctcaaaattcgttcgaagcagtttcagccgaggtggacttaaagggtacttgcgtcctgaaacacaagatgctagaggaaagctatcggagtcgcaagtccattacctgttacgatctctcttgcaacagcacatattgtaaaccaaccctgtacatgatcgtgcccattcatgcttgcaatatgatgaagtcctgtcttatcgcactgggcccttatcgagtacaggttgtgtacgagcgtacttactgcatgacaggggtcttgatagaaggaaaatgttttgtgccagaccagtcagtggtcagtatcattaagcacggcatcttcgatattgccagcgttcatatcgtgtgctttttcgtagctgtgaaaggtaacacctataagctctttgagcaggtcaagaaatctttccaatccacgtgtaatgggactgagaacaaggtgcagggatactatatatgcattgttggcggcaattcagcccccatctacgtgcctaccctggacgattttagaagcatggaagcgttcagtgggatttttaggtctccacacggagaggaccacgatctggccggtgaagagatcgcatcctatagcatcgtcggcccggctaacgccaaagtgccccattcggcatcttccgacacactctcattaattgcttacagtgggatacctagctattcctctctgagcatccttgcctcaagtactgaagcgaagcacgtattctccccaggatttttcccccagttgaatcataccaaatgcgataagacagccattcctctgacctggacgggcatgatcgacctaccaggttactacgaggcaatacacccctgtactgttttctgcgtgctcagcgggccgggagcttcttgtgaggccttttcagaaggcggcattttcaacatcacaagtcctatgtgcctggtcagcaaacagaatcggtttcgccttaccgagcaacaggtgaacttcgtctgtcagagagtggacatggatatcattgtttattgcaacgggcaaaggaaggtgatcctgactaagacattggtaattggacagtgtatatacaccatcacgtccctcttttctctgttacccggtgtcgctcactcgattgccgtggaactgtgcgttccaggcttccatgggtgggcaaccgccgctctccttgtgacattttgtttcggacgggtcctgatccctgcgttgactctaatcattctgaccatactcaaatttatcgcaaatattttccacacaagcaaccaggagaatcgcctgaagtccgtgcttcgaaaaatcaaggaagagtttgagaaaactaagggctcaatggtatgcgacgtgtgtaagtatgaatgcgagacctacaaagaactgaaggcccatggtgttagttgcccccagtctcaatgtccatattgcttcacacactgtgagcccaccgaagctgcctttcaggcacattacagagtctgccaggtgactcacaggttccgggatgacttgaaaaagacggtgacacctcagaacttcaccccagggtgttatcgtactctcaatctgtttcgctacaaaagcagatgctacattttcaccatgtgggtctgtttactggttctagagtccatcctctgggccgcttcagccagcgaggtgccgctgaaccccgtgtggaatgataacgcacacggcgtaggatctgtccctatgcatacagaccttgaattggatttttccctgaccagtagctctaagtatacttacaggcggcgactcacaaatccactggaggaaacgcaatccataaaccttcacatcgagattgaggaacagaccatcggcgtggacgttcatgcgctggggcactggttcgatggacgcttgaatctcaagacttcatttcactgctatggtgcttgtacaaaatacgagtatccctggcataccgccaagtgccactacgaaagagactatcagtacgagacaagttggggctgtaaccctgcagattgcccaggggtgggaactggctgcaccgcctgtggtctgtacttagaccagctgaaacccgtcgggagcgcttataagattatcacgataaggtactcgcggaaagtgtgcgttcaattcggcgaagagaatctatgtaaggtgattgacatgaacgattgctttgtaacccgccatgtcaaggtgtgtatcattggaacagtgtccaaattctctcagggcgacactctcctgtttttcgggccgcttgagggaggtggcttgatctttaagcactggtgcaccagcacatgtcagttcggggatcctggagacataatgtcaccaagagataaaggctttctgtgccccgagttccctggtagtttcaggaagaaatgtaattttgccactacgcccctctgcgagtatgacgggaacatggtctccggctacaagaaagttatggcaaccatcgattctttccagagctttaacacatccaccatgcatttcactgacgaacgtattgagtggaaggatccagacggaatgctgcgggatcacatcaatattttagtgacaaaggacatcgattttgacaacctgggcgaaaatccttgtaaaatagggcttcaaacctcaagcattgagggagcttggggcagtggtgtagggttcactttgacctgcctcatctctctgacagagtgccccacgtttctaacctccatcaaggcctgtgacaaagcgatttgctatggagccgaaagcgtgactctgacacgaggccagaacaccgtcaaggtgtcgggtaaaggcgggcactcaggatctacattcaagtgttgccatggcgaggaatgtagtcagatcgggctccacgctgcagccccacatctggataaggttaatggaatttccgagatagaaaacaataaagtgtacgacgatggcgctccgcaatgcggtgtcaagtgttggtttgtgaaaagcggggagtggatctctggaattttcagcggcaactggatcgttcttattgtgttgtgcgtctttctgttattctccctcgtactgctttcagtgctgtgtcctgttagaaagcacaaaaagagttga

SEQ ID NO: 10067 - RNA, 3408 nt, synthetic construct
  misc_feature 1..3408: note = derived and/or modified CDS sequence (opt3) from HTNV(LongquanAa-10-58)__JQ912861.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgaaaattctgtaatagggtatgtggaactgccaccgatgcccttggcagatactgcccagatggtccctgagtcaagttgtaacatggacaatcatcaaagcatgaacacgatcaccaagtacacacaggtgtcctggaggggaaaagcggatcaggctcaggcctctcaaaattcgttcgaagcagtttcagccgaggtggacttaaagggtacttgcgtcctgaaacacaagatgctagaggaaagctatcggagtcgcaagtccattacctgttacgatctctcttgcaacagcacatattgtaaaccaaccctgtacatgatcgtgcccattcatgcttgcaatatgatgaagtcctgtcttatcgcactgggcccttatcgagtacaggttgtgtacgagcgtacttactgcatgacaggggtcttgatagaaggaaaatgttttgtgccagaccagtcagtggtcagtatcattaagcacggcatcttcgatattgccagcgttcatatcgtgtgctttttcgtagctgtgaaaggtaacacctataagctctttgagcaggtcaagaaatctttccaatccacgtgtaatgggactgagaacaaggtgcagggatactatatatgcattgttggcggcaattcagcccccatctacgtgcctaccctggacgattttagaagcatggaagcgttcagtgggatttttaggtctccacacggagaggaccacgatctggccggtgaagagatcgcatcctatagcatcgtcggcccggctaacgccaaagtgccccattcggcatcttccgacacactctcattaattgcttacagtgggatacctagctattcctctctgagcatccttgcctcaagtactgaagcgaagcacgtattctccccaggatttttcccccagttgaatcataccaaatgcgataagacagccattcctctgacctggacgggcatgatcgacctaccaggttactacgaggcaatacacccctgtactgttttctgcgtgctcagcgggccgggagcttcttgtgaggccttttcagaaggcggcattttcaacatcacaagtcctatgtgcctggtcagcaaacagaatcggtttcgccttaccgagcaacaggtgaacttcgtctgtcagagagtggacatggatatcattgtttattgcaacgggcaaaggaaggtgatcctgactaagacattggtaattggacagtgtatatacaccatcacgtccctcttttctctgttacccggtgtcgctcactcgattgccgtggaactgtgcgttccaggcttccatgggtgggcaaccgccgctctccttgtgacattttgtttcggatgggtcctgatccctgcgttgactctaatcattctgaccatactcaaatttatcgcaaatattttccacacaagcaaccaggagaatcggctgaagtccgtgcttcgcaaaatcaaggaagagtttgagaaaactaagggctcaatggtatgcgacgtgtgtaagtatgaatgcgagacctacaaagaactgaaggcccatggtgttagttgcccccagtctcaatgtccatattgcttcacacactgtgagcccaccgaagctgcctttcaggcacattaccgagtctgccaggtgactcacagattcagggatgacttgaaaaagacggtgacacctcagaacttcaccccagggtgttatcggactctcaatctgtttcgttacaaaagccgctgctacattttcaccatgtgggtctgtttactggttctagagtccatcctctgggccgcttcagccagcgaggtgccgctgaaccccgtgtggaatgataacgcacacggcgtaggatctgtccctatgcatacagaccttgaattggatttttccctgaccagtagctctaagtatacttacagaaggcggctcacaaatccactggaggaaacgcaatccataaaccttcacatcgagattgaggaacagaccatcggcgtggacgttcatgcgctggggcactggttcgatggacgattgaatctcaagacttcatttcactgctatggtgcttgtacaaaatacgagtatccctggcataccgccaagtgccactacgaacgcgactatcagtacgagacaagttggggctgtaaccctgcagattgcccaggggtgggaactggctgcaccgcctgtggtctgtacttagaccagctgaaacccgtcgggagcgcttataagattatcacgataagatactcgaggaaagtgtgcgttcaattcggcgaagagaatctatgtaaggtgattgacatgaacgattgctttgtaacccggcatgtcaaggtgtgtatcattggaacagtgtccaaattctctcagggcgacactctcctgtttttcgggccgcttgagggaggtggcttgatctttaagcactggtgcaccagcacatgtcagttcggggatcctggagacataatgtcaccacgcgataaaggctttctgtgccccgagttccctggtagtttcagaaagaaatgtaattttgccactacgcccctctgcgagtatgacgggaacatggtctccggctacaagaaagttatggcaaccatcgattctttccagagctttaacacatccaccatgcatttcactgacgaaaggattgagtggaaggatccagacggaatgctgcgtgatcacatcaatattttagtgacaaaggacatcgattttgacaacctgggcgaaaatccttgtaaaatagggcttcaaacctcaagcattgagggagcttggggcagtggtgtagggttcactttgacctgcctcatctctctgacagagtgccccacgtttctaacctccatcaaggcctgtgacaaagcgatttgctatggagccgaaagcgtgactctgacacggggccagaacaccgtcaaggtgtcgggtaaaggcgggcactcaggatctacattcaagtgttgccatggcgaggaatgtagtcagatcgggctccacgctgcagccccacatctggataaggttaatggaatttccgagatagaaaacaataaagtgtacgacgatggcgctccgcaatgcggtgtcaagtgttggtttgtgaaaagcggggagtggatctctggaattttcagcggcaactggatcgttcttattgtgttgtgcctgtttttactcttctccctggtccttctgtcagtattgtgtcctgtgcgaaagcacaaaaagagttga

SEQ ID NO: 10068 - RNA, 3408 nt, synthetic construct
  misc_feature 1..3408: note = derived and/or modified CDS sequence (opt3) from HTNV(LongquanAa-10-74)__JQ912864.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgaaaattctgtaatagggtatgtggaactgccaccgatgcccttggcagatactgcccagatggtccctgagtcaagttgtaacatggacaatcatcaaagcatgaacacgatcaccaagtacacacaggtgtcctggaggggaaaagcggatcaggctcaggcctctcaaaattcgttcgaagcagtttcagccgaggtggacttaaagggtacttgcgtcctgaaacacaagatgctagaggaaagctatcggagtcgcaagtccattacctgttacgatctctcttgcaacagcacatattgtaaaccaaccctgtacatgatcgtgcccattcatgcttgcaatatgatgaagtcctgtcttatcgcactgggcccttatcgagtacaggttgtgtacgagcgtacttactgcatgacaggggtcttgatagaaggaaaatgttttgtgccagaccagtcagtggtcagtatcattaagcacggcatcttcgatattgccagcgttcatatcgtgtgctttttcgtagctgtgaaaggtaacacctataagctctttgagcaggtcaagaaatctttccaatccacgtgtaatgggactgagaacaaggtgcagggatactatatatgcattgttggcggcaattcagcccccatctacgtgcctaccctggacgattttagaagcatggaagcgttcagtgggatttttaggtctccacacggagaggaccacgatctggccggtgaagagatcgcatcctatagcatcgtcggcccggctaacgccaaagtgccccattcggcatcttccgacacactctcattaattgcttacagtgggatacctagctattcctctctgagcatccttgcctcaagtactgaagcgaagcacgtattctccccaggatttttcccccagttgaatcataccaaatgcgataagacagccattcctctgacctggacgggcatgatcgacctaccaggttactacgaggcaatacacccctgtactgttttctgcgtgctcagcgggccgggagcttcttgtgaggccttttcagaaggcggcattttcaacatcacaagtcctatgtgcctggtcagcaaacagaatcggtttcgccttaccgagcaacaggtgaacttcgtctgtcagagagtggacatggatatcattgtttattgcaacgggcaaaggaaggtgatcctgactaagacattggtaattggacagtgtatatacaccatcacgtccctcttttctctgttacccggtgtcgctcactcgattgccgtggaactgtgcgttccaggcttccatgggtgggcaaccgccgctctccttgtgacattttgtttcggatgggtcctgatccctgcgttgactctaatcattctgaccatactcaaatttatcgcaaatattttccacacaagcaaccaggagaatcggctgaagtccgtgcttcgcaaaatcaaggaagagtttgagaaaactaagggctcaatggtatgcgacgtgtgtaagtatgaatgcgagacctacaaagaactgaaggcccatggtgttagttgcccccagtctcaatgtccatattgcttcacacactgtgagcccaccgaagctgcctttcaggcacattaccgagtctgccaggtgactcacagattcagggatgacttgaaaaagacggtgacacctcagaacttcaccccagggtgttatcggactctcaatctgtttcgttacaaaagccgctgctacattttcaccatgtgggtctgtttactggttctagagtccatcctctgggccgcttcagccagcgaggtgccgctgaaccccgtgtggaatgataacgcacacggcgtaggatctgtccctatgcatacagaccttgaattggatttttccctgaccagtagctctaagtatacttacagaaggcggctcacaaatccactggaggaaacgcaatccataaaccttcacatcgagattgaggaacagaccatcggcgtggacgttcatgcgctggggcactggttcgatggacgattgaatctcaagacttcatttcactgctatggtgcttgtacaaaatacgagtatccctggcataccgccaagtgccactacgaacgcgactatcagtacgagacaagttggggctgtaaccctgcagattgcccaggggtgggaactggctgcaccgcctgtggtctgtacttagaccagctgaaacccgtcgggagcgcttataagattatcacgataagatactcgaggaaagtgtgcgttcaattcggcgaagagaatctatgtaaggtgattgacatgaacgattgctttgtaacccggcatgtcaaggtgtgtatcattggaacagtgtccaaattctctcagggcgacactctcctgtttttcgggccgcttgagggaggtggcttgatctttaagcactggtgcaccagcacatgtcagttcggggatcctggagacataatgtcaccacgcgataaaggctttctgtgccccgagttccctggtagtttcagaaagaaatgtaattttgccactacgcccctctgcgagtatgacgggaacatggtctccggctacaagaaagttatggcaaccatcgattctttccagagctttaacacatccaccatgcatttcactgacgaaaggattgagtggaaggatccagacggaatgctgcgtgatcacatcaatattttagtgacaaaggacatcgattttgacaacctgggcgaaaatccttgtaaaatagggcttcaaacctcaagcattgagggagcttggggcagtggtgtagggttcactttgacctgcctcatctctctgacagagtgccccacgtttctaacctccatcaaggcctgtgacaaagcgatttgctatggagccgaaagcgtgactctgacacggggccagaacaccgtcaaggtgtcgggtaaaggcgggcactcaggatctacattcgagtgttgccatggcgaagagtgtagtcagatcgggctccacgctgcagccccacatctggataaggttaatggaatttccgaaatagagaacaataaggtgtacgacgatggcgctccgcaatgcggtgtcaaatgttggtttgttaagagcggggagtggatctctggaattttcagcggcaactggatcgtgcttattgtgttgtgcgtctttctgttattctccctcgtactgctttcagtgctgtgtcctgttcgaaaacacaagaaaagttga

SEQ ID NO: 10069 - RNA, 3408 nt, synthetic construct
  misc_feature 1..3408: note = derived and/or modified CDS sequence (opt3) from HTNV(LongquanAa-10-98)__JQ912866.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgaaaattctgtaatagggtatgtggagctgccaccgatgcccttggcagatactgcccagatggtccctgagtcaagttgtaacatggacaatcatcaaagcatgaacacgatcaccaagtacacacaggtgtcctggaggggaaaagcggatcaggctcaggcctctcaaaattcgttcgaagcagtttcagccgaggtggacttaaagggtacttgcgtcctgaaacacaagatgctagaggaaagctatcggagtcgcaagtccattacctgttacgatctctcttgcaacagcacatattgtaaaccaaccctgtacatgatcgtgcccattcatgcttgcaatatgatgaagtcctgtcttatcgcactgggcccttatcgagtacaggttgtgtacgagcgtacttactgcatgacaggggtcttgatagaaggaaaatgttttgtgccagaccagtcagtggtcagtatcattaagcacggcatcttcgatattgccagcgttcatatcgtgtgctttttcgtagctgtgaaaggtaacacctataagctcctggagcaggtcaagaaatcttttcaatccacgtgtaatgacactgagaacaaggtgcaggggtactatatatgcattgttggaggcaattcagcccccatctacgtgcctaccctggatgacttcagaagcatggaagcgtttagtggcattttcaggtctccacacggggaggatcacgacctcgcaggagaagagatcgcctcctatagcatcgtcggtccggctaacgccaaagtgccccattcggcatcttccgatacattatcactgattgcttacagtggcatacctagctattcctctcttagcatcttggcctcaagtactgaagcgaagcacgtattttccccagggttctttccccagctgaatcataccaaatgcgacaagacagccattcctctaacctggacgggaatgatcgacctcccaggctactacgaggcaatacacccctgtactgttttctgcgtgctgagcggtccgggggcttcttgtgaggccttctcagaaggaggcatttttaacatcacaagtcctatgtgccttgtcagcaaacagaatcggttccgcctgaccgagcaacaggtgaactttgtctgtcagagagtggatatggacatcattgtttattgcaacggccaaaggaaggtgatcttgactaagacactcgtaattgggcagtgtatatacaccatcacgtccctgttctctttactgcccggagtcgctcactcgattgccgtggaactctgcgttccaggttttcatggctgggcaaccgccgctctcctggtgacattctgttttgggtgggtcttgatccctgcgctaactctgatcattctcaccatactgaaattcatcgcaaatatttttcacacaagcaaccaggagaatcggcttaagtccgtgctgcgcaaaatcaaggaagagttcgagaaaactaagggatcaatggtatgcgatgtgtgtaagtatgaatgcgagacctacaaagaattgaaggcccatggcgttagttgcccccagtctcaatgtccatattgctttacacactgtgagcccaccgaagctgccttccaggcacattaccgagtctgccaggtgactcacagatttagggacgatctcaaaaagacggtgacacctcagaacttcaccccaggttgttatcggactctgaatttattccgttacaaaagccgctgctacatttttaccatgtgggtctgtctgctagttctcgagtccatcctgtgggccgcttcagccagcgaggtgccgcttaaccccgtgtggaatgacaacgcacacggggtaggctctgtccctatgcatacagatttggaactggacttctccctcaccagtagctctaagtatacttacagaaggcggctgacaaatccacttgaggaaacgcaatccataaacctgcacatcgagattgaggaacagaccatcggagtggatgttcatgcgttgggccactggtttgacgggcgactcaatctgaagacttcattccactgctatggagcttgtacaaaatacgagtatccctggcataccgccaagtgccactacgaacgcgattatcagtacgagacaagttggggttgtaaccctgcagactgcccaggcgtggggactggatgcaccgcctgtggcttatacctggaccagctaaaacccgtcggtagcgcttataagattatcacgataagatactcgaggaaagtgtgcgttcaatttggggaagagaatctctgtaaggtgattgatatgaacgactgcttcgtaacccggcatgtcaaggtgtgtatcattggcacagtgtccaaattttctcagggagatactctgcttttctttggcccgttggaagggggaggtctgatcttcaagcactggtgcaccagcacatgtcagtttggcgaccctggggatataatgtcaccacgcgacaaaggattcctctgccccgagtttcctggcagtttcagaaagaaatgtaatttcgccactacgcccctgtgcgagtatgatggtaacatggtctccgggtacaagaaagttatggcaaccatcgactcttttcagagcttcaacacatccaccatgcattttactgatgaaaggattgagtggaaggacccagatggcatgttacgtgaccacatcaatattctggtgacaaaggatatcgacttcgacaaccttggagaaaatccttgtaaaataggcttgcaaacctcaagcattgagggggcttggggaagtggcgtaggttttactcttacctgcctgatctctctaacagagtgccccacgttcctgacctccatcaaggcctgtgataaagcgatttgctatggggccgaaagcgtgactctcacacggggacagaacaccgtcaaggtgtcgggcaaaggtggccactcagggtctacatttaagtgttgccatggagaggaatgtagtcagatcggcctgcacgctgcagccccacatcttgacaaggttaatgggatttccgagatagaaaacaataaagtgtacgatgacggagctccgcaatgcggcgtcaagtgttggttcgtgaaaagcggtgagtggatctctgggatttttagcggaaactggatcgttttgattgtgctgtgcgtcttcttactcttttccctggtacttctgtcagtgttgtgtcctgttcgaaagcacaaaaagagttga

SEQ ID NO: 10070 - RNA, 3408 nt, synthetic construct
  misc_feature 1..3408: note = derived and/or modified CDS sequence (opt3) from HTNV(LongquanAa-11-452)__KC344264.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgaaaattctgtaatagggtatgtggagctgccaccgatgcccttggcagatactgcccagatggtccctgagtcaagttgtaacatggacaatcatcaaagcatcaacacgattaccaagtacacacaggtgtcctggaggggaaaagcggatcaggctcaggcctctcaaaattcgttcgaagcagtttcagccgaggtggacttaaagggtacttgcgtcctgaaacacaagatgctagaggaaagctatcggagtcgcaagtccatcacctgttacgatctctcttgcaacagcacatattgtaaaccaaccctgtacatgattgtgcccatccatgcttgcaatatgatgaagtcctgtcttatagcactgggcccttatcgagtacaggttgtgtacgagcgtacttactgcatgacaggggtcttgatcgaaggaaaatgttttgtgccagaccagtcagtggtcagtattatcaagcacggcattttcgatatcgccagcgttcatatagtgtgctttttcgtagctgtgaaaggtaacacctataagctcctggagcaggtcaagaaatcttttcaatccacgtgtaatgacactgagaacaaggtgcaggggtactatatttgcatcgttggaggcaattcagcccccatttacgtgcctaccctggatgacttcagaagcatggaagcgtttagtggcatcttcaggtctccacacggggaggatcacgacctcgcaggagaagagatcgcctcctatagcattataggtccggctaacgccaaagtcccccattcggcatcttccgatacattatcactgatcgcttacagtggcattcctagctattcctctcttagcatcttggcctcaagtactgaagcgaagcacgtgttttccccagggttctttccccagctgaatcataccaaatgcgacaagacagccatacctctaacctggacgggaatgattgacctcccaggctactacgaggcaatccacccctgtactgtattctgcgttctgagcggtccgggggcttcttgtgaggccttctcagaaggaggcatctttaacattacaagtcctatgtgccttgtgagcaaacagaatcggttccgcctgaccgagcaacaggtcaactttgtgtgtcagagagtcgatatggacatcattgtgtattgcaacggccaaaggaaggttatattgactaagacactcgtgatcgggcagtgtatttacaccatcacgtccctgttctctttactgcccggagtagctcactcgatcgccgtcgaactctgcgtgccaggttttcatggctgggcaaccgccgctctcctggttacattctgttttgggtgggtgttgattcctgcgctaactctgataatcctcaccattctgaaattcatcgcaaatatttttcacacaagcaaccaggagaatcggcttaagtccgtcctgcgcaaaatcaaggaagagttcgagaaaactaagggatcaatggtgtgcgatgtatgtaagtatgaatgcgagacctacaaagaattgaaggcccatggcgtgagttgcccccagtctcaatgtccatattgctttacacactgtgagcccaccgaagctgccttccaggcacattaccgagtttgccaggtcactcacagatttagggacgatctcaaaaagacggtgacacctcagaacttcaccccaggttgttatcggactctgaatttattccgttacaaaagccgctgctacatatttaccatgtgggtgtgtctgctagtcctcgagtccatcctgtgggccgcttcagccagcgaggttccgcttaaccccgtgtggaatgacaacgcacacggggtgggctctgtacctatgcatacagatttggaactggacttctccctcaccagtagctctaagtatacttacagaaggcggctgacaaatccacttgaggaaacgcaatccattaacctgcacatcgagattgaggaacagaccatcggagtcgatgtgcatgcgttgggccactggtttgacgggcgactcaatctgaagacttcattccactgctatggagcttgtacaaaatacgagtatccctggcataccgccaagtgccactacgaacgcgattatcagtacgagacaagttggggttgtaaccctgcagactgcccaggcgttgggactggatgcaccgcctgtggcttatacctggaccagctaaaacccgtgggtagcgcttataagataattacgatcagatactcgaggaaagtctgcgtgcaatttggggaagagaatctctgtaaggttattgatatgaacgactgcttcgtgacccggcatgtaaaggtctgtatcataggcacagtgtccaaattttctcagggagatactctgcttttctttggcccgttggaagggggaggtctgatcttcaagcactggtgcaccagcacatgtcagtttggcgaccctggggatattatgtcaccacgcgacaaaggattcctctgccccgagtttcctggcagtttcagaaagaaatgtaatttcgccactacgcccctgtgcgagtatgatggtaacatggtgtccgggtacaagaaagtcatggcaaccatcgactcttttcagagcttcaacacatccaccatgcattttactgatgaaaggattgagtggaaggacccagatggcatgttacgtgaccacatcaatatactggttacaaaggatattgacttcgacaaccttggagaaaatccttgtaaaatcggcttgcaaacctcaagcatcgagggggcttggggaagtggcgtgggttttactcttacctgcctgatttctctaacagagtgccccacgttcctgacctccatcaaggcctgtgataaagcgatttgctatggggccgaaagcgtaactctcacacggggacagaacaccgtgaaggtctcgggcaaaggtggccactcagggtctacatttaagtgttgccatggagaggaatgtagtcagataggcctgcacgctgcagccccacatcttgacaaggtgaatgggatctccgagattgaaaacaataaagtttacgatgacggagctccgcaatgcggcgtgaagtgttggttcgtcaaaagcggtgagtggatctctgggatttttagcggaaactggatcgtgttgatagttctgtgcgtgttcttactcttttccctggtccttctgtcagtattgtgtcctgtgcgaaagcacaaaaagagttga

SEQ ID NO: 10071 - RNA, 3408 nt, synthetic construct
  misc_feature 1..3408: note = derived and/or modified CDS sequence (opt3) from HTNV(LongquanAa-11-473)__KC344263.1__GP
  source 1..3408: mol_type = other RNA
atgggcatctggaagtggctggtgatggccagcctcgtctggcccgctttcacccttagaaacgtttacgacatgaaaattgagtgccctcacacagtgtcctttggggaaaattctgtaataggatatgtggagctgccaccgatgcccttggcagatactgcccagatggtccctgaatcaagttgtaacatggacaatcatcaaagcatgaacacgatcaccaagtacacacaggtgtcctggaggggtaaagcggatcaggctcaggcctctcaaaattcgttcgaggcagtttcagccgaagtggacttaaagggcatttgcgtcctgaaacacaagatgctagaggagagctatcggagtcgcaagtccatcacttgttacgatctctcttgcaacagcacctattgtaaaccaacactgtacatgattgtgcccatccatgcttgcaatatgatgaagtcctgtcttatagcactggggccttatcgagtacaggttgtgtacgaacgtacctactgcatgactggagtcttgctcgagggcaaatgttttgtgccagaccagtcagtggtcagtatcattaagcacggtatcttcgatattgccagcgttcatatcgtgtgctttttcgtagctgtgaaagggaacacatataagctgtttgaacaggtcaagaaatctttccaatccacctgtaatgacacggagaacaaggtgcagggatactatatatgcattgttggcggcaattcagcccccatctacgtgcctactctggatgactttagaagcatggaggcgttcagtgggatttttaggtctccacacggagaagatcacgacctcgctggtgaggaaatcgcctcctatagcatcgtcggcccggctaacgccaaagtgccccattcggcatcttccgataccttatcactgattgcttacagtgggatacctagctattcctctcttagcatcttggccaattcaacagaggcgaagcacgtattcagtccaggatttttcccccagctgaaccatactaaatgcgacaagaccgccattcctctaatctggacaggcatgatagacctcccaggttactacgaagcaattcacccctgtaccgttttctgcgtgctgtccgggccgggagctagctgtgaggccttttctgagggcggcatcttcaatatcacgtcacctatgtgccttgtcagtaaacagaaccggtttcgcctgactgaacaacagattaacttcgtgtgtcagagagtcgatgtggacatcattgtttattgcaatgggcaaaggaaggtgatattgacaaagaccctcgtaatcggacagtgtatttacactatcacaagcctgttttccttactgcccggtgtcgctcactctatcgccgtggagctctgcgttccaggcttccatgggtgggcaaccgccgcacttctggtgacgttttgtttcggatgggtcttgattcctgcgctaaccctgataatcctcacaattctgaaatttatcgcaaacattttccacacttcgaatcaggaaaaccggcttaagagcgtgctgcgcaaaatcaaggaggaatttgagaaaaccaagggctccatggtatgcgatgtgtgtaagtatgagtgcgaaacatacaaagagttgaaggcccatggtgtttcatgcccccagagtcaatgtccatattgcttcactcactgtgaacccaccgaggctgcctttcaggcacattaccgagtctgccaggtgacacacagattcagggacgatctcaaaaagaccgtgactcctcagaatttcacgccagggtgttatcggacactgaacttatttcgttacaaatctcgctgctacatattcaccatgtgggtctgtctgctagttctcgaaagcatcctgtgggccgcttccgcctcagaggtgccgcttaatcccgtgtggaacgacaatgcacacggcgtaggaagcgtccctatgcatactgatttggagctggacttttctctcacctccagtagcaagtatacatacagaaggcggctgaccaacccacttgaagagactcaatctattaatctgcacatcgaaattgaggagcagacaatcggcgtggatgttcatgcgttggggcactggttcgacggacgactcaacctgaagacgtcctttcactgctatggtgcttgtaccaaatacgaatatccctggcatactgccaagtgccactacgagcgcgattatcagtacgaaacatcatggggctgtaatcctgcagactgcccaggggtgggaaccggctgcacagcctgtggtttatacctggaccagctaaaacccgtcgggagtgcttataagataattactatcagatacagcaggaaagtgtgcgttcaattcggcgaggaaaacctctgtaaggtgattgatatgaatgactgctttgtaacccggcatgtcaaggtgtgtatcataggaacggtgtcgaaattctcccagggcgataccctgctctttttcgggccgttggagggaggtggcctgatctttaagcactggtgcacatctacttgtcagttcggggaccctggagatattatgagcccacgcgacaaaggctttctctgccccgagttccctggttcattcagaaagaaatgtaactttgccaccacacccctgtgcgaatatgatgggaacatggtcagtggctacaagaaagttatggcaactatcgactccttccagtcttttaataccagcacgatgcatttcacagatgagaggattgaatggaaggacccagatggaatgttacgtgaccacatcaacatactggtgaccaaggatattgactttgacaatcttggcgagaacccttgtaaaatcgggttgcaaacttcctcaatcgaaggagcttggggcagcggtgtagggttcacacttacctgcctgattagtctaactgagtgccccacctttctgacatctatcaaggcctgtgataaagcgatttgctatggagccgagtccgtgacgctcacccggggccagaatactgtcaaggtgagcggtaaaggcgggcactcgggatcaacattcaagtgttgccatggcgaagagtgttctcagatagggctgcacgctgcagccccacatcttgacaaggttaacggaatcagtgaaattgagaataacaaagtgtacgatgacggcgctccgcaatgcggtgtcaagtgttggtttgtgaaatccggggaatggatcagcggaattttctctggcaattggatcgttttgatagtgctgtgcgtctttttactcttcagcctggtacttctgtccgtgttgtgtcctgttcgaaagcacaaaaagtcatga

SEQ ID NO: 10072 - RNA, 3408 nt, synthetic construct
  misc_feature 1..3408: note = derived and/or modified CDS sequence (opt3) from HTNV(LongquanAa-11-642)__KC344262.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgagaatagtgtaatagggtatgtggaactgccaccgatgcccttggcagatactgcccagatggtccctgagtcaagttgtaacatggacaatcatcaaagcatgaacacgatcaccaagtacacacaggtgtcctggaggggaaaagcggatcaggctcaggcctctcaaaattcgttcgaagcagtttcagccgaggtggacttaaagggtacttgcgtcctgaaacacaagatgctagaggaaagctatcggagtcgcaagtccattacctgttacgatctctcttgcaacagcacatattgtaaaccaaccctgtacatgatcgtgcccattcatgcttgcaatatgatgaagtcctgtcttatcgcactgggcccttatcgagtacaggttgtgtacgagcgtacttactgcatgacaggggtcttgctcgaaggaaaatgttttgtgccagaccagtcagtggtcagtataatcaagcacggcattttcgatatcgccagcgttcatattgtgtgctttttcgtagctgtgaaaggtaacacctataagctgtttgagcaggtcaagaaatctttccaatccacgtgtaatgacactgagaacaaggtgcaggggtactatatctgcatagttggaggcaattcagcccccatttacgtgcctaccctggatgactttagaagcatggaagcgttcagtggcatctttaggtctccacacggggaggatcacgacctcgcaggagaagagattgcctcctatagcatcgtcggtccggctaacgccaaagtgccccattcggcatcttccgatacattatcactgatcgcttacagtggcattcctagctattcctctcttagcatattggcctcaagtactgaagcgaagcacgtattctccccagggtttttcccccagctgaatcataccaaatgcgacaagacagccatccctctaatttggaccggaatgatcgacctcccaggctactacgaggcaatacacccctgtacggttttctgcgtgctgagcggtccgggggcttcttgtgaggccttttcagaaggaggcattttcaacatcacttctcctatgtgccttgtcagcaaacagaatcggtttcgcctgacagagcaacaggtgaacttcgtctgtcagagagtggatgttgacatcattgtgtattgcaacggccaaaggaaggtaatcttgaccaagactctcgtcattgggcagtgtatatacacaatcacctccctgttttctttactgcccggagtggctcactcgattgccgttgaactctgcgtgccaggtttccatggctgggcaacggccgcgcttctggtcaccttttgtttcgggtgggtgttgatccctgctctaacactgatcattctcactatactgaaatttatcgcaaatattttccacaccagcaaccaggagaatcggcttaagtccgtactgcgcaaaatcaaggaagagtttgagaaaacaaagggatcaatggtgtgcgatgtttgtaagtatgaatgcgagacttacaaagaattgaaggcccatggcgtcagttgcccccagtctcaatgtccatattgcttcacccactgtgagcccacagaagctgcctttcaggcacattaccgagtgtgccaggtgacccacagattcagggacgatctcaaaaagactgtcacgcctcagaacttcacaccaggttgttatcggaccctgaatttatttcgttacaaaagccgctgctacattttcactatgtgggtttgtctgctagtgctcgagtccatcctgtgggccgcttcagccagcgaggtgccgcttaaccccgtatggaatgacaacgcacacggggtcggctctgtgcctatgcataccgatttggaactggacttttccctcacaagtagctctaagtatacctacagaaggcggctgactaatccacttgaggaaacacaatccataaacctgcacatcgagattgaggaacagacgatcggagttgatgtgcatgcgttgggccactggttcgacgggcgactcaatctgaagacctcatttcactgctatggagcttgtactaaatacgagtatccctggcatacagccaagtgccactacgaacgcgattatcagtacgagaccagttggggttgtaaccctgcagactgcccaggcgtcgggacaggatgcactgcctgtggcttatacctggaccagctaaaacccgtgggtagcgcttataagattatcaccataagatactcgaggaaagtttgcgtgcaattcggggaagagaatctctgtaaggtaattgatatgaacgactgctttgtcacgcggcatgtgaaggtgtgtatcattggcaccgtctccaaattctctcagggagatacactgttgtttttcggcccgcttgaagggggaggtctgatctttaagcactggtgcactagcacctgtcagttcggcgaccctggggatataatgtcaccacgcgacaaaggatttctctgccccgagttccctggcagtttcagaaagaaatgtaattttgccacaactcccctgtgcgagtatgatggtaacatggtttccgggtacaagaaagtgatggcaaccatcgactctttccagagctttaacacgtccacaatgcatttcaccgatgaaaggattgagtggaaggacccagatggcatgttacgtgaccacatcaatattctggtaactaaggatatcgactttgacaaccttggagaaaatccttgtaaaataggcttgcaaacatcaagcattgagggggcttggggaagtggcgtgggtttcaccctcacttgcctgatctctctaaccgagtgccccacatttctgacgtccatcaaggcctgtgataaagcgatttgctatggggccgaaagcgtcaccctcactcggggacagaacacagtgaaggtttcgggcaaaggtggccactcagggtctaccttcaagtgttgccatggagaggaatgtagtcagatcggcctgcacgctgcagccccacatcttgacaaggtgaatgggatttccgagatagaaaacaataaagtctacgatgacggagctccgcaatgcggcgtgaagtgttggtttgttaaaagcggtgagtggatctctgggattttcagcggaaactggatcgtgttgattgtcctgtgcgtatttttactcttctccctggtgcttctgtcagttttgtgtcctgtgcgaaagcacaaaaagagttga

SEQ ID NO: 10073 - RNA, 3408 nt, synthetic construct
  misc_feature 1..3408: note = derived and/or modified CDS sequence (opt3) from HTNV(LongquanAa-11-774)__KC344257.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgaaaattctgtaatagggtatgtggaactgccaccgatgcccttggcagatactgcccagatggtccctgagtcaagttgtaacatggacaatcatcaaagcatgaacacgatcaccaagtacacacaggtgtcctggaggggaaaagcggatcaggctcaggcctctcaaaattcgttcgaagcagtttcagccgaggtggacttaaagggtacttgcgtcctgaaacacaagatgctagaggaaagctatcggagtcgcaagtccattacctgttacgatctctcttgcaacagcacatattgtaaaccaaccctgtacatgatcgtgcccattcatgcttgcaatatgatgaagtcctgtcttatcgcactgggcccttatcgagtacaggttgtgtacgagcgtacttactgcatgacaggggtcttgatagaaggaaaatgttttgtgccagaccagtcagtggtcagtatcattaagcacggcatcttcgatattgccagcgttcatatcgtgtgctttttcgtagctgtgaaaggtaacacctataagctctttgagcaggtcaagaaatctttccaatccacgtgtaatgggactgagaacaaggtgcagggatactatatatgcattgttggcggcaattcagcccccatctacgtgcctaccctggacgattttagaagcatggaagcgttcagtgggatttttaggtctccacacggagaggaccacgatctggccggtgaagagatcgcatcctatagcatcgtcggcccggctaacgccaaagtgccccattcggcatcttccgacacactctcattaattgcttacagtgggatacctagctattcctctctgagcatccttgcctcaagtactgaagcgaagcacgtattctccccaggatttttcccccagttgaatcataccaaatgcgataagacagccattcctctgacctggacgggcatgatcgacctaccaggttactacgaggcaatacacccctgtactgttttctgcgtgctcagcgggccgggagcttcttgtgaggccttttcagaaggcggcattttcaacatcacaagtcctatgtgcctggtcagcaaacagaatcggtttcgccttaccgagcaacaggtgaacttcgtctgtcagagagtggacatggatatcattgtttattgcaacgggcaaaggaaggtgatcctgactaagacattggtaattggacagtgtatatacaccatcacgtccctcttttctctgttacccggtgtcgctcactcgattgccgtggaactgtgcgttccaggcttccatgggtgggcaaccgccgctctccttgtgacattttgtttcggatgggtcctgatccctgcgttgactctaatcattctgaccatactcaaatttatcgcaaatattttccacacaagcaaccaggagaatcggctgaagtccgtgcttcgcaaaatcaaggaagagtttgagaaaactaagggctcaatggtatgcgacgtgtgtaagtatgaatgcgagacctacaaagaactgaaggcccatggtgttagttgcccccagtctcaatgtccatattgcttcacacactgtgagcccaccgaagctgcctttcaggcacattaccgagtctgccaggtgactcacagattcagggatgacttgaaaaagacggtgacacctcagaacttcaccccagggtgttatcggactctcaatctgtttcgttacaaaagccgctgctacattttcaccatgtgggtctgtttactggttctagagtccatcctctgggccgcttcagccagcgaggtgccgctgaaccccgtgtggaatgataacgcacacggcgtaggatctgtccctatgcatacagaccttgaattggatttttccctgaccagtagctctaagtatacttacagaaggcggctcacaaatccactggaggaaacgcaatccataaaccttcacatcgagattgaggaacagaccatcggcgtggacgttcatgcgctggggcactggttcgatggacgattgaatctcaagacttcatttcactgctatggtgcttgtacaaaatacgagtatccctggcataccgccaagtgccactacgaacgcgactatcagtacgagacaagttggggctgtaaccctgcagattgcccaggggtgggaactggctgcaccgcctgtggtctgtacttagaccagctgaaacccgtcgggagcgcttataagattatcacgataagatactcgaggaaagtgtgcgttcaattcggcgaagagaatctatgtaaggtgattgacatgaacgattgctttgtaacccggcatgtcaaggtgtgtatcattggaacagtgtccaaattctctcagggcgacactctcctgtttttcgggccgcttgagggaggtggcttgatctttaagcactggtgcaccagcacatgtcagttcggggatcctggagacataatgtcaccacgcgataaaggctttctgtgccccgagttccctggtagtttcagaaagaaatgtaattttgccactacgcccctctgcgagtatgacgggaacatggtctccggctacaagaaagttatggcaaccatcgattctttccagagctttaacacatccaccatgcatttcactgacgaaaggattgagtggaaggatccagacggaatgctgcgtgatcacatcaatattttagtgacaaaggacatcgattttgacaacctgggcgaaaatccttgtaaaatagggcttcaaacctcaagcattgagggagcttggggcagtggtgtagggttcactttgacctgcctcatctctctgacagagtgccccacgtttctaacctccatcaaggcctgtgacaaagcgatttgctatggagccgaaagcgtgactctgacacggggccagaacaccgtcaaggtgtcgggtaaaggcgggcactcaggatctacattcaagtgttgccatggcgagaagtgtagtcagatcgggctccacgctgcagccccacatctggataaagttaatggaatttccgaaatagagaacaataaggtgtacgacgatggcgctccgcaatgcggtgtcaaatgttggtttgttaagagcggggaatggatctctggaattttcagcggcaactggatcgtgcttattgtgttgtgcgtctttctgttattctccctcgtactgctttcagtgctgtgtcctgttcgaaaacacaagaagagttga

SEQ ID NO: 10074 - RNA, 3408 nt, synthetic construct
  misc_feature 1..3408: note = derived and/or modified CDS sequence (opt3) from HTNV(LongquanMf-09-8)__JQ912875.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgaaaattctgtaatagggtatgtggaactgccaccgatgcccttggcagatactgcccagatggtccctgagtcaagttgtaacatggacaatcatcaaagcatgaacacgatcaccaagtacacacaggtgtcctggaggggaaaagcggatcaggctcaggcctctcaaaattcgttcgaagcagtttcagccgaggtggacttaaagggtacttgcgtcctgaaacacaagatgctagaggaaagctatcggagtcgcaagtccattacctgttacgatctctcttgcaacagcacatattgtaaaccaaccctgtacatgatcgtgcccattcatgcttgcaatatgatgaagtcctgtcttatcgcactgggcccttatcgagtacaggttgtgtacgagcgtacttactgcatgacaggggtcttgatagaaggaaaatgttttgtgccagaccagtcagtggtcagtatcattaagcacggcatcttcgatattgccagcgttcatatcgtgtgctttttcgtagctgtgaaaggtaacacctataagctctttgagcaggtcaagaaatctttccaatccacgtgtaatgggactgagaacaaggtgcagggatactatatatgcattgttggcggcaattcagcccccatctacgtgcctaccctggacgattttagaagcatggaagcgttcagtgggatttttaggtctccacacggagaggaccacgatctggccggtgaagagatcgcatcctatagcatcgtcggcccggctaacgccaaagtgccccattcggcatcttccgacacactctcattaattgcttacagtgggatacctagctattcctctctgagcatccttgcctcaagtactgaagcgaagcacgtattctccccaggatttttcccccagttgaatcataccaaatgcgataagacagccattcctctgacctggacgggcatgatcgacctaccaggttactacgaggcaatacacccctgtactgttttctgcgtgctcagcgggccgggagcttcttgtgaggccttttcagaaggcggcattttcaacatcacaagtcctatgtgcctggtcagcaaacagaatcggtttcgccttaccgagcaacaggtgaacttcgtctgtcagagagtggacatggatatcattgtttattgcaacgggcaaaggaaggtgatcctgactaagacattggtaattggacagtgtatatacaccatcacgtccctcttttctctgttacccggtgtcgctcactcgattgccgtggaactgtgcgttccaggcttccatgggtgggcaaccgccgctctccttgtgacattttgtttcggatgggtcctgatccctgcgttgactctaatcattctgaccatactcaaatttatcgcaaatattttccacacaagcaaccaggagaatcggctgaagtccgtgcttcgcaaaatcaaggaagagtttgagaaaactaagggctcaatggtatgcgacgtgtgtaagtatgaatgcgagacctacaaagaactgaaggcccatggtgttagttgcccccagtctcaatgtccatattgcttcacacactgtgagcccaccgaagctgcctttcaggcacattaccgagtctgccaggtgactcacagattcagggatgacttgaaaaagacggtgacacctcagaacttcaccccagggtgttatcggactctcaatctgtttcgttacaaaagccgctgctacattttcaccatgtgggtctgtttactggttctagagtccatcctctgggccgcttcagccagcgaggtgccgctgaaccccgtgtggaatgataacgcacacggcgtaggatctgtccctatgcatacagaccttgaattggatttttccctgaccagtagctctaagtatacttacagaaggcggctcacaaatccactggaggaaacgcaatccataaaccttcacatcgagattgaggaacagaccatcggcgtggacgttcatgcgctggggcactggttcgatggacgattgaatctcaagacttcatttcactgctatggtgcttgtacaaaatacgagtatccctggcataccgccaagtgccactacgaacgcgactatcagtacgagacaagttggggctgtaaccctgcagattgcccaggggtgggaactggctgcaccgcctgtggtctgtacttagaccagctgaaacccgtcgggagcgcttataagattatcacgataagatactcgaggaaagtgtgcgttcaattcggcgaagagaatctatgtaaggtgattgacatgaacgattgctttgtaacccggcatgtcaaggtgtgtatcattggaacagtgtccaaattctctcagggcgacactctcctgtttttcgggccgcttgagggaggtggcttgatctttaagcactggtgcaccagcacatgtcagttcggggatcctggagacataatgtcaccacgcgataaaggctttctgtgccccgagttccctggtagtttcagaaagaaatgtaattttgccactacgcccctctgcgagtatgacgggaacatggtctccggctacaagaaagttatggcaaccatcgattctttccagagctttaacacatccaccatgcatttcactgacgaaaggattgagtggaaggatccagacggaatgctgcgtgatcacatcaatattttagtgaacaaggacatcgattttgacaatctgggcgaaaacccttgtaaaatagggcttcaaacatcaagcattgagggagcttggggcagtggtgtagggttcaccttgacttgcctcatctctctgaccgagtgccccacatttctaacgtccatcaaggcctgtgacaaagcgatttgctatggagccgaaagcgtgaccctgactcggggccagaatacagtcaaggtgtcgggtaaaggcgggcactcaggatctaccttcaagtgttgccatggcgaggaatgtagtcagatcgggctccacgctgcagccccacatctggataaggttaacggaatttccgagatagaaaataacaaagtgtacgacgatggcgctccgcaatgcggtgtcaagtgttggtttgtgaaaagcggggagtggatctctggaattttcagcggcaattggatcgttcttattgtgttgtgcgtctttctgttattctccctcgtactgctttcagtgctgtgtcctgttcgaaagcacaaaaagagttga

SEQ ID NO: 10075 - RNA, 3408 nt, synthetic construct
  misc_feature 1..3408: note = derived and/or modified CDS sequence (opt3) from HTNV(ROKA14-11)__KU207203.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatggtagaggagtcttatcggagccgcaagtccattacctgttacgatctttcatgcaatagtacttattgtaaaccaacactgtacatgatcgttcccattcatgcgtgcaacatgatgaaaagctgtttgatcgctctcgggccttatcgagtgcaggtcgtgtacgaacgtacctactgcatgacgggagtgctgatagagggcaaatgtttcgtcccagaccagtctgttgtgtccatcattaagcacggtatctttgatattgcctcagtacatatcgtgtgcttctttgtcgcagtgaaagggaatacttataagatattcgaacaggttaagaaaagttttgagagtacctgtaacgacacagagaataaggtgcaaggatactatatttgcatcgtcggcggcaactctgcccccatttacgtgcctactctggatgacttcagatccatggaagcatttaccgggatcttcaggagcccacacggagaggatcacgacctcgctggtgaagagacagccacctattcgatcgtaggcccggctaatgccaaagttccccattctgcgtcctcagatacgttaagtctgattgcatttagcgggataccttcctactctagcctttcaatcttgactagctccacagaagccaagcacgtgttcagcccaggactgtttcccaaactaaaccataccaattgcgacaagggcgctattcctctcatgtggactggtatgatcgacctgccagggtattacgaggccatacacccctgtacagtcttctgcgtgctttctggaccgggcgcatcatgtgaggctttcagtgaaggcgggatttttaacatcaccagccctatgtgcctggtctccaaacagaatcggttccgcttgacggagcaacaggtgaactttgtttgtcaaagagtggatgtagacatcgtcgtgtactgcaacggacagaggaaggttattctcaccaagacactggtgatcggtcagtgtatttatactataacctctttattctcgctgctccccggcgtcgcccacagcatcgcggtggaactttgcgtaccagggtttcatggatgggccacagcagctctgttggtgactttctgttttggctgggttctaattcctgccatcaccttcatcattctgacaatactcaaatttatcgctaatattttccacacctccaaccaagagaatcggctgaagtcagtccttcgcaaaatcaaggaagagtttgagaaaactaagggtagtatggtgtgcgatgtgtgtaagtacgaatgcgagacgtataaagaactgaaggcccatggggtctcttgcccccagagccagtgtccatactgcttcacacactgtgagcccaccgaagcagcctttcaggctcattataaagtttgccaagtgactcaccgattcagagacgatttgaagaaaaccgtgacacctcagaacttcaccccaggctgttacaggactctcaatctgtttcggtataagtcccgttgctacattttcacaatgtggatctttttactggtactagagtcaatactctgggcggcaagcgcctctgagacgccgctgacccccgtctggaacgacaatgctcacggagtgggctccgttcctatgcatactgatcttgaattggacttcagtctgacatcttcttccaagtacacctatcgcagaaaactcacaaacccactggaggaagcccagtcaatcgatcttcacattgagatcgaggaacagactattggggtggacgtccatgcactgggacactggtttgatggtaggttgaatctcaagaccagtttccactgttacggcgcctgcacgaaatatgagtacccctggcataccgctaagtgtcactatgaacgggactaccaatatgagacaagctgggggtgcaacccttcggactgtccaggagtgggcactggttgcaccgcctgcgggctgtacttagatcgactgaaacccgttggctccgcatacaagatcataacaattcgctattctagaagggtgtgtgtacagtttggagaagagaatctatgcaagatcattgacatgaacgattgtttcgtcagccggcatgtgaaagtgtgcatcataggcactgtctcaaagtttagtcagggggacaccctcctgttctttggaccgcttgagggtggcgggttgatcttcaaacactggtgtacgtccacatgccagtttggagatcctggcgacattatgtctccacgcgataagggtttcctgtgtcccgagttccctgggagctttagaaagaagtgcaatttcgcgaccactcccatctgtgaatacgacggcaacatggtttccggatataaaaaggtgatggctacaattgattcatttcagagcttcaataccagtactatgcattttaccgacgaaaggatcgagtggaaggatccagacggcatgctccgtgatcacataaacattctggtaacaaaagacatcgacttcgataacttaggggaaaatccttgcaagatcggactgcagacgtcttccattgagggcgcctggggtagcggggtgggatttacctcgacttgtcttgtctcattgacagagtgccccaccttcctcacatctatcaaagcatgcgacaaggccatttgttacggcgctgaaagtgtgactctgacccggggtcagaacacggttaaagtgtccggcaaagggggacacagcggctctacatttaagtgctgtcatggggaggattgcagccagataggactacacgccgcagctccacatctggacaaggtcaatggcatctccgaaatggagaactcaaaggtgtatgatgacggtgccccgcaatgtgggattaaatgctggttcgttaagagtggagaatggatcagcggcatttttagcggtaattggatcgtgctcatagtcctgtgtgtattccttttgttctccctggtgttactctcaatcctgtgccctgttcgaaaacacaagaagagttga

SEQ ID NO: 10076 - RNA, 3408 nt, synthetic construct
  misc_feature 1..3408: note = derived and/or modified CDS sequence (opt3) from HTNV(US8A15-1)__KU207205.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatggtagaggagtcttatcggagccgcaagtccattacctgttacgatctttcatgcaatagtacttattgtaaaccaacactgtacatgatcgttcccattcatgcgtgcaacatgatgaagagttgtttgatcgctctcgggccttatcgagtgcaggtcgtgtacgaacgtacctactgcatgacgggagtgctgatagagggcaaatgtttcgtcccagaccagtctgttgtgtccatcattaagcacggtatctttgatattgcctcagtacatatcgtgtgcttctttgtcgcagtgaaagggaatacttataagatattcgaacaggttaagaaatcttttgagagtacctgtaacgacacagagaataaggtgcaaggatactatatttgcatcgtcggcggcaactctgcccccatttacgtgcctactctggatgacttcagatccatggaagcatttaccgggatcttcaggagcccacacggagaggatcacgacctcgctggtgaagagacagccacctattcgatcgtaggcccggctaatgccaaagttccccattctgcgtcctcagatacgttaagtctgattgcatttagcgggataccttcctactctagcctttcaatcttgactagctccacagaagccaagcacgtgttcagcccaggactgtttcccaaactaaaccataccaattgcgacaagggcgctattcctctcatgtggactggtatgatcgacctgccagggtattacgaggccatacacccctgtacagtcttctgcgtgctttctggaccgggcgcatcatgtgaggctttcagtgaaggcgggatttttaacatcaccagccctatgtgcctggtctccaaacagaatcggttccgcttgacggagcaacaggtgaactttgtttgtcaaagagtggatgtagacatcgtcgtgtactgcaacggacagaggaaggttattctcaccaagacactggtgatcggtcagtgtatttatactataacctctttattctcgctgctccccggcgtcgcccacagcatcgcggtggaactttgcgtaccagggtttcatggatgggccacagcagctctgttggtgactttctgttttggctgggttctaattcctgccatcaccttcatcattctgacaatactcaaatttatcgctaatattttccacacctccaaccaagagaatcggctgaagtcagtccttcgcaaaatcaaggaagagtttgagaaaactaagggtagtatggtgtgcgatgtgtgtaagtacgaatgcgagacgtataaagaactgaaggcccatggggtctcttgcccccagagccagtgtccatactgcttcacacactgtgagcccaccgaagcagcctttcaggctcattataaagtttgccaagtgactcaccgattcagagacgatttgaagaaaaccgtgacacctcagaacttcaccccaggctgttacaggactctcaatctgtttcggtataagtcccgttgctacattttcacaatgtggatctttttactggtactagagtcaatactctgggcggcaagcgcctctgagacgccgctgacccccgtctggaacgacaatgctcacggagtgggctccgttcctatgcatactgatcttgaattggacttcagtctgacaagcagctccaagtacacctatcgcagaaaactcacaaacccactggaggaagcccagtcaatcgatcttcacattgagatcgaggaacagactattggggtggacgtccatgcactgggacactggtttgatggtaggttgaatctcaagaccagtttccactgttacggcgcctgcacgaaatatgagtacccctggcataccgctaagtgtcactatgaacgggactaccaatatgagacaagctgggggtgcaacccttcggactgtccaggagtgggcactggttgcaccgcctgcgggctgtacttagatcgactgaaacccgttggctccgcatacaagatcataacaattcgctattctagaagggtgtgtgtacagtttggagaagagaatctatgcaagatcattgacatgaacgattgtttcgtcagccggcatgtgaaagtgtgcatcataggcactgtctcaaagtttagtcagggggacaccctcctgttctttggaccgcttgagggtggcgggttgatcttcaaacactggtgtacgtccacatgccagtttggagatcctggcgacattatgtctccacgcgataagggtttcctgtgtcccgagttccctgggagctttagaaaacattgcaatttcgcgaccactcccatctgtgaatacgacggcaacatggtttccggatataagaaagtgatggctacaattgattcatttcagagcttcaataccagtactatgcactttaccgacgaaaggatcgagtggaaggatccagacggcatgctccgtgatcacataaacattctggtaacaaaggacatcgacttcgataacttaggggaaaatccttgcaaaatcggactgcagacgtcttccattgagggcgcctggggtagcggggtgggatttacccttacttgtttggtctcgctcacagagtgccccaccttcctgacatcaatcaaggcatgcgacaaagccatttgttacggcgctgaatctgtgactctaacccggggtcagaacacggttaaggtgagtggcaaagggggacattccggcagcacatttaagtgctgtcacggggaggattgctctcagataggactgcatgccgcagctccacacctcgacaaggtcaatggcatcagcgaaatggagaactccaaagtgtatgatgacggtgccccgcaatgtgggattaagtgctggttcgttaaatcaggagaatggatcagtggcatttttagcggtaattggatcgtgctgaccgtcctttgtgtattcttgctgttctctttagtgctcctgtccatactttgccctgttcgaaagcataaaaagtcatga

SEQ ID NO: 10077 - RNA, 3408 nt, synthetic construct
  misc_feature 1..3408: note = derived and/or modified CDS sequence (opt3) from HTNV(Lee)__D00377.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaactagctttgagaccgtgtccacagaagtcgacctcaaggggacctgcgtgctgaaacacaagatggtagaggagtcttatcggagccgcaagtccattacttgttacgatctttcatgcaacagtacatattgtaaaccaaccctgtacatgatcgttcccattcatgcgtgcaatatgatgaaaagctgtttgatcgctctcgggccttatcgagtgcaggtcgtgtacgaacgtacgtactgcatgactggagtgctgatagagggcaaatgtttcgtcccagaccagtctgttgtgtccatcattaagcacggtatctttgatattgcctcagtacatatcgtgtgcttctttgtcgcagtgaaagggaacacctataagatattcgaacaggttaagaaaagttttgagagtacatgtaatgacactgagaacaaggtgcaaggatactatatttgcatcgtcggcggcaattctgcccccatttacgtgcctaccctggatgacttcagatccatggaagcatttacagggatcttcaggagcccacacggagaggatcacgacctcgctggtgaagagaccgccacgtattcgatcgtaggcccggctaacgccaaagttccccattctgcgtcctcagatactttaagtctgattgcatttagcgggataccttccgactctagcctttcaatcttgacaagttccaccgaagccaagcacgtgttcagcccaggactgtttcccaaactaaatcatactaactgcgacaagggcgctattcctctcatgtggacaggtatgatcgatctgccagggtactatgaggccatacacccctgtaccgtcttctgcgtgctttctggaccgggcgcatcatgtgaggctttcagtgaaggcgggatttttaatatcacgtaccctatgtgcctggtcagcaaacagaaccggttccgcttgaccgagcaacaggtgaattttgtttgtcagagagtggacgtagatatcgtcgtgtactgcaacggacagaggaaggttattctcacaaagactctggtgatcggtcagtgtatttataccataacatccttattctctctgctccccggcgtcgcccactcgatcgcggtggaactttgcgtaccagggtttcatggatgggccactgcagctctgttggtgaccttctgttttggctgggttctaattcctgccatcacattcatcattctgaccatactcaaatttatcgctaacattttccacactagcaatcaagagaaccggctgaagtccgtccttcgcaaaatcaaggaagagtttgagaaaacgaagggttcaatggtgtgcgacgtgtgtaagtacgaatgcgagacatataaagaactgaaggcccatggggtcagttgcccccagtctcagtgtccatactgcttcacccactgtgagcccactgaagcagcctttcaggctcattataaagtttgccaagtgacccaccgattcagagatgacttgaagaaaacagtgacccctcagaatttcactccaggctgttacaggacactcaacctgtttcggtataagagccgttgctacattttcacgatgtggatctttttactggtactagagtccatactctgggcggcatcagccagcgagaccccgctgactcccgtctggaatgataacgctcacggagtgggctctgttcctatgcatacagaccttgaattggatttctccctgaccagtagctctaagtacacatatcgcagaaaactcactaatccactggaggaagcccagtccatcgaccttcacattgagatcgaggaacagaccattggggtggatgtccatgcactgggacactggtttgacggtaggttgaacctcaagacgtcattccactgttacggcgcctgcaccaaatatgagtacccctggcatacagctaagtgtcactatgaacgggactaccaatatgagaccagttgggggtgcaatcctagcgattgtccaggagtgggcactggttgcacagcctgcgggctgtacttagaccgactgaaacccgttggctcggcatacaagatcataactattcgctattccagaagggtgtgtgtacagtttggagaagagaacctatgcaagatcattgatatgaatgactgtttcgtctctcggcatgtgaaagtgtgcatcataggcaccgtcagcaagttttcacagggggatacgctcctgttctttggaccgcttgagggtggcgggttgatcttcaaacactggtgtacaagtacctgccagtttggagaccctggcgatattatgtccccacgcgacaagggtttcctgtgtcccgagttccctgggtcttttagaaagaagtgcaacttcgcgactacacccatctgtgaatacgatggcaatatggttagcggatataaaaaggtgatggctaccattgactcctttcaatcattcaacactagcaccatgcattttacagatgaaaggatcgagtggaaggacccagatggcatgctccgtgaccacataaatattctggtaacgaaagacatcgatttcgacaacttaggggaaaacccttgcaagatcggactgcagaccagttctattgagggcgcctggggttccggggtgggatttactcttacatgtttggtcagcctcaccgagtgccccacattcctgacttcgatcaaagcatgcgataaggccatttgttacggcgctgaatcagtgaccctaacgcggggtcagaatacagttaaagtgtctggcaagggcggacacagtggctccacctttaagtgctgtcatggggaggactgcagccagataggactgcacgccgcagctccacatctcgataaagtcaacggcatctctgaaatggagaatagcaaggaatatgacgatggtgccccgcaatgtgggattaaatgctggttcgtgaagtccggagagtggatctcaggcatttttagtggtaactggatcgttctgatagtgctttgtgtcttcttgctgttcagcttagtactcctgtctatcctttgccctgtgcgaaaacacaagaagtcctga

SEQ ID NO: 10078 - RNA, 3384 nt, synthetic construct
  misc_feature 1..3384: note = derived and/or modified CDS sequence (opt3) from HTNV(M)__U38177.1__GP
  source 1..3384: mol_type = other RNA
atggccagcctggtgtggcccgtcctcacccttagaaacgtttacgacatgaagatcgagtgccctcacacagtgtccttcggcgaaaattctgtaattgggtatgtggagctgccaccggtccccttggctgatactgcacagatggtgcctgaatcaagttgtaacatggacaatcatcagagcttaaacacgataaccaaatacacacaggtttcctggaggggaaaggccgatcagtctcagtcgtcacaaaatagctttgagactgtgagtaccgaagtcgacctgaaaggtacatgcgtgctaaagcacaaaatggtagaggagtcctatcggtctcgcaagagcgttacctgttacgatctctcctgcaactcaacttattgtaagccaacactgtacatgatcgtgcccattcatgcgtgcaatatgatgaaaagttgtcttatcgctctgggcccttatcgagtccaggtggtgtacgaacgtagctactgcatgaccggggtcttgattgagggaaagtgtttcgttccagaccagtctgtggtatccatcataaaacacggcatctttgatattgcctcagtgcatatcgtctgcttctttgtggcagttaagggtaacacgtataaaattttcgaacaggtgaaaaagagctttgagagtacttgtaatgacaccgagaacaaggtccaagggtactatatctgcatagtgggaggcaattctgcccccatttacgtacctacactcgatgacttcagatccatggaggcttttactggcatcttcaggagcccacacggggaggatcacgacctggcaggagaagagattgcctcgtattctatcgttggtgctgccaacgcgaaggtgccgcattccgcatcaagtgataccctgcggctcatcgcctacagcggcattccctcctattctagcttatcaatactgacaagttccaccgaagctaaacacgtctttagccctgggcttttcccaaagttgaatcatacgaactgcgacaaatctgccatccccctgatttggactggaatgatcgacctacctggctactacgaggcagtgcacccatgtacagtcttttgcgtgctctcaggtcccggggctagttgtgaggccttcagcgaaggaggcatattcaatattacctccccgatgtgcctggtttctaagcagaaccgctttagacttactgagcaacaggtgaacttcgtatgtcaaagggtcgatatggacatcgtggtttattgcaatggccagcggaaagtgatcctgacaaagaccttggtcattgggcagtgtatctacacgattacctcgctctttagcctgttacctggagtggcgcactccatagccgtagaactgtgcgtgcccggtttccatggctgggcaacagctgccctccttgttactttttgtttcgggtgggtcctgatcccagctattacctttatcatcttgacagtgctaaagttcattgccaacatatttcacacttcaaatcaagagaaccgcctgaaaagtgtgctccgaaagatcaaagaagagttcgagaagaccaaaggatctatggtctgcgatgtttgtaagtatgaatgcgagacatacaaggaactgaaagcacatggcgtgagctgccctcagtcccagtgtccctattgctttacccactgtgagccaactgaagccgctttccaggcgcattacaaggtgtgccaagtaacgcacagatttagggacgatcttaaaaagacagtcactccccagaatttcacccctggttgttatcggaccctgaacttgttccgttacaaatcacgctgctacatttttacaatgtggatcttcctcctggtgttagagagcattctgtgggcagcctctgcttccgagaccccactaactccggtttggaatgacaacgcccacggggtgggcagtgtccccatgcatacagatctcgaactggactttagccttacgtcttcctcaaagtatacctacagaaggaagttgactaatcctctggaggaagcacagagtatcgatctccacatagagatcgaggaacagacaattggagtggacgttcatgccctgggccactggttcgatgggcggcttaacctgaaaaccagctttcactgttatggagcttgcacaaagtacgagtatccatggcatactgccaaatgtcactacgaacgagactatcaatacgagacctcgtggggttgcaatccctccgactgtcctggcgtggggacgggatgcaccgcatgcggcttgtacctcgatcagctgaagccagtaggttctgcgtataaaatcattacaatccgctacagcagaagggtctgtgtgcagttcggggaagagaacttatgcaagataattgacatgaatgattgttttgtgtcacggcatgtcaaggtttgcatcattggcactgtgagtaaattctcccagggagacaccctgctatttttcggccccctcgaagggggaggtctgatctttaagcactggtgtacatctacttgccaattcggcgatccgggggacataatgagccctcgcgataaaggatttctttgtccagagttccccggctccttcagaaagaaatgcaactttgctaccacgcctatctgtgagtatgacggtaatatggtatcagggtacaagaaagtgatggccacaattgatagcttccagagttttaacacctctactatgcatttcacagacgaaaggatcgagtggaaggatcccgacggcatgttgcgtgatcacattaacatcctggtcaccaaggacatagactttgataatctcggagaaaacccatgcaaaattggcctgcagacttccagcatcgagggggcatggggatcgggcgtgggtttcaccttaacatgtctggtttcacttacggagtgccctacctttttgacttctatcaaggcctgcgacaaagctatttgttatggggccgaaagtgtgacactcacccggggacagaatacagtcaaggtgtccggcaaaggtggccacagcgggtctactttcaagtgctgtcatggagaggattgcagccaaatcggcctgcacgcagctgcgccccatctagacaaggttaacgggatttccgaaatagaaaattcaaaagtgtacgatgacggagccccacagtgtggcatcaagtgctggtttgtcaaaagtggtgaatggattagcgggatcttctctggaaactggattgtactgatcgtgctctgtgtttttctgcttttctccttggtgctgttatcaatactctgcccggtccgaaagcacaaaaagagttga

SEQ ID NO: 10079 - RNA, 3408 nt, synthetic construct
  misc_feature 1..3408: note = derived and/or modified CDS sequence (opt3) from HTNV(N8)__EF077656.1__GP
  source 1..3408: mol_type = other RNA
atgggcatctggaagtggctggtgatggccagcctcgtctggcccgcttacacccttagaaacgtttatgacatgaaaattgagtgccctcacacagtgtccttcggggaaaattctgtaataggatacgtggagctgccaccgatgcccttggcagatactgcccagatggtccctgaatcaagttgtaacatggacaatcatcaaagcatgaacacgatcaccaagtatacacaggtgtcctggaggggtaaagcggatcaggctcaggcctctcaaaattcgtttgaggcagtttcagccgaagtggacttaaagggcacttgcgtcctgaaacacaagatgctagaggagagctaccggagtcgcaagtccattacctgttatgatctctcttgcaacaatacatactgtaaaccaaccctgtatatgatcgtgcccattcatgcttgcaacatgatgaaaagctgtcttatcgcactggggccttaccgagtacaggttatatacgaacgtacttattgcatgacaggagtgttgatcgagggcaagtgtttcgtcccagaccagtccgtggtgtcaattatcaagcacggtatttttgatatcgccagtgtccatatagtttgcttctttgtggctgtaaaagggaatacctacaaactcttcgaacaggtgaagaagtcttttcaatctacgtgtaacgacactgagaataaggtccagggatattacatttgcatcgtgggcggcaactccgcccccatttatgttcctaccctggatgacttcagatcaatggaggcgtttagcgggatcttcaggagtccacacggagaagatcacgacctggcaggggaggaaatcgcctcttactccattgtgggcccggctaatgccaaagtcccccatagcgcatcgtctgatacactctccttaatagcttattcagggatccctagttacagctccctgtctattcttactggaagcaccgaggccaagcacgtgttttcaccaggcttctttccccagttgaaccatacaaaatgcgacaagaccgcgatccctctgacgtggactggtatgatagacctaccagggtactatgaagccattcacccctgtacagtattctgcgttctcagtggaccgggcgcatcctgtgaggctttcagcgagggcgggatctttaatatcacctctcctatgtgcctggtgtcaaaacagaaccggttccgccttactgaacaacaggtcaactttgtgtgtcagagagtcgatatggacattatcgtgtactgcaatggacaaaggaaggttattctgacaaagaccttggtgataggtcagtgtatctatacgattaccagtctcttcagcctgttacccggcgtagcccactccatcgctgtcgagctgtgcgtgccagggtttcatggatgggccacagcagccctccttgttactttctgttttggctgggtgctgatccctgctattaccttcataatcttgacagtcctaaaatttattgcgaacatcttccacacttctaatcaggaaaaccggctgcgcgcagtgctccgaaagattaaagaggaatttgagaagaccaaaggttcgatggtatgcgatgtgtgtaagtacgagtgcgaaacatataaggagctgaaagcccatggggttagctgcccccagtcccaatgtccatactgcttcacccactgtgaacccactgaggctgcctttcaggcacattatagagtctgccaggtgacgcacaggttccgggacgatcttaagaaaacagtgacccctcagaatttcactccaggctgttaccgtaccctgaacttgtttcgctacaagtcaagatgctatatcttcacaatgtgggtctgtctcctggttttagaaagtatactgtgggccgcttctgccagcgaggtgccgctaaatcccgtgtggaacgacaatgcacacggagtaggctccgtccctatgcataccgatctcgagctggacttttcacttactagcagctccaaatacacatataggcggcgattgacgaacccactggaagagacccaagcgatcaatctccacattgaaatcgaggagcagactattggggtggatgttcatgctctgggacactggttcgacggtcgccttaacctgaagacaagttttcactgctacggcgcctgtaccaagtatgaatacccctggcatacagcaaaatgccactatgagagagattaccagtacgaaactagctgggggtgtaatcctgccgactgcccaggagtgggcaccggttgcacggcttgtgggttgtatatcgaccagctcaagcccgtcggctctgcctacaaaataattaccatcaggtattcccggaaggtgtgcgttcaattcggagaggaaaacctgtgtaaagtgattgatatgaatgactgctttgtatcacgccatgtcaaggtgtgtatcataggcacagtgagtaagttcagccagggggatactttactgtttttcggaccgctagagggtggcgggctcatctttaaacactggtgcacctcgacatgtcagttcggagaccctggcgatattatgtccccaagagacaagggttttctgtgccccgagttccctgggtctttcaggaaaaagtgtaactttgcaactacgcccctttgcgaatacgatggcaacatggtcagcggatataaaaaggttatggctaccatcgactcattccagagttttaatacatccaccatgcatttcactgatgagcgtattgaatggaaagacccagatggcatgttgcgggaccacatcaacatactggtgacaaaggatattgactttgacaatctcggggagaacccttgtaagatcggactgcaaacctctagcatcgaaggcgcctggggttccggggtaggattcactttaacctgcctggtgtcacttacagagtgccccacgtttttgaccagcattaaagcgtgtgataaggccatctgctacggcgctgagagtgtcgcactcactcgaggtcagaatacagtgaaagtttctggcaagggtggacactccggcagcaccttcaaatgttgccatggggaagagtgttcgcagattggactgcacgccgctgccccacatctagacaaggtgaacggcatatcagaagtcgagaataacaaggtgtatgatgacggtgcaccgcaatgcggggttaaatgttggtttgtgaagtctggagaatggatcagtggcattttctccggtaattggatcgtcctgattgtactctgcgtgtttctgcttttcagcttggttctgttatctgtgctctgtcctgtcagaaaacacaagaaaagctga

SEQ ID NO: 10080 - RNA, 3408 nt, synthetic construct
  misc_feature 1..3408: note = derived and/or modified CDS sequence (opt3) from HTNV(Q32)__DQ371905.1__GP
  source 1..3408: mol_type = other RNA
atgggcatctggaagtggctggtgatggccagcctcgtctggcccgctttcgcacttagaaacgtttacgacatgaaaattgagtgccctcacaccgtgtcctttggggaaaattctgtaataggatatgtggagctgccaccgatgcccttggccgatacaactcagatggtccctgaatcaagttgtagcatggacaaccatcaatccttaaatacgatcaccaagtacacacagattatctggaggggtaaagcggatcagtctcagtcgtcacaaaacagcttcgagactgtgagtaccgaagttgacctgaagggcacatgcgtgctaaaacacaagatgattgaggagtcctatcggtctcgcaagagcatcacctgttacgatctctcctgcaattcaacttattgtaaaccaacactgtacatgatagtccccatccatgcttgcaacatgatgaagagttgtcttattgccctggggccttatcgagtgcaggtagtttacgaacgtacctactgcatgacgggagtgttgatcgagggcaaatgttttgtcccagaccagagcgtggtgtctattatcaagcacggtatattcgatattgcatccgtccatatcgtttgctttttcgtggccgtaaaagggaatacttataagatttttgaacaggtgaagaaatcattcgagagcaactgtaatgacaccgagaacaaggtccaaggatactatatctgcatcattggcggcaatagttctcccgtgtacgttcctacactcgatgactttagatccatggaagcattcagcgggatatttaggtcgccacacggagaggatcacgacctggctggtgaagaggtggcctcttattccatcgtcggcccggctaacgccaaagtgccccattcagcgagtagcgatactctggggctcattgcatacttcggaatcccttcctattctagcttatcaatactgaccagttccacagaagccaagcacgtatttagcccaggccttttcccccagttgaatcataccaaatgcgacaagacggctattcctctgacttggacaggtatgatcgacctaccagggtactacgaggccatccacccctgtaccgttttctgcgtgctctctggaccgggcgcatcatgtgaggcttttagtgaaggcgggattttcaacatcactagccctatgtgcctggtctccaaacagaatcggtttcgccttacagagcagcaagtgaacttcgtctgtcagagagtggatgttgacattatagtgtattgcaacggacagaggaaggtaatcctgaccaagacgttggtcattggtcaatgtatctacaccatcacatctctcttttcgctgttacccggcgtggcccacagcattgcggttgaactgtgcgtgccagggttccatggatgggccactgcagctctccttgtcaccttttgtttcggctgggtgctgatacctgccatcacatttattatcttgactattctaaaattcatcgctaatatatttcacacctccaaccaggagaatcggctgaagtcagtactccgcaaaatcaaggaagagttcgagcgaacaaaaggtagtatggtgtgcgatatttgtaagtatgaatgcgagacctacaaggaactgaaagcccatggggtttcttgcccccagagccagtgtccatattgctttactcactgtgagcccacggaagcagccttccaagctcattacaaggtctgccaggtgacacacagattcagggacgatcttaaaaagaccgtgactcctcagaactttaccccaggctgttatcggacactgaatttgttccgttacaaatcccgctgctacatctttaccatgtgggtcttcctcctggttttagagtcaattctgtgggcggcaagcgcctctgagatcccgctaaaccccgtgtggaatgacaacgctcacggagtgggctccatacctatgcatactgatctcgaactggactttagtcttacatctagctccaagtatacgtacagaaggaagttgaccaatccactggaggaatcacaggccattgatctccacgtagagatcgaggaacaaactattggggtcgacgtgcatgcactgggacactggttcgatggtcggcttaacctgaaaacaagttttcactgttatggcgcctgcaccaagtacgagtatccctggcatacagctaaatgtcactacgaacgagactatcagtacgagactagctgggggtgcaatccttcggactgtccaggagttggcaccggttgcacggcctgcgggttgtacctcgatcagctgaagcccgtgggctccgcatataaaatcataaccatccgctactctagaagggtctgtgtgcagttcggagaagagaacttatgcaagattatcgacatgaatgattgttttgttagccggcatgtgaaggtatgcattatcggcacagtctcaaaattcagtcaaggggacactctgctatttttcggaccgctcgagggtggcgggctgatatttaagcactggtgtacctccacatgccagttcggagatcctggcgacattatgtctccacgcgataaaggtttcctttgtcccgaatttcctgggagcttcagaaagaaatgcaactttgcgactacccccgtgtgtgagtatgacggcaatatggtgtccggatacaagaaagtcatggctacgatcgattcattccagagctttaacacaagtaccatgcatttcactgacgaaaggatcgagtggaaggatccagacggcatgttgcgtgatcacattaacatcctggttacaaaggacattgactttgataatctcggggaaaacccttgcaaaataggactgcagacctcttccatcgagggcgcctggggtagcggggtgggattcactttaacctgtctgatttcgcttacagagtgctcaacgtttttgacctctatcaaggcatgcgacaaagccatttgttatggcgctgaaagtgtaactctcatccggggtcaaaatacagtgaaggtctccggcaaagggggacacagcggctctagcttcaagtgctgtcatggggaggaatgctcccagataggactgcacgccgcagctccccatctagataaggtgaacggcatctcagagatggaaaatagtaaagtttttgacgatggtgccccacagtgtgggattaagtgctggttcgtgaaaagcggagagtggatctctggcattttctccggtaactggatcgtcctgatagtgctctgtgtttttctgcttttctcattggtgctgttaagtattctctgcccggtccgaaagcacaaaaagagctga

SEQ ID NO: 10081 - RNA, 3408 nt, synthetic construct
  misc_feature 1..3408: note = derived and/or modified CDS sequence (opt3) from HTNV(Bao14)__AB127995.1__GP
  source 1..3408: mol_type = other RNA
atgggcatgtggaagtggctggtgatcgccagcctcgtctggcccgctcttgcactgagaaacgtttacgacatgaaaattgagtgccctcacaccgtgtccttcggggaaaattctgtaataggatatgtggagttgccaccgatgcccttagccgatacagcgcagatggtccctgaatcaagttgtagcatggacaaccatcaatccatcaatactattacgaagtacacccaggtgatctggaggggtaaagctgatccaggccagtcttcgcagaactcatttgagacagttagcactgaagtggacctgaaggggacctgcgtcctaaaacacaagatggtggaggagagttatcggtcccgcaagtctattacatgttacgatctcagctgcaattccacctattgtaaacccactctgtacatgatcgtacctatacatgcctgcaacatgatgaagtcatgtcttatcgcactgggaccatatcgagttcaagtggtctacgaacgtacatactgcatgaccggcgtgttgattgagggtaaatgtttcgtgcccgaccagagtgtcgttagcatcattaagcacgggatctttgatatagcctctgtgcatattgtatgcttctttgtggctgtcaaaggaaatacgtataagttgttcgaacaggtgaagaaatcctttgagtcaacttgtaacgacaccgagaataaggttcagggctactatatctgcattgtgggcgggaacagcgcacctatctacgtcccaacactggatgacttcagaagtatggaagcctttactggaatcttcaaatctccgcacggtgaggatcacgacctggctggcgaagagattgcctcctatagcatagtggggcccgcgaatgcaaaggtacctcattcggcctcttccgataccctctcattaatcgcttacagtgggattccaagctattcctctctgagcatccttacatcaagtaccgacgccaaacacgttttctcccccggcttgttccctaagctgaaccatacgaattgcgacaaaagcgcaataccactaacttggacaggtatgattgatctccccgggtactacgaagctatccacccgtgtaccgtgttttgcgtcctgtctggacctggcgcctcatgtgaggcgttcagtgagggcgggatcttcaacattactagccccatgtgccttgtgtccaagcaaaataggtttcggctgacagaacagcaggtcaacttcgtgtgtcagcgcgttgacatggatatcgtggtatattgcaacggacaaagaaaggtcattttgaccaaaacgctcgtgataggtcagtgtatctacaccattacatctctgttttcgttactgccaggcgttgcccacagcatcgcagtggagctctgcgtccctgggttccatggatgggctactgccgcccttctggtgaccttttgtttcggctgggtattgatccccgctgtgacatttattatactaactgttctgaagttcatcgcaaatatttttcacacctccaaccaggaaaataggctcaaatcagtcctgcggaagatcaaagaggaatttgagaagacaaagggtagtatggtgtgcgacgtgtgtaaatatgagtgcgaaacctacaaggagcttaaagcccatggggtctcttgcccacaaagccagtgtccctattgctttactcactgtgaacctacggaggctgcgttccaggcacattacaaggtttgccaggtgacacaccgctttcgagatgacctgaaaaagaccgtgactccacaaaacttcaccccgggctgttatagaacattgaatctcttcaggtacaagtcccggtgctacatttttaccatgtgggtattcctgttaatcctggaatcagtcctatgggccgctagcgcctctgagactcccctcacacctgtgtggaacgataatgcacacggagttggctccgtgccaatgcatacggacctggagcttgattttagtttgaccagttcttccaaatatacttaccgtcgcaagctgacaaaccccctcgaagaggcccagtcaatagacctgcacatcgaaattgaggagcagaccatcggggtcgatgtgcatgctcttggacactggttcgacggtagactgaatttgaaaacaagttttcactgttatggcgcctgcactaagtacgaatatccttggcataccgcaaaatgtcactacgagagggactatcagtacgaaacgagctgggggtgcaacccatcggattgtcccggagttggcaccggttgcacagcgtgcgggctctacctggaccaattaaagccggtgggctccgcttataagattatcactatacggtactctcgacgcgtatgtgtccagttcggagaggaaaatctgtgcaaaattatcgatatgaacgactgttttgtgagcagacatgtgaaggtctgcattatcggcaccgtttcaaaattcagtcagggggatacactactctttttcggacctctggagggtggcgggcttatatttaagcactggtgtacttctacctgccagttcggagacccaggcgatatcatgtcccccagggacaaaggttttctctgtcctgagttccccgggagcttccggaagaaatgcaattttgccacgacaccaatttgtgaatatgatggcaacatggtgtccggatacaagaaggtaatggcaaccatcgactcattccagagctttaatactagcacaatgcatttcaccgatgagcgcattgaatggaaagaccctgatggcatgctgagagaccacatcaacatactcgtgactaaggacattgattttgacaacctgggggagaatccctgcaaaatcggattacaaacctcttccatcgaaggcgcctggggtagcggggtcggattcacactgacgtgtcttgtgtcgttgaccgagtgcccaacttttctcacatcaattaaggcttgcgataaagccatctgttatggcgcagagtctgttaccctgacaaggggtcagaacactgtgcgtgtcagtggcaagggaggacactccggcagcaccttcaagtgctgtcatggggaagactgctctaaaattggactacacgctgccgcgccgcatctggataaggtgaatggcataagcgagatcgaaaactccaaagtttacgacgatggtgcccctcagtgtgggattaagtgctggtttgtgaaatcaggagagtggatcagtggcattttcagcggtaattggatcgtcctcatagtactgtgtgtgtttcttttgttctctctggttttactctccatcctgtgccccgtgcggaagcacaagaaatcatga

SEQ ID NO: 10082 - RNA, 3408 nt, synthetic construct
  misc_feature 1..3408: note = derived and/or modified CDS sequence (opt3) from HTNV(HubeiHu02)__JQ665881.1__GP
  source 1..3408: mol_type = other RNA
atgggcatctggaagtggctggtgatggccagcctcgtctggcccgctttcgcacttagaaacgtttacgacatgaaaattgagtgccctcacaccgtgtcctttggggaaaattctgtaataggatatgtggagctgccaccgatgcccttggccgatacagcgcagatggtccctgaatcaagttgtagcatggacaaccatcaatccttaaatactatcacgaagtacacccagattgtgtggaggggtaaagctgatcagtctcagtcgtcacaaaacagcttcgagacagttagtactgaagtggacctgaagggcacatgcgtcctaaaacacaagatggtggaggagtcctatcggtctcgcaagagcatcacatgttacgatctctcctgcaattcaacctattgtaaaccaactctgtacatgattgtacccatccatgcctgcaacatgatgaagagttgtcttatagcactggggccttatcgagttcaggtggtctacgaacgtacatactgcatgaccggagtgttgatcgagggcaaatgttttgtgccagaccagagcgtcgtttctattatcaagcacggtattttcgatatcgcctccgtgcatatagtatgctttttcgtggctgtcaaagggtcaacgtataagctctttgaacaggtgaagaaaagtttcgagagcaattgtaacgacactgagaataaggttcaaggacactacatttgcatcgtgggcggcaactctgcacccatttatgtccctaccctggatgactttagatccatggaagccttcagcgggatctttaaatcgccacacggagaggatcatgacctggctggtgaagaggtggcctcttactccatcgtaggcccggcgaatgcaaaggttccccactcagccagtagcgatacactctccttaattgcttattctgggatacctagctactcaagtctgtccatccttactagcttgaccgaagccaaacatgtgttctctccaggactgtttccccagctaaaccacacaaagtgcgacaaaaccgcaattcctctcacgtggactggcatgatcgacctgccaggttattacgaggctgtccacccctgtacagtgttctgcgtcctttcagggccgggagccagttgtgaggcgttcagcgaaggcggcatactgaatattacctcccctatgtgcttggtgtctaagcagaacaggtttcggctcactgagcagcaagttaatttcgtgtgtcagcgcgtagatgtcgacatcgtggtttactgcaacgggcagagaaaggtgatcctgacaaaaaccttagtcattggacaatgtatctatacgattacctcgctgtttagcctccttcccggtgtggcccattccatagcagtagaactgtgcgtgccaggcttccacgggtgggctacagccgctttgctagttactttttgtttcggatgggtcctgatccctgccattacctttatcatcctcacaattctgaagttcatagcaaacatctttcatacttcaaatcaggagaacaggcttaaaagtgtgctgcggaagattaaagaagagttcgagcgcaccaagggctctatggtgtgcgatgtctgtaagtacgaatgcgagacatataaagaattgaaggcccacggtgttagctgcccccagtcccagtgtccatactgctttacccattgtgagcccactgaagctgcgttccaagcacactataaagtgtgccaggtgacgcaccgatttagagacgatctcaagaaaacagtaacccctcagaatttcactccagggtgttacaggaccctgaacttattccggtataagtcacgttgctacatctttacaatgtgggtcttcctgctagtgctcgagagcattctgtgggccgcttctgcctccgagaccccgcttaatcccgtttggaacgacaatgcacatggcgtgggaagtgtccctatgcacactgatttggaactggactttagcctcacatcttcctcaaagtacacgtatcgcagaaaactgaccaacccacttgaggaaagtcaggccatcaatctgcatatagagatcgaggaacaaactattggcgtggatgttcacgctttggggcactggttcgacggaaggctcaacctgaagaccagctttcattgttacggtgcctgcaccaaatatgagtacccctggcacacagcaaagtgtcattatgaacgggattaccagtatgagacttcgtggggctgcaatccttccgactgtccaggggtgggaaccggctgcacggcgtgcggtttatacctggaccagctaaaacccgtagggtctgcttacaagatcattaccatccgatatagccgcagagtctgtgtgcagttcggcgaagagaacctctgcaagataattgatatgaatgactgttttgtgtcaaggcacgtcaaagtttgcatcattggaacagtgagtaagttctcccaaggcgatactctgcttttcttcgggccgttggagggaggtggcctgatctttaaacattggtgtacctctacatgccagttcggggaccctggagatataatgagcccacgggacaagggctttctctgtcccgaatttcctggttccttccgcaaaaagtgcaactttgccactacccccatctgtgagtacgatgggaatatggtatcaggctataaaaaggtgatggcaacgattgacagcttccagagttttaacacatctaccatgcacttcactgatgaaagaatcgagtggaaggacccagatggaatgctgagggaccacatttccatcttagtcacaaaagatatagactttgacaacctgggcgaaaatccttgcaagattgggcttcagaccagctcgatcgagggagcctggggctcaggtgtggggtacactttgacctgtctcatctctctgacagagtgccccacgttcctaaccagtattaaggcttgcgataaggccatctgttatggagcagaatccgttactctgacacgtggccaaaacaccgtgaaagtcagcggtaagggcgggcattctggaagctcctttaagtgctgtcacggcgaggactgctcacagattgggctccatgctgccgcgccacacctggataaagtgaatggaataagtgaaatcgagaacagcaaggttttcgacgatggcgccccgcagtgtggtattaaatgctggtttgtgaagtctggggaatggatctccggaattttcaatggcaactggatcgtccttatagtattgtgtgtgtttctgttattctcactcgttctgcttagtatcctgtgccctgtgcggaaacataaaaagagctga

SEQ ID NO: 10083 - RNA, 3408 nt, synthetic construct
  misc_feature 1..3408: note = derived and/or modified CDS sequence (opt3) from HTNV(HV004)__JQ083394.1__GP
  source 1..3408: mol_type = other RNA
atgggcatctggaagtggctggtgatggccagcctcgtctggcccgctttcgcacttagaaacgtttacgacatgaaaattgagtgccctcacaccgtgtcctttggggaaaattctgtaataggatatgtggagctgccaccgatgcccttggccgatacagcgcagatggtccctgaatcaagttgtagcatggacaaccatcaatccttaaatactatcacgaagtacacccagattatctggaggggtaaagctgatcagtctcagtcgtcacaaaacagcttcgagacagtgagtactgaagttgacctgaaggggacctgcgtgctaaaacacaagatggtcgaggagtcctatcggtctcgcaagagcattacatgttacgatctctcctgcaattcaacctattgtaaaccaactctgtacatgatcgtgcccatacatgcctgcaacatgatgaagagttgtcttatcgcactgggcccttatcgagtacaggttgtgtacgaacgtacatactgcatgaccggagtcttgattgagggcaaatgttttgtgccagaccagagcgtggtctctatcattaagcacggtatcttcgatatagcctccgttcatattgtgtgctttttcgtagctgtgaaagggtcaacgtataagctctttgaacaggtcaagaaaagtttcgagagtaattgtaacgacactgagaataaggtgcaaggatactatatctgcattgttggcggcaactctgcacccatctacgtgcctaccctggatgactttagatccatggaagccttcagcgggatctttaaatcgccacacggagaggatcacgacctggctggtgaagaggtcgcctcttattccattgtgggcccggcgaatgcaaaggtaccccattcagccagtagcgatacactctccttaatagcttactctgggatccctagctattcaagtctgtccattcttactagctctaccgaagccaaacacgttttctcaccaggattgtttccccagctgaaccatacaaagtgcgacaaaaccgcaatccctctaacgtggactggcatgatagacctcccaggttactacgaggctattcacccctgtacagtgttctgcgtcctgagtgggccgggagccagctgtgaggcgttctccgaaggcggcatctttaatatcacctctcctatgtgccttgtgtcgaagcagaacaggttccggctgactgagcagcaagtcaattttgtgtgtcagcgcgttgatgtggacattgtagtctattgcaacgggcagagaaaggtgatcttgacaaaaaccctcgttattggacaatgtatatacacgatcaccagcctgttctccttactgcccggtgtggcccactcaattgcagtcgaactctgcgtgccaggctttcatgggtgggctacagccgcccttctggtaactttctgttttggatgggtgttgatccctgctatcaccttcattatactaacaatcctgaagtttattgcaaacatcttccacactagcaatcaggagaacaaactcaagtctgttctgaggaaaattaaggaagagtttgagcggaccaagggcagcatggtctgcgatgtgtgtaaatatgaatgcgagacatacaaggaacttaaagcccatggtgtgtcctgcccccagtcacagtgtccatattgcttcacccactgtgagcccactgaagctgcgtttcaagcacattacaaggtctgccaggttacgcaccgcttccgagacgatctgaaaaagacagtgacccctcagaatttcactccagggtgttatagaaccttgaacctctttaggtacaagagccggtgctacatcttcacaatgtgggtgtttctgttagtactggagtctatactatgggccgcttccgccagtgagaccccgctcaatcccgtctggaacgacaatgcacacggcgtgggaagcgttcctatgcatactgatctggaacttgacttctctttgacatcctcaagtaaatatacgtaccgtcgcaagctgaccaacccactcgaggaaagccaggccatcaatctgcacattgagatcgaggaacaaactattggcgtggatgtccatgctcttgggcactggtttgacggaagactgaacttgaaaacatcgttccactgttatggtgcctgcaccaagtacgagtatccctggcatacagcaaaatgtcactacgaaagggattatcagtacgagacttcctggggctgcaatccttctgactgtccaggggtgggaaccggctgcacggcgtgcggtctctacctggaccagttaaagcccgttgggagcgcttataagatcataaccattcggtactcacgacgcgtgtgtgtacagtttggcgaagagaacctgtgcaaaatcattgatatgaatgactgtttcgtcagtagacatgtgaaggtgtgcatcataggaacagtctccaaattttctcaaggcgatactctactcttctttgggccgctggagggaggtggccttatcttcaagcactggtgtaccagcacatgccagtttggggaccctggagatattatgtccccaagggacaaaggcttcttgtgtcccgagttccctggttcatttcggaagaaatgcaacttcgccactacccccatctgtgaatatgatgggaatatggttagcggctacaagaaggtgatggcaacgattgacagttttcagtctttcaacacatccaccatgcattttactgatgaacgcatcgagtggaaagacccagatggaatgctgagagaccacataaacattctcgtaacaaaggatatcgacttcgacaatctgggcgaaaacccttgcaaaatcgggttacagaccagctcgattgagggagcctggggctcaggtgtggggtttactctgacctgtcttatctctttgacagagtgccccacgttcctcaccagtattaaggcttgcgataaagccatatgttatggagcagaatccgtcactctgacaaggggccaaaataccgtgaaggttagcggtaagggcgggcactctggaagctcctttaaatgctgtcatggcgaggactgctcacagatcgggctacacgctgccgcgccacatctggataaggtgaacggaattagtgaaatcgagaatagcaaagtcttcgacgatggcgccccgcagtgtggtattaagtgctggtttgtgaaatctggggaatggatctccggaatattcaacggcaattggatcgttctcattgtgctgtgtgtcttccttttgttttcactggtattactcagtatcctgtgccctgtgcgtaagcacaagaaaagctga

SEQ ID NO: 10084 - RNA, 3405 nt, synthetic construct
  misc_feature 1..3405: note = derived and/or modified CDS sequence (opt3) from HTNV(NC167)__AB027115.2__GP
  source 1..3405: mol_type = other RNA
atgtggggcctgctcgtggtcgccgggcttatcggaccctgcattagcctgagaaacgtttacgacatgaagatagagtgtcctcacaccgtgaatttcggtgaaaactccgtaatcggctatgtggagttgccaccggtccccattgctgatatcacacagatggtgcctgaatcttcatgcaatatggacaaccatcaaagtttaagcacttttacgaaatacacccagctgatttggaggaagaaagcagagcaggcccaggcgtcccaaaattctttcgaaacagtttcgcgggaggtggattttaaggggacttgtgtcttcaaacacaagatggtggaggaatcatataagaaccgcaaaagcatcatatgctacgacctaagttgtaatatcacccattgcaagccaacactctatatgattatccccgtacacgcttgtaacatgatgaaatcctgcctgattgcccttggaccttttcgagttcaggtggtctacgagcgtacctattgtatgtctggcatcctgactgaaggtagatgcttcgtgccataccagagcgtggtctccataattaagcatgggatctttgatattgcatcaatccacatcatttgtttctttatagccgttgagggaaatacatacaaattgttcgaggaagtgaagaagagttttgctctcaactgcaatgacaccgagaacaaaatccagggctattacatttgcatcataggcgggaatagcgcacccgtatatgccccttctccagatgacttcaggtccatggaggctttttcaggaattttccggagcccgcacggtgaaaaccatgatctgaatggcgggcgcaacgccccctacagtatcgtgggacctacggacggcaaggtcccacactcttccaaacattataacatcgagttcgatagcatttttcaaaagttccccacttactcgtctttttccatcctggcgggttcagtggaacctaaacacgttttccagccagggctctttcccaagttaaatcacaccaaatgtacaaagagtgcaattccgctggtgtggactggaagaatagacatccctggctattacgaggccgtccatccccttaccgtgtactgcgaattgagcggcccaggggcttcctgtgaggccttctctgaaggaggtatttttaacatcacaagccctatgtgcctggtatcaaagcagaataggttccggagtctacgccagcaagtttcctttgtgtgtcagcgagtcgatatggacatcgtggtctattgcaacggccagaaaaagaccattctcacgaaaactctggtgatagggcaatgtatctacacaattaccagccttttctctctgttgccctcagttgcacacagtatcgctgtggagctctgcgtaccaggatttcatggctgggccactgcggccctgttaattacattctgttttggttgggtcctgatccccgcactcaccttcataatccttacgattctgaagttcatcgctaatatttttcacaccagcaaccaggaaaataaattgaaggccgtgctaagaaagatcaaagaggagttcgaaaagacaaaagggtccatggtttgcgacatatgtaagtatgagtgcgatacttacaaagaactgaaggctcatggcctctcttgccctcagtcgcagtgtccatattgctttacccactgtgagccgacagaaagcgccttccaagcacactacaaggtgtgccaggtcactcataggtttcgggaggagctgaaaaagaccgtgacaccccagaacttcacccctggatgttatcgtactcttaatctgtttcgctacaaatccagatgctacattttcacgatgtggatcttgctcctggtatttgaatcaattttatgggccgctagtgcgtctgacgtgccactgagcacagattggaacgacaatgcacacggcgttgggtccgtccccatgcataccgatctagagctcgacttctcactgacttctagctccaagtatacctacaggcggaaacttacaaaccctgtggataccagtcaggccgtggacttgcacatcgaactggaggagcaaactataggactcgatgtccacgctctgggtcattggtttgacggccgacttaatctgaagactagcttccactgttatggggcctgcacgaagtacgaatatccatggcataccgcaaaatgtcactttgagcgcgatttccagtacgaaacttcttggggatgcaatcccccggactgtcctggcgttggtacagggtgcaccgcctgcggcttgtatatcgaccagctcagaccagtgggaaacgcttacaagattatcacaattaggtactcccggaaagtgtgtgtacagttcggcgatgagaacctgtgcaagactatcgacatgaacgattgttttgtctcaaaacatgtgaaggtttgcataattgggaccgtgagtaaattcagccaaggagacacgttactgtttctaggtcccatggaaggcgggggaatcatcttcaagcactggtgtacctcgacatgccagtttggcgatcctggtgacattatgtcccccaaggataaagggttctcttgtccagagtttagcggctcattccgcaagaaatgcaattttgccactacccctgcatgtgagtatggaggcaacatggtcagtgggtacagaaaggtgatggcgacaatcgactccttccaggcttttaatacttctaccattcacttcacggatgaaaggatagagtggaaagaccccgatggaatgctccgtgaccatatcaacattctggttacacgggatatcgacttcgacaatcttgccgaaaacccatgcaagattggcttgcaagtgagcgcaatcgagggtgcctgggggtccggagtaggctttaccctgacttgtcaggtctcactcacagaatgcagcaccttcctgacaagtataaaggcttgcgataaagccatctgttatggtgcacagtctgtgaccttagtgcgaggccagaatacagtcaagatttccgggaaaggaggccacagcgggtcggcttttaagtgctgtcatggagaggactgctcacaaacgggcctgcaggccgatgcgccgcaccttgacaaagttaacggtatctctgaggtggaaaatgataaggtatacgacgatggggcccctgagtgtggaattaagtgctggttcgtgaaaagtggcgaatgggtcgctggtatcttttccggcaactggatagtgttggttgtgctctgtattttcctgatcatcagcctaattctgctctctatactgtgccccgtcagaaagcataaaaagagctga

SEQ ID NO: 10085 - RNA, 3408 nt, synthetic construct
  misc_feature 1..3408: note = derived and/or modified CDS sequence (opt3) from HTNV(WuhanAaJ10)__JQ665882.1__GP
  source 1..3408: mol_type = other RNA
atgggcatctggaagtggctggtgatggccagcctcgtctggcccgctttcgcacttagaaacgtttacgacatgaaaattgagtgccctcacaccgtgtcctttggggaaaattctgtaataggatatgtggagctgccaccgatgcccttggccgatacagcgcagatggtccctgaatcaagttgtagcatggacaaccatcaatccttaaatactatcacgaagtacacccagattatctggaggggtaaagctgatcagtctcagtcgtcacaaaacagcttcgagacagtgagtactgaagttgacctgaaggggacctgcgtgctaaaacacaagatggtcgaggagtcctatcggtctcgcaagagcattacatgttacgatctctcctgcaattcaacctattgtaaaccagccctgtacatgatcgtgcccatacatgcatgcaacatgatgaagagttgtcttatcgccctgggcccttatcgagtacaggttgtgtacgaacgtacttactgcatgacaggagtcttgattgagggcaaatgttttgtgccagaccagagcgtggtctctatcattaagcacggtatcttcgatatagcttccgttcataccgtgtgctttttcgtagcagtgaaagggtcaacgtataagctctttgaacaggccaagaaatctttccaaagtaattgtaacgacactgagaataaggtccagggatactatatttgcatcgtgggcggcagctccgctcccatttacgttcctaccctggatgactttagaagcatggaggccttctcggggctgtttaaatctccacacggagaagatcacgacctcgcgggtgaggaagtggcatcctattcaatcgtcggcccggccaacgctaaggtgccccatagtgccagctccgatacattatctctgatcgcatacagcgggattccttcatatagttcccttagcatattgacttcttcaaccgaggctaaacacgtattcagtccaggactgtttccccagctaaatcatacaaagtgcgacaaaaccgccatccctctcacgtggactggcatgattgacctgccaggttactacgaagcggttcacccctgtacagtgttctgcgtccttagcgggccgggagcctcctgtgaggcattctctgagggcggcatctttaacataacctcgcctatgtgcctggtgagcaagcagaataggttccggttgactgaacaacaggtcaactttgtgtgtcagcgcgttgatgtggacattatcgtatattgcaatgggcaaagaaaggtcatcctcacaaaaaccctggtgattggacagtgtatctacacgattacctccttaatatcactgctccccggtgttgctcacagtatcgccgtggagctttgcgtcccaggctctcatgggtgggctacagccgcactgttggtgactttctgttttggatgggtactaattcctgccatcaccttcatcattctgacaatactcaagtttatcgctaacattttccacactagcaaccaggaaaataggctgaaatccgtgcttcggaagatcaaagaggaatttgagcgcaccaagggctcaatggtttgcgatgtctgtaagtatgagtgcgaaacatacaaagagctgaaggcgcatggtgtgagctgcccccagtctcaatgtccatattgcttcacccactgtgaacccactgaggcagcctttcaggctcattacaaagtgtgccaggtcacgcaccgattcagagacgatttgaagaaaacagttacccctcagaactttactccagggtgttataggaccctcaatctgttccggtacaagtcccgttgctacattttcacaatgtgggtgtttttactggtgctagaaagtatcctctgggccgcaagcgcctctgagaccccgctgaaccccgtatggaatgacaacgctcacggcgtcggatccgtgcctatgcatactgatcttgagttggacttctcactgacaagtagctcgaagtatacgtaccgcagaaaactcaccaatccactggaagagtcccaagccatagatcttcacatcgaaattgaggaccagactatcggcgttgatgtgcatgcactggggcactggtttgacggaaggttgaacctcgagacatctttccactgttatggtgcgtgcaccaagtacgaatatccctggcatacagctaaatgtcactacgagcgggactatcagtacgaaactagctggggctgctcacctagtgattgtccaggggtcggaaccggctgcacggcctgcggtctgtacttagaccagctgaagcccgtggggtccgcatataaaattatcaccatacgatactctcgcagagtttgtgtgcaaagcggcgaggaaaatctatgcaagattatcgatatgaacgactgttttgtatccaggcatgtcaaggtgtgcattatcggaacagtgtcaaaattcagccagggcgatactctcctgtttttcgggccgcttgagggaggtggcttgatatttaagcactggtgtaccagtacatgccagttcggggaccctggagatatcatgtctccacgggacaaaggctttctgtgtcccgagttccctggttcctttcgcaagaaatgcaatttcgccactacccccatttgtgaatatgatgggaacatggtcagcggctacaagaaagttatggctacgatcgactcgttccagtcatttaatacatctaccatgcatttcactgatgagagaattgaatggaaggacagggatggaatgctccgtgaccacatcaacatactggtgacaaaggacattgattttgacaatttaggcgagaacccatgcaaaatcgggctgcaaaccagttccatcgaaggagcctggggcagcggtgtagggttcactcttacctgtttgatttctctcacagagtgccctacgtttctgaccagcatcaaggcatgcgataaagctatttgttatggagccgagtccgtgactctaacacggggccagaacaccgtcaaggtgtcaggtaaaggcgggcacagtggaagctctttcaagtgctgtcatggcgaagactgctcccagatagggctgcacgcggccgctccccatctcgataaggttaatggaatctcagagattgaaaacagtaaagtgtttgacgatggcgcaccacaatgtggtatcaagtgctggagcgtcaaatccggggagtggatttctggaatcttctcgggcaattggatagtgctgatcgttctttgtgtgtttttgctgttcagcttagtcctcctgtcaattctttgcccggtacgaaagcacaaaaagtcctga

SEQ ID NO: 10086 - RNA, 3408 nt, synthetic construct
  misc_feature 1..3408: note = derived and/or modified CDS sequence (opt3) from HTNV(Z5)__EU074224.1__GP
  source 1..3408: mol_type = other RNA
atgggcatctggaagtggctggtgatggccagcctcgtctggcccgcttgcacccttagaaacgtttacgacatgaaaattgagtgtcctcacacagtgtccttcggggaaaattctgtaataggatatgtggagctgccaccgatgcccttggcagatactgcccagttagtccctgaatcaagttgcaacatggacaatcatcaaagcatgaacacgatcaccaagtacacacaggtgtcctggaggtctaaagttgatcaggcgcaggcttcgcaaaattcatttgaggccgtgagcgcagaagtcgacctgaagggtacttgtgtgctaaaacacaagatgctcgaggagagttatcggtcccgcaagtctattacctgctacgatctgagctgtaactccacatattgcaaaccaaccctttacatgatcgtacccattcatgcctgtaatatgatgaagggctgcctgatcgctttggggccttatcgagttcaggtggtctacgaacgtacttactgtatgacaggagtgctcatagagggcaaatgcttcgtgccagaccagtcagtcgttagtatcattaagcacggtatctttgatattgcaagcgtgcatatcgtatgtttctttgtggccgtcaaagggaacacctataagctgttcgaacaggtgaagaaatcttttcaatccacgtgcaatgacactgagaacaaggttcagggatactatatatgcattgtgggcggcaattcagctcccatctgtgtccctaccctggatgacttcagaagcatggaggcctttagtgggattttcaggtctccacacggagaagatcacgacctcgcgggtgaggaaatcgcatcctacagcatcgtgggcccggccaacgctaaagtaccccattcggcctcttccgatacattatcactgattgcatatagtgggatacctagctactcctctcttagcatcttggctggatcaactgaggccaagcacgtttttagtccaggcttctttccccagctgaatcataccaaatgcgacaagacagcgattcctctaacctggacgggtatgatcgacctcccagggtattacgaagccatacacccctgtactgtgttctgcgtcctgtccggaccgggcgcaagctgtgaggctttctctgagggcgggatttttaacatcacatcacctatgtgccttgtgagtaaacagaatcggttccgcctgaccgaacaacaggtcaactttgtgtgtcagagagttgatatggacatcattgtgtactgcaacggacaaaggaaggtaatcttgactaagacactcgtcattggtcagtgtatatataccatcacgagcctgttctccttactgcccggcgtggcccactctattgctgttgagctctgcgtgccagggtttcatggatgggccaccgcagcccttctggtcacattctgttttggctgggtgttgatccctgctatcactttcgtaattctaaccatactgaaatttatcgcgaatattttccacacatcgaaccagggtaatcggctcaagagcgtgctgaaaaagatcaaagaagagtttgaaaagactaaggggtccatggtttgcgatgtctgcaaatacgagtgtgagacctataaggaacttaaagcacatggcgtgtcatgcccccagagtcaatgtccatactgcttcacacactgtgagcccaccgaagccgcttttcaggcccattatcgcgtgtgccaggtcactcaccgattcagagacgatctgaagaaaacggttacacctcagaacttcaccccaggatgttacaggactttgaatctctttcggtataagtctcgttgctacattttcaccatgtgggtgtgtctgttagtgctggagagcatcctatgggcagcctccgcttcagaagtaccgctcaaccccatatggaatgacaacgcccacggcgtcgggagcgtgcctatgcatacagatctggagcttgacttttctttgacctccagtagcaagtacacttatcgcagaaggctgacaaatccactcgaggaaacgcaagcaatcaacctgcacattgagatcgaggaacagaccattggagttgatgtgcatgcgcttggtcactggttcgacggccggctgaatttgaaaacttcttttcactgctacggggcttgtacaaagtatgagtacccctggcataccgccaaatgccactatgaacgagattaccagtatgagacatcctggggatgcaaccctgcagactgtccaggcgtcggtactgggtgcaccgcctgtggcctctacctggaccagttaaagcccgtgggatcagcttacaaaatcataacgattcgctatagtagaaaggtttgcgtgcaattcggcgaagagaatctgtgtaaggtaatcgatatgaacgactgctttgtcagcaggcatgtgaaagtgtgtattatcgggaccgtctcgaagttctcccagggagatacactactctttttcggtccgctggaaggcgggggacttatatttaaacactggtgcacttctacctgtcagttcggcgaccctggtgatatcatgagcccacgggacaaggggtttttgtgccccgagttccctggctcattccgcaaaaagtgtaattttgccacaactcccctgtgcgagtacgatggaaacatggttagtggctataaaaaggtgatggcaaccattgactccttccagtcttttaacacgagcacaatgcatttcaccgatgaaagaatcgagtggaaggacccagatgggatgctcagggaccacattaatatcctggtaactaaagatatagactttgacaacttaggagaaaatccttgcaaggtgggcctgcaaacatcctcaattgagggtgcttgggggagcggagtcggcttcacccttacttgtttggtgagtctcaccgaatgccccacatttctgacgtctatcaaagcctgtgataaggcgatctgctacggtgccgagtccgttaccctaactcgtggccagaacacagtgaaagtcagcgggaagggaggccactcggggtcaaccttcaagtgttgccatggagaggaatgttctcagattggcctgcacgctgcagccccacatctcgacaaagtgaatggtatcagtgagattgaaaacaataaggtttatgatgacggggctccgcaatgcggagtgaaatgttggtttgtcaagtccggcgagtggataagcggtatcttctctggcaactggattgtactgatcgtgctttgcgtgtttttgctgttcagcttagccctcctgtccgttctttgtcctgtccggcgacacaaaaagtcatga

SEQ ID NO: 10087 - RNA, 3408 nt, synthetic construct
  misc_feature 1..3408: note = derived and/or modified CDS sequence (opt3) from HTNV(ZLS-12)__FJ753399.1__GP
  source 1..3408: mol_type = other RNA
atgggcatctggaagtggctgattatggccagcctcgtgtggcccgcttacacccttagaaacgtctatgacatgaggatagagtgccctcacacagtttccttcggggaaaattctgtgatcggatacgtagagctgccaccgatgcccttggcagatacttcacagatggtgcctgaaagtagctgttccatggacaaccatcaatctttaaatacgattaccaaatatacacaggtctcgtggcggggtaaggccgatcagtcacaggcgagccaaaacagttttgaggctgtgtccgccgaagttgacctgaaaggcacttgcgtgctaaagcacaaaatgctcgaggagtcttaccgcagccgaaagtccatcacctgttatgatctgtcatgcaatagtacatactgtaagccaaccctttatatgattgtccccatccatgcatgcaacatgatgaaaagctgtctgatagccttggggccttaccgtgtgcaggtagtttacgaaagaacttattgcatgacaggaatcctcattgagggcaagtgtttcgtgccagaccagtctgtcgtgtccatcattaaacacggtatctttgatatagcttcagtgcatattgtctgcttctttgttgcagtgaaggggaatacctacaaactgttcgaacaggtaaagaagagttttcaaagcacgtgtaacgacactgaggataaagtgcagggatattacatctgcattgccggcggcaattctgctcccatctatgtccctaccctggacgatttcaggtccatggaggcctttagcgggatcttcaagtcgccacacggagaagaccacgatctcgcgggtgaggaaattgcatcttactccatagtgggcccggccaacgctaaagttccccattcagccagtagcgacacattatccctgactgcatattctgggatccctagctactcaagtctttccattttgaccagctctacagaggctaagcacgtgttttcaccaggattctttccccagctgaatcataccaaatgcgacaagacggccatccctctaatgtggactggcatgatagatctcccaggttactatgaagcgattcacccctgtacagtcttctgcgtgctgagtgggccgggagccagctgtgaggcattctccgagggcggcatctttaacatcacctctcctatgtgccttgtatcgaaacagaatcggttccgcctgactgaacaacaggttaactttgtgtgtcagagagtcgacatggatattgtggtctactgcaatgggcaaaggaaggtgatcttgacaaagaccctcgttattggacagtgtatatatacgatcaccagcctgttctccttactgcccggtgtggctcactcaattgccgtagagctctgcgtcccaggctttcatgggtgggctacagccgcacttctggtgactttctgttttggatgggttttgatccctgccatcaccttcattatactaacaatcctgaaatttattgctaacatcttccacaccagtaaccaggaaaatcggctcaagtctgtgctgcgcaaaattaaggaggaatttgagaaaaccaagggcagcatggtctgcgacgtgtgtaagtacgagtgcgaaacatataaagagcttaaggcgcatggtgtatcctgcccccagtcacaatgtccatactgcttcacccactgtgaacccactgaggcagcctttcaggctcattatcgagtgtgccaggttacgcacagattcagggatgacctgaaaaagacagtcacccctcagaacttcactccagggtgttaccggaccttgaatctctttcgttacaaaagccgctgctatatcttcacaatgtgggtgtttctgttagtgctggaatctatactatgggccgcatccgccagtgaggtcccgctcagccccgtttggaacgataatgctcacggcgtgggatctatccctatgcataccgacctggagcttgatttctccttgacttcaagtagcaagtacacatatagaaggaagctgacgaacccactcgaagagacccaagccattaatctgcacatcgaaattgaggagcagactatcggcgtggacgtacatgcacttgggcactggtttgatggacggctgaacttgaaaacatcgttccactgttacggtgcgtgcaccaagtatgaatacccctggcatacagctaaatgtcactatgagcgagactaccagtacgaaacttcctggggctgcaatcctgccgactgtccaggggtcggaaccggctgcacggcatgcggtctctatctggatcagttaaagcccgtggggtctgcctacaaaataattaccatccgctatagcagaagggtttgtgtgcaactgggcgaggaaaacctatgcaagattatcgacatgaatgattgttttgtctcacggcatgtgaaggtttgcataatcggaacagtgagtaaattctcccagggcgacactctcctgtttttcgggccgcttgagggaggtggcttgatttttaagcactggtgtacctctacatgccagttcggggatcctggagacatcatgagcccacgcgataaaggctttctgtgtcccgagttccctggttccttcagaaagaaatgcaactttgctactactcccctctgtgaatacgacgggaatatggtatcaggctataagaaagtcatggccacgattgatagcttccagagttttaacacatctaccatgcatttcactgacgagaggatcaagtggaaggatccagacggaatgctgcgtgatcacataaatattttagtgacaaaagacatcgactttgataacctgggcgaaaacccttgcaagatcgggcttcaaacctccgcaattgagggagcttggggcagcggtgtggggttcactttgacctgtctcgtctcgctgacagaatgccccacgtttctaacctcaatcaaagcctgcgacaaggcgatttgttacggagccgagtctgttactctgacacggggccagaataccgtgaaagtaagtggtaagggcgggcactccggaagcctcttcaagtgctgtcatggcgaggaatgctctcagatagggctgcacgctgcagccccacatcttgataaagtgaacggaatcagcgagattgaaaataacaaggtctatgacgatggcgctccgcaatgtggtgtgaaatgctggtttgttaagtccggggagtggatctcaggaattttcagtggcaattggatcgtgttgatagtcctgtgtgtgtttttactcttcagcctggttcttctgtctgtgttgtgccctgtccgaaaacacaagaagtcctga

SEQ ID NO: 10088 - RNA, 3408 nt, synthetic construct
  misc_feature 1..3408: note = derived and/or modified CDS sequence (opt3) from HTNV(ZLS6-11)__FJ753397.1__GP
  source 1..3408: mol_type = other RNA
atgggcatctggaagtggctgattatggccagcctcgtgtggcccgcttacacccttagaaacgtctatgacatgaggatagagtgccctcacacagtttccttcggggaaaattctgtgatcggatacgtagagctgccaccgatgcccttggcagatacttcacagatggtgcctgaaagtagctgttccatggacaaccatcaatctttaaatacgattaccaaatatacacaggtctcgtggcggggtaaggccgatcagtcacaggcgagccaaaacagttttgaggctgtgtccgccgaagttgacctgaaaggcacttgcgtgctaaagcacaaaatgctcgaggagtcttaccgcagccgaaagtccatcacctgttatgatctgtcatgcaatagtacatactgtaagccaaccctttatatgattgtccccatccatgcatgcaacatgatgaaaagctgtctgatagccttggggccttaccgtgtgcaggtagtttacgaaagaacttattgcatgacaggaatcctcattgagggcaagtgtttcgtgccagaccagtctgtcgtgtccatcattaaacacggtatctttgatatagcttcagtgcatattgtctgcttctttgttgcagtgaaggggaatacctacaaactgttcgaacaggtaaagaagagttttcaaagcacgtgtaacgacactgaggataaagtgcagggatattacatctgcattgccggcggcaattctgctcccatctatgtccctaccctggacgatttcaggtccatggaggcctttagcgggatcttcaagtcgccacacggagaagaccacgatctcgcgggtgaggaaattgcatcttactccatagtgggcccggccaacgctaaagttccccattcagccagtagcgacacattatccctgactgcatattctgggatccctagctactcaagtctttccattttgaccagctctacagaggctaagcacgtgttttcaccaggattctttccccagctgaatcataccaaatgcgacaagacggccatccctctaatgtggactggcatgatagatctcccaggttactatgaagcgattcacccctgtacagtcttctgcgtgctgagtgggccgggagccagctgtgaggcattctccgagggcggcatctttaacatcacctctcctatgtgccttgtatcgaaacagaatcggttccgcctgactgaacaacaggttaactttgtgtgtcagagagtcgacatggatattgtggtctactgcaatgggcaaaggaaggtgatcttgacaaagaccctcgttattggacagtgtatatatacgatcaccagcctgttctccttactgcccggtgtggctcactcaattgccgtagagctctgcgtcccaggctttcatgggtgggctacagccgcacttctggtgactttctgttttggatgggttttgatccctgccatcaccttcattatactaacaatcctgaaatttattgctaacatcttccacaccagtaaccaggaaaatcggctcaagtctgtgctgcgcaaaattaaggaggaatttgagaaaaccaagggcagcatggtctgcgacgtgtgtaagtacgagtgcgaaacatataaagagcttaaggcgcatggtgtatcctgcccccagtcacaatgtccatactgcttcacccactgtgaacccactgaggcagcctttcaggctcattatcgagtgtgccaggttacgcacagattcagggatgacctgaaaaagacagtcacccctcagaacttcactccagggtgttaccggaccttgaatctctttcgttacaaaagccgctgctatatcttcacaatgtgggtgtttctgttagtgctggaatctatactatgggccgcatccgccagtgaggtcccgctcagccccgtttggaacgataatgctcacggcgtgggatctatccctatgcataccgacctggagcttgatttctccttgacttcaagtagcaagtacacatatagaaggaagctgacgaacccactcgaagagacccaagccattaatctgcacatcgaaattgaggagcagactatcggcgtggacgtacatgcacttgggcactggtttgatggacggctgaacttgaaaacatcgttccactgttacggtgcgtgcaccaagtatgaatacccctggcatacagctaaatgtcactatgagcgagactaccagtacgaaacttcctggggctgcaatcctgccgactgtccaggggtcggaaccggctgcacggcatgcggtctctatctggatcagttaaagcccgtggggtctgcctacaaaataattaccatccgctatagcagaaaggtttgtgtgcaatttggcgaggaaaacctgtgcaagattatcgacatgaatgattgtttcgtctcaaggcatgtgaaagtttgcataatcggaacagtgagtaagttttcccagggcgacactctactcttctttgggccgctggagggaggtggccttattttcaaacactggtgtacctctacatgccagtttggggatcctggagacatcatgagcccacgggataagggcttcttgtgtcccgagttccctggttcctttcgcaaaaagtgcaacttcgctactactcccctgtgtgaatacgacgggaatatggtatcaggctataaaaaggtcatggccacgattgatagctttcagagtttcaacacatctaccatgcattttactgacgagagaatcgaatggaaggatccagacggaatgctcagggatcacataaatattctggtgacaaaagacatcgacttcgataacttaggcgagaacccttgcaagatcgggctgcaaacctccgcaattgaaggagcttggggcagcggtgtggggtttactcttacctgtttggtctcgctcacagagtgccccacgttcctgacctcaatcaaagcctgcgacaaggcgatttgttacggagccgagtctgttactctaacacgtggccagaataccgtgaaagtaagtggtaagggcgggcactccggaagcctgtttaagtgctgtcatggcgaagagtgctctcagatagggctccacgctgcagccccacatctggataaagtggacggaatcagcgaaattgagaacaataaggtctatgatgacggcgctccgcaatgtggtgtgaaatgctggttcgttaagtccggggaatggatctcaggaatttttagtggcaactggatcgtgcttatagtcttgtgtgtgttcctgttattcagcctcgttctgctttctgtgctgtgccctgtccggaaacacaagaagtcctga

SEQ ID NO: 10089 - RNA, 3408 nt, synthetic construct
  misc_feature 1..3408: note = derived and/or modified CDS sequence (opt3) from HTNV__AB030232.1__GP
  source 1..3408: mol_type = other RNA
atgggcctgtggaagtggctcattatggccgtgcttgtctggccctgcttcgctctgagaaacgtttacgacatgaaaattgagtgtcctcacaccgtgaattttggggaaaacagcgtagtgggatatgtcgagttgccaccgatgcccatagcagatatcacacagatgatgcctgaatcctcttgctcaatggacaatcatcaaagtttaaacactattacgaagtacacccaggtgagctggaggaaaaaggccgatcgggcgcagtcctctcagacatcgttcgagactgtttcaagcgaagtggactttaaaggtacctgtgtcctgaagcacaagatggtggaggatagttatcgctcccgaaaatctatcatttgctacgacctaagctgtaattccacattctgcaagccaaccctctatctgatcgtacccgttcatgcttgtaacatgatgaaatcatgccttatagccctgggcccttaccgtgtgcaagatgtctatgagagaacttactgtatgagtggggtgttgctcgaaggaaagtgctttgtgccagacaggagcgtcgtttctatcattaaacacggcatcttcgatattgcatccgtgcatatcgtatgctttttcgtggccataaagggttcaacatacaagattctggagcaggtcaaaaagagctttgaactgacctgtaatgacacggataacaaaatccaggggtattacatttgcctcgtgggaggcaatagtgctcccatctatgttcctactttagacgatttccggtctatggaggcatttgccggcatcttcaagtccccacacggggaggaccacgacctggctggagaagaggtggccagctactcgattgtcggtccggcgaacgcaaaagtgccccattctgcctccgctgataccctttcattggtagcctttagtggcatacctagctattcctctttcagcgttctgacagggtcaactgacgcacgccacgtgttcagtccaggatttttcccccagctaaatcaaaccagatgtgataagacagctatccctctcacctggacgggcatgattgacctgccaggttactatgaagccgtccatccctgcactgtgttttgtgtcctttccgggccgggagcgagctgcgaggccttctctgaaggcggcatctttaacataacatcacctatgtgtctggtgagtgagcagaataggttccggagctccgagcagcaggttaactttgtgtgccaacgcgtagatatggacattgtcgtgtactgtaatgggcagaaaaaggttatcttgaccaagactctcgtgatcggacagtgcatttacacaatcacctctctgttctcgttactgcccggtgtcgcacacagcattgctgtggaactctgtgtaccaggctttcacgggtgggccacggctgcccttctggtgaccttctgctttggatgggttttgatacctgcagtcactctagtgatcctgacaattctcaaattcatcgccaacatctttcatacctccaaccaagagaatcgactgaagtcagtgcttaaaaagattaaagaagagttcgaaaagacaaagggcagtatggtctgtgatgtttgcaaatatgagtgcgagacttacaaggaactgaaagctcacggtgtgtcttgtccccagagccagtgcccatattgtttcacccattgcgagcccacagaagcggcatttcaggcccactacaaggtgtgtcaagtaacccatagattcagggacgatttgaaaaagactgtcacgcctcagaactttacaccagggtgctatcggaccctcaatctgttccgttacaagtcccgctgttatatatttactatgtgggtgttcttactgatcctagagtcaattctctgggctgccagcgcatctgaaaccccgtccacacccatctggaacgacaatgcccacggcgttggaagtattcctatgcacaccgatctggagcttgactttagcttgacttcttcctcaaaatacacatacagaaggaagctgacgaacccactcgagaaaacccaggctgtggacctgcatatcgaacttgccgtccagactataggcgtggatgttcacgcactggggcattggttcgacggacggttgaatctcaagacaagttttcactgctatggtgcgtgtaccaaatacgagtatccctggcacacagctaagtgccattacgaacgagattatcaatacgagactagctggggctgtaaccctgccgactgcccaggggtgggaaccggctgcacggcatgtggtctgtatttagatcagctgaagcccgtagggtcggcctacaaaatcattaccatcaagtactcccgcagagtctgcgtgcagttcggcgaggaaaatctatgtaaagtgattgacatgaacgattgctttgtctctaggcacgttaagatctgtataattggaacagtgagcaaattctcacagggcgacactctcctgtttttcgggccgcttgagggaggtggcttgatcttcaagcattggtgcaccagtacatgtcaatttggggatcctggagacattatgtccccacgggataaaggcttcctgtgccccgaatttcctggttctttccgcaagaagtgtaattttgctactacccccgtatgcgagtatgacgggaacatggtgagcggctacaaaaaggtcatggccacgatcgattccttccagtcatttaatacaagcatgatgcacttcaccgacgaaagaatagagtggaaagacccagatggaatgctcagggaccatatcaacattctggtgactaaggatatcgactttgataatttaggcgacaacccttgtaaagttgggctgcagacaagtgcaattgagggagcttggggctctggtgtggggttcacccttacttgccaggtctccttgaccgaatgccccacatttctcacgagcatcaaggcctgtgataaggcgatatgctatggagccgagtcgattaccctgactcgtggccaaaacacagtgaaagtttcaggtaagggcgggcactctggaagtaccttcaaatgttgccacggcgaagagtgttcccagatcgggctacatgctgcagccccacacctggacaaggtgaatggaatcagcgaaatggagaactctaaagtctacgatgacggcgctccggagtgcggtattaagtgttggttcgtaaagagcggggaatggatctccggaatttttaatggcaactggatagtgctcatcgttctgtgcgccttccttatcttttcattggtgctgttaagtctcctgtgtcctgtccggaaacataagaaagcatga

SEQ ID NO: 10090 - RNA, 3408 nt, synthetic construct
  misc_feature 1..3408: note = derived and/or modified CDS sequence (opt3) from HTNV__AB620032.1__GP
  source 1..3408: mol_type = other RNA
atgggcatgtggaagtggctggtgatcgccagcctcgtctggcccgttcttgctctgagaaacgtgtacgacatgaaaattgagtgccctcacaccgtatccttcggggaaaattctgtgataggatttgtcgagttgccaccgatgcccttagcagatacagcccagatggtgcctgaatcaagttgtagcatggacaaccatcaatccatcaatactattacgaagtatacccaggttacatggaggggtaaagcggatccaggccagtcttcgcagaactcattcgagactgtgagcaccgaagtcgacctgaaggggacatgcgtgctaaaacacaagatggtagaggagagttaccggtcccgcaagtctatcacctgttatgatctcagctgcaattccacttactgtaaacccacactgtatatgattgttcctatccatgcttgcaacatgatgaagtcatgtcttatagccctgggaccataccgagtgcaagtcgtgtatgaacgtacctactgcatgacgggcgtgttgatcgagggtaaatgttttgtccccgaccagagtgttgtgagcattatcaagcacgggattttcgatatcgcatctgtacatatagtgtgctttttcgtcgccattaaaggaaatacttacaagctctttgaacaggtgaagaaatccttcgagtcaacctgtaacgacacagagaataaggttcagggctattacatctgcattgtgggcgggaacagcgctcctatctatgtcccaactctggatgactttagaagtatggaagcattcaccggaatctttaaatctccgcacggtgaggatcacgacctggccggcgaagagattgcttcctacagcatagtggggcccgccaatgcgaaggtacctcattcggcatcttccgatacactctcattaatcgcctatagtgggattccaagctactcctctctgagcatccttacctcaagtacggacgctaaacacgttttctcccccggcttgtttcctaagctgaaccatactaattgcgacaaaagcgccataccactaacatggaccggtatgattgatctccccgggtattacgaagcaatccacccgtgtactgtgttctgcgtcctgtctggacctggcgcttcatgtgaggccttcagtgagggcgggatctttaacattacaagccccatgtgccttgtgtccaagcaaaataggttccggctgaccgaacagcaggtcaactttgtgtgtcagcgcgttgacatggatatcgtggtatactgcaacggacaaagaaaggtcattttgacgaaaaccctcgtgataggtcagtgtatctatacaattacttctctgttctcgttactgccaggcgttgcgcacagcatcgccgtggagctctgcgtccctgggtttcatggatgggcaaccgctgcccttctggtgacattctgttttggctgggtattgatccccgctgtgactttcgttattctaaccatactgaagtttgtcgccaatatcttccacacatccaaccaggaaaataggctcaaatcagtgctgcggaagattaaagaggaatttgagaagaccaagggtagtatggtgtgcgacgtctgtaaatacgagtgcgaaacttataaggagcttaaagcacatggggtttcttgcccacaaagccagtgtccctactgcttcacgcactgtgaacctacagaggccgcttttcaggcgcattataaggtgtgccaggtgacccaccgcttccgagatgacctgaaaaagactgtaaccccacaaaacttcacaccgggctgttacagaaccttgaatctctttaggtataagtcccggtgctacatcttcactatgtgggtctttctgttaattctggaatcagtgctatgggcagccagcgcttctgagacacccctcgcccctgtttggaacgataatgcacacggagtgggctccgtcccaatgcatacggacctggagcttgatttcagtttgaccagctcctccaaatacacttatcgtcgcaagctgacaaaccccctcgaagaggcccagtcaatcgacctgcacatagaaatcgaggagcagaccattggggtggatgttcatgctcttggacactggtttgacggtagactgaatttgaaaacaagtttccactgttacggcgcctgcactaagtatgaatacccttggcataccgcaaaatgtcactatgagagggactaccagtatgaaacgagctgggggtgcaacccatcggattgtcccggagtgggcaccggttgcacagcgtgcgggctctacctggaccaattaaagccggtaggctccgcttacaagatcattactatccggtattctcgacgcgtctgtgtgcagtttggagaggaaaatctgtgcaaaataattgatatgaacgactgtttcgtgagcagacatgtcaaggtttgcatcattggcaccgtgtcaaaatttagtcagggggatacactactcttctttggacctctggagggtggcgggcttatcttcaagcactggtgtacttctacctgccagtttggagacccaggcgatataatgtctcccagggacaaaggtttcttgtgtcctgagttccccgggagctttcggaagaaatgcaatttcgccacgacaccaatctgtgaatacgatggcaacaccgtatccggatataagaaggtgatggcaactattgactcatttcagagcttcaatacaagtaccatgcattttactgatgagcgcatcgaatggaaagaccctgatggcatgctgagagaccacattaacatcctcgtcaccaaggacatagatttcgacaacctgggggagaatccctgcaaaattggattacaaacatcttccatcgaaggcgcctggggtagcggggtgggatttacgctgacctgtcttgtttcgttgactgagtgcccaacattcctcacctcaatcaaggcttgcgataaagccatttgttacggcgcagagtctgtgacactgactaggggtcagaacaccgtcaaggtgagtggcaagggaggacactccggcagcacgtttaaatgctgtcatggggaagactgctctcagatcggactacacgctgccgcgccgcatctggataaggttaatggcattagcgagatagaaaactccaaagtgtatgacgatggtgcccctcaatgtgggatcaagtgctggttcgtcaaatcaggagagtggattagtggcatctttagcggtaattggattgtactcatcgtgctgtgtgttttccttttgttctctctggtgttactctccatactgtgccccgtccgtaagcacaagaaatcatga

SEQ ID NO: 10091 - RNA, 3408 nt, synthetic construct
  misc_feature 1..3408: note = derived and/or modified CDS sequence (opt3) from HTNV__D25532.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcgggggaaattctgtgataggttatgtcgaattgccaccggtgcccttagctgatactgcacagatggttcctgagtcaagttgtagcatggacaaccatcaatccctgaatacgatcaccaagtacacacaggtgtcttggaggggcaaagccgatcagtcgcagtcaagccaaaacagttttgaaactgtctccaccgaggtggacctaaaggggacatgcgtactcaaacacaagatggttgaagagtcttatcggagccgcaagtccgtgacctgttacgatctgtcatgcaatagtacttattgtaaaccaacactttacatgattgtccccatccatgcgtgcaacatgatgaaaagctgtctgattgctttgggaccttatcgagtccaggtggtgtacgagcgtacctactgcatgacgggcgttctcatcgaaggtaaatgtttcgtgccagaccagtctgtagtgtccataatcaagcacgggatttttgatatcgcctcagtccatattgtgtgcttctttgttgcagtgaaaggaaatacttataagatcttcgagcaggtcaagaaaagttttgaaagcacctgtaacgacacagagaataaggtgcaaggctactatatatgcattgtaggcgggaactctgcccccatctacgttcctactctggatgacttcagatccatggaggcttttaccggaattttcaggagcccacacggtgaagatcacgacctggcaggcgaggaaatcgcctcgtattctatcgtggggccggctaatgccaaagtcccccattccgcgtcaagtgatacactccggttaattgcatacagcggaataccttcctattctagcctgtcaatccttaccagttccacggaggccaagcacgtgtttagcccaggcttgttccccaaactgaaccatactaattgcgacaagtctgctattcctctaatctggacaggtatgatagacctcccagggtactacgaagccgtccacccctgtaccgtgttttgcgttctgtcaggaccgggcgcaagttgtgaggctttcagcgagggcgggattttcaacatcacttcctctatgtgccttgtgtcgaaacagaatcgctttagactgacagaacagcaggtaaacttcgtctgtcaaagggtggatatggacatcgttgtgtattgcaacggacagcggaaggtcattttgaccaagacgctcgtgatcggtcagtgtatttacaccataacaagcctgttttccttactgcctggcgtagcccactcaatcgcggtggagctctgcgttcccgggttccatggatgggccactgcagcccttctggtcaccttttgtttcggctgggtgttgattccagctatcacatttatcattctaactgtgctgaaattcatagctaatatctttcacaccagtaaccaagaaaatcgcctcaagtctgtcctgcgaaaaattaaggaggaatttgagaaaacaaagggtagcatggtttgcgatgtgtgtaagtatgagtgcgaaacctacaaagagcttaaggcccatggggtgtcctgccctcagtcacagtgtccctattgcttcactcactgtgaaccaacggaggcagccttccaggctcattacaaagtatgccaagtcacacacagatttagggacgatctgaagaaaaccgtgactccccagaacttcacccctggctgttatcggacattgaatctcttccgttacaagagccgctgctacatctttaccatgtggattttcctgttagttctggaatctatcctatgggcggcatccgccagtgagactccactcacaccggtgtggaacgacaatgctcacggagtcggcagcgtgcccatgcatacggatctggagcttgacttttctttgacctcctcaagtaagtatacttacagaaggaaactgacaaaccctctcgaagaggcccagagcatagatctgcacatcgaaattgaggagcagaccatcggggttgacgtgcatgcacttggacactggttcgatggtcggctgaatttgaagacatcgtttcactgttatggcgcctgcactaaatacgaatatccatggcataccgctaagtgtcactacgagcgagactatcaatacgaaacgtcctgggggtgcaacccctctgactgtcctggagtaggcaccggttgcacagcctgcgggctctacctggatcagttaaaaccagtcggcagcgcatataagattatcactatacgctactcaagaagggtgtgtgtgcagttcggagaggaaaatctgtgcaagattatcgacatgaacgattgttttgtcagtcggcatgttaaagtgtgcattatcggcaccgtatccaagttctctcagggggacacactactctttttcggacccctggagggtggcgggcttatatttaaacactggtgtactagcacgtgccaattcggagatccgggcgacatcatgtcccctcgcgataaggggtttttgtgtccagagttccccgggtcattcagaaagaagtgcaattttgcgaccacacctatttgtgaatatgacggcaacatggtgagcggatacaaaaaggtcatggctaccatcgatagtttccagtcttttaatacttccacaatgcatttcaccgacgagaggattgaatggaaggatcccgacggcatgctgcgtgatcacatcaacatactcgtgactaaagacattgactttgataacctgggggagaatccatgcaagatcggattacagaccagctcgatcgaaggcgcctggggttcaggggttggattcacactgacgtgtcttgtgtctttgaccgagtgccctacttttctcacaagtattaaagcatgcgacaaggccatctgttatggcgctgagtccgtcaccctgacacggggtcagaacactgtgaaagttagcggcaagggtggacactctggcagcaccttcaagtgctgtcatggggaagattgctcccaaattggactacacgccgcagctccccatctggacaaagtgaatggcatatcagagatcgaaaacagtaaggtctacgatgacggtgccccacagtgtgggattaaatgctggtttgtaaagagcggagagtggatctctggcattttctccggtaattggatcgtgctcatagttctgtgtgtgtttcttttgttctcactggtcttactcggcatcctgtgcccggtgcgaaaacacaagaagagttga

SEQ ID NO: 10092 - RNA, 3408 nt, synthetic construct
  misc_feature 1..3408: note = derived and/or modified CDS sequence (opt3) from HTNV__L08753.1__GP
  source 1..3408: mol_type = other RNA
atgggcatctggaagtggctggtgatggccagcctcgtctggcccgcttacacccttagaaacgtttatgacatgaaaattgagtgccctcacacagtgtccttcggggaaaattctgtaataggatacgtggagctgccaccgatccccttggcagatactacgcagatggtccctgaatcaagttgtagcatggacaaccatcaatccttaaataccgtgacaaagtatactcaggtttcttggaggggtaaagccgatcaggcgcaggcttcgcaaaactcatttgaggccgtgagcgcagaagtcgacctgaaggggacctgcgtgctaaaacacaagatgctcgaggagagttaccggtcccgcaagtctattgcctgttatgatctgagctgcaattccacatactgtaaaccaaccctttatatgatcgtacccattcatgcttgcaacatgatgaagtcatgtctgatcgcattggggcctcaccgagttcaggtggtctacgaacgtacttactgcatgacaggagtgctcatagagggcaaatgtttcgtgccagaccagagtgtcgttagcatcattaagcatggtatctttgatattgcctctgtgcacatcgtatgcttctttgtggctgtcaaagggaatacctataagatattcgaacagattaagaaatcctttgagtcaacgtacaacgacactaagaataaagtggagggatattacatctgtattgttggcggcaacagcgcccccatctatgtgcctaccctggatgacttcagaagtatggaagcgttttctgggatcttcaggtccccacacggagaggatcatgacctggccggtgaagagattgcaagctactcgatagtcggcccggctaatgtgaaggtaccccactctgcctcctcagatacactcagtttaactgcatatagcgggatcccttcctactctagcctgtcaattcttgctggaagtgccgaagcgaaacatgtttttagtccaggcttctttccccaattgaaccacaccaagtgcgacaaaacagccatccctctgatgtggaccggtatgatagacctaccagggtactatgaggcaattcacccctgcacggtgttctgtgtcctcagcggaccgggcgcttcttgcgaggccttctcagaaggcgggatctttaatatcacttcccctatgtgtctggtgagcaagcagaaccggttccgccttacagagcagcaggtcaattttgtgtgccaaagagttgatatggacattatcgtgtactgtaacggacagaggaaggtaattctgaccaaaactttggtcataggtcagtgcatctatacaattacctccctcttctctctgttacccggcgtggctcattcgatcgccgttgaactgtgtgtgccagggtttcacggatgggcaacggccgctctccttgtcaccttctgctttggctgggtgctgatccctgcgatgacattcattgtattgactatactaaagtttatcgcaaacattttccataccagcaatcaagagaacaaactgaagtccgtgctccggaaaatcaaggaagagtttgagaagacaaaaggttcaatggtttgtgatgtctgcaagtacgaatgtgagacttataaagaactgaaggcccacggggtgagttgcccccagtctcagtgcccatactgtttcacccattgcgagcccacagaagctgcctttcaggcacactatcgcgtgtgtcaagtcacccaccgattcagagacgatcttaaaaagactgttacgcctcagaatttcacaccaggctgctacaggaccctgaacttgtttcggtacaagagccgttgttatattttcactatgtgggtgtttctcctggtgttagagtccatcctgtgggccgcttcagccagcgagataccgctataccccgtatggaatgacaacgcacatggagtcggctctgtgcctatgcacaccgatctcgaactggacttctcccttacaagtagctctaaatatacctaccgcagaaagttgactaatccactggaggaatcccaggcgatcaacctccatattgagatcgaggaacagacaattggggttgatgtgcacgctctgggacactggtttgacggtaggcttaatctgaaaacgtcattccattgctatggcgcctgtaccaagtacgagtatccctggcacactgcaaaatgccattacgatcgggactaccaatatgaaacaagttgggggtgtaaccctagcgactgcccaggagtcggcaccggttgtacagcctgcgggttgtacctcgatcagctgaagcccgtgggctcggcttataagatcataactattcgatactcccgcagagtttgcgtgcagtttggagaggaaaatttatgtaaaatcattgacatgaacgattgcttcgtatctaggcacgtcaaggtgtgtatcataggcaccgtgagcaaattttcacagggggacacgctgctattctttggaccgctcgagggtggcgggctgatcttcaagcattggtgcaccagtacatgtcaatttggagatcctggcgacattatgtccccacgggataaaggtttcctttgccccgagttccctgggtcttttcgcaagaaatgtaatttcgccactacccccttgtgcgaatatgacggcaacatggtcagcggatacaagaaggttatggcaacaatcgattcctttcagtcattcaatactagcaccatgcactttacggacgagagaattgaatggaaagatccagacggcatgctgagggatcacatcaacatactcgtgacaaaggacattgacttcgagaacctgggggaaaatccttgtaaaatcggattacagaccagttctatcgagggcgcttggggttccggggtaggatttactctgacatgccttgtgagcttgaccgagtgtcccactttcctcacctcgattaaggcctgcgataaagcgatctgctatggcgccgaatcagtcacactgacgcgtggtcagaacaccgtgaaggtttctggcaagggcggatacagtggctccacttttaaatgttgccatggggaggaatgtagccaaattggactacacgctgcagccccacatctggacaaggtgaatggcatatctgagatcgaaaacaataaagtctacgatgacggtgctccgcagtgcgggattaagtgttggttcgtgaaaagcggagagtggatctccggcatcttttcaggtaactggattgttctcatagtgctgtgcgtcttccttttgttcagtctgatcttactcagcattctgtgtcctgcccggaagcacaagaaatcttga

SEQ ID NO: 10093 - RNA, 3408 nt, synthetic construct
  misc_feature 1..3408: note = derived and/or modified CDS sequence (opt3) from HTNV__M14627.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccggtgcccttagctgatactgcacagatggttcctgaatcaagttgtaacatggacaatcatcaaagcctgaacacgatcaccaagtacacacaggtgtcctggaggggtaaagccgatcagtctcagtcgtcacaaaatagctttgagactgtcagtaccgaagtggacctaaagggcacatgcgtactcaaacacaagatggttgaggagtcctatcggtctcgcaagagcgtgacctgttacgatctgtcctgcaactcaacttattgtaaaccaacactttacatgattgtccccatccatgcgtgcaatatgatgaagagttgtctgattgctttggggccttatcgagtccaggtggtgtacgaacgtagctactgcatgaccggagttctcatcgagggcaaatgtttcgtgccagaccagtctgtagtgtccataatcaagcacggtatttttgatatcgcctcagtccatattgtgtgcttctttgttgcagtgaaagggaacacgtataagatcttcgaacaggtcaagaaaagttttgagagtacttgtaatgacaccgagaacaaggtgcaaggatactatatatgcattgtaggcggcaattctgcccccatctacgttcctacactggatgacttcagatccatggaggcttttactgggattttcaggagcccacacggagaagatcacgacctggctggtgaagagatcgcctcgtattctatcgtgggcccggctaacgccaaagtcccccattccgcgtcaagtgataccctcagcttaattgcatactccgggataccttcttatagctcactgagtatccttacatccagcaccgaagccaagcacgtgttttctccaggattgttccccaaactgaatcatacgaactgcgacaagtcagctattcctctaatctggactggcatgatagacctcccaggttactacgaggccgtccacccctgtacagtgttttgcgttctgagtgggccgggagcaagctgtgaggctttctccgaaggcggcattttcaatatcacctctcctatgtgccttgtgtcgaaacagaaccggtttcgcctgactgagcagcaggtaaacttcgtctgtcaaagagtggatatggacatcgttgtgtattgcaatgggcagaggaaggtcattttgacaaagaccctcgtgatcggacagtgtatttacacgataaccagcctgttttccttactgcccggtgtagcccactcaatcgcggtggaactctgcgttccaggcttccatgggtgggccacagcagcacttctggtcactttttgtttcggatgggtgttgattcctgccatcacctttatcattctaacagtgctgaaattcatagctaacatctttcacactagcaatcaagagaaccggctcaagtctgtcctgcgcaaaattaaggaagagttcgagaaaaccaagggcagcatggtttgcgatgtgtgtaagtatgaatgcgagacatacaaagaacttaaggcccatggtgtgtcctgcccccagtcacagtgtccatattgctttacccactgtgagcccactgaagcagccttccaggctcattacaaagtatgccaagtcacgcaccgatttagagacgatctgaagaaaacagtgacccctcagaatttcactccagggtgttataggaccttgaacctcttccggtacaagagccgttgctacatctttacaatgtggattttcctgttagttctggagtctatcctatgggcggcatccgccagtgagaccccgctcactcccgtgtggaatgacaacgctcacggcgtcggaagcgtgcctatgcatacagatctggaacttgacttttctttgacgtcctcaagtaagtatacctaccgcagaaaactgactaatccactcgaggaagcccagagcatagatctgcacatcgagattgaggaacagacaatcggcgttgacgtgcatgcacttgggcactggttcgatggaaggctgaacttgaagacctcgtttcactgttatggtgcctgcacaaaatacgagtatccctggcatactgctaagtgtcactacgaacgggactatcaatacgagacctcctggggctgcaatccttctgactgtccaggggtaggaacgggctgcaccgcctgcggtctctacctggatcagttaaaacccgtcgggagcgcatataagattatcacaatacgatactcacgcagagtgtgtgtgcagttcggcgaagagaacctgtgcaagattatcgacatgaatgattgttttgtcagtaggcatgttaaagtgtgcattatcggaactgtatccaagttctctcagggcgacaccctactctttttcgggccgctggagggaggtggccttatatttaaacactggtgtacaagcacttgccaattcggggatcctggagacatcatgtccccacgggataagggctttttgtgtcccgagttccctggttcattccgcaaaaagtgcaactttgcgaccacgcccatttgtgaatatgacgggaatatggtgagcggctacaaaaaggtcatggctacaatcgatagtttccagtcttttaacacctccactatgcatttcacagacgaaagaattgagtggaaggatccagacggaatgctgagggatcacatcaacatactcgtgaccaaagacattgactttgataatctgggcgaaaacccttgcaagatcgggttacagactagctcgatcgagggagcctggggctcaggtgttgggttcaccctgacatgtcttgtgtctttgacggagtgccccacctttctcacaagtattaaagcatgcgacaaggccatctgttatggagctgaatccgtcactctgacccgtggccagaatacagtgaaagttagcggtaagggcgggcactctggaagcactttccggtgctgtcatggcgaggattgctcccaaattgggctacacgccgcagctccacatctggacaaggtgaacggaatatcagaaatcgagaatagtaaagtctacgatgacggcgccccgcagtgtggtattaagtgctggtttgtaaaaagcggggaatggatctctggaattttctccggcaactggatcgtgctcatagttctgtgtgtgtttcttttgttctcactggtcttactcagtatcctgtgccctgtgcgaaagcacaaaaagagctga

SEQ ID NO: 10094 - RNA, 3408 nt, synthetic construct
  misc_feature 1..3408: note = derived and/or modified CDS sequence (opt3) from HTNV__EU074672.1__GP
  source 1..3408: mol_type = other RNA
atgggcatctggaagtggctggtgatggccagcctcgtctggcccgctttcgcacttagaaacgtttacgacatgaaaattgagtgccctcacaccgtgtcctttggggaaaattctgtaataggatatgtggagctgccaccgatgcccttggccgatacaactcagatggtccctgaatcaagttgtagcatggacaaccatcaatccttaaatacgatcaccaagtacacacagattatctggaggggtaaagcggatcagtctcagtcgtcacaaaacagcttcgagactgtgagtaccgaagttgacctgaagggcacatgcgtgctaaaacacaagatgattgaggagtcctatcggtctcgcaagagcatcacctgttacgatctctcctgcaattcaacttattgtaaaccaacactgtacatgatagtccccatccatgcttgcaacatgatgaagagttgtcttattgccctggggccttatcgagtgcaggtagtttacgaacgtacctactgcatgacgggagtgttgatcgagggcaaatgttttgtcccagaccagagcgtggtgtctattatcaagcacggtatattcgatattgcatccgtccatatcgtttgctttttcgtggccgtaaaagggaatacttataagatttttgaacaggtgaagaaatcattcgagagcaactgtaatgacaccgagaacaaggtccaaggatactatatctgcatcattggcggcaatagttctcccgtgtacgttcctacactcgatgactttagatccatggaagcattcagcgggatatttaggtcgccacacggagaggatcacgacctggctggtgaagaggtggcctcttattccatcgtcggcccggctaacgccaaagtgccccattcagcgagtagcgatactctggggctcattgcatactccggaatcccttcttatagctcattaagtatactgacctccagcacagaagccaagcacgtattctctccaggcctttttccccagttgaatcataccaaatgcgacaagacggctattcctctgacttggacaggtatgatcgacctaccagggtactacgaggccatccacccctgtaccgttttctgcgtgctctcaggaccgggcgcaagttgtgaggctttcagcgaaggcgggatttttaacatcacttcccctatgtgcctggtctctaaacagaatcggttccgccttacagagcagcaagtgaactttgtctgtcagagagtggatgttgacattatagtgtattgcaacggacagaggaaggtaatcctgaccaagacgttggtcattggtcaatgtatctacaccatcacaagcctcttcagcctgttacccggcgtggcccactccattgcggttgaactgtgcgtgccagggtttcatggatgggccactgcagctctccttgtcaccttctgttttggctgggtgctgatacctgccatcacattcattatcttgactattctaaaatttatcgctaatatattccacacctcaaaccaggagaatcggctgaagagtgtactccgcaaaatcaaggaagagtttgagcgaacaaaaggttctatggtgtgcgatatttgtaagtatgaatgcgagacctacagagaactgaaggcccatggggttagctgcccccagtcccagtgtccatattgcttcactcactgtgagcccacggaagcagcctttcaagctcattacaaagtctgccaggtgacacacaggttccgggacgatcttaagaaaaccgtgactcctcagaacttcaccccaggctgttatcgtacactgaatttgtttcgctacaagtcaagatgctacatcttcaccatgtgggtctttctcctggttttagagagcattctgtgggcggcatctgcctccgagatcccgctaaaccccgtgtggaatgacaacgctcacggagtgggcagtatacctatgcatactgatctcgaactggacttcagccttacatcttcctcaaaatatacgtacaggcggaagttgaccaatccactggaggaaagtcaggccattgatctccacgtagagatcgaggaacaaactattggggtcgacgtgcatgcactgggacactggtttgatggtcgacttaacctgaagacatcgttccactgttatggcgcctgcaccaaatacgagtatccctggcatacagctaagtgtcactacgaacgcgactatcagtacgagacttcgtgggggtgcaatccttccgactgtccaggagttggcaccggttgcacggcctgcgggttgtacctcgatcagctgaaacccgtgggctctgcatataagatcataaccatcagatacagcaggcgggtctgtgtgcagtttggagaagagaacttatgcaaaattatcgacatgaatgattgtttcgtttcacgccatgtgaaggtatgcattatcggcacagtcagtaagttttcccaaggggacactctgctattctttggaccgctcgagggtggcgggctgatattcaaacactggtgtacctctacatgccagtttggagatcctggcgacattatgagcccaagagataagggtttcctttgtcccgagttccctgggtcctttaggaaaaagtgcaacttcgcgactacccccgtgtgtgaatatgacggcaatatggtgtcaggatacaaaaaggtcatggctacgatcgatagctttcagagtttcaacacatctaccatgcattttactgacgaacgtatcgagtggaaagatccagacggcatgttgcgggatcacattaacatcctggttacaaaggacattgacttcgataatctcggggaaaacccttgcaagataggactgcagacctccagcatcgagggcgcctggggttcgggggtgggatttactttaacctgtctgatttcacttacagagtgctctacgttcttgaccagtatcaaagcatgcgacaaggccatttgttatggcgctgaatccgtaactctcacacgaggtcaaaataccgtgaaagtcagcggcaaagggggacactctggcagctcctttaagtgctgtcatggggaggaatgctcacagatcggactgcacgccgcagctccccatctagataaggtgaacggcataagtgagatggaaaatagcaaggttttcgacgatggtgccccacagtgtgggatcaaatgctggtttgtgaagtctggagagtggatttccggcatcttctcaggtaactggattgtcctgatcgtgctctgtgttttcctgctttttagtttggtgctgttaagcatactctgcccggtcagaaaacacaagaaatcctga

SEQ ID NO: 10095 - RNA, 3408 nt, synthetic construct
  misc_feature 1..3408: note = derived and/or modified CDS sequence (opt3) from HTNV__GQ120966.1__GP
  source 1..3408: mol_type = other RNA
atggagatctggaagtggctggtgatggccagcctcgtctggcccgctttcacccttagaaacgtttacgacatgaaaattgaatgccctcacacagtgtcctttggcgaaaattctgtaatagggtatgtggaactgccaccgatgcccttggcagatactgcccagatggtccctgagtcaagttgtaacatggacaatcatcaaagcatgaacacgatcaccaagtacacacaggtgtcctggaggggaaaagcggatcaggctcaggcctctcaaaattcgttcgaagcagtttcagccgaggtggacttaaagggtacttgcgtcctgaaacacaagatgctagaggaaagctatcggagtcgcaagtccattacctgttacgatctctcttgcaacagcacatattgtaaaccaaccctgtacatgatcgtgcccattcatgcttgcaatatgatgaagtcctgtcttatcgcactgggcccttatcgagtacaggttgtgtacgagcgtacttactgcatgacaggggtcttgatagaaggaaaatgttttgtgccagaccagtcagtggtcagtatcattaagcacggcatcttcgatattgccagcgttcatatcgtgtgctttttcgtagctgtgaaaggtaacacctataagctctttgagcaggtcaagaaatctttccaatccacgtgtaatgggactgagaacaaggtgcagggatactatatatgcattgttggcggcaattcagcccccatctacgtgcctaccctggacgattttagaagcatggaagcgttcagtgggatttttaggtctccacacggagaggaccacgatctggccggtgaagagatcgcatcctatagcatcgtcggcccggctaacgccaaagtgccccattcggcatcttccgacacactctcattaattgcttacagtgggatacctagctattcctctctgagcatccttgcctcaagtactgaagcgaagcacgtattctccccaggatttttcccccagttgaatcataccaaatgcgataagacagccattcctctgacctggacgggcatgatcgacctaccaggttactacgaggcaatacacccctgtactgttttctgcgtgctcagcgggccgggagcttcttgtgaggccttttcagaaggcggcattttcaacatcacaagtcctatgtgcctggtcagcaaacagaatcggtttcgccttaccgagcaacaggtgaacttcgtctgtcagagagtggacatggatatcattgtttattgcaacgggcaaaggaaggtgatcctgactaagacattggtaattggacagtgtatatacaccatcacgtccctcttttctctgttacccggtgtcgctcactcgattgccgtggaactgtgcgttccaggcttccatgggtgggcaaccgccgctctccttgtgacattttgtttcggatgggtcctgatccctgcgttgactctaatcattctgaccatactcaaatttatcgcaaatattttccacacaagcaaccaggagaatcggctgaagtccgtgcttcgcaaaatcaaggaagagtttgagaaaactaagggctcaatggtatgcgacgtgtgtaagtatgaatgcgagacctacaaagaactgaaggcccatggtgttagttgcccccagtctcaatgtccatattgcttcacacactgtgagcccaccgaagctgcctttcaggcacattaccgagtctgccaggtgactcacagattcagggatgacttgaaaaagacggtgacacctcagaacttcaccccagggtgttatcggactctcaatctgtttcgttacaaaagccgctgctacattttcaccatgtgggtctgtttactggttctagagtccatcctctgggccgcttcagccagcgaggtgccgctgaaccccgtgtggaatgataacgcacacggcgtaggatctgtccctatgcatacagaccttgaattggattttccactgacctccagtagcaagtatacttacagaaggcggctcacaaatcccctggaggaaacgcaatctataaaccttcacatcgagattgaggaacagaccatcggcgtggacgttcatgcgctggggcactggttcgatggacgattgaatctcaagacttcctttcactgctatggtgcttgtacaaaatacgagtatccttggcataccgccaagtgccactacgaacgcgactatcagtacgagacatcatggggctgtaacccagcagattgccccggggtgggaactggctgcaccgcctgtggtctgtacttagaccagctgaaaccggtcgggagtgcttataagattatcacgataagatacagcaggaaagtgtgcgttcaattcggcgaagagaatctatgtaaggtgattgacatgaacgattgctttgtaacccggcatgtcaaggtgtgtatcattggaacagtgtcgaaattctcccagggcgacactctcctgtttttcgggcctcttgagggaggtggcttgatctttaagcactggtgcacctctacatgtcagttcggggatccaggagacataatgagcccccgcgataaaggctttctgtgccctgagttccccggttcattcagaaagaaatgtaattttgccactaccccactctgcgagtatgacgggaacatggtcagtggctacaagaaagttatggcaacgatcgattccttccagtcttttaacacaagcaccatgcatttcactgacgaaaggattgagtggaaggatcctgacggaatgctgcgtgatcacatcaatattttagtgacaaaggacatcgattttgacaacctgggcgaaaatccctgtaaaatagggcttcaaacctcctcaattgagggagcttggggcagcggtgtagggttcactttgacctgcctcatcagtctgacagagtgcccaacgtttctaacctctatcaaggcctgtgacaaagcgatttgctatggagccgaatccgtgactctgacacggggccagaacaccgtcaaggtgagcggtaaaggcgggcactcgggatcaacattcaagtgttgccatggcgaggaatgttctcagatcgggctccacgctgcagccccgcatctggataaggttaatggaattagtgagatagaaaacaataaagtgtacgacgatggcgctcctcaatgcggtgtcaagtgttggtttgtgaaatccggggagtggatcagcggaattttctctggcaactggatcgttcttattgtgttgtgcgtctttctgttattcagcctcgtactgctttccgtgctgtgtcccgttcgaaagcacaaaaagtcatga

SEQ ID NO: 10096 - RNA, 3408 nt, synthetic construct
  misc_feature 1..3408: note = derived and/or modified CDS sequence (opt3) from HTNV(CGAa1011)__EF990927.1__GP
  source 1..3408: mol_type = other RNA
atggagatctggaagtggctggtgatggccagcctcgtctggcccgctcttgcactgagaaacgttcacgacatgaagattgaatgccctcataccgtgtccttcggcaagaatagcgtaatagggtacgtggagttgccaccgatgcccttagccgatacaatccagatggtccctgaatcaagttgtagcatggacaaccaccaatccctgtctactgtgacgaaatatacccaggtttcgtggaggggaaaggcggatcaggctcagtcaaatcaaactagctttgagacagtgagtgtcgaagtggacctaaaaggtacctgcgtactcaagcataagctggttgaggagtcctaccggtctcgcaaaagccttacatgttatgatctgtcctgcaactcaacctactgtaagccaactttgtatatgattgtgcccatccacgcctgcaatatgatgaaaagttgtattatcgcactcggccctcatcgagtccaggtggtgtacgaacgtacatattgcatgaccggggtcctgctggagggaaagtgtttcgttccagaccagagcgtggtaggcatagtgaaacacggtatctttgatattgcctctgtccacatcgcttgcttctttgtggcaattacggggaacacttacaaactcttcgaacaggttaagaaatcctttggaaccacatgtaatgacactgagaacaaggtgcaaggctactatatctgcatattaggcggaaattcaccccctatttacgtcccaaccctggatgacttcagaagcatggaggcctttagtggaatcttcaaatctccgcatggtgaagatcacgaccttgctggcgaggaaattgcctcctatagcatcgtggggcccgcgaacgcaaaggtacctcattcggcctcttccgatacattgtcactgatcgcttttagtgggattccaagctactcctctctaagcatactcacctcaagtacggaggccaaacacgttttctcccccggcctgtttcctcagcttaatcacactaagtgcgacaaaacagcaatcccactgacctggactggtattatcgacttgcccgggtattacgaagctgtgcatccgtgtacagtcttctgcgtgctcagcggacctggcgcctcttgtgaggcgttctcagagggcgggatatttaacattaccagtcccatgtgcctggtcagcaagcagaataggttccggttaacggaacagcaagtgaactttgtttgtcagcgcgtggatatggacatcgtagtctattgcaatggacagagaaaggtgatcctgaccaaaacactcgttattggtcaatgtatctacactattacctcccttttctctctgttgccaggcgtggcccactcgatagcagtcgagctatgcgtgcctgggtttcatggatgggctacagccgctctgctcatcactttctgttttggctgggtactgattcccgcccttaccttcatcgtgctgacagttttgaagtttatcgcaaacattttccacaccagcaaccaggaaaataggctcaaaatggtcctgaagaaaataaaggaggaatttgagcggactaagggttccatggtgtgcgatatctgtaaatacgagtgcgaaacgtataaggagttaaaagcccatggggtgtcatgcccacagagtcagtgtccctactgcttcacacactgtgaacctaccgagtctgcttttcaagcgcactatcgcgtctgccaggttactcatcgattcagagacgatctgaagaaaaccgtgacaccacagaacttcaccccgggctgttacaggactctaaatctctttcggtataagagccgttgctacattttcacaatgtggatctgtctgcttgtgttggaatccattctgtgggcagcctcagctagcgagatccccctctctcctacgtggaacgacaatgcccacggagtaggctccataccaatgcataccgatctggagcttgactttagtctgacttcttcttccaagtatacataccgcagaaaattgaccaaccccctcgaagagtcacaggcagtcaatttccacgtggaaatcgaggagcaagccattggggttgatgtgcacgctctgggacattggtttgacggtaggttaaacctgaagacaagtttccactgctacggcgcctgtactaaatatgaatacccttggcataccgcaaagtgccactatgagcgggattaccagtatgaaacgagctgggggtgtaatccatcggactgccccggagtcggcaccggttgcacagcgtgtgggctatacctcgaccagctgaaaccggtgggctccgcttataagatcattactatccgatactctcgcagagtttgcgtgcagtttggagaggaaaacctttgtaaggtaatagatatgaatgactgcttcgtcagcaggcatgtgaaagtgtgtattatcggcaccgtctcaaagtttagtcaaggggatacattgctgttctttggacctctcgagggtggcgggctgattttcaaacactggtgcacttccacctgtcagtttggagacccaggcgatatcatgtctccccgggacaagggtttcttatgccctgagttccccgggagctttcgcaaaaagtgtaacttcgccacgacaccagtttgcgaatacgatggcaatatggtgtccggatataaaaaggtaatggcaaccatagactcatttcagagcagtaacacttctacaatgcacttcaccgatgagagaatcgaatggaaggaccctgatggcatgctgagggaccatattaatatccttgtgactaaagatattgactttgacaacttgggggagaacccctgtaagatcggactccagacctccagcatagaaggcgcctggggttcgggggtcggattcacactgacgtgcctaatttcactgaccgagtgcccaacttttctcacatctatcaaggcttgtgataaggccatctgctacggcgcagagagtgtgaccctgacacgtggtcaaaatactgttaaagtgtccggcaaagggggacacagcggctctaccttcaagtgttgccatggggaagactgtagccagtccggacttcacgctgccgcgccgcatttggataaggtcaacggcatttcagagatcgaaaatagtaaggtgtatgacgatggtgcccctcagtgcggggttaaatgttggtttgtcaagagcggagagtggatttctggcatattctccggtaactggatcgtgctgattgtattatgcgtgtttctcctgttctcacttgttctgttgagtatcctctgtcccgtgcggaaacacaaaaagagctga

SEQ ID NO: 10097 - RNA, 3408 nt, synthetic construct
  misc_feature 1..3408: note = derived and/or modified CDS sequence (opt3) from HTNV(CGAa2)__EU092223.1__GP
  source 1..3408: mol_type = other RNA
atggagatctggaagtggctggtgatggccagcctcgtctggcccgcccttgcactgagaaacgttcacgacatgaaaattgaatgccctcataccgtgtccttcggcaaaaattctgtaatagggtacgtggagttgccaccgatgcccttagccgatacaatccagatggtccctgaatcaagttgtagcatggacaaccaccaatccctgtctactgtgacgaagtatacccaggtttcgtggaggggaaaggcggatcaggctcagccatcacaaacatcctttgagactgtgagtgtcgaagtggacctaaaaggtacctgcgtactcaagcataagctggttgaggagtcctaccggtctcgcaaaagccttacatgttatgatctgtcctgcaattcaacctactgtaagcccactttgtatatgattgtgcctatccacgcctgcaacatgatgaaaagttgtattatcgcactcggcccacatcgagtccaggtggtgtacgaacgtacatattgcatgaccggggtcctgctggagggaaagtgtttcgttcccgaccagagcgtggtatctatagtgagacacggcatctttgatattgcctccgtccacatcgcttgcttctttgtggcaattacgggtaatacttacaaactcttcgaacaggttaagaagtcatttgggaccacatgtaacgacactgagaataaagtgcaaggatactatatctgcatattaggcggcaacagccctccaatttacgtcccgaccctggatgacttcaggagtatggaggccttttctgggatcttcaagagcccccatggagaagatcacgaccttgctggtgaggaaattgccagctattcgatcgtgggccctgcgaatgcaaaagtaccacattctgcctcctcagatacattgagtctgatcgcttttagcgggattccctcctactctagcctatcaatactcaccagttccacggaggccaagcacgttttcagccctggactgtttccacagcttaaccacactaaatgcgacaagacagcaatccccctgacctggactggcattatcgacttgccgggttattacgaagctgtgcatccttgtacagtcttctgcgtgctctctgggcccggagcctcatgtgaggcgttcagtgagggcggcatatttaatattaccagcccaatgtgcctggtctccaaacagaaccggttccgcttaacggaacagcaagtgaattttgtttgtcagagagtggatatggacatcgtagtctattgcaacgggcagaggaaggtgatcctgaccaagacactcgttattggacaatgtatctacactattacctctcttttctcgctgttgcctggtgtggcccacagcatagcagtcgagctatgcgtgcccggctttcatgggtgggctacagccgctctgctcatcactttctgttttggatgggtactgattccagcccttaccttcatcgtgctgacagttttgaaatttatcgcaaatattttccacacctccaaccaggaaaaccggctcaagatggtcctgaaaaagataaaagaggaatttgagcgcactaagggctcaatggtgtgcgatatctgtaagtacgagtgcgaaacgtataaagagttaaaggcccatggtgtgagttgcccccagtctcagtgtccttactgcttcacacactgtgaaccaaccgagagcgcttttcaagcgcactatcgagtctgccaggttactcatagattcagggacgatctgaaaaagaccgtgacaccgcagaatttcacccccgggtgttaccggactctaaacctctttcgttataaatcccgctgctacattttcacaatgtggatctgtctgcttgtgttggaatcaattctgtgggcagccagcgcttctgagatccctctctccccaacgtggaatgacaacgcccacggcgtaggaagtatacccatgcataccgatctggagcttgactttagcctgacttcttcctcaaagtatacatacagaaggaagttgaccaatcctctcgaagagagtcaggcagtcaacttccacgtggaaatcgaggagcaagccattggcgttgatgtgcacgctctggggcattggagcgacggacggttaaatctgaaaacatcgtttcactgctacggtgcctgtactaagtatgaatacccatggcataccgcaaaatgccactatgagcgagattaccagtatgaaacgtcctggggctgtaacccctctgactgcccgggggtcggaaccggctgcacagcgtgtggtctatacctcgaccagctgaagcctgtggggagcgcttataaaatcattactatccgctactcaagaagggtttgcgtgcagttcggcgaggaaaatctttgtaaggtaatagatatgaacgactgctttgtcagtcggcatgtgaaggtgtgtattatcggaaccgtctccaaattctctcaaggcgatacattgctgtttttcgggccactcgagggaggtggcctgatttttaagcactggtgcactagcacctgtcagttcggggaccccggagatatcatgtcccctcgcgacaaaggctttttatgccccgagttcccaggttcattcagaaagaaatgtaattttgccacgacacctgtttgcgaatacgatgggaacatggtgagcggctataagaaagtaatggcaaccatagacagtttccagtcttccaatactagcacaatgcactttaccgatgagaggatcgaatggaaggaccccgatggaatgctgcgtgaccatattaacatccttgtgactaaggatattgacttcgacaatttgggcgagaacccatgtaaaatcgggctccagacctcgtcaatagaaggagcctggggctctggtgtcgggtttacactgacgtgcctaattagtctgaccgagtgcccgactttcctcacatccatcaaggcttgtgataaagccatctgctacggagcagagagcgtgaccctgacacggggccaaaacactgttaaggtgtctggtaaaggcgggcacagcggatccacctttaagtgttgccatggcgaagactgttcacagagtgggcttcacgctgccgcgcctcatttggataaggtcaatggaattagcgagatcgaaaactctaaagtgtatgacgatggcgctccccagtgcggtgttaagtgttggttcgtgaaatccggggagtggatttcaggaatatttagtggcaattggatcgtcctgattgtattatgcgtgttcctcctgtttagccttgttctgttgtccatcctctgtccagtgcgaaagcacaaaaagtcttga

SEQ ID NO: 10098 - RNA, 3408 nt, synthetic construct
  misc_feature 1..3408: note = derived and/or modified CDS sequence (opt3) from HTNV(CGAa31MP7)__EF990925.1__GP
  source 1..3408: mol_type = other RNA
atgggcatctggaagtggctggtgatggccagcctcgtctggcccgctttcgcacttagaaacgtttacgacatgaaaattgagtgccctcacaccgtgtcctttggggaaaattctgtaataggatatgtggagctgccaccgatgcccttggccgatacaactcagatggtccctgaatcaagttgtagcatggacaaccatcaatccttaaatacgatcaccaagtacacacagattatctggaggggtaaagcggatcagtctcagtcgtcacaaaacagcttcgagactgtgagtaccggcgttgacctgaaggggacatgcgtgctaaaacacaagatgattgaagagtcctatcggtctcgcaagagcatcacctgttacgatctctcctgcaattcaacttattgtaaaccaacactgtacatgatagtccccatccatgcttgcaacatgatgaagagttgtcttattgccctgggaccttatcgagtgcaggtagtttacgagcgtacctactgcatgacgggcgtgttgatcgaaggtaaatgttttgtcccagaccagagcgtggtgtctattatcaagcacgggatattcgatattgcatccgtccatatcgtttgctttttcgtggccgtaaaaggaaatacttataagatttttgaacaggtgaagaaatcattcgagagcaactgtaatgacaccgagaacaaggtccaaggctactatatctgcatcattggcgggaatagttctcccgtgtacgttcctacactcgatgactttagatccatggaggctttcagcggaatatttaggtcgccacacggtgaagatcacgacctggcaggcgaggaagtggcctcttattccatcgtcgggccggctaacgccaaagtgccccattcagcgagtagcgatactctgggactcattgcatactccggcatcccttcttatagctcattaagtatactgacctccagcacagaggccaagcacgtattctctccaggtctttttccccagttgaatcataccaaatgcgacaagacggctattcctctgacttggacagggatgatcgacctaccaggatactacgaagccatccacccctgtaccgttttctgcgtgctctcaggcccgggcgcaagttgtgaggctttcagcgaagggggaatttttaacatcacttcccctatgtgcctggtctctaaacagaatcggttccgccttacagagcagcaagtgaactttgtctgtcagagagtggatgttgacattatagtgtattgcaacggtcagaggaaggtaatcctgaccaagacgttggtcattggccaatgtatctacaccatcacaagcctcttcagcctgttacccggggtggcccactccattgcggttgagctgtgcgtgccaggatttcatggctgggccactgcagctctccttgtcaccttctgttttggttgggtgctgatacctgccatcacattcattatcttgactattctaaaatttatcgctaatatattccacacctcaaaccaggaaaatcggctgaagagtgtactccgcaaaatcaaggaggaatttgagcgaacaaaagggtctatggtgtgcgatatttgtaagtatgagtgcgaaacctacaaggagctgaaagcccatggcgttagctgcccccagtcccagtgtccatattgcttcactcactgtgaacccacggaggcagcctttcaagctcattacagagtctgccaggtgacacacaggttccgggacgatcttaagaaaaccgtgactcctcagaacttcaccccaggatgttatcgtacactgaatttgtttcgctacaagtcaagatgctacatcttcaccatgtggatttgtctcctggtcttagaaagcatcctgtgggcggcatctgcctccgagataccgctaaaccccgtttggaatgacaacgctcacggcgtggggagtattcctatgcatactgatctcgagctggactttagccttacatcttcctcaaaacacacgtataggcggaagttgaccaatccactggaagagagtcaggccatcgatctccatgtggaaattgaggagcaaactatcggagtagacgtccacgcactgggtcactggttcgatggccgacttaacctgaagacatcgtttcattgctacggggcctgtaccaaatatgaatacccctggcacacagctaagtgccattatgagcgcgactaccagtatgaaacttcgtggggatgtaatccttccgactgcccaggcgtgggtaccgggtgcacggcctgtggcttgtacctcgatcagctgaaacccgttggatctgcatacaagataatcaccattagatatagcaggcgggtgtgcgtccagttcggcgaggaaaacttatgtaaagtgatcgacatgaatgattgctttgtttcacgccacgtgaaggtatgtattatcgggacagtcagtaagttctcccaaggagacactctgctatttttcggtccgctcgagggcgggggactgatatttaaacattggtgcacctctacatgtcagttcggcgatcctggtgacattatgagcccaagagataaggggtttctttgccccgagttccctggctccttcaggaaaaagtgtaactttgcgactacccccgtgtgcggatacgacggcaatatggtgtcagggtataaaaaggtcatggctacgatcgatagcttccagagttttaacacatctaccatgcacttcactgacgaacgtatcgagtggaaagatccagacggaatgttgcgggatcacattaacatcctggttacaaaggacattgactttgataatctcggcgaaaacccttgtaagataggtctgcagacctccagcatcgagggggcctggggatcgggcgtgggtttcactttaacctgcctgatttcacttacagaatgccccacgtttttgacctctatcaaagcatgtgacaaggccatttgctacggcgctgagagtgtaactctcacacgagggcaaaataccgtgaaagtctccggaaagggcgggcatagcggatctacattcaaatgttgccacggcgaggattgtagccagtccggtctgcatgccgcagctccacacctagacaaggtgaacgggatctcagaaatagagaatagtaaggtttatgatgacggagccccgcagtgcggcatcaaatgttggtttgtcaagagcggtgaatggatttctggcatcttctccgggaactggattgtgctgatcgtgctctgcgtttttctgcttttctcattggtgctgttaagtatactctgtcctgtcagaaaacataagaaaagctga

SEQ ID NO: 10099 - RNA, 3408 nt, synthetic construct
  misc_feature 1..3408: note = derived and/or modified CDS sequence (opt3) from HTNV(CGAa4MP9)__EF990929.1__GP
  source 1..3408: mol_type = other RNA
atggagatctggaagtggctggtgatggccagcctcgtctggcccgctcttgcactgagaaacgtttacgacatgaaaattgaatgccctcacaccgtgtccttcggcgaaaattctgtattggggtatgtggaattaccaccgatgcccctggccgatacaatacagatggtccctgagtcaagttgtagcatggacaaccatcaatccatgtctactgcgacgaagtacacccaggtgtcgtggaggggaaaagctgatcaggcccagtcaagccaaacaagttttgaaactgtttccgtggaggtcgacctaaagggtacctgcgtgctcaaacacaagatggtagagaagtcttatcggagccgcaaatccctgacatgttacgatctttcatgcaatagtacctattgtaagccaactctgtacatgatcgttcccattcatgcatgcaacatgatgaaaagctgtatcattgccttgggcccttatcgagtgcaggtcgtgtacgaacgtacatactgcatgaccggggtgctcctggagggaaagtgtttcgtcccagaccagtctgttgtgtccatcgtaaaacactcaatatttgatatcgctagcgtgcatattgcatgcttctttgtcgccatcacgggcaatacttataagctgattgaacaggtgaagaccagtttcggtacaacttgtaacgacaccgaggataaagttcaagggtactatatctgcatactcggaggcaattctccccctatttacgtgccaacattagacgattttagatccatggaggctttcagcggcatctttaggtcgccgcacggggaagaccacgatctggccggagaggaaattgcgtcttattccatcgtcggtcccgcaaacgccaagatccctcattcagctagtagcgacaccctttccttgattgccttctctggcataccaagctactcaagtctgtccatcctaacgagctctactgaggcaaaacacgtgttttcacccgggcttttccctcagctgaatcatacaaagtgcgacaaaaccgctattccacttacttggacaggaatcatagatctgcccggctattacgaagccgtacacccgtgtaccgtgttttgcgttttgagtggtcctggggcgagctgtgaggccttctccgagggaggcattttcaacatcacgtctcccatgtgcctcgtctcgaagcagaatcggtttcgcctgaccgaacagcaagtgaacttcgtctgtcagagagtggacatggatatcgttgtgtactgcaatggccagaggaaagtaattttaacaaagactctggtcatcgggcaatgtatttataccataacaagcctcttttcccttctgccaggagtggcacactcaatcgctgttgagttgtgcgtgcctggtttccatggctgggccactgctgccctactggtcaccttttgtttcgggtgggtgctcattcccgcaatcacatttgtagtgctgaccgttcttaagttcatcgccaacatttttcacacttccaatcaggaaaaccggctgaaaatggtcttgaagaaaataaaggaggagttcgagaaaacgaagggatctatggtgtgcgacatctgtaagtacgagtgcgaaacatataaagagctcaaggctcatggcgtgagctgcccacagtcccagtgtccctactgctttacccactgtgaacctactgagtcagcgttccaagcacattatcgcgtctgccaggttacccaccgatttagagaagatctgaaaaagacagtgaccccacagaacttcactccgggttgttacaggacattaaatctgttccggtataaaagccgttgctacatttttacgatgtggatcttcctactcgtgctggagtctattctttgggccgcttccgccagtgagacccccttgagccctacttggaacgacaatgcacacggggtaggctctatcccaatgcatacagatctggaactcgacttttccctgacctcaagtagcaagtacacatatcgcagaaagctcactaaccccctggaggaagcccaggctgtctcgttccacgtggagatagaggaacaaaccatcggagttgatgtgcatgccttgggccactggtttgacgggaggctcaatctgaaaacgtccttccactgttacggagcatgcaccaagtatgagtacccttggcatacagcgaaatgtcactatgaacgggattaccagtatgagacttcttggggttgcaacccaagcgactgtcccggcgtcgggaccggatgcacagcttgcggcttatacctggaccagctaaagccggtgggttcagcctacaaaattatcactattcgatatagtcgcagagtttgtgtgcagtttggggaagagaatctctgcaaggtaatcgatatggacgattgtttcgtctccaggcatgtgaaggtgtgcataattggcaccgtctctaaatttagccaaggagacacgctgcttttctttggccctttggaagggggaggtctgatctacaagcactggtgtacaagtacctgccagttcggcgatccaggggacattatgtcaccccgggataaaggactcctgtgtcctgagtttcccggcagcttccgcaagaaatgcaacttcgcaactacaccagtttgtgagtatgacggtaatatggtgagtgggtacaagaaagtaatggccaccatcgattcttttcagtccataaacactagcaccatgcatttcacagacgaaagaatcgagtggaaggatcctgacggcatgttaagggatcacattaatatcctggtgacgaaggacattgactttgataaccttggagaaaatccctgcaaaatcggcttgcagacctcgtcaatagagggggcttggggatctggcgtcggtttcactctcacatgtctgattagtctaaccgagtgcccaacatttctgacttccatcaaggcctgcgacaaagcaatctgttatggggctgaaagcgtgaccctcacgcgtggacaaaacacagttaaggtgtctggcaaaggtggccacagcgggtccaccttcaagtgctgtcatggagaggattgctcacagagtggcctgcacgccgcggccccgcatcttgacaaggtcaatgggattagcgaaatggagaactctaaagtgtacgatgacggagctcctcagtgtggcatcaagtgctggtttgttaaatccggtgaatggatttcagggatattcagtggaaactggatcgtgttgattgtcctgtgtgtatttttactcttcagcctggtgcttctgtccatcttgtgccccgttcggaagcacaaaaagtcttga

SEQ ID NO: 10100 - RNA, 3408 nt, synthetic construct
  misc_feature 1..3408: note = derived and/or modified CDS sequence (opt3) from HTNV(CGAa4P15)__EF990928.1__GP
  source 1..3408: mol_type = other RNA
atggagatctggaagtggctggtgatggccagcctcgtctggcccgctcttgcactgagaaacgtttacgacatgaaaattgaatgccctcacaccgtgtccttcggcgaaaattctgtattggggtatgtggagttaccaccgatgcccctggccgatacaatacagatggtccctgagtcaagttgtagcatggacaaccatcaatccatgtctactgcgacgaagtacacccaggtgtcgtggaggggaaaagctgatcaggcccagtcaagccaaacaagttttgaaactgtttccgtggaggtcgacctaaagggtacctgcgtgctcaaacacaagatggtagagaagtcttatcggagccgcaaatccctgacatgttacgatctttcatgcaatagtacctattgtaagccaactctgtacatgatcgttcccattcatgcatgcaacatgatgaaaagctgtatcattgccttgggcccttatcgagtgcaggtcgtgtacgaacgtacatactgcatgaccggggtgctcctggagggaaagtgtttcgtcccagaccagtctgttgtgtccatcgtaaaacactcaatatttgatatcgctagcgtgcatattgcatgcttctttgtcgccatcacgggcaatacttataagctgttcgaacaggtgaagaccagttttggtacaacttgtaacgacaccgaggataaagttcaagggtactatatttgcatcctcggaggcaattctccccctatatacgtgccaacattagacgatttcagatccatggaggcttttagcggcattttcaggtcgccgcacggggaagaccacgatctggccggagaggaaatcgcgtcttattccattgtcggtcccgcaaacgccaagatccctcattcagctagtagcgacaccctttccttgatcgccttttctggcattccaagctactcaagtctgtccatactaacgagctctactgaggcaaaacacgtgttctcacccgggctctttcctcagctgaatcatacaaagtgcgacaaaaccgctatcccacttacttggacaggaattatcgatctgcccggctattacgaagccgtacacccgtgtaccgttttctgcgtgttgagtggtcctggggcgagctgtgaggccttctccgagggaggcatatttaacattacgtctcccatgtgcctcgtctcgaagcagaatcggttccgcctgaccgaacagcaagtgaactttgtctgtcagagagtggacatggatatcgttgtgtactgcaatggccagaggaaagtaatcttaacaaagactctggtcattgggcaatgtatctataccattacaagcctcttctcccttctgccaggagtggcacactcaatagctgttgagttgtgcgtgcctggttttcatggctgggccactgctgccctactggtcaccttctgttttgggtgggtgctcatccccgcaattacattcgtagtgctgaccgttcttaagtttatcgccaacatcttccacacttccaatcaggaaaaccggctgaaaatggtcttgaagaaaattaaggaggaatttgagaaaacgaagggatctatggtgtgcgacatatgtaagtacgagtgcgaaacatataaagagctcaaggctcatggcgtgagctgcccacagtcccagtgtccctactgcttcacccactgtgaacctactgagtcagcgtttcaagcacattatcgcgtctgccaggttacccaccgattcagagaagatctgaaaaagacagtgaccccacagaacttcactccgggttgttacaggacattaaatctgtttcggtataaaagccgttgctacatcttcacgatgtggatttttctactcgtgctggagtctatcctttgggccgcttccgccagtgagacccccttgagccctacttggaacgacaatgcacacggggtaggctctattccaatgcatacagatctggaactcgacttctccctgacctcaagtagcaagtacacatatcgcagaaaacttactaaccccctggaggaagcccaggctgtctcgtttcacgtggagatcgaggaacaaaccataggagttgatgtgcatgccttgggccactggttcgacgggaggctcaatctgaagacgtcctttcactgttacggagcatgcaccaagtatgagtacccttggcatacagcgaaatgtcactatgaacgggattaccagtatgagacttcttggggttgcaacccaagcgactgtcccggcgtcgggaccggatgcacagcttgcggcttatacctggaccagctaaagccggtgggttcagcctacaaaatcattactatccgatatagtcgcagagtttgtgtgcagttcggggaagagaatctctgcaaggtaattgatatggacgattgttttgtctccaggcatgtgaaggtgtgcatcataggcaccgtctctaaattcagccaaggagacacgctgttgtttttcggccctcttgaagggggaggtctgatttttaagcactggtgtacaagtacctgccagttcggcgatccaggggacatcatgtcaccccgggataaaggattcctctgtcctgagtttcccggcagcttccgcaagaaatgcaactttgcaactacaccagtttgtgagtacgacggtaatatggtgagtgggtataagaaagtaatggccaccattgattctttccagtccatcaacactagcaccatgcattttacagacgaaagaatagagtggaaggatcctgacggcatgctgagggatcacatcaatattttagtgacgaaggacatcgacttcgataacctgggagaaaatccctgcaaaattggccttcagacctcgtcaatcgagggggcttggggatctggcgtcggttttactttgacatgtctcataagtctgaccgagtgcccaacattcctaacttccattaaggcctgcgacaaagcaatctgttacggggctgaaagcgtgaccctgacgcgtggacaaaacacagttaaggtgtctggcaaaggtggccacagcgggtccacctttaagtgctgtcatggagaggattgctcacagagtggcctccacgccgcggccccgcatctggacaaggtcaatgggatcagcgaaatggagaactctaaagtgtatgatgacggagctcctcagtgtggcattaagtgctggttcgttaaatccggtgaatggatctcagggatttttagtggaaactggatagtgcttatcgtcttgtgtgtattcctgttattcagcctcgtgctgctttccattctgtgccccgttcggaagcacaaaaagtcttga

SEQ ID NO: 10101 - RNA, 3408 nt, synthetic construct
  misc_feature 1..3408: note = derived and/or modified CDS sequence (opt3) from HTNV(CGAa75)__EU092224.1__GP
  source 1..3408: mol_type = other RNA
atggagatctggaagtggctggtgatggccagcctcgtctggcccgctcttgcactgagaaacgttcacgacatgaaaattgaatgccctcataccgtgtccttcggcaaaaattctgtaatagggtacgtggagttgccaccgatgcccttagccgatacaatccagatggtccctgaatcaagttgtagcatggacaaccaccaatccctgtctactgtgacgaaacatacccaggtttcgtggaggggaaaggcggatcaggctcagtcaagccaaacaagttttgagactgtgtccgtcgaagtggacctaaaaggtacctgcgtactcaagcacaagctggttgaggagtcttatcggagccgcaaatcccttacatgttacgatctgtcatgcaatagtacctattgtaagccaactttgtacatgattgtgcccatccatgcctgcaacatgatgaaaagctgtattatcgcactcggccctcaccgagtccaggtggtgtatgaacgtacatactgcatgaccggggtcctgctggagggaaagtgtttcgttccagaccagtctgtggtatccatagtgagacacggcatctttgatattgcctcagtccatatcgcttgcttctttgtggcaattacgggtaatacttataaactcttcgaacaggttaaaaagagctttgggaccacatgtaacgacactgagaataaagtgcaaggatactacatctgcatattaggcggcaacagtccccctatttatgtcccaaccctggatgacttcaggtctatggaggccttttccgggatcttcaagagcccgcacggagaagatcatgaccttgctggtgaggaaattgcctcgtactctatcgtgggccccgcgaatgcaaaagtacctcactccgcctcaagtgatacattgagcctgatcgctttttccgggattccatcttatagctcactaagtatactcacctccagcacggaggccaagcacgttttctctcccggactgtttcctcagcttaaccatactaaatgcgacaagacagcaatcccactgacctggactggcattatcgacttgcccggttactatgaagctgtgcacccgtgtacagtcttctgcgtgctctcagggcctggagccagttgtgaggcgttcagcgagggcggcatatttaatattacctcccccatgtgcctggtctctaaacagaaccggttccgcttaacggaacagcaagtgaattttgtttgtcagagagtggatatggacatcgtagtctactgcaacgggcagaggaaggtgatcctgaccaagacactcgttattggacaatgtatctatactattacctcgcttttcagcctgttgccaggtgtggcccattccatagcagtcgagctatgcgtgcctggctttcacgggtgggctacagccgctctgctcatcactttctgttttggatgggtactgattcccgcccttaccttcatcgtgctgacagttttgaaatttatcgcaaatattttccatacctcaaaccaggaaaaccggctcaagatggtcctgaaaaagataaaagaggaatttgagcgcactaagggcagtatggtgtgcgatatctgtaagtacgagtgcgaaacgaataaagagttaaaggcccacggtgtgtcttgcccacagagccagtgtccctactgcttcacacactgtgaacctaccgagtccgcttcacaagcgcattatcgagtctgccaggttactcacagatttagggacgatctgaaaaagaccgtgacaccacagaacttcaccccggggtgttaccggactctaaatctcttccgttataaaagccgctgctacatttttacaatgtggatctgtctgcttgtgttggaatctattctgtgggcagcctccgctagtgagatccccctcagccctacgtggaacgacaatgcccatggcgtaggatctataccaatgcacaccgatctggagcttgacttctccctgacttcaagtagcaagtatacatacagaaggaagttgaccaaccccctcgaagagtcgcaggcagtcaattttcacgtggaaatcgaggagcaagccattggcgttgatgtgcatgctctggggcactggttcgacggacggttaaacctgaaaacatcctttcattgctatggtgcctgtactaagtacgaatacccttggcacaccgcaaaatgccattatgagcgagattaccagtatgaaacgtcttggggctgtaatccaagcgactgccccggggtcggaaccggctgcacagcgtgtggtctatacctcgaccagctgaagccggtggggtcagcttataaaatcattactatccgctacagtagaagggtttgcgtgcagttcggcgaggaaaacctttgtatagtaattgatatgaatgactgctttgtctcccggcacgtgaaggtgtgtatcattggaaccgtctctaagttcagccaaggcgatacattgctgtttttcgggcctctcgagggaggtggcctgatcttaaaacactggtgcacttccacctgtcagtttggggacccaggagatataatgtcaccccgcgacaagggcttcctgtgccctgagtttcccggtagcttcagaaagaagtgtaacttcgccacgacaccagtttgcgaatatgggggcaatatggtgagtggatacaaaaaggtaatggcaaccatcgattcttttcagtccttcaacactagcacaatgcattttaccgacgagaggattgaatggaaagatcctgacggcatgcttcgtgatcacatcaatattttggtgactaaggacatcgatttcgacaacctcggggagaacccctgtaagataggactgcagacctcgtcaattgaaggcgcctggggttctggggtcggatttacactaacgtgcctgatcagtctcaccgagtgcccaactttcctgacatccatcaaggcttgtgacaaggccatttgctacggcgcagagagcgtgacccttacacggggtcaaaatactgttaaagtgtctggcaaagggggacatagcggctccacctttaagtgttgccacggggaagattgttcacagagtggattgcatgctgccgcgccgcacctggacaaggtcaacggcatcagcgagattgaaaattctaaggtgtatgatgacggtgcccctcagtgcgggataaaatgttggttcgttaagtccggagagtggatctcaggcatttttagtggtaactggatcgtgttaattgtcctctgcgtattcctgctttttagcctggtgttgctctccatcctgtgtcccgttcgaaaacacaaggaatcttga

SEQ ID NO: 10102 - RNA, 3408 nt, synthetic construct
  misc_feature 1..3408: note = derived and/or modified CDS sequence (opt3) from HTNV(CGHu2)__EU363819.1__GP
  source 1..3408: mol_type = other RNA
atgggcatctggaagtggctggtgatggccagcctcgtctggcccgctttcgcacttagaaacgtttacgacatgaaaattgagtgccctcacaccgtgtcctttggggaaaattctgtaataggatatgtggagctgccaccgatgcccttggccgatacaactcagatggtccctgaatcaagttgtagcatggacaaccatcaatccttaaatacgatcaccaagtacacacagattatctggaggggtaaagcggatcagtctcagtcgtcacaaaacagcttcgagactgtgagtaccggcgttgacctgaaggggacatgcgtgctaaaacacaagatgattgaagagtcctatcggtctcgcaagagcatcacctgttacgatctctcctgcaattcaacttattgtaaaccaacactgtacatgatagtccccatccatgcttgcaacatgatgaagagttgtcttattgccctgggaccttatcgagtgcaggtagtttacgagcgtacctactgcatgacgggcgtgttgatcgaaggtaaatgttttgtcccagaccagagcgtggtgtctattatcaagcacgggatattcgatattgcatccgtccatatcgtttgcttttatgtggccgtaaaaggaaatacttacaagattttcgaacaggtgaagaaatcatttgagagcaactgtaatgacaccgagaacaaggtccaaggctattacatctgcatcattggcgggaatagttctcccgtgtatgttcctacactcgatgacttcagatccatggaggcttttagcggaataatcaggtcgccacacggtgaagatcacgacctggcaggcgaggaagtggcctcttactccattgtcgggccggctaacgccaaagtgccccattcagcgagtagcgatactctgggactcatcgcatattccggcataccttcttacagctcattaagtattctgacctccagcacagaggccaagcacgtattctctccaggtctttttccccagttgaatcataccaaatgcgacaagacggctatccctctgacttggacagggatgatcgacctaccaggatactatgaagccattcacccctgtaccgttatctgcgtgctctcaggcccgggcgcaagttgtgaggctctgagcgaagggggaattttcaacataacttcccctatgtgccttgtctctaaacagaatcggtttcgcctgacagagcagcaagtgaacttcgtctgtcagagagtggatgttgacatcattgtgtactgcaacggtcagaggaaggtaatcttgaccaagacgctcgtcatcggccaatgtatttataccataacatcgctgttcagcttactgcccggggtggcccactccatcgcggttgagctctgcgtgccaggatttcatggctgggccactgcagcccttctggtcaccttctgttttggttgggtgttgattcctgctatcacattcattatcctaactatactgaaatttatcgctaatattttccacacctcaaaccaggaaaatcggctcaagagtgtactgcgcaaaatcaaggaggaatttgagcgaacaaaagggtctatggtgtgcgatatttgtaagtacgagtgcgaaacctataaggagcttaaagcccatggcgttagctgcccccagtcccagtgtccatactgcttcactcactgtgaacccacggaggcagcctttcaagctcattatagagtctgccaggtgacacacaggttccgggacgatctgaagaaaaccgtgactcctcagaactttaccccaggatgttaccgtacattgaatctcttccgctacaagtcaagatgctatatctttaccatgtggatatgtctgttagtcctggaaagcattctatgggcggcatctgcctccgagatcccgctcaaccccgtttggaatgacaacgctcacggcgtggggagtattcctatgcatactgatctggagcttgacttcagcttgacatcttcctcaaaacacacgtacaggcggaagctgaccaatccactcgaagagagtcaggccatcgatctgcatgtggaaatagaggagcaaactatcggagtagacgtccacgcacttggtcactggttcgatggccgactgaacttgaagaccagctttcattgctatggggcctgtacaaaatacgaatatccctggcacacagctaagtgccattacgagcgcgactatcagtacgaaacttcgtggggatgtaatccttccgactgcccaggcgtgggtaccgggtgcacggcctgtggcctctacctggatcagttaaaacccgttggatctgcatataagattatcaccattagatacagcaggcgggtgtgcgtccagttcggcgaggaaaacctgtgtaaagtgatcgacatgaatgattgctttgtttcacgccacgtgaaggtatgtataattgggacagtcagtaagttctcccaaggagacactctactctttttcggtccgctggagggcgggggacttatctttaaacattggtgcacctctacatgtcagttcggcgatcctggtgacatcatgagcccaagagataaggggtttttgtgccccgagttccctggctcctttaggaaaaagtgtaacttcgcgactacccccgtgtgcggatatgacggcaatatggtgtcagggtacaaaaaggtcatggctacgattgatagctttcagagtttcaacacatctaccatgcacttcactgacgaacgtatcgagtggaaagatccagacggaatgctgcgggatcacattaacatactcgttacaaaggacatcgactttgataatctgggcgaaaacccttgtaagattggtttacagacctccagcatcgagggggcctggggatcgggcgtgggtttcactctgacctgccttatttcattgacagaatgccccacgtttctcacctctatcaaagcatgtgacaaggccatatgctatggcgctgagagtgtaactctgacacgagggcaaaataccgtgaaagtctccggaaagggcgggcatagcggatctacattcaaatgttgccacggcgaggattgtagccagtccggtctacatgccgcagctccacacctggacaaggtgaacgggatctcagaaattgagaatagtaaggtttacgatgacggagccccgcagtgcggcatcaaatgttggtttgtcaagagcggtgaatggatttctggcatcttctccgggaactggatagtgctcattgtgctgtgcgtttttcttttgttctcactggtgttactcagtatcctgtgtcctgtcagaaaacataagaaaagctga

SEQ ID NO: 10103 - RNA, 3408 nt, synthetic construct
  misc_feature 1..3408: note = derived and/or modified CDS sequence (opt3) from HTNV(CGHu3)__EU363818.1__GP
  source 1..3408: mol_type = other RNA
atggagatctggaagtggctggtgatggccagcctcgtctggcccgctcttgcactgagaaacgttcacgacatgaaaattgaatgccctcataccgtgtccttcggcaaaaattctgtaatagggtacgtggagttgccaccgatgcccttagccgatacaatccagatggtccctgaatcaagttgtagcatggacaaccaccaatccctgtctactgcgacgaaatatacccaggtgtcgtggaggggaaaggctgatcaggcccagtcaagccaaacaagttttgagactgtttccgtggaagtcgacctaaaaggtacctgcgtgctcaagcataagctggtagaggagtcttaccggagccgcaaatcccttacatgttatgatctgtcatgcaatagtacctactgtaagccaactttgtatatgattgttcccatccacgcatgcaacatgatgaaaagctgtattatcgccctcggccctcatcgagtgcaggtcgtgtacgaacgtacatattgcatgaccggggtgctgctggagggaaagtgtttcgtcccagaccagtctgttgtgtccatagtaagacacggcatctttgatattgcttcagtgcacatcgcatgcttctttgtcgccattacgggtaatacttacaaactcttcgaacaggtgaagaagtcctttgggaccacatgtaacgacactgagaataaagttcaaggatactatatctgcatattaggcggcaacagtccccctatttacgtgccaaccctggatgacttcaggtctatggaggctttttccgggatcttcaagagcccgcatggagaagatcacgaccttgccggtgaggaaattgcgtcgtattctatcgtcggccccgcaaatgccaaagtgcctcattccgcttcaagtgatacattgagcctgatcgccttttccgggattccatcttacagctcactaagtatactcacctccagcacggaggcaaagcacgtattctctcccggactgtttcctcagcttaaccacactaaatgcgacaagacagctatcccactgacctggactggcattatcgacttgcccggttattacgaagccgttcatccgtgtacagtgttctgcgtcctctcagggcctggagcgagttgtgaggccttcagcgagggcggcatatttaatattacctcccccatgtgcctggtgtctaaacagaaccggttccgcttaacggaacagcaagtcaattttgtgtgtcagagagttgatatggacatcgtggtatattgcaacgggcagaggaaggtcatcctgaccaagacactcgtgattggacaatgtatctacactcttacctcgctgttcagcttgctaccaggtgttgcacactccattgctgtggagctgtgcgtccctggctttcatgggtgggccacagctgccctcctgataactttctgttttggatgggtgcttatccccgcactgaccttcattgtattgacagtgctcaaatttatcgccaatatcttccacacctcaaaccaggaaaaccggctgaagatggttttaaagaagattaaagaggaatttgagcgcactaagggcagtatggtctgcgatatatgtaagtacgagtgcgaaacgtataaagagctgaaggctcatggtgtgtcttgcccacagagccagtgtccctactgcttcacacactgtgaacctaccgagtccgcgtttcaagcacactatcgagtgtgccaggtcactcatagattcagggacgatctgaaaaagaccgttacaccacagaatttcaccccggggtgttaccggactctcaacctgtttcgttataaatcacgctgctacatcttcacaatgtggatttgtcttttggtgctggaaagcatcctctgggccgcttctgcctccgagattcccctgagtcctacgtggaatgacaacgcacacggcgtgggaagcatcccaatgcataccgatcttgagctggacttttctttgacttcctcaagtaagtatacatacagaaggaagctcaccaatcccctggaagagagccaggccgtaaacttccacgtcgaaatagaggagcaagctatcggcgtggatgttcacgccttagggcattggtttgacggacggctgaatctaaaaacatcgttccactgctacggtgcatgtactaagtatgaatacccttggcataccgcgaaatgccactatgagcgagattaccagtatgaaacgtcctggggctgtaacccatctgactgccccggggtgggaaccggctgcacagcttgtggtctctacctggaccagcttaagccggtcgggagcgcctataaaattatcactattcgctactcaagaagggtgtgcgttcagtttggcgaggaaaatttgtgtaaggtgatcgatatgaacgactgcttcgtaagtcggcatgtcaaggtgtgtataattggaaccgtgtccaaattttctcaaggcgatacactactcttctttgggcctctggagggaggtggcttaatcttcaagcactggtgcactagcacctgtcagtttggggacccaggagatattatgagcccccgcgacaaaggcttcctgtgccctgagttccccggttcatttagaaagaaatgtaatttcgcaacgacaccagtctgcgaatacgatgggaacatggttagcggctataagaaagtgatggccaccatcgacagttttcagtctttcaatacttccacaatgcactttaccgatgagaggatagaatggaaggaccctgatggaatgcttcgtgaccatatcaacattttggtaactaaggatatcgacttcgacaatctcggcgagaacccctgtaaagtggggctgcggaccagctcgattgaaggagcttggggctcaggtgtcgggtttacactaacgtgcctgatctctctcaccgagtgcccaactttcctgacaagtataaaggcctgtgataaagcaatttgctacggagctgagtccgtgacccttacacgaggccagaacactgttaaggtgagcggtaaaggcgggcactctggaagcacctttaagtgttgccatggcgaagactgttcccaatcagggttgcacgccgcggccccgcatctggataaggtcaatggaatcagtgagatcgaaaacagcaaagtgtatgacgatggcgctcctcagtgcggtattaagtgttggttcgttaaatctggggagtggatctccggaatattttcaggcaattggattgtgttaatcgtcctctgcgtattcctgcttttcagtctggtgttgctcagcattctgtgtcccgttagaaagcacaaaaagtcctga

SEQ ID NO: 10104 - RNA, 3408 nt, synthetic construct
  misc_feature 1..3408: note = derived and/or modified CDS sequence (opt3) from HTNV(CGHu3612)__EF990923.1__GP
  source 1..3408: mol_type = other RNA
atgggcatctggaagtggctggtgatggccagcctcgtctggcccgctttcgcacttagaaacctgtacgacatgaaaattgagtgccctcacaccgtttcctttggggaaaattctgtgacaggatatgtagagttgccaccgatgcccttagccgatactacgcagatggtgcctgaatcaagttgtagcatggacaaccatcaatccctgaataccataacaaagtacactcagatcatttggaggggtaaagcggatcagtctcagtcgtcacaaaacagcttcgagaccgtcagtacagaagtggacctaaaggggacctgcgttctcaaacacaagatgatcgaggagtcctatcggtctcgcaagagcattacttgttacgatctgtcctgcaattcaacatattgtaaaccaaccctttacatgatcgtgcccatacatgcttgcaacatgatgaagagttgtctgatcgccttgggcccttatcgagtccaggtggtatacgaacgtacgtactgcatgactggagttctcattgagggcaaatgttttgtgccagaccagagcgtcgtgtctatcattaagcacggtatcttcgatatagcatccgtgcatattgtctgctttatcgttgccgtgaaagggaatacctataagattttcgaacaggtaaagaaaacatttgagtcaaactgtaatgacactgagaacaaggtgcaaggatactatatctgcatcattggcggcaatagcagtcccgtctacgtgcctaccctggatgacttcagatctatggaagcattttccgggataatcaggagcccacacggagaggatcacgacctggctggtgaagaggttgcctcgtattctattgtgggcccggctaacgccaaagtcccccattccgcgtcaagtgatacactcgggttaatcgcatacagctccataccttcttatagctcactgagtattcttacctccagcacggaagccaagcacgtgttctctccaggattgtttcggcagctgaatcatactaaatgcgacaagacagctatccccctaacctggactggcatgatcgacctccctggttactacgaggccattcacccatgtacagtattctgcgttctgtcagggcccggagcaagttgtgaggcttttagcgaaggcggcatcttcaacattgcctccccgatgtgccttgtgtctaaacagaatcgcttcagactgaccgagcagcaagtcaactttgtgtgtcagagggtcgatgtggacataatcgtttattgcaacgggcagcggaaggtgattttgacgaagaccctcgtaatcggacaatgtatctacacaattacttcgctgttcagcttactgcctggtgtcgcgcactccatagccgtggaactctgcgttcccggctttcatgggtgggcaaccgctgcccttctggtgacattctgttttggatgggtcttgatcccagctattactttcatcattctaaccatcctgaaatttatagccaatatcttccacacatcaaaccaggagaatcgcctcaagagtgtgctgcgaaaaattaaggaagagtttgagagaaccaaaggctctatggtatgcgatatctgtaagtatgaatgcgagacttacaaggaacttaaagcacatggtgtgagctgccctcagtcccagtgtccctattgcttcacgcactgtgagccaacagaagccgcttttcaagcgcattacaaggtttgccaggtcacccacaggttccgggacgatctgaaaaagactgtgactccccagaactttacacctgggtgttatcgtaccttgaatctcttccgctacaaatcaagatgctacattttcactatgtgggtgtttctgttagtcctggagagcatcctatgggcagcctctgcttccgagataccactcaacccggtttggaatgacaacgcccacggcgtgggaagtattcccatgcatacagatctggaacttgacttcagcttgacgtcttcctcaaagtatacctacaggcggaagctgactaatcctctcgaggaaagtcaggcaatcgatctgcacgtggagattgaggaacaaacaatcggcgtagacgtccatgcccttgggcactggtttgatggacgactgaacttgaaaaccagcttccactgttatggtgcttgcacaaagtacgagtatccatggcatactgccaaatgtcactacgaacgcgactatcagtacgagacctcgtggggctgcaatccctccgactgtcctggggtgggaacgggctgcaccgcatgcggtctctacctggatcagttaaagccagttgggtctgcgtataaaataatcacaattagatacagcaggcgggtgtgtgtccagtttggcgaagagaacctgtgcaagatcattgacatgaatgattgtttcgtgtcacgccatgttaaggtgtgcatcataggaactgtaagtaaattttcccaaggcgacaccctactcttctttgggcccctggagggaggtggccttattttcaagcactggtgtacatctacttgccagtttggggatccgggagacatcatgagccctagagataaaggcttcttgtgtccagaatttcccggttccttcaggaagaaatgcaacttcgctaccacgcctgtctgtgagtatgacgggaatatggtgtcaggctacaagaaagtgatggccacaatcgatagcattcagagttttaacacctctactatgcatttcacagacgaacgtatcgagtggaaggatcccgacggaatgctgcgggatcacattaacatactcgtcaccaaggacatcgactttgataatctgggcgaaaacccatgcaaaattgggttacagacttccagcatcgagggagcatggggctcgggtgttgggttcaccctgacatgtcttatttcattgacggagtgctctacctttctcaccagtatcaaggcctgcgacaaagctatatgttatggagccgaatccgtgacactgacccgaggccaaaatacagtaaaggtgagcggtaaaggcgggcactctggaagctccttcaagtgctgtcatggcgaggaatgctcacagatcgggctacacgcagctgcccctcatctggataaggtcaacggaattagtgagatggaaaatagcaaagtgtttgacgatggcgcgccccagtgtggtatcaagtgctggttcgttaaatctggggagtggatttccggaatcttttcaggcaactggatagtgctcattgtcctgtgtgtgttccttttgtttagtctggttttactcagcatcctgtgcccagtgagaaagcacaaaaagtcctga

SEQ ID NO: 10105 - RNA, 3408 nt, synthetic construct
  misc_feature 1..3408: note = derived and/or modified CDS sequence (opt3) from HTNV(CGHu3614)__EF990922.1__GP
  source 1..3408: mol_type = other RNA
atgggcatctggaagtggctggtgatggccagcctcgtctggcccgctttcgcacttagaaacctgtacgacatgaaaattgagtgccctcacaccgtttcctttggggaaaattctgtgacaggatatgtagagttgccaccgatgcccttagccgatactacgcagatggtgcctgaatcaagttgtagcatggacaaccatcaatccctgaataccataacaaagtacactcagatcatttggaggggtaaagcggatcagtctcagtcgtcacaaaacagcttcgagaccgtcagtacagaagtggacctaaagggcacttgcgttctcaaacacaagatgatcgaggagtcctatcggtctcgcaagagcattacttgttacgatctgtcctgcaattcaacatattgtaaaccaaccctttacatgatcgtgcccatacatgcttgcaacatgatgaagagttgtctgatcgccttggggccttatcgagtccaggtggtatacgaacgtacgtactgcatgactggagttctcattgagggcaaatgttttgtgccagaccagagcgtcgtgtctatcattaagcacggtatcttcgatatagcatccgtgcatattgtctgctttttcgttgccgtgaaagggaatacctataagatctttgaacaggtaaagaaaacattcgagtcaaactgtaatgacactgagaacaaggtgcaaggatactatatttgcatcatcggcggcaatagcagtcccgtctacgtgcctaccctggatgactttagatctatggaggctttctccgggatttttaggagcccacacggagaagatcacgacctggccggtgaagaggttgcctcgtattctatagtgggcccggctaacgccaaagtcccccattccgcgtcaagtgatacactcgggttaatcgcatacagctccattccttcttatagctcactgagtatccttacctccagcacggaagccaagcacgtgttctctccaggattgtttccccagctgaatcatactaaatgcgacaagacagctatacctctaacctggactggcatgattgacctcccaggttactacgaggccatccacccctgtacagtattctgcgttctgtcagggccgggagcaagttgtgaggctttcagcgaaggcggcatctttaacattgcctcccctatgtgccttgtgtctaaacagaatcggttccgcctgaccgagcagcaagtcaactttgtgtgtcagagagtcgatgtggacatcattgtttattgcaacgggcagaggaaggtgatattgacgaagaccctcgtaatcggacaatgtatttacacaatcacttcgctgttcagcttactgcccggtgtcgcgcactccatcgccgtggaactctgcgttccaggctttcatgggtgggcaaccgctgcccttctggtgacattctgttttggatgggtcttgattcctgctataactttcatcattctaaccatcctgaaatttattgccaatatcttccacacatcaaaccaggagaatcggctcaagagtgtgctgcgcaaaataaaggaagagtttgagcgaaccaaaggctctatggtatgcgatatctgtaagtatgaatgcgagacttacaaggaacttaaagcacatggtgtgagctgcccccagtcccagtgtccatattgcttcacgcactgtgagcccacagaagccgcttttcaagcgcattacaaggtttgccaggtcacccacagattcagggacgatctgaaaaagactgtgacccctcagaacttcacaccagggtgttatcggaccttgaatctctttcgttacaaatcacgctgctacattttcactatgtgggtgtttctgttagtcctggagagcatcctatgggcagcctctgcttccgagattccgctcaaccccgtttggaatgacaacgcccacggcgtgggaagtatccctatgcatacagatctggaacttgacttcagcttgacgtcttcctcaaagtatacctacagaaggaagctgactaatccactcgaggaaagtcaggcaatagatctgcacgtggagattgaggaacaaacaatcggcgtagacgtccatgcccttgggcactggtttgatggacggctgaacttgaaaaccagcttccactgttatggtgcttgcacaaagtacgagtatccctggcatactgccaaatgtcactacgaacgagactatcagtacgagacctcgtggggctgcaatccttccgactgtccaggggtgggaacgggctgcaccgcatgcggtctctacctggatcagttaaagcccgttgggtctgcgtataaaattatcacaatacgctacagcagaagggtgtgtgtccagtttggcgaagagaacctgtgcaagatcattgacatgaatgattgtttcgtgtcacggcatgttaaggtgtgcatcattggaactgtaagtaaattttcccaaggcgacaccctactcttctttgggccgctggagggaggtggccttatcttcaagcactggtgtacatctacttgccagtttggggatcctggagacataatgagcccacgcgataaaggcttcttgtgtcccgagttccctggttcctttagaaagaaatgcaacttcgctaccacgcccgtctgtgaatatgacgggaatatggtgtcaggctacaagaaagtgatggccacaattgatagctttcagagtttcaacacctctactatgcattttacagacgaaaggatcgagtggaaggatccagacggaatgctgcgtgatcacatcaacattctcgtcaccaaggacatcgacttcgataatctgggcgaaaacccttgcaaaattgggttacagacttccagcatagagggagcatggggctcgggtgttgggtttaccctgacatgtcttatctcattgacggagtgctctaccttcctcaccagtattaaggcctgcgacaaagctatctgttatggagccgaatccgtgacactgacccggggccaaaatacagtaaaggtgagcggtaaaggcgggcactctggaagctcctttaagtgctgtcatggcgaggaatgctcacagattgggctacacgcagctgcaccccatctggataaggtcaacggaatcagtgagatggaaaatagcaaagtgttcgacgatggcgcgccacagtgtggtataaagtgctggtttgttaaatctggggagtggatctccggaattttctcaggcaactggatcgtgctcattgtcctgtgtgtgttccttttgtttagtctggttttactcagcatcctgtgcccggtgcgaaagcacaaaaagtcctga

SEQ ID NO: 10106 - RNA, 3408 nt, synthetic construct
  misc_feature 1..3408: note = derived and/or modified CDS sequence (opt3) from HTNV(CGRn15)__EU363814.1__GP
  source 1..3408: mol_type = other RNA
atggagatctggaagtggctggtgatggccagcctcgtctggcccgctcttgcactgagaaacgttcacgacatgaaaattgaatgccctcataccgtgtccttcggcaaaaattctgtaatagggtacgtggagttgccaccgatgcccttagccgatacaatccagatggtccctgaatcaagttgtagcatggacaaccaccaatccctgtctactgtgacgaagtatacccaggtttcgtggaggggaaaggcggatcaggctcagtcaagccaaacaagttccgagactgtgtctgtcgaagtggacctaaaaggtacctgcgtactcaagcataagctggttgaggagagctaccggtcccgcaaatcacttacatgttatgatctgagttgcaatagcacctactgtaagccaactttgtatatgattgtgcccatccacgcctgcaacatgatgaaatcttgtattatcgcactcggccctcatcgagtccaggtggtgtacgaacgtacatattgcatgaccggggtcctgctggagggaaagtgttttgttccagaccagtccgtggtatcaatagtgagacacggcatcttcgatattgccagcgtccacatcgcttgctttttcgtggcaattacgggtaatacttacaaactctttgaacaggttaagaagagtttcgggaccacatgtaacgacactgagaataaagtgcaaggatactatatctgcatattaggcggcaactctccccctatttacgtcccaaccctggatgactttaggtccatggaggccttcagcgggatctttaagtcgccgcatggagaagatcacgaccttgctggtgaggaaattgcctcttattccatcgtgggccccgcgaatgcaaaagtacctcattcagccagtagcgatacattgtccctgatcgctttctctgggattccaagctactcaagtctatccatactcaccagctctacggaggccaagcacgttttctcacccggactgttccctcagcttaaccacactaaatgcgacaagacagcaatcccactgacctggactggcattatcgacttgcccggttattacgaagctgtgcatccgtgtacagtcttttgcgtgctcagtgggcctggagccagctgtgaggcgttctccgagggcggcatattcaatattacctctcccatgtgcctggtctcgaaacagaaccggtttcgcttaacggaacagcaagtgaatttcgtttgtcagagagtggatatggacatcgtagtctattgcaacgggcagaggaaggtgatcctgaccaagacactcgttattggacaatgtatctacactattaccagcctgttttcccttttgccaggtgtggcccactcaatagcagtcgagctatgcgtgcctggcttccatgggtgggctacagccgctctgctcatcactttttgtttcggatgggtactgattcccgcccttacctttatcgtgctgacagttttgaaattcatcgcaaatatttttcacaccagtaaccaggaaaaccggctcaagatggtcctgaaaaagataaaagaggaatttgagcgcactaagggctctatggtgtgcgatatctgtaagtacgagtgcgaaacgtataaagagttaaaggcccatggtgtgagctgcccacagtcccagtgtccctactgctttacacactgtgaacctaccgagtcagctttccaagcgcactatcgagtctgccaggttactcatagatttagggacgatctgaaaaagaccgtgacaccacagaatttcaccccggggtgttaccggactctaaacctcttccgttataaaagccgctgctacatttttacaatgtggatctgtctgcttgtgttggaatctattctgtgggcagcctccgctagtgagatccccctcagccctacgtggaatgacaacgcccacggcgtaggatctataccaatgcataccgatctggagcttgacttctccctgacttcaagtagcaagtatacatacagaaggaagttgaccaatcccctcgaagagtcgcaggcagtcaactttcacgtggaaatcgaggagcaagccattggcgttgatgtgcacgctctggggcattggttcgacggacggttaaatctgaaaacatcctttcactgctacggtgcctgtactaagtatgaatacccttggcataccgcaaaatgccactatgagcgagattaccagtatgaaacgtcttggggcagcaacccatcagactgtcccggggtcggaaccggctgcacagcgtgcggtctatacctcgaccagctgaagccggtggggagtgcttataaaatcattactatccgctactccagaagggtttgtgtgcagttcggcgaggaaaatctttgcaaggtaatagatatgaacgactgttttgtctctcggcatgtgaaggtgtgcattatcggaaccgtcagcaaattctcccaaggcgatacattgctgtttttcgggcctctcgagggaggtggcctgatttttaagcactggtgtacttcaacctgccagttcggggacccaggagatatcatgagcccccgcgacaaaggctttttatgtcctgagttccccggtagtttcagaaagaaatgcaattttgccacgacaccagtttgtgaatacgatgggaacatggtgtctggctataagaaagtaatggcaaccatagactccttccagagctcgaatacttcaacaatgcactttaccgatgagaggatcgaatggaaggaccctgatggaatgctgcgtgaccatattaacatccttgtgactaaggatattgacttcgacaatttgggcgagaacccctgcaaaatcgggctccagacctctagtatagaaggagcctggggctccggtgtcgggtttacactgacgtgtctaattagcctgaccgagtgcccaactttcctcacatctatcaaggcttgcgataaagccatctgttacggagcagagagcgtgaccctgacacggggccaaaacactgttaaggtgtccggtaaaggcgggcactcaggaagtacctttaagtgctgtcatggcgaagactgcagccagtctgggcttcacgctgccgcgccgcatttggataaggtcaatggaatttccgagatcgaaaactcaaaagtgtatgacgatggcgcccctcagtgtggtgttaagtgctggttcgtgaaaagtggggagtggattagcggaatattttccggcaattggatcgtcctgattgtattatgtgtgttcctcctgttttctcttgttctgttgtcgatcctctgccccgtgcgaaagcacaaaaagagctga

SEQ ID NO: 10107 - RNA, 3408 nt, synthetic construct
  misc_feature 1..3408: note = derived and/or modified CDS sequence (opt3) from HTNV(CGRn2616)__EU363816.1__GP
  source 1..3408: mol_type = other RNA
atggagatctggaagtggctggtgatggccagcctcgtctggcccgctcttgcactgagaaacgttcacgacatgaaaattgaatgccctcataccgtgtccttcggcaaaaattctgtaatagggtacgtggagttgccaccgatgcccttagccgatacaatccagatggtccctgaatcaagttgtagcatggacaaccaccaatccctgtctactgtgacgaaacatacccaggtttcgtggaggggaaaggcggatcaggctcagtcaagccaaacaagttttgagactgtgtccgtcgaagtggacctaaaaggtacctgcgtactcaagcacaagctggttgaggagtcttatcggagccgcaaatcccttacatgttacgatctgtcatgcaatagtacctattgtaagccaactttgtacatgattgtgcccatccatgcctgcaacatgatgaaaagctgtattatcgcactcggccctcaccgagtccaggtggtgtatgaacgtacatactgcatgaccggggtcctgctggagggaaagtgtttcgttccagaccagtctgtggtatccatagtgagacacggcatctttgatattgcctcagtccatatcgcttgcttctttgtggcaattacgggtaatacttataaactcttcgaacaggttaagaagtcctttgggaccacatgtaacgacactgagaataaagtgcaaggatactacatctgcatattaggcggcaacagtccccctatttatgtcccaaccctggatgacttcaggtctatggaggccttttccgggatcttcaagagcccgcacggagaagatcatgaccttgctggtgaggaaattgcctcgtactctatcgtgggccccgcgaatgcaaaagtacctcactccgcctcaagtgatacattgagcctgatcgctttttccgggattccatcttatagctcactaagtatactcacctccagcacggaggccaagcacgttttctctcccggactgtttcctcagcttaaccatactaaatgcgacaagacagcaatcccactgacctggactggcattatcgacttgcccggttactatgaagctgtgcacccgtgtacagtcttctgcgtgctctcagggcctggagccagttgtgaggcgttcagcgagggcggcatatttaatattacctcccccatgtgcctggtctctaaacagaaccggttccgcttaacggaacagcaagtgaattttgtttgtcagagagtggatatggacatcgtagtctactgcaacgggcagaggaaggtgatcctgaccaagacactcgttattggacaatgtatctatactattacctcgcttttcagcctgttgccaggtgtggcccattccatagcagtcgagctatgcgtgcctggctttcacgggtgggctacagccgctctgctcatcactttctgttttggatgggtactgattcccgcccttaccttcatcgtgctgacagttttgaaatttatcgcaaatattttccatacctcaaaccaggaaaaccggctcaagatggtcctgaaaaagataaaagaggaatttgagcgcactaagggcagtatggtgtgcgatatctgtaagtacgagtgcgaaacgaataaagagttaaaggcccacggtgtgtcttgcccacagagccagtgtccctactgcttcacacactgtgaacctaccgagtccgcttttcaagcgcattatcgagtctgccaggttactcacagattcagggacgatctgaaaaagaccgtgacaccacagaacttcaccccggggtgttaccggactctaaatctctttcgttataaatcacgctgctacattttcacaatgtggatctgtctgcttgtgttggaaagcattctgtgggcagcctctgcttccgagatccccctcagtcctacgtggaacgacaatgcccatggcgtaggaagcataccaatgcacaccgatctggagcttgacttttctctgacttcctcaagtaagtatacatacagaaggaagttgaccaaccccctcgaagagagccaggcagtcaatttccacgtggaaatcgaggagcaagccattggcgttgatgtgcatgctctggggcactggtttgacggacggttaaacctgaaaacatcgttccattgctatggtgcctgtactaagtacgaatacccttggcacaccgcaaaatgccattatgagcgagattaccagtatgaaacgtcctggggctgtaatccatctgactgccccggggtcggaaccggctgcacagcgtgtggtctatacctcgaccagctgaagccggtggggagcgcttataaaatcattactatccgctactcaagaagggtttgcgtgcagtttggcgaggaaaacctttgtatagtaattgatatgaatgactgcttcgtcagtcggcacgtgaaggtgtgtatcattggaaccgtctccaagttttctcaaggcgatacattgctgttctttgggcctctcgagggaggtggcctgatcttcaaacactggtgcactagcacctgtcagtttggggacccaggagatataatgagcccccgcgacaagggcttcttatgccctgagttccccggttcatttagaaagaagtgtaacttcgccacgacaccagtttgcgaatatgggggcaatatggtgagcggatacaaaaaggtaatggcaaccatcgatagttttcagtctttcaacacttccacaatgcattttaccgacgagaggattgaatggaaagatcctgacggcatgctgcgtgatcacatcaatattcttgtgactaaggacatcgatttcgacaacttgggggagaacccctgtaagataggactccagaccagctcgattgaaggcgcctggggttcaggggtcggatttacactgacgtgcctaatctctctgaccgagtgcccaactttcctcacaagtatcaaggcttgtgacaaggccatttgctacggcgcagagtccgtgaccctgacacggggtcaaaatactgttaaagtgagcggcaaagggggacattctggcagcacctttaaatgttgccacggggaagattgttcccagtcaggacttcatgctgccgcgccgcacttggacaaggtcaacggcatcagtgagattgaaaatagcaaggtgtatgatgacggtgcccctcagtgcgggataaaatgttggttcgttaagtctggagagtggatctccggcatcttttcaggtaactggattgtgctgattgtcttatgcgtattcctcctgttcagtcttgtgctgttgagcatcctctgtcccgttcgaaaacacaagaaatcctga

SEQ ID NO: 10108 - RNA, 3408 nt, synthetic construct
  misc_feature 1..3408: note = derived and/or modified CDS sequence (opt3) from HTNV(CGRn2618)__EU363817.1__GP
  source 1..3408: mol_type = other RNA
atggagatctggaagtggctggtgatggccagcctcgtctggcccgctcttgcactgagaaacgttcacgacatgaaaattgaatgccctcataccgtgtccttcggcaagaatagcgtaatagggtacgtggagttgccaccgatgcccttagccgatacaatccagatggtccctgaatcaagttgtagcatggacaaccaccaatccctgtctactgtgacgaaatatacccaggtttcgtggaggggaaaggcggatcaggctcagtcaagccaaacaccatttgagactgtgagtgtcgaagtggacctaaaacggacctgcgtactcaagcataagctggttgaggagtcctaccgctctcgaaaaagccttacatgttatgatctgtcctgcaattcaacctactgtaagcccactttgtatatgattgtgcctatccacgcctgcaacatgatgaaaagttgtattatcgcactcggtccacatcgtgtccaggtggtgtacgaaagaacatattgcatgaccggcgtcctgctggaggggaagtgtttcgttcccgaccagagcgtggtatctatagtgaggcacggaatctttgatattgcctccgtccacatcgcttgcttctttgtggcaattacgggcaatacttacaaactcttcgaacaggttaagaagtcatttggtaccacatgtaacgacactgagaataaagtgcaagggtactatatctgcatattaggaggcaacagccctccaatttacgtcccgaccctggatgacttccggagtatggaggccttttctggcatcttcaagagtccccatggggaagatcacgaccttgctggagaggaaattgccagctattcgatcgtgggtcctgcgaatgcaaaagtaccacattctgcctcctcagatacattgagtctgatcgcttttagcggcattccctcctactctagcctatcaatactcaccagttccacggaggccaagcacgttttcagccctgggctgtttccacagcttaaccacactaaatgcgacaagacagcaatccccctgacctggactggaattatcgacttgccgggctattacgaagctgtgcatccttgtacagtcttctgcgtgctctctggtcccggggcctcatgtgaggcgttcagtgagggaggcatatttaatattaccagcccaatgtgcctggtctccaaacagaaccgcttcagattaacggaacagcaagtgaattttgtttgtcagagggtggatatggacatcgtagtctattgcaacggccagcggaaggtgatcctgaccaagacactcgttattgggcaatgtatctacactattacctctcttttctcgctgttgcctggagtggcccacagcatagcagtcgagctatgcgtgcccggttttcatggctgggctacagccgctctgctcatcactttctgttttgggtgggtactgattccagcccttaccttcatcgtgctgacagttttgaaatttatcgcaaatattttccacacctccaaccaggaaaaccgcctcaagatggtcctgaaaaagataaaagaggaatttgagcgaactaagggatcaatggtgtgcgatatctgtaagtacgagtgcgaaacgtataaagagttaaaggcccatggcgtgagttgcccccagtctcagtgtccttactgcttcacacactgtgaaccaaccgagagcgcttttcaagcgcactatagagtctgccaggttactcataggttccgggacgatctgaaaaagaccgtgacaccgcagaatttcacccccggttgttaccgtactctaaacctctttcgctataaatccagatgctacattctgacaatgtggaatcttttgctgatccctgggtataggctctgggcagcctcagctagcgaaattccactgtctcccacgtggaacgacaatgcccacggcgtgggatccatccctatgcataccgatcttgagctggacttcagtttgacttcttcttccaagtacacataccggcgaaagctcaccaacccactggaggaatcacaggcagtaaattttcacgtcgagatagaggagcaagccatcggcgtggatgttcacgctttagggcattggttcgacggacgcctgaacctaaaaacaagttttcactgttatggtgcctgcactaagtacgagtatccctggcataccgcaaaatgtcactacgaaagagattatcagtacgagacgagctggggctgcaatccgtcggactgtcctggggtgggaaccggctgcacagcgtgcggtctctatctggaccagcttaagccagtcgggtccgcttacaaaattatcactattaggtactctcggcgcgtgtgtgttcagttcggcgaagagaacttgtgcatcgtgatagatatgaatgactgttttgtaagcagacatgtcaaggtgtgcattatcggaaccgtgtcaaagttcagtcaaggcgatacactgctctttttcgggcccctggaaggaggtggcttaatttttaaacactggtgtacttctacctgccagttcggggaccctggagatatcatgtcccccagggacaagggctttctgtgtccagagttccctggtagcttccgtaaaaagtgcaactttgccacgacacccgtctgtgagtatgggggcaatatggtttccggatacaaaaaggtgatggcaaccatagattcattccagagctttaacacttccacaatgcacttcaccgacgaacggatcgagtggaaagatccagacggcatgcttcgagatcatattaatatcttggtaactaaggacattgattttgacaacctcggggaaaacccgtgcaagatcggactgcagacctcttccatagagggcgcctggggtagcggggtgggattcacactaacgtgtctgatttcgctcaccgaatgccctacttttctgacatcaatcaaggcttgcgacaaggccatctgttatggcgcagagtctgtcacccttacaagaggtcaaaatactgtgaaagttagtggcaaagggggacactccggcagcaccttcaaatgctgtcatggggaggattgctctcagagcggattgcacgctgccgcgccccatctggacaaggtgaacggcatttccgaaatcgaaaattcaaaggtctacgatgacggtgccccacagtgtgggattaaatgctggtttgtgaagagtggagaatggataagcggcatcttctctggtaactggattgttttaatcgtgctctgtgtctttctgcttttctccctggtattgctctcaattctgtgccccgtgaggaaacacaagaaaagttga

SEQ ID NO: 10109 - RNA, 3408 nt, synthetic construct
  misc_feature 1..3408: note = derived and/or modified CDS sequence (opt3) from HTNV(CGRn45)__EU092225.1__GP
  source 1..3408: mol_type = other RNA
atggagatctggaagtggctggtgatggccagcctcgtctggcccgctcttgcactgagaaacgttcacgacatgaaaattgaatgccctcataccgtgtccttcggcaagaatagtgtaatagggtacgtggagttgccaccgatgcccttagccgatacaatccagatggtccctgaatcaagttgtagcatggacaaccaccaatccctgtctactgtgacgaaatatacccaggtttcgtggaggggaaaggcggatcaggctcagtcaagccaaacaagttttgaggccgtgtccgtcgaagtggacctaaaaggtacttgcgtactcaagcataagctggttgaggagtcttaccggagccgcaaatcccttacctgttatgatctgtcatgcaatagtacatactgtaagccaaccttgtatatgattgtgcccatccacgcatgcaacatgatgaaaagctgtattatcgccctcggccctcatcgagtccaggtggtgtacgaacgtacttattgcatgacaggggtcctgctggagggaaagtgtttcgttccagaccagtctgtggtatccatagtgagacacggcatctttgatattgcttcagtccacatcgcatgcttctttgtggccattaccggtaatacgtacaaactcttcgaacaggttaaaaagagctttgggactacctgtaacgacacagagaataaggtgcaaggatactatatctgcatattaggcggcaacagtccccctatttacgtcccaactctggatgacttcaggtctatggaggctttttccgggatcttcaagagcccgcatggagaagatcacgaccttgccggtgaggaaattgcgtcgtattctatcgtgggccccgcaaatgccaaagtacctcattccgcttcaagtgataccttgagcctgatcgccttttccgggattccatcttacagctcactaagtatactcacatccagcaccgaggcaaagcacgttttctctcccggactgtttcctcagcttaaccacacgaaatgcgacaagactgctatcccactgacatggaccggcattatcgacttgcccggttattacgaagccgtgcatccgtgtactgtcttctgcgtgctctcagggcctggagcgagttgtgaggccttcagcgagggcggcatatttaatattacatcccccatgtgcctggtctctaaacagaaccggttccgcttaaccgaacagcaagtgaattttgtttgtcagagagtggatatggacatcgtagtctattgcaacgggcagaggaaggtgatcctgacgaagaccctcgttattggacaatgtatctacacaattacttcgcttttcagcctgttgccaggtgtggcacactccatagctgtcgagctatgcgtgcctggctttcatgggtgggccaccgctgccctgctcatcacattctgttttggatgggtactgattcccgcacttactttcatcgtgctgaccgttttgaaatttatcgccaatattttccacacatcaaaccaggaaaaccggctcaagatggtcctgaaaaagataaaagaggaatttgagcgcaccaagggcagtatggtgtgcgatatctgtaagtacgagtgcgaaacttataaagagttaaaggctcatggtgtgtcttgcccacagagccagtgtccctactgcttcacgcactgtgaacctacagagtccgcgtttcaagcacactatcgagtctgccaggttacccatagattcagggacgatctgaaaaagactgtgaccccacagaatttcacaccggggtgttaccggaccctaaacctctttcgttataaatcacgctgctacattttcactatgtggatctgtctgcttgtgttggaaagcattctgtgggccgcttctgcctccgagatccccctcagtcctacatggaatgacaacgcacacggcgtaggaagcataccaatgcatacggatctggagcttgacttttctctgacctcctcaagtaagtatacttacagaaggaagttgacaaatcccctcgaagagagccaggccgtcaacttccacgtggaaatcgaggagcaagctattggcgttgatgtgcacgccctggggcattggtttgacggacggttaaatctgaaaacctcgttccactgctacggtgcatgtacaaagtatgaatacccttggcatactgcgaaatgccactatgagcgagatcatcagtacgaaacctcctggggctgtaacccatctgactgccccggggtcggaacgggctgcaccgcttgtggtctatatctcgaccagctgaagccggtggggagcgcctacaaaatcattacaatccgctattcaagaagggtttgcgtgcagtttggcgaggaaaatctttgtaaggtaatagatcggaacgactgcttcgtcagtcgccacgtgaaggtgtgtattatcggaactgtctccaaattttctcaaggcgataccttgctgttctttgggcctctcgagggaggtggcctgattttcaagcactggtgcacaagcacttgtcagtttggggacccaggagatatcatgtcccccagagacaaaggcttcttatgccctgagttccccggttcatttaggaagaaatgtaatttcgcaaccacgccagtttgcgaatacgatgggaacatggtgagcggctacaagaaagtaatggccacaatagacagttttcagtctttcaatacctccactatgcattttacagatgagcgtatcgaatggaaggaccctgatggaatgctgcgggaccacattaacatccttgtgaccaaggatattgacttcgacaatttgggcgagaacccctgtaaaatcgggctccagactagctcgatagaaggagcttggggctcaggtgtcgggtttaccctgacatgcctaatttctctgacggagtgcccaaccttcctcacttctatcaaggcctgtgataaagcaatctgctatggagctgagtccgtgacactgacccgaggccaaaacacagttaaggtgagcggtaaaggcgggcattctggaagcacttttaagtgttgccacggcgaagactgttcccagtcagggcttcatgccgcggccccgcacttggataaggtcaatggaattagtgagatcgaaaacagcaaagtgtacgacgatggcgctcctcagtgcggtattaagtgttggttcgttaaatctggggagtggatatccggaatcttttcaggcaattggattgtgctgatcgtcttatgcgtattcctcctgttcagtcttgtgctgttgagcattctctgtcccgttagaaagcacaaaaagtcctga

SEQ ID NO: 10110 - RNA, 3408 nt, synthetic construct
  misc_feature 1..3408: note = derived and/or modified CDS sequence (opt3) from HTNV(CGRn53)__EF990921.1__GP
  source 1..3408: mol_type = other RNA
atgggcatctggaagtggctggtgatggccagcctcgtctggcccgcttacacccttagaaacgtttatgacatgaaaattgagtgccctcacacagtgtccttcggggaaaattctgtaataggatacgtggagctgccaccgatccccttggcagatactacgcagatggtccctgaatcaagttgtagcatggacaaccatcaatccttaaataccattacaaagtatactcaggtgtcttggaggggtaaagccggccaggcgcaggcttcgcaaaactcatttgaggccgttagcgcagaagtggatctgaaggggacctgcgtcctaaaacacaagatgctcgaggagagttaccggtcccgcaagtctatcgcctgttatgacctgagctgcaattccacatactgtaaaccaaccctttatatgattgtgcccatccatgcttgcaacatgatgaagtcatgtctgatagcattgggacctcaccgagtacaggttgtgtacgaacgtacttactgcatgacaggcgtcctcatcgagggtaaatgtttcgtgccagatcagagtgtggtcagcattatcaagcatgggatttttgacatcgcctctgttcacatagtgtgcttctttgtagctgtgaaaggaaatacctataagattttcgaacagatcaagaaatcctttgagtcaacgtgtaacgatactaagaataaagtccaaggctactatatttgcatcgtgggcgggaacagcgcccccatctacgttcctaccctggacgatttcagaagtatggaggcgttttctggaattttcaggtccccacacggtgaagaccatgatctggcaggcgaggaaatagccagctattcgatcgtggggccggctaatgccaaggtcccccactctgcatcctcagacacactcagtttaactgcttacagcggcattccttcctattctagcctgtcaatccttgccggaagtgcggaggccaaacatgtgttttccccaggtttctttccccagttgaaccacaccaagtgcgataaaacagcaatacctctgatgtggaccgggatgattgacctaccaggatactacgaagctatccacccctgtacggtattctgcgttctcagcggcccgggcgcctcttgtgaggctttctcagaagggggaatctttaatattacttcccctatgtgcctggtgagcaagcagaaccggttccgccttacagaacagcaagtcaattttgtgtgtcagagagtcgacatggatatcattgtgtattgcaacggtcagaggaaggttatactgaccaaaactttggtgatcggccaatgtatttacacaatcacctccctcttctctctgttacccggggtagcccattcgatcgcagtcgagctgtgcgtgccaggatttcacggctgggccacggctgcgctccttgttaccttctgttttggttgggtgctgattcctgcaatgacattcatagtcttgactatcctaaagtttattgccaacatcttccataccagcaatcaggaaaacaaactgaagtccgtgctccggaaaattaaggaggaatttgagaagacaaaagggtcaatggtatgcgacgtgtgtaagtatgagtgcgaaacttacaaagagctgaaggctcacggcgttagttgcccccagtctcagtgtccatattgcttcacccattgtgaacccacagaggccgcatttcaagcccactaccgcgtctgccaggtgacccaccgattcagagatgaccttaaaaagactgtgacgcctcagaatttcacaccaggatgttataggaccctgaacttgtttcggtacaagagccgttgctacatcctcactatgtggaatctgttactggtcccgggctatcgcgcttgggccgcatccgcgtcagaaatacccctaaaccctgtttggaatgataacgctcatggggtgggaagcgtgccaatgcacaccgacctcgagctggatttctctcttacatccagtagcaaatacacctatagaaggaagttgactaatcccctggaggaatctcaggccatcaacctccatattgagatcgaggagcaaacaattggtgtagacgtccacgcactgggccactggtttgtggggcggcttaatctgaaaacgtccttccattgttacggagcctgcaccaagtatgagtacccttggcacactgctaaatgtcattatgaacgagattaccagtacgagacatcatggggctgcaacccaagtgactgtcccggtgttgggaccggctgcacagcctgcggattgtatctcgatcagctgaagccggtgggcagcgcatacaagatcataactattcgctattcgagaagggtctgtgtgcagtttggggaagagaatttatgcaaaatcattgacatgaacgactgtttcgtttcccggcacgtgaaggtatgcatcataggaaccgtctctaaatttagccaaggtgatacgctgctattctttggccctctcgaagggggaggcctgatcttcaagcattggtgtacctcaacatgccagtttggtgacccaggggatattatgagtccccgcgacaaaggcttcctttgtcctgagtttcccggatccttcagaaagaaatgcaatttcgctactaccccattgtgtgagtacgatggcaacatggtgtctgggtataagaaggtgatggccacaatcgacagctttcagtccttcaacacttcaaccatgcactttacggatgaaaggattgagtggaaagaccctgatggaatgctgcgtgaccacatcaatatactcgtcacaaaggatattgacttcgaaaacctgggcgagaatccctgcaaaatcggtttacagaccagcagtatcgaaggggcgtggggatctggcgttggttttactctgacatgtcttgtgtccttgaccgagtgcccaactttcctcaccagcattaaggcctgcgataaagctatctgttacggcgcagagtcggtaacactgacgcgggggcaaaacaccgtgaaggtctcaggaaagggcgggcattctggaagtacttttaaatgctgtcacggcgaagagtgctcccagattggtctacatgccgctgccccgcacctggacaaggtgaatgggataagcgaaatcgagaacaataaagtttatgacgatggagcacctcagtgtggcattaagtgctggttcgtgaaatctggtgaatggatcagcggcatttttagtgggaactggatcgtcctcatagtgctgtgtgttttccttttgttttcactgatcttactcagtattctgtgccccgtgcgaaagcataagaaaagctga

SEQ ID NO: 10111 - RNA, 3408 nt, synthetic construct
  misc_feature 1..3408: note = derived and/or modified CDS sequence (opt3) from HTNV(CGRn93MP8)__EF990919.1__GP
  source 1..3408: mol_type = other RNA
atgggcatctggaagtggctggtgaaagccagcctcgtctggcccgcttacacccttagaaacgtttatgacatgaagattgagtgccctcacacagtgtccttcggggaaaattctgtaataggatacgtggagctgccaccgatccccttggcagatactacgcatatggtccctgaatcaagttgtagcatggacaaccaccagtccttaaataccattacaaaatatactcaagtgtcttggaggggtaaggccgatcaggcgcaggcttcgcagaactcatttgaggccgttagcgcagaagtggacctgaaaggtacctgcgtcctaaagcataagatgctcgaggagagttaccggtcccgcaaatctatcgcctgttatgatctgagctgcaattccacatactgtaagccaaccctttatatgattgtgcccatccacgcttgcaacatgatgaaatcatgtctgatagcattggggcctcatcgagtacaagttgtgtacgaacgtacttactgcatgacaggattcctcatcgagggcaagtgttttgtcccagacagaagtgtggtgagcattatcaaacacggtattttcgatatcgcctctgtccacatagtttgctttttcgtggctgtaaaggggaatacctataagatttttgaacagatcaaaaagtccttcgagtcaacgtgtaacgacactaaaaataaggtgcagggatactatatttgcatcgtcggcggcaacagcgcccccatctacgtgcctaccctggatgactttaggagtatggaggcgttctctgggatttttcggtccccacatggagaagatcacgacctggcaggcgaggaaatagccagctattcgatcgttggcccggctaatgccaaagtgccccattctgcatcctcagatacactcagtttaactgcttacagcgggattccttcctattctagcctgtcaatccttgccggaagtgcggaggccaagcacgtcttctccccaggctttttgccccagctgaaccacaccaaatgcgacaagacagcaatacctctaatgtggaccggtatgattgacctcccagggtactacgaagctatccatccctgtacggtgttctgcgtactgagcggaccgggcgcctcttgtgaggctttctcagagggcgggatctttaatattaccagtcctatgtgccttgttagcaagcaaaaccgcttcagactgacagaacaacaggtgaattttgtctgtcagagggtggatatggacatcattgtctattgcaacggacagcggaaagtgatattgaccaagactctcgttatcggtcagtgtatttacacaatcacctccctgttctctttactgcccggcgtggcccactcgatcgcagtagagctctgcgtcccagggtttcatggatgggccacggctgcgcttctggtgaccttctgttttggctgggttttgattcctgcaatgacattcatagtgctaactatcctgaaatttattgccaacatcttccacaccagcaatcaggaaaacaagctcaaatccgtcctgcgcaagattaaggaggaatttgagaaaacaaagggttcaatggtgtgcgatgtatgtaaatatgagtgcgaaacttacaaggagcttaaagctcatggggtgagttgcccccaatctcagtgtccatattgcttcacccactgtgaacccacagaggccgcatttcaggcccactaccgagtttgccaggtcacccatagattcagggacgatctgaagaagactgtgacgcctcaaaatttcacaccaggctgttatcggaccttgaacctctttcgttacaaaagccgctgctacatcttcactatgtgggtgtttctgttagtcctggaatccatactatgggctgcctcagcaagcgagatcccgctcaatcccgtttggaacgacaatgcgcacggagtgggctctgtgcctatgcataccgatctggagcttgacttctccttgacaagtagctctaagtatacctacagaaggaaactgactaacccactcgaagagtcccaggctattaatctgcacatcgaaattgaggagcagacaatcggggtagatgtccacgcccttggacattggtttgacggtcggctgaacttgaagacgtcattccactgttatggcgcatgcaccaaatacgaatatccctggcatactgccaagtgtcactacgagcgagattatcagtacgaaacaagttgggggtgcaatcctagcgactgtccaggagtgggcaccggttgcacagcttgcgggctctacctggaccaattaaagcccgttggctcggcctataaaataattactatccgctactccagaagggtgtgtgtccagtttggagaggaaaacctgtgcaagattatcgatatgaatgactgtttcgtgtctcggcatgttaaagtgtgcataatcggcaccgtaagcaagttttcacagggggatacgctactcttctttggaccgctggagggtggcgggcttattttcaaacactggtgtaccagtacatgccagtttggagaccctggcgatatcatgtccccacgcgacaagggtttcttgtgtcccgagttccctgggtcttttaggaaaaagtgcaacttcgcaactactcccctgtgtgaatatgatggcaatatggtcagcggatacaagaaagtgatggctacaattgactcctttcaatcattcaacactagcaccatgcactttacggatgagagaatcgaatggaaggacccagatggcatgctccgtgaccatataaacattctggtgacaaaagatatcgacttcgagaatttaggggaaaacccttgcaagatcggactgcagaccagttctattgagggcgcctggggttccggggtcggatttactcttacatgtttggttagcctcaccgagtgccccactttcctgacctcgatcaaagcgtgcgacaaggccatttgttatggcgctgaatcagtgacactaacgcggggtcagaataccgtaaaggtgtctggcaaagggggacacagtggctccacttttaagtgctgtcatggggaggaatgcagccagataggactgcacgcagccgctccacatctcgataaagtcaacggcatctctgagattgaaaataacaaggtgtacgacgatggtgccccgcaatgtgggatcaaatgctggttcgttaagagcggagagtggatttccggcatcttttcaggtaattggatagtgctgatcgtcctttgtgtgttcttgctgttcagtttaattctcctgagcatcctttgccctgttcgaaagcacgagaaatcttga

SEQ ID NO: 10112 - RNA, 3408 nt, synthetic construct
  misc_feature 1..3408: note = derived and/or modified CDS sequence (opt3) from HTNV(CGRn93P8)__EF990918.1__GP
  source 1..3408: mol_type = other RNA
atgggcatctggaagtggctggtgatggccagcctcgtctggcccgcttacacccttagaaacgtttatgacatgaaaattgagtgccctcacacagtgtccttcggggaaaattctgtaataggatacgtggagctgccaccgatccccttggcagatactacgcagatggtccctgaatcaagttgtagcatggacaaccatcaatccttaaataccattacaaagtatactcaggtgtcttggaggggtaaagccgatcaggcgcaggcttcgcaaaactcatttgaggccgttagcgcagaagtggacctgaagggcacttgcgtcctaaaacacaagatgctcgaggagagttaccggtcccgcaagtctatcgcctgttatgatctgagctgcaattccacatactgtaaaccaaccctttatatgattgtgcccatccatgcttgcaacatgatgaagtcatgtctgatagcattggggcctcaccgagtacaggttgtgtacgaacgtacttactgcatgacaggagtcctcatcgagggcaaatgtttcgtgccagacagaagtgtggtcagcattatcaagcatggtatttttgatatcgcctctgttcacatagtgtgcttctttgtagctgtgaaagggaataactataagattttcgaacagatcaagaaatcctttgagtcaacctgtaatgacacgaagaacaaagtccagggatactatatttgcatcgtgggcggcaatagcgcccccatctacgttcctactctggatgacttcaggagtatggaggcgttttctgggattttccggtccccacacggagaagatcatgacctggccggtgaggaaatagcaagctattcgatcgtgggcccggctaacgccaaggtcccccactctgcatcctcagataccctcagtttaacagcttacagcgggattccttcctattctagcctgtcaatccttgccggaagtgcggaggccaaacatgtgttttccccaggcttctttccccaattgaatcacactaagtgcgacaaaaccgcaatacctctgatgtggacaggtatgattgacctaccagggtactacgaagctatccacccctgtaccgtattctgcgttctcagcggaccgggcgcctcttgtgaggctttctcagagggcgggatctttaacattacgagtcctatgtgcctggtgagcaagcagaatcgcttcagacttactgaacagcaggtcaactttgtgtgtcaaagggtcgatatggacatcattgtgtattgcaacggacagcggaaggttatactgacaaaaaccttggtgatcggtcagtgtatttacactatcacatccctcttctctctgttacccggcgtagcccattcgatcgcagtcgagctgtgcgtgccagggtttcacggatgggccaccgctgcgctccttgttacgttctgttttggctgggtgctgattcctgcaatgaccttcatagtcttgacaatcctaaagtttattgccaatatcttccatactagcaaccaagaaaataaactgaagtccgtgctccgcaaaattaaggaggaatttgagaagaccaaaggttcaatggtatgcgatgtgtgtaagtatgagtgcgaaacatacaaagagctgaaggctcacggggttagttgcccccagtctcagtgtccatattgcttcactcattgtgaacccaccgaggccgcatttcaggcccactaccgagtctgccaagtgacacacagattcagggacgatcttaaaaagaccgtgactcctcagaacttcacgccagtctgttatcggacactgaatttgtttcgttacaagagccgctgctacatcttcaccatgtgggtttttctcctggtgttagaatccatactgtgggctgcctcagcaagcgagatcccgctaaaccccgtgtggaatgacaacgcgcatggcgtaggatctgtccctatgcacactgatctcgagctggacttctcccttaccagtagctctaaatatacatacagaaggaagttgaccaatccactggaagagtcccaggctattaacctccatatcgaaattgaggagcagactatcggcgtggatgttcacgccctggggcactggtttgacggacggcttaatctgaaaacatcattccattgttatggtgcatgcacgaagtacgaatatccctggcacaccgccaaatgtcattacgagcgagattatcaatacgaaaccagttggggctgcaaccctagcgactgtccaggggtgggaacaggctgcaccatatgcggtttgtacctcgaccagctgaagcccgtcgggtcggcttataagattatcacaattcgctactccagaagggtgtgtgttcagtttggcgaggaaaatttatgcaaagtgatcgatatgaacgactgtttcgtatctcggcacgtcaaggtgtgcataatcggaactgtgagcaaattttcacagggcgataccctgctattctttgggccgctcgagggaggtggcctgattttcaagcattggtgtacgagtacctgccaatttggggaccctggagatatcatgtccccacgcgacaaaggcttcctttgtcccgagttccctggttcttttagaaagaaatgcaatttcgccacaactcccgtctgtgaatatgatgggaacatggttagcggctacaagaaggtgatggcaaccattgactcctttcagtcattcaacacaagcactatgcactttaccgatgagaggatcgaatggaaagacccagatggaatgttgcgtgaccacataaatattctggtaacgaaggatatcgacttcgacaacctcggcgagaatccttgcaaaatcgggctgcagacaagttctattgaaggagcttggggctccggtgtggggtttaccttaacttgtctgatcagccttacagagtgccccaccttcttgacttcgattaaggcctgcgataaagcgatatgttatggagccgagtcagtcaccctcacacggggccagaacacggtgaaggtttctggtaagggcgggcatagtggatccacctttaaatgctgtcacggcgaagactgcagccaatctgggctgcatgctgcagccccacacctagataaggtgaatggaatcagcgagattgaaaactccaaagtctacgacgatggcgctccgcagtgtggtatcaagtgctggttcgtgaaatcaggggagtggattagtggaatctttagcggcaattggatagttctgatcgtgctctgtgtcttcctgcttttctctttggtactgttatccattctctgccctgtgcgaaagcataagaaatcatga

SEQ ID NO: 10113 - RNA, 3408 nt, synthetic construct
  misc_feature 1..3408: note = derived and/or modified CDS sequence (opt3) from HTNV(CGRni1)__EU363815.1__GP
  source 1..3408: mol_type = other RNA
atgggcatctggaagtggctggtgatggccagcctcgtctggcccgctttcgcacttagaaacctgtacgacatgaaaattgagtgccctcacaccgtttcctttggggaaaattctgtgacaggatatgtagagttgccaccgatgcccttagccgatactacgcagatggtgcctgaatcaagttgtagcatggacaaccatcaatccctgaataccataacaaagtacactcagatcatttggaggggtaaagcggatcagtctcagtcgtcacaaaacagcttcgagaccgtcagtacagaagtggacctaaagggcacttgcgttctcaaacacaagatgatcgaggagtcctatcggtctcgcaagagcattacttgttacgatctgtcctgcaattcaacatattgtaaaccaaccctttacatgatcgtgcccatacatgcttgcaacatgatgaagagttgtctgatcgccttggggccttatcgagtccaggtggtatacgaacgtacgtactgcatgactggagttctcattgagggcaaatgttttgtgccagaccagagcgtcgtgtctatcattaagcacggtatcttcgatatagcatccgtgcatattgtctgcttttatgttgccgtgaaagggaatacctacaagatcttcgaacaggtaaagaaaacatttgagtcaaactgtaatgacactgagaacaaggtgcaaggatattacatttgcatcatcggcggcaatagcagtcccgtctatgtgcctaccctggatgacttcagatctatggaagcattttccgggattataaggagcccacacggagaggatcacgacctggctggtgaagaggttgcctcgtactctatcgtgggcccggctaacgccaaagtcccccattccgcgtcaagtgatacactcgggttaattgcatatagctccatcccttcttacagctcactgagtatacttacctccagcacggaagccaagcacgtgttctctccaggattgtttccccagctgaatcatactaaatgcgacaagacagctattcctctaacctggactggcatgatcgacctcccaggttactatgaggccatccacccctgtacagtattctgcgttctgtcagggccgggagcaagttgtgaggcttttagcgaaggcggcattttcaacatcgcctcccctatgtgccttgtgtctaaacagaatcggttccgcctgaccgagcagcaagtcaactttgtgtgtcagagagtcgatgtggacattatagtttactgcaacgggcagaggaaggtgatcttgacgaagaccctcgtaattggacaatgtatctatacaatcacttcgctgttcagcttactgcccggtgtcgcgcactccattgccgtggaactctgcgttccaggctttcatgggtgggcaaccgctgcccttctggtgacattctgttttggatgggtcttgatacctgctatcactttcattatcctaaccattctgaaatttatcgccaatatattccacacatcaaaccaggagaatcggctcaagagtgtgctgcgcaaaatcaaggaagagtttgagcgaaccatgggctctatggtatgcgatatttgtaaatacgaatgcgagacttataaggaacttaaggcacatggtgtgagctgcccccagtcccagtgtccatactgcttcacgcactgtgagcccacagaagccgcttttcaagcgcattataaagtttgccaggtcacccacagattcagggacgatctgaagaaaactgtgacccggcagaactttacacctgggtgttaccgtaccttgaatctcttccgctacaagtcaagatgctatatcttcactatgtgggtgtttctgattgtcttagagagcatcctgtgggcagcctctgcttccgagataccactaaacccggtttggaatgacaacgcccacggcgtgggaagtattcccatgcatacagatctcgaactggacttcagccttacgtcttcctcaaaatacacctataggcggaagttgactaatcctctggaggaaagtcaggcaatcgatctccacgtggagattgaggaacaaacaatcggcgtagacgtccatgccctggggcactggtttgatggacgacttaacctgaagaccagcttccactgttacggtgcttgcacaaaatatgagtacccatggcatactgccaagtgtcactatgaacgcgactaccagtacgagacctcgtggggctgcaatccctccgactgtcctggggtgggaacgggctgcaccgcatgcggtttgtatctcgatcagctgaaaccagttgggtctgcgtacaagataatcacaattagatatagcaggcgggtgtgtgtccagtttggcgaagagaacttatgcaaaatcattgacatgaatgattgtttcgtgtcacgccatgttaaggtgtgcatcataggaactgtaagtaagttttcccaaggcgacaccctgctattctttgggcccctcgagggaggtggcctgattttcaaacactggtgtacatctacttgccagtttggggatccgggagacatcatgagccctagagataagggcttcctttgtccagaatttcccggttccttcaggaaaaagtgcaacttcgctaccacgcctgtctgtgagtacgacgggaatatggtgtcaggctataaaaaggtgatggccacaatcgatagctttcagagtttcaacacctctactatgcattttacagacgaacgtattgagtggaaagatcccgacggaatgttgcgggatcacatcaacattctggtcaccaaggacatagacttcgataatctcggcgaaaacccatgcaagatcgggctgcagacttccagcattgagggagcatggggctcgggtgttgggtttaccttaacatgtctgatctcacttacggagtgctctaccttcttgaccagtattaaagcctgcgacaaggctatctgttacggagccgaatccgtgacactcacccgaggccaaaatacagtaaaagtgagcggtaagggcgggcactctggaagctcctttaaatgctgtcatggcgaggaatgctcacagatagggctgcacgcagctgcccctcatctagataaggtcaacggaatcagtgagatggaaaatagcaaggtgttcgacgatggcgcgccccagtgtggtattaaatgctggtttgttaagtctggggagtggatctccggaattttctcaggcaactggatcgtgctgatagtcctctgtgtgtttctgcttttcagtttggttctgttaagcattctctgcccagtgagaaaacacaagaaatcctga

SEQ ID NO: 10114 - RNA, 3408 nt, synthetic construct
  misc_feature 1..3408: note = derived and/or modified CDS sequence (opt3) from HTNV(Aa10-434)__KU207160.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcgggggaaattctgtgataggttatgtcgaattgccaccgatgcccttagctgatactgcacagctggtgcctgagtcaagttgtagcatggacaaccatcaatccctaaatacgatcaccaagtacacacaggtttcttggaggggcaaagccgatcagtcgcagtcaagccaaattagttttgaaactgtgtccaccgaggtcgacctcaaggggacatgcgtgctgaaacacaagatggtagaagagtcttatcggagccgcaagtccatcacctgttacgatctttcatgcaacagtacttattgtaaaccaacactgtacatgattgttcccatccatgcgtgcaatatgatgaaaagctgtttgatagctctcggaccttatcgagtgcaggtcgtgtacgagcgtacctactgcatgacgggcgtgctgatcgaaggtaaatgtttcgtcccagaccagtctgttgtgtccattatcaagcacgggatttttgatatcgcctcagtacatatagtgtgcttctttgtcgcagtgaaaggaaacacttataagattttcgagcaggttaagaaaagttttgaaagtacctgtaatgacacagagaacaaggtgcaaggctactatatctgcattgtcggcgggaatagcgcccccatctacgtgcctactctggatgacttcagatccatggaggcttttaccggaatcttcaggagcccacacggtgaagatcacgacctcgcaggcgaggaaacagccacctattcgattgtagggccggctaacgccaaagttccccattctgcgtcctcagatacgttaagtctgatagcatttagcggaatcccttcctactctagcctttcaattttgactagctccacagaggccaagcacgtgttcagcccaggcctgtttcccaaactaaatcataccaactgcgacaagggtgctatccctctcatgtggactgggatgatagacctgccaggatattacgaagccattcacccctgtacagtcttctgcgtgctttctggcccgggcgcatcatgtgaggctttcagtgaagggggaatctttaatatcaccagccctatgtgcctggtctccaaacagaaccggttccgcttgacggagcaacaggtgaattttgtttgtcaaagagtggatgtagacattgtcgtgtactgcaacggtcagaggaaggttatcctcaccaagacactggtgattggccagtgtatatatactatcacctctttattctcgctgctccccggggtcgcccacagcattgcggtggagctttgcgtaccaggatttcatggctgggccacagcagctctgttggtgactttctgttttggttgggttctaatccctgccatcaccttcattatactgacaatcctcaaatttattgctaacatcttccacacctccaatcaagaaaaccggctgaagtcagtccttcgcaaaattaaggaggaatttgagaaaactaaggggagtatggtgtgcgatatctgtaagtacgagtgcgaaacgtataaagagctgaaggcccatggcgtgtcttgcccccagagccagtgtccatactgcttcacacactgtgaacccaccgaggcagcctttcaggctcattataaagtctgccaagttactcaccgattcagagacgatttgaagaaaaccgtgacacctcagaatttcaccccaggatgttacaggactctcaacctgtttcggtataagtcccgttgctacatattcacaatgtggatctttttactggtgctagaatcaattctctgggcggcaagcgcctctgagacgccgctgacccccgtatggaatgacaacgctcacggcgtcgggtccgtgcctatgcatactgatcttgagttggacttcagtctgacatcttcttccaagtacacctatcgcagaaaactcacaaatccactggaagaggcccagtcaatcgatcttcacattgaaatcgaggagcagactataggagttgacgtgcatgcactgggtcactggtttgatggcaggttgaacctcaagaccagtttccactgttacggggcctgcacgaaatatgaatacccctggcataccgctaagtgtcactatgagcgggactaccaatatgaaacaagctggggatgcaatccttcggactgtccaggcgtcggtactgggtgcaccgcctgcggcctgtacttagatcgactgaaacccgtgggatccgcatacaagattatcacaattcgctattctagaagggtttgtgtgcagtttggcgaggaaaacctatgcaagatcatagacatgaatgattgtttcgtaagccggcatgtcaaagtgtgcatcattgggactatctcaaagtttagtcagggagacaccctcctgttctttggtccgcttgagggcgggggattgattttcaaacactggtgtacgtccacatgccagtttggcgatcctggtgacatcatgtctccacgcgataaggggttcctgtgtcccgagttccctggcagctttagaaagaagtgcaacttcgcgaccactcccatatgtgaatacgacggaaatatggtgtccggctataaaaaggtcatggctacaattgattcatttcagagcttcaacaccagtactatgcattttaccgacgagaggatcgaatggaaggatccagacgggatgctccgtgatcacatcaatattctggttacaaaagacatcgacttcgataacttaggagagaacccttgcaagattggcctgcaggcctcttccatagaaggtgcatgggggagcggagtgggctttacgcttacctgtttggtatcgctcactgagtgccccacattcctgacctcaatcaaagcctgcgacaaggctatttgttacggtgccgagtctgtgacactaactcggggccagaataccgtcaaagtgagtgggaagggaggccactccgggagcacgtttaagtgctgtcatggagaagattgctctcagatcggcctgcacgcagctgccccacatctcgacaaagttaacggtattagcgagatggaaaattccaaggtgtatgatgacggggcgccgcaatgtggaatcaaatgctggttcgtcaagtcaggcgagtggataagtggtatctttagcggcaactggattgtgctgatcgttctttgtgtgttcttgctgttctctttagtcctcctgtccattctttgccctgtacgaaaacacaagaagtcatga

SEQ ID NO: 10115 - RNA, 3408 nt, synthetic construct
  misc_feature 1..3408: note = derived and/or modified CDS sequence (opt3) from HTNV(Aa10-518)__KU207161.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatggtagaggagtcttatcggagccgcaagtccattacctgttacgatctttcatgcaatagtacttattgtaaaccaacactgtacatgatcgttcccattcatgcgtgcaacatgatgaagagttgtttgatcgctctcgggccttatcgagtgcaggtcgtgtacgaacgtacctactgcatgacgggagtgctgatagagggcaaatgtttcgtcccagaccagtctgttgtgtccatcattaagcacggtatctttgatattgcctcagtacatatcgtgtgcttctttgtcgcagtgaaagggaatacttataagatattcgaacaggttaagaaatcttttgagagtacctgtaacgacacaaagaataaagtgcaaggatactatatttgcatcgtcggcggcaactctgcccccatttacgtgcctactctggatgacttcagatccatggaggcttttaccgggatcttcaggagcccacacggagaagatcacgacctcgcaggggaggaaacagccacctattcgatcgtaggcccggctaatgccaaggttccccattctgcgtcctcagatacgttaagtctgattgcatttagcgggataccttcctactctagcctttcaatcttgactagctccacagaggccaaacacgtgttcagcccaggactgtttcccaagctaaaccataccaattgcgacaaaggcgctattcctctcatgtggactggtatgatcgacctgccagggtattacgaagccatacacccctgtacagtcttctgcgtgctttctggaccgggcgcatcatgtgaggctttcagtgagggcgggatttttaacatcaccagccctatgtgcctggtctccaagcagaatcggttccgcttgacggaacaacaggtgaactttgtttgtcaaagagtggatgtagacatcgtcgtgtactgcaacggacagaggaaggttattctcaccaaaacactggtgatcggtcagtgtatttatactataacctctttattctcgctgctccccggcgtcgcccacagcatcgcggtggagctttgcgtaccagggtttcatggatgggccacagcagctctgttggtgactttctgttttggctgggttctaattcctgccatcaccttcatcattctgacaatactcaagtttatcgctaatattttccacacctccaaccaagaaaatcggctgaaatcagtccttcgcaagatcaaagaggaatttgagaagactaagggtagtatggtgtgcgatatttgtaaatacgagtgcgaaacgtataaggagctgaaagcccatggggtgtcttgcccccagagccagtgtccatactgcttcacacactgtgaacccaccgaggcagcctttcaggctcattataaggtctgccaagttactcaccgattcagagacgatttgaaaaagaccgtgacacctcagaacttcaccccaggctgttacaggactctcaatctgtttcggtataagtcccgttgctacatcttcacaatgtggatatttttactggtgctagaatcaatcctctgggcggcaagcgcctctgagacgccgctgacccccgtatggaacgacaatgctcacggagtcggctccgtgcctatgcatactgatcttgagttggacttcagtctgacaagcagctccaaatacacctatcgcagaaagctcacaaacccactggaagaggcccagtcaattgatcttcacatcgaaattgaggagcagactatcggggttgacgtgcatgcactgggacactggtttgatggtaggttgaatctcaaaaccagtttccactgttacggcgcctgcacgaagtatgaatacccctggcataccgctaaatgtcactatgagcgggactaccaatatgaaacaagctgggggtgcaacccttcggactgtccaggagtcggcactggttgcaccgcctgcgggctgtacttagatcgactgaagcccgtgggctccgcatacaagataattacaatccgctattctagaagggtttgtgtgcagtttggagaggaaaatctatgcaaaattgtagacatgaacgattgtttcgtcagccggcatgtgaaggtgtgcatcataggcactgtctcaaaatttagtcagggggacaccctcctgttctttggaccgcttgagggtggcgggttgatcttcaagcactggtgtacgtccacatgccagtttggagatcctggcgacattatgtctccacgcgataaaggtttcctgtgtcccgagttccctgggagctttagaaagaaatgcaatttcgcgaccactcccatctgtgaatacgacggcaacatggtttccggatataagaaggtgatggctacaattgattcatttcagagcttcaataccagtactatgcattttaccgacgagaggatcgaatggaaagatccagacggcatgctccgtgatcacataaacattctggtaacaaaggacatcgacttcgataacttaggggagaatccttgcaaaatcggactgcagacgtcttccattgaaggcgcctggggtagcggggtgggatttacccttacttgtttggtctcgctcacagagtgccccaccttcctgacatcaatcaaggcatgcgacaaagccatttgttacggcgctgagtctgtgactctaacccggggtcagaacacggttaaggtgagtggcaagggtggacactccggcagcacatttaaatgctgtcatggggaagattgctctcagataggactgcacgccgcagctccacatctcgacaaggtcaatggcatcagcgagatggaaaactccaaagtgtatgatgacggtgccccgcaatgtgggattaagtgctggttcgttaaatcaggagagtggatcagtggcatttttagcggtaattggatcgtgctgatagtcctttgtgtattcttgctgttctctttagtgctcctgtccatcctttgccctgttcgaaagcacaagaaatcatga

SEQ ID NO: 10116 - RNA, 3408 nt, synthetic construct
  misc_feature 1..3408: note = derived and/or modified CDS sequence (opt3) from HTNV(Aa13_3)__KX687227.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagtggatactgttcagctggtgcctgaatcaagttgtagcatggacaaccatcaatccctaaatacgatcaccaagtacacacaggtctcttggaggggtaaagctgatcagtcgcagtcaagccaaaacagttttgagactgtgtccaccgaagtagacctcaagggcacatgcgttctgaaacacaagatggtggaggagtcttatcggagccgcaagtccattacctgttacgatctttcatgcaatagtacttattgtaaaccaacactgtacatgatcgtccccattcatgcatgcaacatgatgaaaagctgtttgatcgccctcgggccttatcgagtccaggtggtgtacgaacgtacctactgcatgacgggagttctgatagagggcaaatgtttcgtgccagaccagtctgtagtgtccatcattaagcacggtatctttgatattgcgtcagtccatatcgtgtgcttctttgttgctgtgaaagggaatacttataagatattcgaacaggtcaagaaaagttttgagagtacctgtaacgacacagagaataaggtgcaaggatactatatttgcatcgtaggcggcaactctgcccccatttacgttcctactctggatgacttcagatccatggaagcatttaccgggatcttcaggagcccacacggagaggatcacgacctcgccggtgaagagacagctacctattcgatcgtgggcccggcaaatgccaaagtcccccattctgcttcctcagatacgttaagtctgattgcctttagcgggataccttcctactctagcctttcaatcttgactagctccacagaagcgaagcacgtgttcagcccaggactgtttcccaaactaaaccataccaattgcgacaagggcgcaattcctctcatgtggactggtatgatcgacctgccagggtattacgaggccatacacccctgtacagtcttctgcgtgctttctggaccgggcgcttcatgtgaggccttcagtgaaggcgggatttttaacatcaccagccctatgtgcctggtttccaaacagaatcggttccgcttgacggagcaacaggtgaactttgtatgtcaaagagtcgatgtggacatcgttgtgtactgcaacggacagaggaaggtcattctcaccaagacactggtgatcggtcagtgtatttatactataacctctttattctcgctgctccccggcgtagcacacagcatcgctgtggaactttgcgttccagggtttcatggatgggccacagcggccctgttggtcactttctgttttggctgggtgctaattcctgcaatcaccttcatcattctgacaatactcaaatttatcgctaatattttccacacctccaaccaagagaatcggctgaagtcagtgcttcgcaaaatcaaggaagagtttgagaaaactaagggtagtatggtctgcgatatttgtaagtacgaatgcgagacgtataaagaactgaaggcccatggggtttcttgcccccagagccagtgtccatactgcttcacacactgtgagcccaccgaagctgcctttcaggcacattataaagtgtgccaagtgactcaccgattcagagacgatttgaagaaaaccgtaacacctcagaacttcaccccaggctgttacaggactctcaatctgtttcggtataagtcccgttgctacatcttcacaatgtggatatttttactggtcctagagtcaatcctctgggccgctagcgcgtctgagacgccgctgacccccgtgtggaacgacaatgcacacggagttggctccgtgcctatgcatactgatcttgaattggacttcagtctgacatctagctccaagtacacctatcgcagaaaactcacaaacccactggaggaagcccagtcaattgatcttcacatcgagattgaggaacagactatcggggtcgacgtgcatgctctgggacactggtttgatggtaggttgaatctcaagaccagtttccactgttacggcgcctgcacgaaatatgagtacccctggcataccgcaaagtgtcactatgaacgggactaccaatatgagacaagctgggggtgcaacccttcggactgtccaggagttggcactggttgcaccgcctgcgggctgtacttagatcgactgaaacccgtgggctccgcttacaagataattacaatccgctattctagaagggtatgtgtccagtttggagaagagaatctatgcaagattatcgacatgaacgattgtttcgtgagccggcatgtgaaagtctgcataatcggcactgtttcaaagtttagtcagggggacaccctcctgttctttggaccgcttgagggtggcgggttgattttcaaacactggtgtacgtccacatgccagtttggagatcctggcgacatcatgtctccacgcgataagggtttcctgtgtcccgagttccctgggagctttagaaagaagtgcaatttcgccaccactcccatttgtgaatacgacggcaacatggtgtccggatataaaaaggtaatggcaacaatcgattcatttcagagcttcaataccagtactatgcattttaccgacgaaaggatagagtggaaggatccagacggcatgctccgtgatcacattaacatcctggtgacaaaagacatcgacttcgataacttaggggaaaatccttgcaagattggactgcagacgtcttccatcgagggcgcgtggggtagcggggtcggatttacccttacttgtttggtgtcgctcacagagtgccccaccttcctgacatcaattaaggcttgcgacaaggccatatgttacggcgcagaatctgttactctaacccggggtcagaacacggtgaaagtcagtggcaaagggggacactccggcagcacatttaagtgctgtcatggggaggattgctctcagatcggactgcacgccgctgccccacatctcgacaaagtgaatggcattagcgaaatggagaactccaaggtttatgatgacggtgcaccgcaatgtgggatcaaatgctggttcgtgaagtcaggagaatggattagtggcatctttagcggtaattggatagtcctgatcgtactttgtgtgttcttgctgttctctttagttctcctgtccattctttgccctgtgcgaaaacacaagaagtcatga

SEQ ID NO: 10117 - RNA, 3408 nt, synthetic construct
  misc_feature 1..3408: note = derived and/or modified CDS sequence (opt3) from HTNV(Aa14_186)__KX687228.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatgattgaggagtcttatcggagccgcaagtccatcacctgttacgatctttcatgcaataacacttattgtaaaccaacactgtacatgattgtacccatccatgcgtgcaatatgatgaagagttgtttgatagctctcgggccttatcgagttcaggtggtctacgaacgtacctactgcatgacgggagtgctgatcgagggcaaatgtttcgtgccagaccagagcgtcgtttctattatcaagcacggtatttttgatatcgcctccgtgcatatagtatgcttctttgtggcagtcaaagggaacacttataagattttcgaacaggtgaagaaatcatttgagagcacctgtaatgacacagagaacaaggttcaaggatactatatctgcattgtgggcggcaatagtgcccccatctacgtccctactctggatgacttcagatctatggaagcatttaccgggatcttcaggtccccacacggagaggatcacgacctcgctggtgaagagacagccacctatagcattgtgggcccggctaacgccaaagtaccccattcggcgtcttccgatacgttatcactgatagcatttagtgggatccctagctactcctctcttagcattttgacttcaagtacagaagccaagcacgttttctccccaggactgtttcccaaactaaatcataccaactgcgacaagggcgctatccctctcatgtggactggtatgatagacctgccagggtattacgaggccattcacccctgtacagtgttctgcgtccttagcggaccgggcgcatcttgtgaggctttctcagaaggcgggatctttaatatcaccagtcctatgtgcctggtgagcaaacagaaccggttccgcttgacggagcagcaggtcaactttgtgtgtcaaagagttgatgtggacattgtagtctactgcaatggacagaggaaggtgatcctcaccaagacactggttattggtcagtgtatatatactatcacctccttattctctctgctccccggcgtggcccactcgattgcggtcgaactttgcgtgccagggtttcatggatgggccacagcagctctgttggtaactttctgttttggctgggtgctaatccctgccatcaccttcattatactgacaatcctcaaatttattgctaacatcttccacaccagcaatcaagagaaccggctgaagtccgttcttcgcaaaattaaggaagagtttgagaaaactaagggttcaatggtctgcgatatctgtaagtacgaatgcgagacgtataaagaactgaaggcccatggggtgagttgcccccagtctcagtgtccatactgcttcacacactgtgagcccaccgaagcagcctttcaggctcattataaagtgtgccaagtcactcaccgattcagagacgatttgaagaaaaccgttacacctcagaatttcaccccaggctgttacaggactctcaacctgtttcggtataagagccgttgctacatattcacaatgtggatctttttactggtgctagagtccattctctgggcggcatcagccagcgagacgccgctgacccccgtgtggaatgacaacgctcacggagtaggctctgtccctatgcatactgatcttgaattggacttctccctgacaagtagctctaagtacacctatcgcagaaaactcacaaatccactggaggaagcccagtccatcgatcttcacattgagatcgaggaacagactataggggtggacgttcatgcactgggacactggtttgatggtaggttgaacctcaagacctcattccactgttacggcgcctgcacgaaatatgagtacccctggcataccgctaagtgtcactatgaacgggactaccaatatgagacaagttgggggtgcaatcctagcgactgtccaggagtgggcactggttgcaccgcctgcgggctgtacttagatcgactgaaacccgtcggctcggcatacaagattatcacaattcgctattccagaagggtgtgtgttcagtttggagaagagaacctatgcaagatcatagacatgaatgattgtttcgtgtctcggcatgtaaaagtctgcatcattggcactgtgagcaagttttcacagggggacaccctcctgttctttggaccgcttgagggtggcgggttgatcttcaaacactggtgtacgagtacatgccagtttggagatcctggcgacattatgtccccacgcgataagggtttcctgtgtcccgagttccctgggtcttttagaaagaagtgcaacttcgcgaccactcccatctgtgaatacgacggcaatatggtgagcggatataaaaaggtcatggctacaatagattcctttcaatcattcaacaccagcactatgcattttaccgacgaaaggattgagtggaaggatccagacggcatgctccgtgatcacatcaacatcctggttacaaaagacattgacttcgataatttaggggaaaacccttgcaagatcggactgcagacgagttctattgagggcgcctggggttccggggtgggatttacccttacttgtttggtaagcctcacagagtgccccaccttcctgacatcgataaaagcatgcgacaaggccatctgttacggcgctgaatcagtgactctaacccggggtcagaatacggtcaaagtgtctggcaaagggggacacagtggctccacatttaagtgctgtcatggggaggattgcagccagattggactgcacgccgcagctccacatctcgacaaagttaacggcatctctgaagtggagaatagcaaggtctatgatgacggtgccccgcaatgtgggattaaatgctggttcgtgaagtccggagaatggatctcaggcatatttagtggtaactggatcgttctgattgtgctttgtgtcttcttgctgttcagcttagtactcctgtctatcctttgccctgtgcgaaaacacaagaagtcctga

SEQ ID NO: 10118 - RNA, 3408 nt, synthetic construct
  misc_feature 1..3408: note = derived and/or modified CDS sequence (opt3) from HTNV(Aa14_234)__KX687230.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaactagctttgagaccgtgtccacagaagtcgacctcaaggggacctgcgtgctgaaacacaagatggtagaggagtcttatcggagccgcaagtccattacttgttacgatctttcatgcaacagtacatattgtaaaccaaccctgtacatgatcgttcccattcatgcgtgcaatatgatgaaaagctgtttgatcgctctcgggccttatcgagtgcaggtcgtgtacgaacgtacgtactgcatgactggagtgctgatagagggcaaatgtttcgtcccagaccagtctgttgtgtccatcattaagcacggtatctttgatattgcctcagtacatatcgtgtgcttctttgtcgcagtgaaagggaacacctataagatattcgaacaggttaagaaaagttttgagagtacatgtaatgacactgagaacaaggtgcaaggatactatatttgcatcgtcggcggcaattctgcccccatttacgtgcctaccctggatgacttcagatccatggaagcatttacagggatcttcaggagcccacacggagaggatcacgacctcgctggtgaagagaccgccacgtattcgatcgtaggcccggctaacgccaaagttccccattctgcgtcctcagatactttaagtctgattgcatttagcgggataccttcctactctagcctttcaatcttgacaagttccaccgaagccaagcacgtgttcagcccaggactgtttcccaaactaaatcatacttcttgcgacaagggcgctattcctctcatgtggacaggtatgatcgacctgccagggtattacgaggccatacacccctgtaccgtcttctgcgtgctttcaggaccgggcgcaagttgtgaggctttcagcgaaggcgggatttttaacatcacgtcccctatgtgcctggtctctaaacagaatcggttccgcttgaccgagcaacaggtgaactttgtttgtcagagagtggatgtagacatcgtcgtgtactgcaatggacagaggaaggttattctcacaaagactctggtgatcggtcagtgtatttataccataacatcgttattcagcctgctccccggcgtcgcccactccatcgcggtggaactttgcgtaccagggtttcatggatgggccactgcagctctgttggtgaccttctgttttggctgggttctaattcctgccatcacattcatcattctgaccgtcctcaaatttatagctaacatcttccacacttcaaaccaagagaatcggctgaagagtgtgcttcgcaaaattaaggaagagtttgagaaaacgaagggttctatggtgtgcgatatctgtaagtacgaatgcgagacatataaagaactgaaggcccatggggtcagctgcccccagtcccagtgtccatactgcttcacccactgtgagcccactgaagcagcctttcaggctcattataaagtttgccaagtgacccaccgattcagagacgatttgaagaaaacagtgacccctcagaacttcactccaggctgttacaggacactcaatctgtttcggtataagtcacgttgctacattttcacgatgtggatctttttactggtactagagagcatactctgggcggcatctgcctccgagaccccgctgactcccgtctggaacgacaatgctcacggagtgggcagtgttcctatgcatacagatcttgaattggacttcagcctgacctcttcctcaaagtacacatatcgcagaaaactcactaacccactggaggaagcccagagtatcgatcttcacattgagatcgacgagcagaccattggggtggatgtccatgcactgggacactggtttgacggtaggttgaatctcaagacgagcttccactgttacggcgcctgcaccaaatatgaatacccctggcatacagctaagtgtcactatgagcgggactaccaatatgaaacttcgtgggggtgcaacccttccgattgtccaggagtgggcaccggttgcacagcctgcgggctgtacttagaccgactgaaacccgttggctctgcatacaagatcataactattcgctatagcagaagggtgtgtgtacagtttggagaggaaaatctatgcaagatcattgatatgaacgactgtttcgtctcacggcatgtgaaagtgtgcatcataggcaccgtcagtaagttttcccagggggatacgctcctgttctttggaccgcttgagggtggcgggttgatcttcaaacactggtgtacatctacctgccagtttggagaccctggcgatattatgagcccacgcgacaagggtttcctgtgtcccgagttccctgggtcctttagaaagaagtgcaatttcgcgactacacccatctgtgaatacgatggcaacatggtttcaggatataaaaaggtgatggctaccattgacagctttcaaagtttcaatacttctaccatgcattttacagatgagaggatcgaatggaaggacccagatggcatgctccgtgaccacataaacattctggtaacgaaagacatcgatttcgacaatttaggggagaacccttgcaagatcggactgcagacctccagcattgaaggcgcctggggttcgggggtgggatttactcttacatgtttggtctcactcaccgagtgccccacattcctgacttctatcaaagcatgcgataaggccatttgttacggcgctgagagtgtgaccctaacgcggggtcagaacacagttaaagtgtccggcaagggcggacacagcggctctacctttaagtgctgtcatggggaagactgcagccagataggactgcacgccgcagctccacatctcgataaagtcaatggcatctccgagatggaaaactcaaaggtgtatgacgatggtgccccgcaatgtgggattaaatgctggttcgttaagagtggagagtggatcagcggcatcttttctggtaattggattgtgctgatagtcctttgtgtattcttgctgttctccttagtgctcctgtcaatcctttgccctgttcgaaaacacaagaagagttga

SEQ ID NO: 10119 - RNA, 3408 nt, synthetic construct
  misc_feature 1..3408: note = derived and/or modified CDS sequence (opt3) from HTNV(Aa14_239)__KX687231.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatggtagaggagtcttatcggagccgcaagtccattacctgttacgatctttcatgcaatagtacttattgtaaaccaacactgtacatgatcgttcccattcatgcgtgcaacatgatgaagagttgtttgatcgctctcgggccttatcgagtgcaggtcgtgtacgaacgtacctactgcatgacgggagtgctgatagagggcaaatgtttcgtcccagaccagtctgttgtgtccatcattaagcacggtatctttgatattgcctcagtacatatcgtgtgcttctttgtcgcagtgaaagggaatacttataagatattcgaacaggttaagaaatcttttgagagtacctgtaacgacacagagaataaggtgcaaggatactatatttgcatcgtcggcggcaactctgcccccatttacgtgcctactctggatgacttcagatccatggaagcatttaccgggatcttcaggagcccacacggagaggatcacgacctcgctggtgaagagacagccacctattcgatcgtaggcccggctaatgccaaagttccccattctgcgtcctcagatacgttaagtctgattgcatttagcgggataccttcctactctagcctttcaatcttgactagctccacagaagccaagcacgtgttcagcccaggactgtttcccaaactaaaccataccaattgcgacaagggcgctattcctctcatgtggactggtatgatcgacctgccagggtattacgaggccatacacccctgtacagtcttctgcgtgctttctggaccgggcgcatcatgtgaggctttcagtgaaggcgggatttttaacatcaccagccctatgtgcctggtctccaaacagaatcggttccgcttgacggagcaacaggtgaactttgtttgtcaaagagtggatgtagacatcgtcgtgtactgcaacggacagaggaaggttattctcaccaagacactggtgatcggtcagtgtatttatactataacctctttattctcgctgctccccggcgtcgcccacagcatcgcggtggaactttgcgtaccagggtttcatggatgggccacagcagctctgttggtgactttctgttttggctgggttctaattcctgccatcaccttcatcattctgacagtcctcaaatttatagctaatatcttccacacctccaaccaagagaatcggctgaagtcagtgcttcgcaaaattaaggaagagtttgagaaaactaagggtagtatggtgtgcgatatctgtaagtacgaatgcgagacgtataaagaactgaaggcccatggggtctcttgcccccagagccagtgtccatactgcttcacacactgtgagcccaccgaagcagcctttcaggctcattataaagtttgccaagtgactcaccgattcagagacgatttgaagaaaaccgtgacacctcagaacttcaccccaggctgttacaggactctcaatctgtttcggtataagtcccgttgctacattttcacaatgtggatctttttactggtactagagtcaatactctgggcggcaagcgcctctgagacgccgctgacccccgtctggaacgacaatgctcacggagtgggctccgttcctatgcatactgatcttgaattggacttcagtctgacaagcagctccaagtacacctatcgcagaaaactcacaaacccactggaggaagcccagtcaatcgatcttcacattgagatcgacgagcagactattggggtggatgtccatgcactgggacactggtttgacggtaggttgaatctcaagaccagtttccactgttacggcgcctgcacgaaatatgaatacccctggcataccgctaagtgtcactatgagcgggactaccaatatgaaacaagctgggggtgcaacccttcggattgtccaggagtgggcactggttgcaccgcctgcgggctgtacttagaccgactgaaacccgttggctccgcatacaagatcataacaattcgctattctagaagggtgtgtgtacagtttggagaggaaaatctatgcaagatcattgatatgaacgactgtttcgtcagccggcatgtgaaagtgtgcatcataggcactgtctcaaagtttagtcagggggataccctcctgttctttggaccgcttgagggtggcgggttgatcttcaaacactggtgtacgtccacatgccagtttggagaccctggcgatattatgtctccacgcgacaagggtttcctgtgtcccgagttccctgggagctttagaaagaagtgcaatttcgcgaccactcccatctgtgaatacgatggcaacatggtttccggatataaaaaggtgatggctacaattgactcatttcagagcttcaataccagtactatgcattttaccgatgagaggatcgaatggaaggacccagatggcatgctccgtgaccacataaacattctggtaacaaaagacatcgatttcgacaacttaggggagaatccttgcaagatcggactgcagacgtcttccattgaaggcgcctggggtagcggggtgggatttacccttacttgtttggtctcgctcacagagtgccccaccttcctgacatcaatcaaagcatgcgataaggccatttgttacggcgctgagtctgtgactctaacccggggtcagaacacggttaaagtgagtggcaaagggggacactccggcagcacatttaagtgctgtcatggggaagactgctctcagataggactgcacgccgcagctccacatctcgataaagtcaatggcatcagcgagatggaaaactccaaggtgtatgacgatggtgccccgcaatgtgggattaaatgctggttcgttaagtcaggagagtggatcagtggcatttttagcggtaattggatcgtgctgatagtcctttgtgtattcttgctgttctctttagtgctcctgtccatcctttgccctgttcgaaaacacaagaagtcatga

SEQ ID NO: 10120 - RNA, 3408 nt, synthetic construct
  misc_feature 1..3408: note = derived and/or modified CDS sequence (opt3) from HTNV(Aa14-172)__KU207162.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttaactgatacggctcagctggtgcctgaatcaagttgtagcatggacaaccatcaatccctaaataccatcacaaagtacactcaggtttcttggaggggtaaagcagatcagtcgcagtcaagccaaaacagttttgagaccgtgtccacagaagtcgacctcaagggcacttgcgtgctgaaacacaagatgattgaggagtcttatcggagccgcaagtccatcacttgttacgatctttcatgcaataacacatattgtaaaccaaccctgtacatgattgtacccatccatgcctgcaatatgatgaagagttgtttgatagcgctcgggccttatcgagttcaggtggtctacgaacgtacgtactgcatgactggagtgctgatcgagggcaaatgtttcgtgccagaccagagcgtcgtttctattatcaagcacggtatttttgatatcgcttccgtgcatatagtatgcttctttgtggccgtcaaagggaacacctataagattttcgaacaggtgaagaaatcatttgagagcacatgtaatgacactgagaacaaggttcaaggatactatatctgcattgtgggcggcaatagtgcacccatctacgtccctaccctggatgacttcagatctatggaagcctttacagggatcttcaggtccccacacggagaggatcacgacctcgctggtgaagagaccgcaacgtatagcattgtgggcccggccaacgctaaagtaccccattcggcctcttccgatactttatcactgatagcgtttagtgggatccctagctactcctctcttagcattttgacatcaagtaccgaagcaaagcacgttttctccccaggactgtttcccaaactaaatcatactaactgcgacaagggcgccatccctctcatgtggacaggtatgatagacctgccagggtattacgaggctattcacccctgtaccgtgttctgcgtccttagcggaccgggcgcctcttgtgaggcattctcagaaggcgggatctttaatatcacgagtcctatgtgcctggtgagcaaacagaaccggttccgcttgaccgagcagcaggtcaactttgtgtgtcaaagagttgatgtggacattgtagtctactgcaatggacagaggaaggtgatcctcacaaagactctggttattggtcagtgtatatataccatcacatccttattctctctgctccccggcgtggctcactcgattgccgtcgaactttgcgtgccagggtttcatggatgggcgactgccgcactgttggtaaccttctgttttggctgggtgctaatccctgctatcacattcattatactgaccatcctcaaatttattgccaacatcttccacactagcaatcaagagaaccggctgaagtccgttcttcgcaaaattaaggaagagtttgagaaaacgaagggttcaatggtctgcgatatctgtaagtacgaatgcgagacatataaagaactgaaggctcatggggtgagttgcccccagtctcagtgtccatactgcttcacccactgtgagcccactgaagccgcatttcaggcccattataaagtgtgccaagtcacccaccgattcagagacgatttgaagaaaacagttacccctcagaatttcactccaggctgttacaggacactcaacctgtttcggtataagagccgttgctacatattcacgatgtggatctttttactggtgctagagtccattctctgggctgcgtcagcaagcgagaccccgctgactcccgtgtggaatgacaacgcccacggagtaggctctgtccctatgcatacagatcttgaattggacttctccctgaccagtagctctaagtacacatatcgcagaaaactcactaatccactggaggaagctcagtccatcgatcttcacattgagatcgaggaacagaccataggggtggacgttcatgccctgggacactggtttgatggtaggttgaacctcaagacgtcattccactgttacggcgcatgcaccaaatatgagtacccctggcatacagccaagtgtcactatgaacgggactaccaatatgagaccagttgggggtgcaatcctagcgactgtccaggagtgggcaccggttgcacagcttgcgggctgtacttagatcgactgaaacccgtcggctcggcctacaagattatcactattcgctattccagaagggtgtgtgttcagtttggagaagagaacctatgcaagatcatagacatgaatgattgtttcgtgtctcggcatgtaaaagtctgcatcattggcaccgtgagcaagttttcacagggggacacgctcctgttctttggaccgcttgagggtggcgggttgatcttcaaacactggtgtacaagtacctgccagtttggagatcctggcgacattatgtccccacgcgataagggtttcctgtgtcccgagttccctgggtcttttagaaagaagtgcaacttcgcaactacacccatctgtgaatacgacggcaatatggtgagcggatataaaaaggtcatggcgaccatagattcctttcaatcattcaacactagcaccatgcattttacagacgaaaggattgagtggaaggatccagacggcatgctccgtgatcacatcaacatcctggttacgaaagacattgacttcgataatttaggggaaaacccttgcaagatcggactgcagaccagttctattgagggcgcttggggttccggggtgggatttactcttacatgtttggtaagcctcaccgagtgccccacattcctgacttcgataaaagcctgcgacaaggcaatctgttacggcgccgaatcagtgaccctaacgcggggtcagaatacagtcaaagtgtctggcaaagggggacacagtggctccacctttaagtgctgtcatggggaggattgcagccagattggactgcacgctgccgcaccacatctcgacaaagttaacggcatctctgaagtggagaatagcaaggtctatgatgacggtgctccgcaatgtgggattaaatgctggttcgtgaagtccggagaatggatctcaggcatatttagtggtaactggatcgttctgattgtgctttgtgtcttcttgctgttcagcttagtactcctgtctatcctttgccctgtgcgaaaacacaagaagtcctga

SEQ ID NO: 10121 - RNA, 3408 nt, synthetic construct
  misc_feature 1..3408: note = derived and/or modified CDS sequence (opt3) from HTNV(Aa14-175)__KU207163.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatggtagaggagtcttatcggagccgcaagtccattacctgttacgatctttcatgcaatagtacttattgtaaaccaacactgtacatgatcgttcccattcatgcgtgcaacatgatgaaaagctgtttgatcgctctcgggccttatcgagtgcaggtcgtgtacgaacgtacctactgcatgacgggagtgctgatagagggcaaatgtttcgtcccagaccagtctgttgtgtccatcattaagcacggtatctttgatattgcctcagtacatatcgtgtgcttctttgtcgcagtgaaagggaatacttataagatattcgaacaggttaagaaaagttttgagagtacctgtaacgacacagagaataaggtgcaaggatactatatttgcatcgtcggcggcaactctgcccccatttacgtgcctactctggatgacttcagatccatggaagcatttaccgggatcttcaggagcccacacggagaggatcacgacctcgctggtgaagagacagccacctattcgatcgtaggcccggctaatgccaaagttccccattctgcgtcctcagatacgttaagtctgattgcatttagcgggataccttcctactctagcctttcaatcttgactagctccacagaagccaagcacgtgttcagcccaggactgtttcccaaactaaaccataccaattgcgacaagggcgctattcctctcatgtggactggtatgatcgacctgccagggtattacgaggccatacacccctgtacagtcttctgcgtgctttctggaccgggcgcatcatgtgaggctttcagtgaaggcgggatttttaacatcaccagccctatgtgcctggtctccaaacagaatcggttccgcttgacggagcaacaggtgaactttgtttgtcaaagagtggatgtagacatcgtcgtgtactgcaacggacagaggaaggttattctcaccaagacactggtgatcggtcagtgtatttatactataacctctttattctcgctgctccccggcgtcgcccacagcatcgcggtggaactttgcgtaccagggtttcatggatgggccacagcagctctgttggtgactttctgttttggctgggttctaattcctgccatcaccttcatcattctgacaatactcaaatttatcgctaatattttccacacctccaaccaagagaatcggctgaagtcagtccttcgcaaaatcaaggaagagtttgagaaaactaagggtagtatggtgtgcgatgtgtgtaagtacgaatgcgagacgtataaagaactgaaggcccatggggtctcttgcccccagagccagtgtccatactgcttcacacactgtgagcccaccgaagcagcctttcaggctcattataaagtttgccaagtgactcaccgattcagagacgatttgaagaaaaccgtgacacctcagaacttcaccccaggctgttacaggactctcaatctgtttcggtataagtcccgttgctacattttcacaatgtggatctttttactggtactagagtcaatactctgggcggcaagcgcctctgagacgccgctgacccccgtctggaacgacaatgctcacggagtgggctccgttcctatgcatactgatcttgaattggacttcagtctgacatctagctccaagtacacctatcgcagaaaactcacaaacccactggaggaagcccagtcaatcgatcttcacattgagatcgaggaacagactattggggtggacgtccatgcactgggacactggtttgatggtaggttgaatctcaagaccagtttccactgttacggcgcctgcacgaaatatgagtacccctggcataccgctaagtgtcactatgaacgggactaccaatatgagacaagctgggggtgcaacccttcggactgtccaggagtgggcactggttgcaccgcctgcgggctgtacttagatcgactgaaacccgttggctccgcatacaagatcataacaattcgctattctagaagggtgtgtgtacagtttggagaagagaatctatgcaagatcattgacatgaacgattgtttcgtcagccggcatgtgaaagtgtgcatcataggcactgtctcaaagtttagtcagggggacaccctcctgttctttggaccgcttgagggtggcgggttgatcttcaaacactggtgtacgtccacatgccagtttggagatcctggcgacattatgtctccacgcgataagggtttcctgtgtcccgagttccctgggagctttagaaagaagtgcaatttcgcgaccactcccatctgtgaatacgacggcaacatggtttccggatataaaaaggtgatggctacaattgattcatttcagagcttcaataccagtactatgcattttaccgacgaaaggatcgagtggaaggatccagacggcatgctccgtgatcacataaacattctggtaacaaaagacatcgacttcgataacttaggggaaaatccttgcaagatcggactgcagacgtcttccattgagggcgcctggggtagcggggtgggatttacccttacttgtttggtctcgctcacagagtgccccaccttcctgacatcaatcaaagcatgcgacaaggccatttgttacggcgctgaatctgtgactctaacccggggtcagaacacggttaaagtgagtggcaaagggggacactccggcagcacatttaagtgctgtcatggggaggattgctctcagataggactgcacgccgcagctccacatctcgacaaggtcaatggcatcagcgaagtggagaactccaaggtttatgatgacggtgccccgcaatgtgggattaaatgctggttcgtgaagtcaggagaatggatcagtggcatttttagcggtaattggatcgtcctgatagtactttgtgtgttcttgctgttctctttagttctcctgtccatcctttgccctgtgcgaaaacacaagaagtcatga

SEQ ID NO: 10122 - RNA, 3408 nt, synthetic construct
  misc_feature 1..3408: note = derived and/or modified CDS sequence (opt3) from HTNV(Aa14-184)__KU207164.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatgattgaggagtcttatcggagccgcaagtccatcacctgttacgatctttcatgcaataacacttattgtaaaccaacactgtacatgattgtacccatccatgcgtgcaatatgatgaagagttgtttgatagctctcgggccttatcgagttcaggtggtctacgaacgtacctactgcatgacgggagtgctgatcgagggcaaatgtttcgtgccagaccagagcgtcgtttctattatcaagcacggtatttttgatatcgcctccgtgcatatagtatgcttctttgtggcagtcaaagggaacacttataagattttcgaacaggtgaagaaatcatttgagagcacctgtaatgacacagagaacaaggttcaaggatactatatctgcattgtgggcggcaatagtgcccccatctacgtccctactctggatgacttcagatctatggaagcatttaccgggatcttcaggtccccacacggagaggatcacgacctcgctggtgaagagacagccacctatagcattgtgggcccggctaacgccaaagtaccccattcggcgtcttccgatacgttatcactgatagcatttagtgggatccctagctactcctctcttagcattttgacttcaagtacagaagccaagcacgttttctccccaggactgtttcccaaactaaatcataccaactgcgacaagggcgctatccctctcatgtggactggtatgatagacctgccagggtattacgaggccattcacccctgtacagtgttctgcgtccttagcggaccgggcgcatcttgtgaggctttctcagaaggcgggatctttaatatcaccagtcctatgtgcctggtgagcaaacagaaccggttccgcttgacggagcagcaggtcaactttgtgtgtcaaagagttgatgtggacattgtagtctactgcaatggacagaggaaggtgatcctcaccaagacactggttattggtcagtgtatatatactatcacctccttattctctctgctccccggcgtggcccactcgattgcggtcgaactttgcgtgccagggtttcatggatgggccacagcagctctgttggtaactttctgttttggctgggtgctaatccctgccatcaccttcattatactgacaatcctcaaatttattgctaacatcttccacaccagcaatcaagagaaccggctgaagtccgttcttcgcaaaattaaggaagagtttgagaaaactaagggttcaatggtctgcgatgtgtgtaagtacgaatgcgagacgtataaagaactgaaggcccatggggtgagttgcccccagtctcagtgtccatactgcttcacacactgtgagcccaccgaagcagcctttcaggctcattataaagtctgccaagttactcaccgattcagagacgatttgaagaaaaccgtgacacctcagaatttcaccccaggctgttacaggactctcaacctgtttcggtataagagccgttgctacatcttcacaatgtggatatttttactggtgctagagtccatcctctgggcggcatcagccagcgagacgccgctgacccccgtatggaatgacaacgctcacggagtcggctctgtgcctatgcatactgatcttgaattggacttctccctgacaagtagctctaagtacacctatcgcagaaaactcacaaatccactggaggaagcccagtccattgatcttcacatcgagattgaggaacagactatcggggttgacgtgcatgcactgggacactggtttgatggtaggttgaacctcaagacctcattccactgttacggcgcctgcacgaaatatgagtacccctggcataccgctaagtgtcactatgaacgggactaccaatatgagacaagttgggggtgcaatcctagcgactgtccaggagtcggcactggttgcaccgcctgcgggctgtacttagatcgactgaaacccgtgggctcggcatacaagataattacaatccgctattccagaagggtttgtgtgcagtttggagaagagaacctatgcaagattatcgacatgaatgattgtttcgtatctcggcatgtcaaagtgtgcataatcggcactgtgagcaagttttcacagggggacaccctcctgttctttggaccgcttgagggtggcgggttgattttcaaacactggtgtacgagtacatgccagtttggagatcctggcgacatcatgtccccacgcgataagggtttcctgtgtcccgagttccctgggtcttttagaaagaagtgcaacttcgcgaccactcccatttgtgaatacgacggcaatatggtcagcggatataaaaaggttatggctacaatcgattcctttcaatcattcaacaccagcactatgcattttaccgacgaaaggatagagtggaaggatccagacggcatgctccgtgatcacattaacatcctggtgacaaaagacatcgacttcgataatttaggggaaaacccttgcaagattggactgcagacgagttctatcgagggcgcctggggttccggggtaggatttacccttacttgtttggtgagcctcacagagtgccccaccttcctgacatcgattaaagcatgcgacaaggccatatgttacggcgctgaatcagtcactctaacccggggtcagaatacggtgaaagtttctggcaaagggggacacagtggctccacatttaagtgctgtcatggggaggattgcagccagatcggactgcacgccgcagctccacatctcgacaaagtgaacggcatttctgaagtcgagaatagcaaggtgtatgatgacggtgccccgcaatgtgggatcaaatgctggttcgttaagtccggagaatggatttcaggcatctttagtggtaactggatagtgctgatcgtcctttgtgtattcttgctgttcagcttagtgctcctgtctattctttgccctgttcgaaaacacaagaagtcctga

SEQ ID NO: 10123 - RNA, 3408 nt, synthetic construct
  misc_feature 1..3408: note = derived and/or modified CDS sequence (opt3) from HTNV(LR1)__AF288293.1__GP
  source 1..3408: mol_type = other RNA
atgggcatctggaagtggctggtgatggccagcctcgtctggcccgttcttaccctgagaaacgtgtacgacatgaagattgagtgccctcacacagtatccttcgggggaaattctgtgataggttatgtcgaattgccaccggtgcccttagctgatactgcacagatggttcctgagtcaagttgtagcatggacaaccatcaatccctgaatacgatcaccaagtacacacaggtgtcttggaggggcaaagccgatcagtcgcagtcaagccaaaacagttttgaaactgtctccaccgaggtggacctaaaggggacatgcgtactcaaacacaagatggttgaagagtcttatcggagccgcaagtccgtgacctgttacgatctgtcatgcaatagtacttattgtaaaccaacactttacatgattgtccccatccatgcgtgcaacatgatgaaaagctgtctgattgctttgggaccttatcgagtccaggtggtgtacgagcgtacctactgcatgacgggcgttctcatcgaaggtaagtgtttcgtgccagaccagtctgtagtgtccataatcaagcacgggatttttgatatcgcctcagtccatattgtgtgcttctttgttgcagtgaaaggaaatacttataagatcttcgagcaggtcaagaaaagttttgaaagcacctgtaacgacacagagaataaggtgcaaggctactatatatgcattgtaggcgggaactctgcccccatctacgttcctactctggatgacttcagatccatggaggcttttaccggaattttcaggagcccacacggtgaagatcgggacctggcaggcgaggaaatcgcctcgtattctatcgtggggccggctaatgccaaagtcccccactccgcgtcaagtgatacactccgcttaattgcatacagcggaataccttcctattctagcctgtcaatccttaccagttccacggaggccaagcatgtgtttagcccaggcttgttccccaaactgaaccacactaattgcgacaagtctgctattcctctaatctggacaggtatgatagacctcccagggtactacgaagccgtccatccctgtaccgtgttttgcgttctgtcaggaccgggcgcaagttgtgaggctttcagcgagggcgggattttcaacatcacttcctctatgtgccttgtgtcgaaacagaatagatttaggctgacagaacagcaggtaaacttcgtctgtcaacgggtggatatggacatcgttgtgtattgcaacggacagcgcaaggtcattttgaccaagacgctcgtgatcggtcagtgtatttacaccataacaagcctgttttccttactgcctggcgtagcccactcaatcgcggtggagctctgcgttcccgggttccacggatgggccactgcagcccttctggtcacctttcgattcggctgggtgttgattccagctatcacatttatcattctaactgtgctgaaattcatagctaatatctttcataccagtaaccaagaaaatagactcaagtctgtcctgaggaaaattaaggaggaatttgagaaaacaaagggtagcatggtttgtgatgtgtgcaagtatgagtgtgaaacctacaaagagcttaaggcccacggggtgtcctgccctcagtcacagtgcccctattgtttcactcattgcgaaccaacggaggcagccttccaggctcactacaaagtatgtcaagtcacacatcggtttcgtgacggcctgaagaaaaccgtgactccccagaacttcacccctggatgctatcgcacattgaatctcttcagatacaagtctaggtgttacatctttaccatgtggattttcctgttagttctggaaagcatcctatgggcggcatccgccagtgagactccactcacaccggtgtggaacgataatgctcacggcgtcgggagcgtgcccatgcacacggacctggagcttgatttttctttgacctcctcaagtaagtatacttaccggcgaaaactgacaaaccctctcgaagaggcccagagcatagacctgcatatcgaaattgaggagcagaccatcggagttgatgtgcacgcacttggtcattggttcgacggccgcctgaatttgaagacatcgtttcactgctatggggcctgtactaaatacgaatatccatggcacaccgctaagtgccattacgagagagattatcaatacgaaacgtcctggggatgtaacccctctgactgccctggcgtaggtaccgggtgtacagcctgcggcctctacctggaccagttaaaaccagtcggaagcgcatataagattatcactataaggtactcacggcgcgtgtgcgtgcagttcggcgaggaaaatctgtgtaagattatcgatatgaacgactgctttgtcagtagacacgttaaagtgtgtattatcgggaccgtatccaagttctctcagggagatacactactctttttcggtcccctggagggcgggggacttatatttaaacattggtgcactagcacctgtcaattcggcgacccgggtgatatcatgtcccctagggacaaggggtttttgtgcccagagttccccggctcattccgtaaaaagtgtaattttgcgacgacacctatttgcgaatatgatggaaacatggtgagcggctacaaaaaggtcatggctaccatcgacagtttccagtcttttaatacttccacaatgcacttcaccgatgagcggattgaatggaaggaccccgatgggatgctgcgagaccatatcaacatactcgtgactaaagatattgactttgacaacctgggagagaatccatgtaagatcggcttacagaccagctcgatcgaaggtgcctgggggtcaggagttggcttcacactgacgtgccttgtgtctttgaccgagtgtcctacttttctcacaagtattaaagcatgcgataaggccatctgctatggtgctgagtccggcaccctgacaagagggcagaacactgtcaaagtgagcggaaagggcgggcactctggaagcaccttcaagtgttgccacggcgaagactgttcccaaattggtctacatgccgcagctccccacctggataaagttaatgggatatcagagatcgaaaacagtaaggtgtacgacgatggagccccacagtgcggcattaaatgttggtttgtcaagagcggtgagtggatctctggcattttctccgggaattggatcgtactcatagtgctgtgcgtttttcttttgttctcactggtgttactcagtatcccgtgtcctgtcaggaaacataaaaagagctga

SEQ ID NO: 10124 - RNA, 3408 nt, synthetic construct
  misc_feature 1..3408: note = derived and/or modified CDS sequence (opt3) from HTNV(SN7)__AF288656.1__GP
  source 1..3408: mol_type = other RNA
atgggcgtgtggaagtggctggtcatggccagcctcgtttggcccgcttgcacccttagaaacgtgtacgacatgaaaatcgagtgtcctcacacagtatccttcggggaaaattctgtgattggatatgtcgagctgccaccgatgcccttggcagatactacgcagttagtgcctgaatcaagttgcagcatggacaaccatcaatccctgaataccataacaaagtacactcaggtttcttggaggaaaaaggccgatcaggcgcagtcgtcacaaaacagctttgagaccgtgagtgtcgaagtggacctaaaaggtacatgtgtactcaagcacaagatgatcgaggagtcctatcggtctcgcaaaagcattacctgctacgatctgtcctgtaattcaacttattgcaagccaacactttacatgatcgttcccattcatgcttgtaacatgatgaaaagttgcctgatcgccttgggcccttatcgagtgcaggtcgtgtacgaacgtacctactgtatgacgggggtgctcatagagggaaagtgcttcgtcccagaccagagcgttgtgtctatcattaaacacggcatctttgatattgcatccgtaaagatcgtgtgtttctttgtcgccgtgaagagaaatacttataaactgttcgaacaggttaagaaatcatttgactcgacctgcaacgatacagagaataaggtgcaaggttactatatatgcattgtcgggggaaacagtgctcccatctacgtgcctactctggacgatttcaggtctatggaggcattttccggcattttccggagcccacatggcgaagaccacgatctcgccggggaggaagtagcttcgtattctatcgttggaccggccaatgcgaaagtgccccactccgcatcaagtgacaccttaagcctgatcgcctactccggtattccttcttatagctcacttagtatattgacatccagcaccgaggctaagcatgtcttttctccaggcttctttccccagctgaaccacacgaaatgtgacaagactgccatccctctaacatggaccgggatgattgatctcccaggatactacgaagcaatccatccctgcactgtgttctgtgtcctgtcaggcccgggtgctagttgcgaggccttcagcgagggaggaatatttaatattacatcccctatgtgtcttgtgtctaagcagaaccgcttcagactgaccgaacagcaagttaattttgtgtgccagagggtagacatggatatcgtcgtgtattgtaacggccagcggaaagttatcttgacgaagaccatggtgattggccaatgcatctacacaattactagcctcttcagcctgttacccggggtcgcgcactccatagccgtggagctgtgtgtaccaggatttcacggttgggcaaccgctgccctccttgtgacattctgctttggctgggttctgatccctgctgtcactttcattatcttgaccgtgctaaaatttgtggccaacatcttccatacatcaaatcaggaaaaccgcctgaagagtgtcctccgaaaaattaaggaggaatttgagaagaccaaagggtctatggtttgtgacgtgtgcaagtatgagtgcgaaacttacaaagagctgaaggcacacggagtgagctgtccccagtcccagtgcccatattgtttcacgcattgcgaacccacagaggccgcttttcaagcgcactacagagtatgtcaggtcacccataggttccgggatgaccttaaaaagactgtgacccctcagaatttcacaccaggctgctatcgtaccctgaacttgtttcgctacaagtcaagatgttacatattcactatgtgggtttttctcctggtgttagaaagcatcctgtgggcagcctctgcttccgaggtcccgctaaatcccatttggaacgataatgcccacggtgtggggagtgttcctatgcacacagacctcgagctggatttcagccttacgtcttcctcaaaatatacctacaggcggaagttgactaacccactggaagagacacaggcaatcgacctccatattgaaatcgaggagcaaaccataggcgtggatgtacacgccctgggacattggtttgacggccgacttaatctgaaaacaagtttccactgctatggggcttgtactaagtacgaatatccctggcacaccgccaaatgccattacgagcgcgactatcagtacgaaacgagctggggatgtaacccttcggattgcccaggtgtcggcaccgggtgcacagcatgtggattgtacctcgaccagctgaagcccgtgggctccgcgtataagatcattactatcagatactctaggcgggtgtgcgtccagtttggtgaggaaaatttatgtaaagttattgatatgaacgactgcttcgtgagccgccacgtaaaggtgtgtatcatagggaccgtctcaaaatttagtcaaggcgatacactgctattctttggaccgctcgagggcgggggactgattttcaagcattggtgcacttccacctgtcagtttggtgaccctggcgatatcatgtctccaagagacaaagggttcctttgccccgagttccctgggagctttaggaagaaatgtaatttcgctacgacacccttgtgcgaatatgatggcaacatgatttccggttacaagaaggtgatggccaccatcgactcatttcagagcttcaatacaagtactatgcactttaccgatgagcgtatagaatggaaagacccagatgggatgctgcgggaccatatcaacattctcgttactaaggacatcgatttcgacaacctgggcgagaatccttgtaaaattggattacagacctcttccatcgaaggcgcatgggggagcggagtgggctttacactgacgtgccttgtctcgttgaccgagtgccccactttcctcacatcaataaaggcctgtgataaagctatttgctatggtgccgagtctgtgaccctgacacgagggcaaaacactgttaaggtgagtggaaagggcggtcactccggcagcacctttaaatgttgccacggggaagactgttctcagacgggactacatgcagctgccccacacctggataaggtcaatggcatcagcgagtccgaaaactcaaaagtatacgacgatggggcgccgcagtgcggaatcaagtgttggttcgtgaaaagtggcgagtggattagcggtatcttttctgggaattggattgttctcatagtgctgtgcgtcttccttttgttctccctggtgttactctcagtactgtgtcctgtgagaaagcataagaaaagttga

SEQ ID NO: 10125 - RNA, 3408 nt, synthetic construct
  misc_feature 1..3408: note = derived and/or modified CDS sequence (opt3) from HTNV(84FLi)__AF366569.1__GP
  source 1..3408: mol_type = other RNA
atgggcgtgtggaagtggctggtcatggccagcctcgtttggcccgcttgcacccttagaaacgtgtacgacatgaaaatcgagtgtcctcacacagtatccttcggggaaaattctgtgattggatatgtcgagctgccaccgatgcccttggcagatactacgcagttagtgcctgaatcaagttgcagcatggacaaccatcaatccctgaataccataacaaagtacactcaggtttcttggaggaaaaaggccgatcaggcgcagtcgtcacaaaacagctttgagaccgtgagtgtcgaagtggacctaaaaggtacatgtgtactcaagcacaagatgatcgaggagtcctatcggtctcgcaaaagcattacctgctacgatctgtcctgtaattcaacttattgcaagccaacactttacatgatcgttcccattcatgcttgtaacatgatgaaaagttgcctgatcgccttgggcccttatcgagtgcaggtcgtgtacgaacgtacctactgtatgacgggggtgctcatagagggaaagtgcttcgtcccagaccagagcgttgtgtctatcattaaacacggcatctttgatattgcatccgtaaagatcgtgtgtttctttgtcgccgtgaagggtaatacttataaactgttcgaacaggttaagaaatcatttgacagtacctgcaacgatacagagaataaggtgcaagggtactatatatgcattgtcggaggcaacagtgctcccatctacgtgcctactctggacgatttcagatctatggaggcattttccggcattttcaggagcccacatggggaagaccacgatctcgccggagaggaagtagcttcgtattctatcgttggtccggccaatgcgaaagtgccccacaacgcatcctcagacaccttaagtctgatcgcctacagcggcattccttcctattctagcctttcaatattgacaagttccaccgaggctaagcatgtctttagcccagggttctttccccagctgaatcacacgaaatgtgacaagactgccatccctctaacatggaccggaatgattgatctcccaggctactacgaagcaatccatccctgcactgtgttctgtgtcctgtctggtccgggggcttcatgcgaggccttcagtgagggaggcatatttaacattacaagccctatgtgtcttgtgtccaagcagaatcggttccgcctgaccaaacagcaagttaactttgtgtgccagagagtagacatggatatcgtcgtgtattgtaacggccagaggaaggttatcttgacgaaaaccatggtgattgggcaatgcatctacacaattacttctctcttctcgctgttacccggagtcgcgcacagcatagccgtggaactgtgtgtaccaggttttcacggctgggcaaccgctgccctccttgtgacattctgctttgggtgggttctgatccctgctgtcactttcattatcttgaccgtgctaaagtttgtggccaatatcttccatacatccaaccaggagaatcggctgaaatcagtcctccgcaagattaaggaagagtttgagaaaaccaagggaagtatggtttgtgacgtgtgcaaatatgagtgcgagacttacaaggaactgaaagcacacggcgtgtcttgtccccagagccagtgcccatattgtttcacgcattgcgagcccacagaagccgcttttcaagcgcactaccgagtatgtcaggtcacccatagattcagggatgaccttaagaagactgtgacccctcagaacttcacaccaggttgctatcggaccctgaatttgtttcgttacaaatcccgctgttacatattcactatgtgggtttttctcctggtgttagagtcaatcctgtgggcagccagcgcttctgaagtcccgctaaaccccatttggaatgataacgcccacggggtgggctccgttcctatgcacacagacctcgagctggatttcagtcttacgtctagctccaagtatacctacagaaggaaattgactaatccactggaggaaacacaggcaatcgacctccatattgagatcgaagaacaaaccataggagtggatgtacacgccctgggccattggtttgacgggcggcttaacctgaagacatcattccactgctatggagcttgtactaaatacgagtatccctggcacaccgccaagtgccattacgaacgagactatcagtacgagacgagttggggttgtaatcctagcgattgcccaggcgtcgggaccggatgcacagcatgtggcttgtacctcgaccagctgaagcccgtgggttcggcgtataaaatcattactatccgctactccagaagggtgtgcgtccagtttggggaagagaacttatgtaaggttattgatatgaatgactgcttcgtgtctcggcacgtaaaagtgtgtatcataggcaccgtcagcaagttttcacaaggagatacactgctattctttggcccgctcgaagggggaggtctgattttcaaacattggtgcactagcacctgtcagtttggcgaccctggggatatcatgtccccacgcgacaagggattcctttgccccgagttccctggctcttttaggaaaaagtgtaacttcgctacgacacccttgtgcgagtatgatggtaatatgattagcgggtacaagaaagtgatggccaccatcgactcctttcagtcattcaacactagcacaatgcactttaccgatgaaagaatagagtggaaggacccagatggcatgctgcgtgaccatatcaacattctcgttactaaagacatcgatttcgacaatctgggagaaaacccttgtaagattggcttacagaccagttctatcgagggggcatggggatccggcgtgggttttacactgacgtgccttgtcagcttgaccgaatgccccactttcctcacatcgataaaagcctgtgataaggctatttgctatggggccgagtcagtgaccctgacacggggacaaaatactgttaaggtgtctggcaaaggtggccacagtgggtccacctttaagtgttgccacggagaggactgtagccagacgggcctacatgcagctgccccacacctggataaagtcaacgggatctctgaaatcgagaatagcaaggtatacgacgatggagcgccgcagtgcggcattaaatgttggttcgtgaagtccggtgaatggatctcagggatttttagtggaaactggatagttctcatcgtgctgtgcgtcttccttttgttcagcctggtgttactctctgtactgtgtcctgtgcgaaagcataaaaagtcctga

SEQ ID NO: 10126 - RNA, 3408 nt, synthetic construct
  misc_feature 1..3408: note = derived and/or modified CDS sequence (opt3) from HTNV(Aa08-1111)__KY594715.1__GP
  source 1..3408: mol_type = other RNA
atgggcatctggaagtggctggtgatggccagcctcgtctggcccgttttcacccttagaaacgtgtacgacatgaaaattgagtgccctcacacagtatcctttggggaaaattctgtgataggatatgtcgagctgccaccgatgcccttggctgatactgcacagatggtgcctgaatcaagttgtagcatggacaaccatcaatccttaaatacgatcaccaagtacacacaggtttcttggaggggtaaagccgatcagtcgcagtcaagccaaaacagtttcgagactgtgtccaccgaagtcgacctgaagggcacatgcgtgctaaaacacaagatggtagaggagtcttatcggagccgcaagtccattacctgttacgatctctcatgcaatagtacttattgtaaaccaacactgtacatgatcgttcccattcatgcgtgcaacatgatgaaaagctgtcttatcgctctggggccttatcgagtgcaggtcgtgtacgaacgtacctactgcatgacgggagtgttgatagagggcaagtgttttgtcccagaccagtctgttgtgtccatcattaagcacggtatcttcgatattgcctcagtacatatcgtgtgctttttcgtcgcagtgaaagggaatacttataagatatttgaacaggttaagaaaagtttcgagagcacctgtaacgacacagagaataaggtgcaaggatactatatttgcatcgtcggcggcaactctgcccccatttacgctcctactctcgatgactttagatccatggaagcattcaccgggatctttaggagcccacacggagaggatcacgacctggccggtgaagagatcgcttcgtattctattgtgggcccggccaatgcgaaagtaccccattccgcatcaagtgatacactgagcctcatagcctactccgggatcccttcttatagctcattaagtattatcacctccagcacggaagctaagcacgttttctctccaggactgtttcccaaacttaaccatactaattgcaacaagggcgccatacctttgatttggacaggtatgatcgacctgccagggtactacgaggcagtgcacccctgtaccgtcttctgcgtgctatcaggaccgggcgctagttgtgaggccttcagcgaaggcgggatctttaatattacttcccctatgtgcctcgtctctaaacagaaccggttccgcctgacagagcaacaggtgaactttgtttgtcagagagtggacatggatatcgtagtctattgcaatggacagaggaaggtgattcttaccaagacgctggttataggtcagtgtatctacaccattacatcgttgttcagcctcctgcccggcgtggcgcactccatcgccgtcgaattatgcgtgccagggtttcatggatgggcaactgctgccctgctcgtaaccttctgttttggctgggtgcttatccctgctattacattcataatcctgactgttttgaaatttattgccaacatcttccacacctcaaatcaagagaaccggctaaagagtgtcctgcgcaaaattaaggaagagtttgagaaaacaaagggttctatggtgtgcgacatctgtaagtatgaatgcgagacctacaaagaactcaaggcacatggggtgagctgcccccagtcccagtgtccatattgcttcactcactgtgagcccacggaagccgcttttcaggcgcattacaaagtctgccaagttacacaccgattcagagatgacctgaagaaaaccgtgactcctcagaatttcaccccaggctgttataggacacttaacctgtttcggtacaagtcacgttgctacatattcaccatgtggatctttttgctcgtgctggagagcattttatgggcagcctctgcttccgagactccgctgacacccgtatggaatgataacgcccacggagtcggcagtgtgcctatgcatacggacctagaactcgatttcagcctgacctcttcctcaaagtatacttaccgcagaaaacttacaaatccattggaggaagcacagagtatcgggctgcacattgagatcgaggaacagaccataggagttgacgtgcatgccctcggtcactggtttgatggcaggctgaaccttaagactagcttccactgttatggggcttgcacaaaatacgagtatccctggcataccgccaagtgtcactacgaacgggactatcaatacgagacgtcgtggggatgcaatccttccgattgtccaggcgtcggtaccgggtgcacagcatgcggcctgtacttggaccagctcaaacccgtgggatctgcgtataagattatcactattcgatacagccgcagagtttgtgtgcagtttggcgaagaacatctgtgcaagatcatagacatgaacgattgtttcgtatcaaggcacgtcaaagtgtgcatcattgggaccgtgagtaagttttcccagggagacacattactgttctttggtccgctagagggcgggggactcatcttcaaacattggtgtacttctacctgccaatttggcgatcctggtgacattatgagcccacgggataaggggttcctgtgtcccgagttccctggctcctttcgcaaaaagtgcaatttcgctacgacacccatctgtgagtatgacggaaacatggtctcaggctacaaaaaggttatggccaccatagatagctttcagagtttcaatacttctacaatgcactttaccgacgaaagaattgagtggaaggatccagacgggatgcttagggatcacatcaacatcttggtgactaaagacattgatttcgacaacctgggagaaaatccttgcaagatcggcctccagacctccagcattgagggtgcatgggggtcgggagtaggctttacactgacgtgtttagtgtcactgaccgagtgccccactttccttacatctataaaagcctgcgacaaggctatctgttatggtgccgaaagtgtcaccttgacacgtggccagaacactgtgaaagtttccgggaagggaggccatagcgggtctacctttaagtgctgtcacggagaggaatgcagccaaattggcctccatgcagctgccccacacctggataaagtgaatggtatctccgagattgaaaactcaaaggtctacgacgatggggcgccgcagtgtggaatcaaatgctggttcgtgaagagtggcgagtggataagcggtatcttttctggcaattggattgttctaatcgtgctgtgtgtcttcctcctgttctcccttgtattgctgtcaattttatgccctgtgcggaaacataagaagagttga

SEQ ID NO: 10127 - RNA, 3408 nt, synthetic construct
  misc_feature 1..3408: note = derived and/or modified CDS sequence (opt3) from HTNV(Aa09-189)__KY594716.1__GP
  source 1..3408: mol_type = other RNA
atgggcatctggaagtggctggtgatggccagcctcgtctggcccgttttcacccttagaaacgtgtacgacatgaaaattgagtgccctcacacagtatcctttggggaaaattctgtgataggatatgtcgagctgccaccgatgcccttggctgatactgcacagatggtgcctgaatcaagttgtagcatggacaaccatcaatccttaaatacgatcaccaagtacacacaggtttcttggaggggtaaagccgatcagtcgcagtcaagccaaaacagtttcgagactgtgtccaccgaagtcgacctgaagggcacatgcgtgctaaaacacaagatggtagaggagtcttatcggagccgcaagtccattacctgttacgatctctcatgcaatagtacttattgtaaaccaacactgtacatgatcgttcccattcatgcgtgcaacatgatgaaaagctgtcttatcgctctggggccttatcgagtgcaggtcgtgtacgaacgtacctactgcatgacgggagtgttgatagagggcaagtgttttgtcccagaccagtctgttgtgtccatcattaagcacggtatcttcgatattgcctcagtacatatcgtgtgctttttcgtcgcagtgaaagggaatacttataagatatttgaacaggttaagaaaagtttcgagagcacctgtaacgacacagagaataaggtgcaaggatactatatttgcatcgtcggcggcaactctgcccccatttacgctcctactctcgatgactttagatccatggaagcattcaccgggatctttaggagcccacacggagaggatcacgacctggccggtgaagagatcgcttcgtattctattgtgggcccggccaatgcgaaagtaccccattccgcatcaagtgatacactgagcctcatagcctactccgggatcccttcttatagctcattaagtattatcacctccagcacggaagctaagcacgttttctctccaggactgtttcccaaacttaaccatactaattgcgacaagggcgccatacctttgatttggacaggtatgatcgacctgccagggtactacgaggcagtgcacccctgtaccgtcttctgcgtgctatcaggaccgggcgctagttgtgaggccttcagcgaaggcgggatctttaacattacttcccctatgtgcctcgtctctaaacagaatcggttccgcctgacagagcaacaggtgaactttgtttgtcagagagtggatatggacatcgtagtctattgcaacggacagaggaaggtgattcttaccaagacgctggttataggtcagtgtatctacaccattacatcgttgttcagcctcctgcccggcgtggcgcactccatcgccgtcgaattatgcgtgccagggtttcatggatgggcaactgctgccctgctcgtaaccttctgttttggctgggtgcttatccctgctattacattcataatcctgactgttttgaaatttattgccaatatcttccacacctcaaaccaagagaatcggctaaagagtgtcctgcgcaaaattaaggaagagtttgagaaaacaaagggttctatggtgtgcgatatctgtaagtatgaatgcgagacctacaaagaactcaaggcacatggggtgagctgcccccagtcccagtgtccatattgcttcactcactgtgagcccacggaagccgcttttcaggcgcattacaaagtctgccaagttacacaccgattcagagacgatctgaagaaaaccgtgactcctcagaacttcaccccaggctgttataggacacttaatctgtttcggtacaagtcacgttgctacatattcaccatgtggatctttttgctcgtgctggagagcattttatgggcagcctctgcttccgagactccgctgacacccgtatggaacgacaatgcccacggagtcggcagtgtgcctatgcatacggatctagaactcgacttcagcctgacctcttcctcaaagtatacttaccgcagaaaacttacaaacccattggaggaagcacagagtatcgggctgcacattgagatcgaggaacagaccataggagttgatgtgcatgccctcggtcactggtttgacggcaggctgaatcttaagactagcttccactgttatggggcttgcacaaaatacgagtatccctggcataccgccaagtgtcactacgaacgggattatcaatacgagacgtcgtggggatgcaacccttccgactgtccaggcgtcggtaccgggtgcacagcatgcggcctgtacttggaccagctcaaacccgtgggatctgcgtataagattatcactattcgatacagccgcagagtttgtgtgcagtttggcgaagaacatctgtgcaagatcatagatatgaatgactgtttcgtatcaaggcacgtcaaagtgtgcatcattgggaccgtgagtaagttttcccagggagatacattactgttctttggtccgctagagggcgggggactcatcttcaaacattggtgtacttctacctgccaatttggcgaccctggtgatattatgagcccacgggacaaggggttcctgtgtcccgagttccctggctcctttcgcaaaaagtgcaacttcgctacgacacccatctgtgagtatgatggaaatatggtctcaggctacaaaaaggttatggccaccatagacagctttcagagtttcaacacttctacaatgcactttaccgatgaaagaattgagtggaaggacccagatgggatgcttagggaccacatcaatatcttggtgactaaagatattgacttcgacaacctgggagaaaacccttgcaagatcggcctccagacctccagcattgagggtgcatgggggtcgggagtaggctttacactgacgtgtttagtgtcactgaccgagtgccccactttccttacatctataaaagcctgcgataaggctatctgttatggtgccgaaagtgtcaccttgacacgtggccagaatactgtgaaagtttccgggaagggaggccatagcgggtctacctttaagtgctgtcacggagaggaatgcagccaaattggcctccatgcagctgccccacacctggacaaagtgaacggtatctccgagattgaaaattcaaaggtctacgatgacggggcgccgcagtgtggaatcaaatgctggttcgtgaagagtggcgagtggataagcggtatcttttctggcaactggattgttctaatcgtgctgtgtgtcttcctcctgttctcccttgtattgctgtcaattttatgccctgtgcggaaacataagaagagttga

SEQ ID NO: 10128 - RNA, 3408 nt, synthetic construct
  misc_feature 1..3408: note = derived and/or modified CDS sequence (opt3) from HTNV(CJilin93)__AY748307.1__GP
  source 1..3408: mol_type = other RNA
atgggcatgtggaagtggctggtgatcgccagcctcgtctggcccgctcttgcactgagaaacgtttacgacatgaaaattgagtgccctcacaccgtgtccttcggggaaaattctgtaataggatatgtggagttgccaccgatgcccttagccgatacagcgcagatggtccctgaatcaagttgtagcatggacaaccatcaatccatcaatactattacgaagtacacccaggtgacatggaggggtaaagctgatccaggccagtcttcgcagaactcatttgagactctgagcgccgaagttgacctaaaggggacctgcgtgctcaaacacaagatggtcgaggagagttatcggtcccgcaagtctatcacatgttacgatctgagctgcaattccacctattgtaaacccactctttacatgattgtgcctatccatgcatgcaacatgatgaagtcatgtctgatagccttgggaccatatcgagtacaagttgtgtacgaacgtacatactgcatgaccggcgtcctcatcgagggtaaatgtttcgtgcccgaccagagtgtggtcagcattatcaagcacgggatttttgatatcgcttctgttcatatagtgtgcttctttgtagcagtgaaaggaaatacgtataagctgttcgaacaggtcaagaaatcctttgagtcaacttgtaacgacaccgagaataaggtgcagggctactatatttgcatcgttggcgggaacagcgcccctatttacgtgccaacactggatgacttcagaagtatggaggcttttactggaatcttcaaatctccgcacggtgaagatcacgacctcgccggcgaagagatcgcgtcctatagcattgtcgggcccgcaaatgccaaggtgcctcattcggcttcttccgataccttatcactgatagcctacagtggaatcccaagctattcctctcttagcattttgacatcaagtaccgacgcaaaacacgtattttcccccggcctgttccctaagctaaaccatacgaattgcgacaaaagcgctatcccactcacttggacaggtatgatagatctgcccgggtactacgaagccattcacccgtgtaccgtgttttgcgttctttctggacctggcgcgtcatgtgaggccttcagtgagggcgggatcttcaacatcactagccccatgtgcctggtctccaagcaaaataggtttcggttgacagaacaacaggtgaacttcgtctgtcagcgcgtggacatggatattgttgtgtattgcaacggacaaagaaaggtaatcctcaccaaaacgctggtcattggtcagtgtatatacaccatcacatctttattttcgctgctcccaggcgtggcacacagcattgctgttgagctttgcgtgcctgggttccatggatgggccactgctgccctgttggtcacctattgttttggctgggtgctaatccccgcaatcacattcattatactgactgtactcaagtttatcgccaatattttccacacctccaaccaggaaaataggctgaaatcagtgcttcggaagatcaaagaggaatttgagaagacaaagggtagtatggtttgcgacgtctgtaaatacgagtgcgaaacctataaggagctgaaagctcatggggtgtcttgcccacaaagccagtgtccctactgcttcactcactgtgaacctacggaggcggcatttcaggcccattataaggtgtgccaggtcacacaccgcttccgagatgacttgaaaaagaccgttactccacaaaactttaccccgggctgttacagaacactcaatctgttcaggtacaagtcccggtgctatattttcaccatgtgggtgtttttactgatcctagaatcagtgctctgggctgccagcgcatctgagactcccctgacacctgtatggaacgataatgcccacggagtcggctccgtgccaatgcatacggaccttgagttggatttcagtctgaccagttcttccaaatacacttatcgtcgcaagctcacaaaccccctggaagaggctcagtcaatagaccttcacatcgaaattgaggagcagaccatcggggttgatgtgcatgccctgggacactggtttgacggtagattgaatattaaaacaagtttccactgttacggcgcatgcactaagtatgaatacccttggcataccgcgaaatgtcactatgagagggactaccagtacgaaacgagctgggggtgcaacccatcggattgtcccggagtcggcaccggttgcacagcttgcgggctctatctggaccaattaaagccggtgggctccgcctacaagatcataactattcggtattctcgacgcgtttgtgtgcagtttggagaggaaaatctgtgcaaaatcattgatatgaacgactgtttcgtaagcagacatgtcaaggtgtgcatcataggcaccgtgtcaaaatttagtcagggggatacactactcttctttggacctctggagggtggcgggcttatcttcaagcactggtgtacttctacctgccagtttggagacccaggcgatattatgtcccccagggacaaaggtttcttgtgtcctgagtttcccgggagcttccggaagaaatgcaatttcgcaacgacaccaatctgtgaatacgatggcaacatggtctccggatataagaaggttatggccaccattgactcatttcagagcttcaatactagcacaatgcattttaccgatgagcgcatcgaatggaaagaccctgatggcatgctgagagaccacataaacattctcgtgactaaggacatcgatttcgacaacctgggggagaatccctgcaaaatcggattacagacctcttccattgaaggcgcttggggtagcggggtaggatttacactgacgtgtcttgtgtcgttgaccgagtgcccaactttcctcacatcaatcaaggcctgcgataaagcaatttgttacggcgctgagtctgtcaccctgacaaggggtcagaacactgtgaaggttagtggcaaagggggacactccggcagcacctttaagtgctgtcatggggaagactgctctaagataggactacacgccgcggccccgcatctggataaagtgaatggcatcagcgagattgaaaactccaaggtctatgacgatggtgctcctcagtgtgggatcaaatgctggttcgtgaagtcaggagagtggattagtggcatctttagcggtaattggatagttctcatcgtgctgtgtgtcttccttttgttttctctggtattactctccattctgtgccccgtgcgtaagcacaaaaagtcatga

SEQ ID NO: 10129 - RNA, 3408 nt, synthetic construct
  misc_feature 1..3408: note = derived and/or modified CDS sequence (opt3) from HTNV(KHF,clone:4)__LC209208.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatggtagaggagtcttatcggagccgcaagtccattacctgttacgatctttcatgcaatagtacttattgtaaaccaacactgtacatgatcgttcccattcatgcgtgcaacatgatgaaaagctgtttgatcgctctcgggccttatcgagtgcaggtcgtgtacgaacgtacctactgcatgacgggagtgctgatagagggcaagtgtttcgtcccagaccagtctgttgtgtccatcattaagcacggtatctttgatattgcctcagtacatatcgtgtgcttctttgtcgcagtgaaagggaatacttataagatattcgaacaggttaagaaaagttttgagagtacctgtaacgacacagagaataaggtgcaaggatactatatttgcatcgtcggcggcaactctgcccccatttacgtgcctactctggatgacttcagatccatggaagcatttaccgggatcttcaggagcccacacggagaggatcacgacctcgctggtgaagagacagccacctattcgatcgtaggcccggctaatgccaaagttccccattctgcgtcctcagatacgttaagtctgattgcatttagcgggataccttcctactctagcctttcaatcttgactagctccacagaagccaagcacgtgttcagcccaggactgtttcccaaactaaaccataccaattgcgacaagggcgctattcctctcatgtggactggtatgatcgacctgccagggtattacgaggccatacacccctgtacagtcttctgcgtgctttctggaccgggcgcatcatgtgaggctttcagtgaaggcgggatttttaacatcaccagccctatgtgcctggtctccaaacagaatcggttccgcttgacgaagcaacaggtgaactttgtttgtcaaagagtggatgtagacatcgtcgtgtactgcaacggacagaggaaggttattctcaccaaaacactggtgatcggtcagtgtatttatactataacctctttattctcgctgctccccggcgtcgcccacagcatcgcggtggagctttgcgtaccagggtttcatggatgggccacagcagctctgttggtgactttctgttttggctgggttctaattcctgccgtcaccttcatcatcctggctattctcaagtttatagccaatatcttccacacatccaaccaagaaaatcggctgaaatcagtgcttcgcaagattaaagaggaatttgagaagaccaagggtagtatggtgtgcgatgtctgtaaatacgagtgcgaaacttataaggagctgaaagcacatggggtttcttgcccccagagccagtgtccatactgcttcacgcactgtgaacccacagaggccgcttttcaggcgcattataaggtgtgccaagtgacccaccgattcagagacgatttgaaaaagactgtaacccctcagaacttcacaccaggctgttacaggaccctcaatctgtttcggtataagtcccgttgctacatcttcactatgtggatctttttactggtcctagaatcaattctctgggcagccagcgcttctgagacaccgctgacgcccgtgtggaacgacaatgcccacggagttggctccatacctatgcataccgatcttgagttggacttcagtctgactagcagttccaaatacacatatcgcagaaagctcaccaacccactggaagaggcacagtcaatcgatcttcacattgaaatcgaggagcagacaattggggtggacgtccatgccctgggacactggtttgatggtaggttgaatctcaaaacttctttccactgttacggcgcttgcaccaagtatgaatacccctggcatacggccaaatgtcactatgagcgggactaccaatatgaaaccagctgggggtgcaacccttcggactgtccaggagtgggcacaggttgcactgcatgcgggctgtacttagatcgactgaagcccgttggctccgcgtacaagatcataaccattcgctattctagaagggtgtgtgtacagtttggagaggaaaatctatgcaaaatcattgacatgaacgattgtttcgtcagccggcatgtgaaggtgtgcatcataggcacagtctcaaaatttagtcagggggacactctcctgttctttggaccgcttgagggtggcgggttgatcttcaagcactggtgtacctccacgtgccagtttggagatcctggcgacattatgtctccacgcgataaaggtttcctgtgtcccgagttccctgggagctttagaaagaaatgcaatttcgctacaacccccatctgtgaatacgacggcaacatggtttccggatataagaaggtgatggccactattgattcatttcagagcttcaatacaagtaccatgcattttactgacgagaggatcgaatggaaagatccagacggcatgctccgtgatcacataaacattctggtaaccaaggacatcgacttcgataacttaggggagaatccttgcaaaatcggactgcagacatcttccattgaaggcgcatggggtagcggggtgggatttacgcttacctgtttggtctcgctcactgagtgccccacattcctgacctcaatcaaggcctgcgacaaagctatttgttacggcgccgagtctgtgacactaactcggggtcagaacaccgttaaggtgagtggcaaagggggacactccggcagcacgtttaagtgctgtcatggggaagattgctctccaaatggactgcacgcagctgccccgcatctcgacaaggtcaacggcataagcgagatcgaaaattccaaagtgtatgatgacggtgcgcctcagtgtgggattaagtgctggttcgttaaatcaggagagtggatcagtggcatttttagcggtaactggatcgtgctgatagtcctttgtgtattcttgctgttctctttagtgctcctgtccatcctttgccccgttcgaaagcacaagaaatcatga

SEQ ID NO: 10130 - RNA, 3408 nt, synthetic construct
  misc_feature 1..3408: note = derived and/or modified CDS sequence (opt3) from HTNV(KHF,clone:5)__LC209209.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatggtagaggagtcttatcggagccgcaagtccattacctgttacgatctttcatgcaatagtacttattgtaaaccaacactgtacatgatcgttcccattcatgcgtgcaacatgatgaaaagctgtttgatcgctctcgggccttatcgagtgcaggtcgtgtacgaacgtacctactgcatgacgggagtgctgatagagggcaaatgtttcgtcccagaccagtctgttgtgtccatcattaagcacggtatctttgatattgcctcagtacatatcgtgtgcttctttgtcgcagtgaaagggaatacttataagatattcgaacaggttaagaaaagttttgagagtacctgtaacgacacagagaataaggtgcaaggatactatatttgcatcgtcggcggcaactctgcccccatttacgtgcctactctggatgacttcagatccatggaagcatttaccgggatcttcaggagcccacacggagaggatcacgacctcgctggtgaagagacagccacctattcgatcgtaggcccggctaatgccaaagttccccattctgcgtcctcagatacgttaagtctgattgcatttagcgggataccttcctactctagcctttcaatcttgactagctccacagaagccaagcacgtgttcagcccaggactgtttcccaaactaaaccataccaattgcgacaagggcgctattcctctcatgtggactggtatgatcgacctgccagggtattacgaggccatacacccctgtacagtcttctgcgtgctttctggaccgggcgcatcatgtgaggctttcagtgaaggcgggatttttaacatcaccagccctatgtgcctggtctccaaacagaatcggttccgcttgacggagcaacaggtgaactttgtttgtcaaagagtggatgtagacatcgtcgtgtactgcaacggacagaggaaggttattctcaccaagacactggtgatcggtcagtgtatttatactataacctctttattctcgctgctccccggcgtcgcccacagcatcgcggtggaactttgcgtaccagggtttcatggatgggccacagcagctctgttggtgactttctgttttggctgggttctaattcctgccgtcaccttcatcatcctggctattctcaaatttatagccaatatcttccacacatccaaccaagagaatcggctgaagtcagtgcttcgcaaaattaaggaagagtttgagaaaaccaagggtagtatggtgtgcgatgtctgtaagtacgaatgcgagacttataaagaactgaaggcacatggggtttcttgcccccagagccagtgtccatactgcttcacgcactgtgagcccacagaagccgcttttcaggcgcattataaagtgtgccaagtgacccaccgattcagagacgatttgaagaaaactgtaacccctcagaacttcacaccaggctgttacaggaccctcaatctgtttcggtataagtcccgttgctacatcttcactatgtggatctttttactggtcctagagtcaattctctgggcagccagcgcttctgagacaccgctgacgcccgtgtggaacgacaatgcccacggagttggctccatacctatgcataccgatcttgaattggacttcagtctgacttctagctccaagtacacatatcgcagaaaactcaccaacccactggaggaagcacagtcaatcgatcttcacattgagatcgaggaacagacaattggggtggacgtccatgccctgggacactggtttgatggtaggttgaatctcaagaccagtttccactgttacggcgcttgcactaaatatgagtacccctggcatacggccaagtgtcactatgaacgggactaccaatatgagaccagctgggggtgcaacccttcggactgtccaggagtgggcacaggttgcactgcatgcgggctgtacttagatcgactgaaacccgttggctccgcgtacaagatcataaccattcgctattctagaagggtgtgtgtacagtttggagaagagaatctatgcaagatcattgacatgaacgattgtttcgtcagccggcatgtgaaagtgtgcatcataggcacagtctcaaagtttagtcagggggacactctcctgttctttggaccgcttgagggtggcgggttgatcttcaaacactggtgtacctccacgtgccagtttggagatcctggcgacattatgtctccacgcgataagggtttcctgtgtcccgagttccctgggagctttagaaagaagtgcaatttcgctacaacccccatctgtgagtacgacggcaacatggtttccggatataaaaaggtgatggccactattgattcatttcagagcttcaatacaagtaccatgcattttactgacgaaaggatcgagtggaaggatccagacggcatgctccgtgatcacataaacattctggtaaccaaagacatcgacttcgataacttaggggaaaatccttgcaagatcggactgcagacatcttccattgagggcgcatggggtagcggggtgggatttacgcttacctgtttggtctcgctcactgagtgccccacattcctgacctcaatcaaagcctgcgacaaggctatttgttacggcgccgaatctgtgacactaactcggggtcagaacaccgttaaagtgagtggcaaagggggacactccggcagcacgtttaagtgctgtcatggggaggattgctctccaaatggactgcacgcagctgccccgcatctcgacaaggtcaacggcataagcgaaatcgaaaattccaaggtgtatgatgacggtgcgcctcagtgtgggattaaatgctggttcgttaagtcaggagaatggatcagtggcatttttagcggtaactggatcgtgctgatagtcctttgtgtattcttgctgttctctttagtgctcctgtccatcctttgccccgttcgaaaacacaagaagtcatga

SEQ ID NO: 10131 - RNA, 3405 nt, synthetic construct
  misc_feature 1..3405: note = derived and/or modified CDS sequence (opt3) from HTNV__D00376.1__GP
  source 1..3405: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatggtagaggagtcttatcggagccgcaagtccattacctgttacgatctttcatgcaatagtacttattgtaaaccaacactgtacatgatcgttcccattcatgcgtgcaacatgatgaaaagctgtttgatcgctctcgggccttatcgagtgcaggtcgtgtacgaacgtacctactgcatgacgggagtgctgatagagggcaagtgtttcgtcccagaccagtctgttgtgtccatcattaagcacggtatctttgatattgcctcagtacatatcgtgtgcttctttgtcgcagtgaaagggaatacttataagatattcgaacaggttaagaaaagttttgagagtacctgtaacgacacagagaataaggtgcaaggatactatatttgcatcgtcggcggcaactctgcccccatttacgtgcctactctggatgacttcagatccatggaagcatttaccgggatcttcaggagcccacacggagaggatcacgacctcgctggtgaagagacagccacctattcgatcgtaggcccggctaatgccaaagttccccattctgcgtcctcagatacgttaagtctgattgcatttagcgggataccttcctactctagcctttcaatcttgactagctccacagaagccaagcacgtgttcagcccaggactgtttcccaaactaaaccataccaattgcgacaagggcgctattcctctcatgtggactggtatgatcgacgtcccacggtattacgatgggatacaccccttcacagtgttctgtgtcctgtctggaccgggcgcctcatgcgaggcatttagtgagggcgggattttcaacatcaccagccctatgtgtcttgtgtccaaacagaatcgctttagactgacggaacagcaggttaacttcgtgtgccaaagggtagacgtcgatatcgtggtttactgtaacggacagcggaaggtgattttgaccaagacactcgtcatcggtcagtgcatttatactataacctctctgttttcgttactgcccggcgtggctcacagcatcgccgtagagctctgtgtgccagggttccatggatgggcgacagccgcacttctggttactttttgcttcggctgggtcttgattcctgctgtgacctttatcatcctagccattctgaaattcatagctaatatctttcacacatccaaccaagaaaatcgcctcaagtcagtgctgcgaaaaattaaggaggagttcgagaaaaccaagggtagtatggtctgtgacgtttgcaagtacgagtgtgaaacttataaagagcttaaggcccatggggtgtcttgcccccagagccagtgcccatactgttttacgcactgcgaacccacagaggcagccttccaggctcattataaagtgtgtcaagtaacccacagattcagggatgacctgaagaaaactgtcacccctcagaactttacaccaggctgctaccggaccttgaatctcttccgttataagtcccgctgttacatctttactatgtggattttcctgttagtgctggaatcaatcctatgggcggcaagcgcctctgagacaccgctcacgcccgtttggaacgataatgctcacggagtgggctccatacctatgcataccgacctggagcttgattttagtttgactagcagttccaagtacacatatagaaggaaactgaccaacccactcgaagcccagtcaatcgacctgcacattgagatcgaggaacagacaattggggtcgatgtgcatgcacttggacactggttcgacggtcggctgaatttgaagacttcttttcactgctacggcgcctgtaccaaatatgagtacccctggcatacggctaagtgccactatgaacgagactaccaatatgagaccagctgggggtgtaacccttcggattgcccaggatgtggcacaggttgcactgcctgcgggctctacctggaccgcttaaaacccgttggctccgcatacaagatcataaccattagatattctaggcgggtgtgtgtacagttcggagaagagaatctgtgcaagatcattgatatgaacgactgttttgtcagccgccatgtgaaagtgtgcatcataggcacagtctcaaagttcagtcagggggatactctactctttttcggaccgctggaaggtggcgggcttatctttaaacactggagaacctccacgtgtcagttcggagaccctggcgatattatgtctccaagggacaagggtttcttgtgccccgagtttcctgggagcttccgtaaaaagtgtaattttgcgacaacccccatctgcgagtacgatggcaacatggtttccggatataaaaaggtgatggctactattgactcattccagagctttaatacaagtaccatgcatttcactgatgaacggatcgagtggaaggacccagatggcatgctgcgagaccacataaacattctcgtaaccaaagacatcgattttgacaacctgggggaaaatccttgtaagatcggattacaaacatcttccattgagggcgcctggggtagcggggtgggattcacgctgacctgccttgtctcgttgactgaatgtcccacatttctcacctcaatcaaagcatgcgataaggccatttgctacggcgctgagtctgtgacactgactagaggtcagaacaccgttaaagtgagtggcaaagggggacactccggcagcacgttcaagtgttgccatggggaggactgttctccaaatggactacacgccgcagctccgcatctggataaggtcaacggcataagcgaaatcgaaaattccaaggaatatgacgatggtgcccctcagtgcgggattaaatgttggtttgtgaagtcaggagagtggatcagtggcattttcagcggtaactggatcgttctcatagtgctgtgcgtcttccttttgttttctctggtattactctccatcctgtgtcccgtgaggaaacacaagaagtcatga

SEQ ID NO: 10132 - RNA, 3417 nt, synthetic construct
  misc_feature 1..3417: note = derived and/or modified CDS sequence (opt3) from LANV(510B)__AF005728.1__GP
  source 1..3417: mol_type = other RNA
atggagggctggctgttcaccatcctcggggtgtgctacattatgacaactgtccttcccaagacgatatatgaactgaaaatggagtgtcctcacaccgttggattgggtcagggctacatcattgggagcgccgaattaggactgatcgacattgctacagtgccagagatcaagctagaatcctcttgcaactttgatctccatactacctcaagtacacaaaaatctttcacccagctggagtggagaaagaaagcagagactacagacaccacgcaggccgcgtccactacctttgaagctcagacaaagactgtaaatataaggggcacctgtatccttgcctctgatctgtatgacacattgaagcgggtgaaaaagaccgtcctctgctacgatctgacgtgtaaccaaactcagtgccagccgacagtgtatctgattacccccgttggtacttgtatgtcgatccgctcatgcatggcaaatctcttaagcaaccgtattcagatcacattcgagaaaacccactgtgtgacggggcaactggtcgaaggacagtgctttaatcctagtcattcccttaccttgtctcagccaccccacacatacgacgtggtaactctgcctaccacatgtttctttactgccaagaaagctgatcagtataagatagttaagaccttcgagggcattatcagcaaaacaggctgcaccgagaactccattcaagggtactacgtgtgctttatcggatcacatagtgaaccactaatcattcccactctcgaggacatacgaagcgcagaactggcctctagaatgcttctgcaccctaggggtgaggatcacgacccattgcagaatgctcaggccgtcctccggatcgtgggcccgattacggcgaaggtgccctcctcaagcagtacagaaaccctgcaagggatcgcattcgccggagtccctatgtattcttcctttagcactttagttcgcaacgctgatccagagtacgtgttctcgcccggcataattcctgagtctaatcagtccgtatgtgacaaaaagaccctgccactcacatggaccggttatcttcccatctcaggggaaatggagaaagtgactggatgcacagtcttttgtacgctggccggcccgggcgcaaactgcgaggcttacagtgaaagcgggatcttcaatatttcctctcctacctgtttggtgaacaaggttcagagattcaggggaagcgaacagaaaatcaattttatgtgccaacggattgataacaatgtggtcgtgtattgtaacggtcagaagaaggtaatactaactaaaacactggttatcggccagtgcatttacaccttcacatcactctttagtctgatgcccgacgtggcccattcccttgcggtcgagctgtgtgtgccagggttgcacggatgggccactatcgcactcctgagcaccttctgctttggctggttactgatccctggtattacgctaatagtcctcaagatcctgaaaattcttacctattcttgttcacattacagtagcgagtccaagttcaaaatgatcttggaaaaggtgaaggttgagtaccagaaaacaatggggtctatggtgtgcgacatttgccaccacgaatgtgagactgtaaaggaactggagtcgcataaacaaagctgcgtcgagggccagtgtccctattgcatgaccgtgacagaagctactcagtccgccctccaggctcacttttcaatctgtaagctgaccggacgcttccatgaggcccttaaaaagagtctgaagaaaccagaagttcaccgaggctgctacagaacgttgggggtgtttaggtatcggtctcgttgttacgtcggactcgtgtggggttgcctgttaacaatagagctggtactatgggcagccagcgctgagactcccctcctggaacctggctggtccgataccgcgcatggggtgggagagcttccattgaagacagacctggaactcgatttctcactgccgagcagctccagttatagctaccgcagaaggttaaccaaccccgcaaataaagaggaatctctgccttttcacttccaaatggagaagcaggttatccacgccgagattcagtcccttggccattggatggacgctacttttaacatcaaaaccgccttccactgttatggtgcatgcaagcagtactcatacccatggcaaacagccaagtgtttctttgaaaaagattatcagtacgagacggggtggggctgcaatcccggagactgccctggcgtcgggaccggatgtactgcttgcggtatttatttggataagctcaaaagtgtgggcaaggcctacaaagtgatcagcctgaagtatacacggaaagtctgtatacagctagggaccgaacaagtttgcaagcatattgacgcaaacgattgtctggtgacaccatcggtgaaggtatgcatcattggaactgtctccaaaatccagccctctgacaccctcctgttccttggcccgttggagcagggtggggtgatactgaagcagtggtgtacgacaagctgcacctttggcgatcctggagacatcatgtcaactaccagtggcatgcgatgtccagaacacacagggtccttccgcaaaatttgcggatttgcgactacccccgtttgtgagtaccaaggcaatacaatctctggttatcagagattaatggctacgaaggacagcttccagtcctttaacctcaccgatcctcacattacttcaagcaaactggagtggatcgaccccgatgggaatacaagggaccatgtgaaccttatactgaatcgggatgtcagtttccaggacttgtctgataacccatgcaaggtggacctccacacccaatccattgatggagcctggggcagcggtgttggctttactctgacatgcgtggtagggctaaccgaatgtccttcgttcatcacgtcaatcaaggcatgcgacctggccatgtgttacggatctactgtcgctaccctcgcccgcggcagtaatacagtgaaagtggtcgggaagggaggccattccggtagctcttttaaatgctgtcacgatagcgactgctcctcagaggggctgatggcaagtgctccccatcttgaaagagttaccggattcaaccagattgatagcgacaaggtgtacgacgatggcgccccaccgtgttcttttaaatgctggttcactaagtccggtgagtggttgctgggcatcttaaatgggaactggattgtaatagcggtgctcgtcatcattctgatcatttcaatcatacttttcagttttctgtgtcctaggcgtagccacaagaaaaatgtgtga

SEQ ID NO: 10133 - RNA, 3402 nt, synthetic construct
  misc_feature 1..3402: note = derived and/or modified CDS sequence (opt3) from LQUV(Longquan-Rs-32)__JX465402.1__GP
  source 1..3402: mol_type = other RNA
atgaagagtatcctgctcattcttctgttggagcaggtaagatccaaagccaccaacgaaataaagttagagtgcccccacgaccaaagggtcgaaacaggcttctctcatgggtttactgatctgtcacctatcctatacacgaaaggactcttcaccaagcacctggagaataactgtccatttgacattagtatcattaatcggcttgttcgcgatgtgcgaatcagcacatggcaggctaaatccactaacaccgacgcaacagtagcctctgcgacctcgttcgaaactaaggatacagacgataagctggctggtgtgtgcggctttttcgacgatataaccaaaccgaagcaggggcagcgtaaagccatcatttgttatgacttgtcatgcaatcaaacgcattgtctccccactctgcacctgatctttcctcagcagttctgccagagcctcaagcaatgtagtattaacgcatacgatcataaaatcttaataaccatttccctgtctttttgcccagagggacttatcattggcggtaattgtatcgtccccgtgttggcccagagccagctgctacacaaccacatgacatataatatcaaggttacttgcttctttgagtactccatggctagagaatcactcgacaacaagttcctggaggaaatgaataggcttgtgctggggcggaactgtgagaaaaccgagtatttgggaggctacgtctgctttctcgcaggctatgggacagccattcatgtgccttacgataatacctacctgagtggagctgtagttaacagcatgaaggccaatttacacggtgaagaccatgaccgcctgaaactcggcgatacgtctgcggtgatagcagggaaccttaagttcgtcatcgactccactgccccagagaaatcatatcagggagaatgcttcacaggccacatgggttacaccagcctgtatttttaccccgtgagaagtaaggggaaatatgtgactattttgacaaagggagtcatccctgttataaacaagaccacgtgtatgccaaaaattgtgccgctagtatggaccggcatggtggagatgaggggcatcgaagagaagctggaggcttgcacaatgcactgtatcatggtcgggaatggagccacttgcgaagcattctctgctaccggtatttttgatatcaaatccacaacttgtcaaattggcaagacccataaataccggcgcacagaggaccagataaccttcacttgccaggatctcaacaaggacatcagcgtgatttgtaatggggaaaacatcacggttcccgtgaagtcgctgatcgtcggacaatgcatttatacaataacctctatcttttccattttccctgccactgcgcactcaatcgccaccgagatgtgtgtgcagggcattcatggttggcttacaatcataatctttttcaccttttgcttcgggtggctgttgattccaatcctcacttgtctgattatcaatacaatagcatacagtttaattacgctggcttactttaaaaacggcgcccgactaggaaatctcatcaagagaatgaaaagcgagttccagaggaccattggcaacactacatgcaatatctgcctgcgggagtgtgagtccgaatctgagtataagagccacgaagaactttgcaaaaacgggtcatgtccctactgcatgaaggatataggagtaagtcaggttttgctgaatgaacattataacgcttgtatgctcatcgaccgttacgagaagcgcctgacccacacacttaatcaaactcctctgtattccagaaaagtgaggaagattcagagctttcggtaccgaaaccgctgcttcatcttgaccgtctggattatcctcctgacggtggagtctttaatatgggcctcaagtgcagaagatattaaaccagcccccaagtggcagaataccgctcacggtatcggcacaatcaaactgaacagcgactatgagctagatttctccgtcgtggcggggtctgaatttactcataagagaatgctccagtcgccggagagcggaaagaaaaacattcctttcaccgtttacctgtccgagcaacttatcacatcaactgtgcagattttgggcaattggatggacgcagaaataaacgtaaagagtgtctttcactgttacggtacctgcaaaaagtattcttacccctggcagagctccccatgtcataaagaggtggacttcgaatttcagtcaagctgggggtgcaatcctatctcttgtcccggcattaactccggatgcacggcctgcggcacatatgttgataagctgaaaaccatcgctaaggcctacaggattatcactgtgaagtatagtcggaaagtctgttaccaaatagggacaaagaaagcatgcaagaccctcgagagcaatgactgtctggtgtctaacggagtaaaaatctgcgccattggtactatctccaccttacagacaggcatgacgctggtgttctttgggccacttaatggaggcgctttgctcattaaggattggtgtatctcaagttgcaagttcggtgaccccggggatataatgcagattagcaacaatatcacctgtccttcgtttgacggcactatgcagcgcgtttgcagattcggactggaaccaatgtgttcctattctggcaacaaaatcagcggggtcaagagggtgctagagacaaaagattcatacctgagtgtgaatctcaccaagccgaaactggtcggatccacacttttgtggaactctctggacagctccattaaggatcacataaatatcgttgtgtcaaacgacattgattttgaggacttagccgaaactccctgcaaggtgaccatcaaaaatctcaagattgagggcgcatggggtagcgggatcggaataaaactgcactgtgaagtaagtctttctgagtgctccgaatacctgacgacaatcaaggtctgcgataacgcgatttgttatggcggtaacgtggctcatttgagccgtggcctcaataccgttatcattaaaggggccggaggccactcggggtcatctttcaagtgctgtcatgagactagctgctccgacatcggatttaaggcagaggcccctcacctggctcggatagtggacgatggcattaccacaagcatgtcttacagcgacggtgccccagaagcagggatcgtctcctggatctataaagtggctgagtggattaagggaatgttcaacggcaattggttcgttctaatcataatgattctgtttctcatcatttcaatcgtgctgcttatattcttgtgtcccgtgaaaaagtacaaatga

SEQ ID NO: 10134 - RNA, 3402 nt, synthetic construct
  misc_feature 1..3402: note = derived and/or modified CDS sequence (opt3) from LQUV(Longquan-Ra-25)__JX465397.1__GP
  source 1..3402: mol_type = other RNA
atgaaaagcatcctgctcattcttctgttgggccaggtgagatccaaagccaccaacgagataaagttagaatgcccccacgaccaaagggtcgagacagggttctctcatggatttactgatctgtcacctatcctatacacgaaaggtctcttcaccaagcacctggaaaataactgtccatttgacattagtatcattaatcggcttgttcgcgatgtgcgaatcagcacatggcaggctaaatccactaacaccgacgcaacagtagcctctgcgacctcgttcgagactaaggatacagacgataagctggctggcgtgtgcgggtttttcgacgatataaccaaaccgaagcagggacagcgtaaagccatcatttgttatgacttgtcatgcaatcaaacgcattgtctccccactctgcacctgatctttcctcagcagttctgccagagcctcaagcaatgtagtattaacgcatacgatcataaaatcttaataaccatttccctgtctttttgcccagaaggccttatcattggtgggaattgtatcgtccccgtgttggcccagagccagctgctacacaaccacatgacatataatatcaaggttacttgcttctttgagtactccatggctagagagtcactcgacaacaagttcctggaagagatgaataggcttgtgctgggacggaactgtgaaaagaccgagtatttgggcggctacgtctgctttctcgcagggtatggaacagccattcatgtgccttacgataatacctacctgagtggtgctgtagttaacagcatgaaggccaatttacacggcgaggaccatgaccgcctgaaactcggggatacgtctgcggtgatagcaggaaaccttaagttcgtcatcgactccactgccccagaaaaatcatatcagggcgagtgcttcacaggtcacatggggtacaccagcctgtatttttaccccgtgagaagtaagggaaaatatgtgactattttgacaaagggcgtcatccctgttataaacaagaccacgtgtatgccaaaaattgtgccgctagtatggaccggcatggtggaaatgagggggatcgaggaaaagctggaggcttgcacaatgcactgtatcatggtcggaaatggtgccacttgcgaggcattctctgctaccggcatttttgatatcaaatccacaacttgtcaaattgggaagacccataaataccggcgcacagaagaccagataaccttcacttgccaggatctcaacaaggacatcagcgtgatttgtaatggagagaacatcacggttcccgtgaagtcgctgatcgtcggccaatgcatttatacaataacctctatcttttccattttccctgccactgcgcactcaatcgccaccgaaatgtgtgtgcagggtattcatgggtggcttacaatcataatctttttcaccttttgcttcggctggctgttgattccaatcctcacttgtctgattatcaatacaatagcatacagtttaattacgctggcttactttaaaaacggagcccgactaggcaatctcatcaagagaatgaaaagcgagttccagaggaccattgggaacactacatgcaatatctgcctgcgggaatgtgagtccgagtctgaatataagagccacgaggaactttgcaaaaacggatcatgtccctactgcatgaaggatataggtgtaagtcaggttttgctgaatgagcattataacgcttgtatgctcatcgaccgttacgaaaagcgcctgacccacacacttaatcaaactcctctgtattccagaaaagtgaggaagattcagagctttcggtaccgaaaccgctgcttcatcttgaccgtctggattatcctcctgacggtggagtctttaatatgggcctcaagtgcagaggatattaaaccagcccccaagtggcagaataccgctcacggcatcgggacaatcaaactgaacagcgactatgaactagatttctccgtcgtggcgggatctgagtttactcataagagaatgctccagtcgccggaaagcggcaagaaaaacattcctttcaccgtttacctgtccgagcaacttatcacatcaactgtgcagattttgggtaattggatggacgcagagataaacgtaaagagtgtctttcactgttacgggacctgcaaaaagtattcttacccctggcagagctccccatgtcataaagaagtggacttcgagtttcagtcaagctggggctgcaatcctatctcttgtcccggaattaactccggctgcacggcctgcgggacatatgttgataagctgaaaaccatcgctaaggcctacaggattatcactgtgaagtatagtcggaaagtctgttaccaaataggaacaaagaaagcatgcaagaccctcgaaagcaatgactgtctggtgtctaacggtgtaaaaatctgcgccattggcactatctccaccttacagacagggatgacgctggtgttctttggaccacttaatggcggtgctttgctcattaaggattggtgtatctcaagttgcaagttcggggaccccggcgatataatgcagattagcaacaatatcacctgtccttcgtttgacggaactatgcagcgcgtttgcagattcggcctggagccaatgtgttcctattctgggaacaaaatcagcggagtcaagagggtgctagaaacaaaagattcatacctgagtgtgaatctcaccaagccgaaactggtcggctccacacttttgtggaactctctggacagctccattaaggatcacataaatatcgttgtgtcaaacgacattgattttgaggacttagccgagactccctgcaaggtgaccatcaaaaatctcaagattgaaggtgcatgggggagcggaatcggcataaaactgcactgtgaggtaagtctttctgaatgctccgagtacctgacgacaatcaaggtctgcgataacgcgatttgttatggtggcaacgtggctcatttgagccgtgggctcaataccgttatcattaaaggagccggcgggcactcgggatcatctttcaagtgctgtcatgaaaccagttgctccgacatcggctttaaggcagaggcccctcacctggctcggatagtggacgatggtattactacaagcatgtcttacagcgacggggccccagaggcaggaatcatctcctggatttataaagtcgctgaatggatcaagggcatgttcaacggtaattggttcgtgctaataattatgatcctgtttctcattatctcaatagttctgcttattttcttgtgtcccgtgaaaaagtacaaatga

SEQ ID NO: 10135 - RNA, 3402 nt, synthetic construct
  misc_feature 1..3402: note = derived and/or modified CDS sequence (opt3) from LQUV(Longquan-Ra-5)__JX465398.1__GP
  source 1..3402: mol_type = other RNA
atgaaaagcatcctgctcattcttctgttgggccaggtgagatccaaagccaccaacgagataaagttagaatgcccccacgaccaaagggtcgagacagggttctctcatggatttactgatctgtcacctatcctatacacgaaaggtctcttcaccaagcacctggaaaataactgtccatttgacattagtatcattaatcggcttgttcgcgatgtgcgaatcagcacatggcaggctaaatccactaacaccgacgcaacagtagcctctgcgacctcgttcgagactaaggatacagacgataagctggctggcgtgtgcgggtttttcgacgatataaccaaaccgaagcagggacagcgtaaagccatcatttgttatgacttgtcatgcaatcaaacgcattgtctccccactctgcacctgatctttcctcagcagttctgccagagcctcaagcaatgtagtattaacgcatacgatcataaaatcttaataaccatttccctgtctttttgcccagaaggccttatcattggtgggaattgtatcgtccccgtgttggcccagagccagctgctacacaaccacatgacatataatatcaaggttacttgcttctttgagtactccatggctagagagtcactcgacaacaagttcctggaagagatgaataggcttgtgctgggacggaactgtgaaaagaccgagtatttgggcggctacgtctgctttctcgcagggtatggaacagccattcatgtgccttacgataatacctacctgagtggtgctgtagttaacagcatgaaggccaatttacacggcgaggaccatgaccgcctgaaactcggggatacgtctgcggtgatagcaggaaaccttaagttcgtcatcgactccactgccccagaaaaatcatatcagggcgagtgcttcacaggtcacatggggtacaccagcctgtatttttaccccgtgagaagtaagggaaaatatgtgactattttgacaaagggcgtcatccctgttataaacaagaccacgtgtatgccaaaaattgtgccgctagtatggaccggcatggtggaaatgagggggatcgaggaaaagctggaggcttgcacaatgcactgtatcatggtcggaaatggtgccacttgcgaggcattctctgctaccggcatttttgatatcaaatccacaacttgtcaaattgggaagacccataaataccggcgcacagaagaccagataaccttcacttgccaggatctcaacaaggacatcggagtgatttgtaatggcgagaacatcacggttcccgtaaagagcctgatcgtcggtcaatgcatttatacaataacctcgatcttttctattttccctgccactgcgcactccatcgccaccgaaatgtgtgtgcaggggattcatggctggcttacaatcataatctttttcaccttttgcttcggatggctgttgattccaatcctcacttgtctgattatcaatacaatagcatactcattaattacgctggcttactttaaaaacggcgcccgactagggaatctcatcaagagaatgaaaagtgagttccagaggaccattggaaacactacatgcaatatctgcctgcgggaatgtgagagcgagtccgaatataagtctcacgaggaactttgcaaaaacggtagctgtccctactgcatgaaggatataggcgtatcacaggttttgctgaatgagcattataacgcttgtatgctcatcgaccgttacgaaaagcgcctgacccacacacttaatcaaactcctctgtatagtagaaaagtgaggaagattcagtcctttcggtaccgaaaccgctgcttcatcttgaccgtctggattacgctcctgaccgtggagagcttaatctgggcctcttcagcagaggatataaaaccagcccccaagtggcagaatacagctcacgggattggaactatcaaactgaacagtgactatgaactagatttcagcgtcgtggcgggctccgagtttacccataagagaatgctccagtctccggaatcgggtaagaaaaacatccctttcacagtttacctgagcgagcaacttattacttccaccgtgcagatcttggggaattggatggacgcagagattaacgtaaagtcagtctttcactgttacggcacgtgcaaaaagtatagttacccctggcagtctagcccatgtcataaagaagtggacttcgagtttcagtcctcatggggatgcaatcctataagctgtcccggcatcaactctgggtgcacagcctgcggaacctatgttgataagctgaaaactattgctaaggcctacaggatcattacagtgaagtattcccggaaagtctgttaccaaatcggtaccaagaaagcatgcaagactctcgaaagtaatgactgtctggtgagcaacggcgtaaaaatatgcgccatcgggaccatttctacattacagacgggaatgaccctggtgttctttggcccacttaatggtggggctttgctcatcaaggattggtgtatttcctcatgcaagttcggcgaccccggagatatcatgcagataagtaacaatattacttgtcctagctttgacggcacaatgcagcgcgtttgcagattcgggctggagccaatgtgttcgtattccggaaacaaaatctctggcgtcaagagggtgctagaaaccaaagatagctacctgtcagtgaatctcacaaagccgaaactggtcggtagtactcttttgtggaactccctggactctagcatcaaggatcacattaatatagttgtgtccaacgacatcgattttgaggacttagccgagaccccctgcaaggtgacgattaaaaatctcaagatcgaaggggcatggggatcaggcattggtatcaaactgcactgtgaggtaagccttagtgaatgctctgagtacctgacaaccataaaggtctgcgataacgcgatctgttatggcgggaacgtggctcatttgtcccgtggactcaatactgttattatcaaaggcgccgggggacacagcggctcgtcattcaagtgctgtcatgaaacctcttgcagtgacattggttttaaggcagaggcccctcacctggctcggatcgtggacgatgggataacaacttccatgagctactctgacggagccccagaggcaggcattgtcagctggatctataaagtggctgaatggatcaagggtatgttcaacggcaattggttcgttctaattatcatgatactgtttctcattatctccattgtgctgcttatcttcttgtgtcccgtgaaaaagtacaaatga

SEQ ID NO: 10136 - RNA, 3402 nt, synthetic construct
  misc_feature 1..3402: note = derived and/or modified CDS sequence (opt3) from LQUV(Longquan-Ra-56)__JX465399.1__GP
  source 1..3402: mol_type = other RNA
atgaaaagcatcctgctcattcttctgttgggccaggtgagatccaaagccaccaacgagataaagttagaatgcccccacgaccaaagggtcgagacagggttctctcatggatttactgatctgtcacctatcctatacacgaaaggtctcttcaccaagcacctggaaaataactgtccatttgacattagtatcattaatcggcttgttcgcgatgtgcgaatcagcacatggcaggctaaatccactaacaccgacgcaacagtagcctctgcgacctcgttcgagactaaggatacagacgataagctggctggcgtgtgcgggtttttcgacgatataaccaaaccgaagcagggacagcgtaaagccatcatttgttatgacttgtcatgcaatcaaacgcattgtctccccactctgcacctgatctttcctcagcagttctgccagagcctcaagcaatgtagtattaacgcatacgatcataaaatcttaataaccatttccctgtctttttgcccagaaggccttatcattggtgggaattgtatcgtccccgtgttggcccagagccagctgctacacaaccacatgacatataatatcaaggttacttgcttctttgagtactccatggctagagagtcactcgacaacaagttcctggaagagatgaataggcttgtgctgggacggaactgtgaaaagaccgagtatttgggcggctacgtctgctttctcgcagggtatggaacagccattcatgtgccttacgataatacctacctgagtggtgctgtagttaacagcatgaaggccaatttacacggcgaggaccatgaccgcctgaaactcggggatacgtctgcggtgatagcaggaaaccttaagttcgtcatcgactccactgccccagaaaaatcatatcagggcgagtgcttcacaggtcacatggggtacaccagcctgtatttttaccccgtgagaagtaagggaaaatatgtgactattttgacaaagggcgtcatccctgttataaacaagaccacgtgtatgccaaaaattgtgccgctagtatggaccggcatggtggaaatgagggggatcgaggaaaagctggaggcttgcacaatgcactgtatcatggtcggaaatggtgccacttgcgaggcattctctgctaccggcatttttgatatcaaatccacaacttgtcaaattgggaagacccataaataccggcgcacagaagaccagataaccttcacttgccaggatctcaacaaggacatcagcgtgatttgtaatggagagaacatcacggttcccgtgaagtcgctgatcgtcggccaatgcatttatacaatatcttccatcttttcaattttccctgccaccgcgcacagtatcgccactgaaatgtgtgtgcagagcattcatggttggcttaccatcataatctttttcacattttgcttcgggtggctgttgattccaatcctcacctgtctgattatcaatactatagcatactccttaattacactggcttactttaaaaacggcgcccgactaggaaatctcatcaagagaatgaaatctgagttccagaggacgattggcaacaccacttgcaatatctgcctgcgggaatgtgagagcgagtcagaatataagagtcacgaggaactttgcaaaaacgggtcctgtccctactgcatgaaggatataggagtaagccaggttttgctgaatgagcattataacgcttgtatgctcatcgaccgttacgaaaagcgcctgacacacacccttaatcaaacacctctgtattctagaaaagtgaggaagattcagtcatttcggtaccgaaaccgctgcttcatcttgactgtctggattatcctcctgaccgtggagagtttaatatgggccagctccgcagaggatattaaaccagcccccaagtggcagaatacggctcacggtatcggcaccatcaaactgaactctgactatgaactagatttctcggtcgtggcggggagcgagtttacacataagagaatgctccagtccccggaatcaggaaagaaaaacattcctttcactgtttacctgagtgagcaacttatcacctctacagtgcagattttgggcaattggatggacgcagagataaacgtaaagagcgtctttcactgttacggtacttgcaaaaagtattcctacccctggcagtcaagcccatgtcataaagaagtggacttcgagtttcagtcttcctgggggtgcaatcctatcagttgtcccggcattaacagcggatgcaccgcctgcggcacgtatgttgataagctgaaaacaatcgctaaggcctacaggattatcaccgtgaagtattctcggaaagtctgttaccaaatagggactaagaaagcatgcaagacactcgaatccaatgactgtctggtgtcaaacggagtaaaaatctgcgccattggtaccatcagtactttacagaccggcatgacactggtgttctttgggccacttaatggaggcgctttgctcattaaggattggtgtatcagctcgtgcaagttcggtgaccccggggatataatgcagatttccaacaatatcacgtgtccttcttttgacggcaccatgcagcgcgtttgcagattcggactggagccaatgtgtagctattcaggcaacaaaatcagtggggtcaagagggtgctagaaactaaagattcctacctgtctgtgaatctcacaaagccgaaactggtcggaagcacccttttgtggaactccctggactcaagcattaaggatcacataaatatcgttgtgagtaacgacattgattttgaggacttagccgagacaccctgcaaggtgactatcaaaaatctcaagattgaaggcgcatggggttctgggatcggaataaaactgcactgtgaggtatcccttagcgaatgctcgaagtacctgaccacgatcaaagtctgcgataacgcgatttgttatggcggtaacgtggctcatttgtcacgtggcctcaatacagttatcattaagggggccggaggccactctgggagttccttcaagtgctgtcatgagaccagctgctctgacatcggatttaaagcagaagcccctcacctggctcggatagtggacgatggcattactaccagcatgtcctactcagacggtgccccagaggcagggatcgtcagttggatctataaggtggctgagtggattaaaggaatgttcaacggcaattggttcgttctaatcataatgattctgtttctcatcattagcatcgtgctgcttatattcttgtgtcccgtaaagaaatacaagtga

SEQ ID NO: 10137 - RNA, 3402 nt, synthetic construct
  misc_feature 1..3402: note = derived and/or modified CDS sequence (opt3) from LQUV(Longquan-Ra-90)__JX465400.1__GP
  source 1..3402: mol_type = other RNA
atgaaaagcatcctgctcattcttctgttgggccaggtaagatccaaagccaccaacgagataaagttagaatgcccccacgaccaaagggtcgagacagggttctctcatggatttactgatctgtcacctatcctatacacgaaaggtctcttcaccaagcacctggaaaataactgtccatttgacattagtatcattaatcggcttgttcgcgatgtgcgaatcagcacatggcaggctaaatccactaacaccgacgcaacagtagcctctgcgacctcgttcgagactaaggatacagacgataagctggctggcgtgtgcgggtttttcgacgatataaccaaaccgaagcagggacagcgtaaagccatcatttgttatgacttgtcatgcaatcaaacgcattgtctccccactctgcacctgatctttcctcagcagttctgccagagcctcaagcaatgtagtattaacgcatacgatcataaaatcttaataaccatttccctgtctttttgcccagaaggccttatcattggtgggaattgtatcgtccccgtgttggcccagagccagctgctacacaaccacatgacatataatatcaaggttacttgcttctttgagtactccatggctagagagtcactcgacaacaagttcctggaagagatgaataggcttgtgctgggacggaactgtgaaaagaccgagtatttgggcggctacgtctgctttctcgcagggtatggaacagccattcatgtgccttacgataatacctacctgagtggtgctgtagttaacagcatgaaggccaatttacacggcgaggaccatgaccgcctgaaactcggggatacgtctgcggtgatagcaggaaaccttaagttcgtcatcgactccactgccccagaaaaatcatatcagggcgagtgcttcacaggtcacatggggtacaccagcctgtatttttaccccgtgagaagtaagggaaaatatgtgactattttgacaaagggcgtcatccctgttataaacaagaccacgtgtatgccaaaaattgtgccgctagtatggaccggcatggtggaaatgagggggatcgaggaaaagctggaggcttgcacaatgcactgtatcatggtcggaaatggtgccacttgcgaggcattctctgctaccggcatttttgatatcaaatccacaacttgtcaaattgggaagacccataaataccggcgcacagaagaccagataaccttcacttgccaggatctcaacaaggacatcagcgtgatttgtaatggagagaacatcacggttcccgtgaagtcgctgatcgtcggccaatgcatttatacaataacctctatcttttccattttccctgccactgcgcactcaatcgccaccgaaatgtgtgtgcagggtattcatgggtggcttacaatcataatctttttcaccttttgcttcggctggctgttgattccaatcctcacttgtctgattatcaatacaatagcatacagtttaattacgctggcttactttaaaaacggagcccgactaggcaatctcatcaagagaatgaaaagcgagttccagaggaccattgggaacactacatgcaatatctgcctgcgggaatgtgagtccgagtctgaatataagagccacgaggaactttgcaaaaacggatcatgtccctactgcatgaaggatataggtgtaagtcaggttttgctgaatgagcattataacgcttgtatgctcatcgaccgttacgaaaagcgcctgacccacacacttaatcaaactcctctgtattccagaaaagtgaggaagattcagagctttcggtaccgaaaccgctgcttcatcttgaccgtctggattatcctcctgacggtggagtctttaatatgggcctcaagtgcagaggatattaaaccagcccccaagtggcagaataccgctcacggcatcgggacaatcaaactgaacagcgactatgaactagatttctccgtcgtggcgggatctgagtttactcataagagaatgctccagtcgccggaaagcggcaagaaaaacattcctttcaccgtttacctgtccgagcaacttatcacatcaactgtgcagattttgggtaattggatggacgcagagataaacgtaaagagtgtctttcactgttacgggacctgcaaaaagtattcttacccctggcagagctccccatgtcataaagaagtggacttcgagtttcagtcaagctggggctgcaatcctatctcttgtcccggaattaactccggctgcacggcctgcgggacatatgttgataagctgaaaaccatcgctaaggcctacaggattatcactgtgaagtatagtcggaaagtctgttaccaaataggaacaaagaaagcatgcaagaccctcgaaagcaatgactgtctggtgtctaacggtgtaaaaatctgcgccattggcactatctccaccttacagacagggatgacgctggtgttctttggaccacttaatggcggtgctttgctcattaaggattggtgtatctcaagttgcaagttcggggaccccggcgatataatgcagattagcaacaatatcacctgtccttcgtttgacggaactatgcagcgcgtttgcagattcggcctggagccaatgtgttcctattctgggaacaaaatcagcggagtcaagagggtgctagaaacaaaagattcatacctgagtgtgaatctcaccaagccgaaactggtcggctccacacttttgtggaactctctggacagctccattaaggatcacataaatatcgttgtgtcaaacgacattgattttgaggacttagccgagactccctgcaaggtgaccatcaaaaatctcaagattgaaggtgcatgggggagcggaatcggcataaaactgcactgtgaggtaagtctttctgaatgctccgagtacctgacgacaatcaaggtctgcgataacgcgatttgttatggtggcaacgtggctcatttgagccgtgggctcaataccgttatcattaaaggagccggcgggcactcgggatcatctttcaagtgctgtcatgaaaccagttgctccgacatcggctttaaggcagaggcccctcacctggctcggatagtggacgatggtattactacaagcatgtcttacagcgacggggccccagaggcaggaatcgtctcctggatctataaagtggctgaatggattaagggcatgttcaacggtaattggttcgttctaatcataatgattctgtttctcatcatttcaatcgtgctgcttatattcttgtgtcccgtgaaaaagtacaaatga

SEQ ID NO: 10138 - RNA, 3423 nt, synthetic construct
  misc_feature 1..3423: note = derived and/or modified CDS sequence (opt3) from NYV(Rhode Island-1 (RI-1))__U36801.1__GP
  source 1..3423: mol_type = other RNA
atggtgggctgggtctgcatcttcctggttgtgctcgccaccacaactgctgggcttacgagaaacctgtacgagttgaagattgaatgtccccacaccgtaggattaggtcagggctatgtgacagggagcgtcgagactacccctatactgctaacacaagtgaccgacctcaaaatcgaatcctcttgcaattttgatctgcatgttccatcaacaagtattcagaagtacaaccaggtggagtgggccaaaaagagctccactaccgaatctacgtcggcaggagcgactaccttcgaggctaaaacaaaggaggtctcacttaagggcacttgtaatatcccggtgaccacatttgaagccgcatataaaagcaggaagaccgtaatttgctacgacctggcctgtaaccagacgtattgcttgcccactgttcacctcatcgctcctgtgcaaacatgtatgagtgtccggtcctgcatgataggtctgctgtctagccgcatccaggtgatttacgagaaaacctattgtgtgactgggcagctcgtcgaaggattatgcttcatcccaacacataccattgcactgacgcagcccggccacacctacgatacaatgactcttcctatcacctgtttcttggttgccaagaaactgggcacacaactaaagatagctgtggagctcgagaagctgattactgcctccgggtgcaccgaaaattcatttcagggatactatatctgctttcttggtaaacatagtgagccactgagcgtacccatgatggacgattaccgatctgcggaattgttcacacgtatggtgctcaaccctagaggcgaggaccacgatccagaccagaatgggcagggactgatgaggattgcaggcccgatcaccgccaaggtcccctccactgaaacgacagagaccatgcaaggtatcgcttttgccggggcacctacttattccagcttcagtaccttagtgcggaaagctgatccagactacgtgttttctcccggaattatagccgagtccaaccacagcgtttgtgataagaaagcgatccctctgacatggaccggcttcctcgccgtctcgggcgaaattgagaagatcactgggtgcacagtgttttgtacgcttgtaggaccaggtgcatcttgcaaggcttattccgaaaccggcatattcaatatttcaagtcccacttgtctggttaacaaagtgcagaagttccgcgggagcgagcagagaatcaattttatgtgccaaagggtcgaccaggatgtgatcgtctactgtaacggacagaaaaaggtgattttgacaaaaaccctaatcattggccagtgcatatatacattcacttccctgttttctctcatcccgggtgttgcccatagcctggctgtggaactttgtgtacctgggctgcacggctgggccaccgcagccttgctcattacgttctgctttggatggctgttaatccccaccatcacaatgattatactgaagatcctacggctcctgactttctcatgtagtcattactccaccgagagcaaatttaaggctattcttgagcgcgtcaaggtggaataccagaaaacaatgggctctatggtttgcgacgcgtgccaccacgagtgtgaaactgcaaaggagttggaaacccataaaaagtcatgcccagaggggcaatgtccttattgcatgacgatgacagagagtaccgaaagcgccctgctcgctcacttctccatctgtaaactgactaatcgatttcaggagaaccttaagaagtctctgaaaagacccgaagtgaagcagggaaggtaccggacattgggtgtcttccgttataaatcgcgctgctacgtgggcctcgtatggggagtgctgttaaccactgagctgattgtttgggccgcaagcgccgacaccccactaatggagtccgggtggtcagatacagctcatggcgtcggtatcgtgcccatgaagacggacctcgaactggattttgcccttgcaagttctagctcctattcatacagaaggaaattggtgaatcctgcgaacaaggaggaaaccctgccattccactttcaactcgacaagcaggtcgttcatgctgagatacagaacctggggcactggatggatggcactttcaatatcaaaacagccttccactgttatggagaatgcaagaaatacgcatacccgtggcagaccgccaagtgctttttcgagaaagactatcaatacgagacaagctggggctgtaatccccctgattgtccaggggtgggaactggttgcaccgcttgcggcgtgtatttagacaagctgcggtctgggggaaaagcctacaagattgtatcccttaagtttacgcgaaaagtctgtatccagttgggcacagaacagacctgcaagcatattgatgtgaacgactgtctcgttactcccagtgtgaaagtctgcctgatcggtaccataagcaagctacagcctggggatacactcctgttcctgggcccacttgagcaaggaggcattatcttgaaacagtggtgtactacctcttgcgtgtttggggaccccggagacattatgtccacaacgaccggcatgaagtgtccggaacacactggttcattccgcaagatctgcgggtttgcaacaacccctacttgtgagtatcagggaaacacaataagtggcttccaaagaatgatggctaccagggatagctttcagtcgttcaatgttacggaaccacatatcacttccaaccggctggagtggattgaccccgattctagcatcaaagaccacattaatatggtgttaaaccgcgatgtatcatttcaggacctcagtgataatccttgcaaggtcgacctgcacacccagtccatcgatggtgcctggggctctggggtgggattcacacttgtgtgtaccgtcggcctgactgagtgcgcgaactttataacaagcattaaagcctgcgactccgctatgtgttacggggcaaccgttacaaatttgctcagaggatcaaacactgtgaaggtagtgggcaaaggtgggcatagcagttctctgttcaagtgctgtcacgataccgactgcacggaagagggactagccgcttcacccccacatctggatagggtcacaggctataatcaaatcgacagcgacaaggtgtacgatgacggtgcccctccctgtaccatcaaatgctggttcactaagtcgggcgaatggctcctggggattcttaacggaaattgggttgtggtcgcagtgttgatcgttattctgatattatcaatcctcctgttttctttcttttgtccaattcgtggccggaaaaacaagagtaactga

SEQ ID NO: 10139 - RNA, 3423 nt, synthetic construct
  misc_feature 1..3423: note = derived and/or modified CDS sequence (opt3) from NYV(New York-1 (NY-1))__U36802.1__GP
  source 1..3423: mol_type = other RNA
atggtgggctgggtctgcatcagcctggttgtgctcgccaccacaactgctgggcttacgagaaacctgtacgagttgaagattgaatgtccccacaccgtaggattaggtcagggctatgtgacagggtccgtcgagactacccctatactgctaacacaagtgaccgacctcaaaatcgaatcttcatgcaatttcgatctgcatgttccaagtactagcattcagaagtacaaccaggtggagtgggcaaagaagtcctctacaaccgaatcgacgtcagccggagcgactacctttgaggctaaaacaaaggaggtcagccttaagggcacttgtaatatcccggtgaccacattcgaagccgcatataaaagtaggaagaccgtaatttgctacgacctggcctgtaaccagacgcactgcttgcccactgttcatctcatcgctcctgtgcaaacatgtatgtccgtccggtcttgcatgataggtctgctgagctcccgcatccaggtgatttatgagaaaacctactgtgtgactgggcagctcgtcgaaggattatgctttatcccaacacacaccattgcactgacgcagcccggccatacctatgatacaatgactcttcctatcacctgtttcttggttgccaagaaactgggcacacaactaaagatagctgtggagctcgagaagctgattactgcctcagggtgcaccgaaaatagttttcagggatactacatctgcttccttggtaaacacagcgagccactgtttgtacccatgatggacgattatcgatctgcggaattgttcacacgtatggtgctcaaccctagaggcgaggaccacgatccagaccagaatgggcagggactgatgaggattgcaggcccgatcaccgccaaggtcccctccactgaaacgacagagaccatgcaaggtatcgcttttgccggggcacctatgtactcatctttcagtactttagtgcggaaagctgatccagactatgtttttagccccggaattatagccgagtccaaccatagcgtgtgtgataagaaaaccatccctctgacatggaccggcttcctcgcggtctcgggcgaaattgagaagatcactgggtgcacagtgttttgtacgcttgtaggaccaggtgcctcttgcgaagcatactccgagaccggcatattcaatatttcaagtcccacttgtctggttaacaaagtgcagaagttccgcgggagcgaacagagaatcaattttatgtgccaaagggtcgaccaggatgtgatcgtctattgtaacggacagaagaaagtgattttgacaaagaccctagttatcggccagtgcatttacacattcacttccctgttttctctcataccgggtgtggctcacagcctggccgtagagctttgtgtccctgggctgcatggctgggctaccacggccttgctcatcaccttctgctttggatggctgttaattcccacaatcactatgatcattctgaaaatactacggctcctgaccttctcatgtagtcactattccacagagagcaagtttaaagcaatccttgaacgcgtgaaggttgagtaccaaaagactatgggctctatggtgtgcgacgtctgccaccatgaatgtgagaccgccaaagaattggagacgcacaagaaatcatgcccagaggggcagtgtccttactgcatgacaatgaccgaaagtactgagagcgctctgcaggcgcatttctccatttgtaagctcacaaatcgatttcaggaaaacctgaaaaagtctcttaagagacccgaggtgaaacaaggatgctataggaccctgggtgtattccggtacaagtcgcgttgttatgtgggcttggtttggggagtcctcctgactaccgagttaatcgtgtgggcagccagcgctgacacaccactgatggaatccgggtggtcagatacggcccacggcgtgggtattgtccccatgaaaaccgacctagagctcgattttgcactggccagttctagctcctactcatatcgcagaaaacttgttaatcctgctaacaaagaagagactttgccattccattttcagctggacaaacaggtggtgcacgccgaaatccagaacctcgggcactggatggatggcacattcaatataaagaccgcattccattgctacggagagtgtaagaagtatgcgtacccgtggcaaacagctaaatgctttttcgagaaggactaccagtatgaaactagctggggctgtaatccccctgattgcccaggggtaggaaccggttgcacggcctgtggcgtctacctggacaaattaaggtctgtggggaaggcatataaaatcgtttccctgaagtttacacggaaggtgtgcattcagcttggaaccgagcagacttgtaaacacatcgatgtcaacgactgcttggtgacccccagtgttaaggtgtgtctcattggcacaatcagcaaactgcaacctggtgatactctactgttcctcgggccactggaacagggcggaataattcttaagcagtggtgcaccacatcttgtgtatttggcgaccccggggacatcatgtccacgaccactggaatgaaatgcccggagcatacaggctcattccgaaagatttgtggttttgccaccactcctacatgcgaataccaagggaacaccatcagtggattccagcgcatgatggctacgagagatagctttcagtcgttcaatgtcactgagccacacataacctccaacaggttggagtggatcgaccccgattctagcattaaggaccacatcaatatggtgctgaaccgggatgtgtcatttcaggacttaagtgataatccttgtaaagtcgacctccatacacaatccattgatggcgcctggggttctggcgttgggttcaccctggtgtgcactgtaggacttacagaatgcgcaaactttatcaccagcataaaggcttgtgactccgccatgtgctatggcgcgacagtgactaatctgttgcgcgggtcaaacaccgtcaaagtggttggaaagggcggtcacagcgggagtctcttcaaatgttgccatgatacggactgtacagaggaaggactggccgcttctcccccacacctagatagagtgaccggctacaatcagattgactccgacaaggtctatgatgacggtgcacctccctgcactatcaagtgttggttcaccaaaagcggcgagtggctgctcgggatcctgaacggaaattgggtggttgtggccgtccttattgtaatcttgattctgtcgatattactcttttcattcttttgcccaatcaggggccgtaagaacaaatctaactga

SEQ ID NO: 10140 - RNA, 3423 nt, synthetic construct
  misc_feature 1..3423: note = derived and/or modified CDS sequence (opt3) from NYV(New York-2 (NY-2))__U36803.1__GP
  source 1..3423: mol_type = other RNA
atggtgggcttcgtctgcatctttctggttgtgctcgccaccacaactgctgggcttacgagaaacctgtacgagttgaagattgaatgtccccacaccgtaggattaggtcagggctatgtgacagggagcgtcggaactacccctatactgctaacacaagtgaccgacctcaaaatcgagtcctcttgcaatttcgatctgcatgttccatcaactagcattcagaagtacaaccaggtggaatgggccaaaaagagctccacaaccgagtctacgtcggcaggcgcgactacctttgaagctaaaacaaaggaggtctcacttaagggtacttgtaatatcccggtgaccacattcgaggccgcatataaaagcaggaagaccgtaatttgctacgacctggcctgtaaccagacgcactgcttgcccactgttcatctcatcgctcctgtgcaaacatgtatgagtgtccggtcctgcatgatagggctgctgtctagccgcatccaggtgatttatgagaaaacctactgtgtgactggacagctcgtcgagggcttatgctttatcccaacacacaccattgcactgacgcagcccggccatacctatgatacaatgactcttcctatcacctgtttcttggttgccaagaaactggggacacaactaaagatagctgtggaactcgagaagctgattactgccggaggttgcaccgaaaattcctttcagggctactacatctgcttccttgggaaacactcagaaccactgtttgtacccatgatggacgattatcgaagtgcggagttgttcacacgtatggtgctcaaccctagaggagaagaccacgatccagaccagaatggccagggtctgatgaggattgcagggccgatcaccgccaaggtccccagcactgagacgacagaagctatgcaaggaatcgcctttgcaggcgctcctatgtactcttccttctcaaccttagtgcggaaagccgatccagactatgtttttagccccggcattatagcggagagtaaccattctgtgtgtgataagaaaactatccctctgacctggacagggttcctcgccgtctccggagagattgaaaagatcaccggttgcactgtgttctgtacacttgtaggcccaggggcaagctgcgaggcttactcggaaacgggaatatttaatatttcttcccccacctgtctggttaacaaagtgcagaagttccgcggctcagagcagagaatcaattttatgtgccaaagggtcgaccaggatgtgatcgtctattgtaacggtcagaagaaagtgattttgactaagacacttgttatcgggcagtgcatttacaccttcacaagtctgtttagcctcataccgggcgtggcccactccctggctgtagaactttgtgtccctggactgcatggctgggccactaccgcattgctcatcacgttctgctttgggtggctgttaattcccaccatcacaatgatcattctgaaaatactacggctcctgactttctcttgtagccactattcaaccgagagtaagtttaaagccatccttgagcgcgtgaaggttgaataccaaaagacaatgggatccatggtgtgcgacgtctgccaccatgagtgtgaaactgctaaagagttggaaacccacaagaaaagctgcccagagggtcagtgtccttactgcatgacgatgacagagtctaccgaatcagcgctgcaggcacatttcagtatttgtaagctcactaatcgatttcaggagaacctgaaaaagagccttaagagacccgaagtgaaacaaggctgctataggacactgggggtattccggtacaagtcccgttgttatgtgggattggtttggggcgtcctcctgaccactgagttaatcgtgtgggccgcttctgccgacaccccactgatggagtcgggttggagcgatacagcacacggggtgggcattgtccccatgaaaacggacctagaactcgattttgccctggcttcctcaagttcttacagctatcgcagaaagctagttgaccctgccaataaagaggaaaccttgccattccatttccagctggataaacaggtggtgcacgcagagatccagaacctcggacactggatggacggcacttttaacataaagacagcgttccattgctacggggaatgtaagaagtatgcttacccgtggcaaaccgccaaatgctttttcgagaaggattaccagtatgagacatcctggggatgtaatccccctgactgcccaggtgtaggcactgggtgcaccgcatgtggagtctacctggataaattaaggtcagtgggcaaggcctataaaatcgttagcctgaagtttacgcggaaggtgtgcattcagcttggtacagaacagacctgtaaacacatcgacgtcaacgattgcttggtgactccctctgttaaggtgtgtctcattgggaccatctccaaactgcaacctggcgacacactactgttcctcggaccactggagcagggcgggataattcttaagcagtggtgcactaccagttgtgtatttggagaccccggcgatatcatgagcacaacgaccggtatgaaatgcccggaacatactgggtctttccgaaagatttgtggatttgctacaacccctacttgcgagtaccaaggcaatacaatctccggtttccagcgcatgatggccaccagagactcatttcagagtttcaacgtcacggaaccacacataactagcaataggttggagtggatcgatcccgactcgtccattaaggatcacatcaacatggtgctgaatcgggacgtgtcttttcaggatttaagcgacaacccttgtaaagtcgatctccatacccaatcaattgacggcgcatgggggagtggagttggcttcacactggtgtgcaccgtagggcttactgagtgcgctaatttcatcacatccataaaggcctgtgattctgcgatgtgctatggagccaccgtgacaaacctgttgcgcggcagcaatactgtcaaagtggttggtaaagggggacactccggctcactctttaagtgttgccatgacaccgattgtacggaagagggtctggctgcaagtcccccacacctagacagagtgacaggctacaaccagattgacagtgataaggtctatgacgatggggcccctccctgcaccatcaagtgttggttcactaaatctggagaatggctgctcggcatcctgaatgggaactgggtggttgtggctgtccttattgtaatcttgattctgtccatattactctttagcttcttttgcccaatcaggggacgtaagaataaatcgaactga

SEQ ID NO: 10141 - RNA, 3447 nt, synthetic construct
  misc_feature 1..3447: note = derived and/or modified CDS sequence (opt3) from PUUV(K27)__L08754.1__GP
  source 1..3447: mol_type = other RNA
atgggcgagctgagccccgtgtgcctctaccttctgttgcaggggttactgctatgtaacaccggagccgctagaaatctcaacgaactgaagatggagtgccctcacacaatcaggcttggtcaaggcctggtcgttgggtccgtggaattgccatctctcccgattcagcaggtagagactctgaaactggaatcaagttgtaatttcgacctccatacgagcaccgcaggacagcaatcctttacaaagtggacttgggagataaaaggcgatttagccgagaacacccaggcgtcttcgacatcattccagaccaagagcagtgaagtgaatctgcggggtctttgcttgatccccactctggtcgtggagacagctgcccgcatgcgaaaaaccattgcatgttatgacctatcctgcaaccagacggtttgtcaacctactgtgtacctcatggggccaatccagacctgcattacaactaagtcttgtctgcttagcctgggagatcagcgtatccaggtcaattatgaaaagacctactgcgtgtccggccaattggtagagggcatatgttttaaccccatccacacaatggccctctcacagcctagtcatacctatgacattatgacgatgatggttagatgcttcctggtgatcaaaaaggtcactagcggggattctatgaaaattgagaagaattttgaaacattagtgcagaaaaacggatgcaccgctaataacttccaaggttactatatctgtctgataggctcctcaagcgagccactctacgtgcccgcacttgacgattacaggagtgccgaagtcctgtctcggatggcttttgcccctcacggggaggaccatgatattgaaaagaatgcggtttccgcaatgcgcatcgccggaaaggtgactggcaaagctccaagcacagagtcgtctgacaccgtacagggtattgccttctccgggtcaccgttgtatacgagtaccggagtgctaacaagcaaggatgaccccgtctacatctgggcacctggcatcattatggagggcaaccactccatatgcgagaaaaagactctgccactcacctggacagggtttatctctctgcccggagaaattgagaaaactacccagtgtacagtgttctgcacccttgctggtcctggcgccgattgtgaagcgtatagcgaaactgggatctttaatatatcaagtccaacgtgctccattaacagagttcagaggttccggggaagcgagcaacagatcaagtttgtgtgtcagcgcgtcgacatggacatcacagtgtactgcaacggcatgaaaaaggtaattctgaccaagactttggttatcggtcagtgtatttataccttcacatctatattctcactcatccccggggtggcccacagtctggcagtcgagttatgcgtgccgggcctgcatggatgggctaccatgctactcctgcttactttgtgttttggctgggtcctgattcctacaatcacgatgatcctcctgaaaattcttatagccttcgcttacctgtgcagcaagtataataccgattccaaatttcgaatcttgattgaaaaggtgaaaagagagtaccaaaagactatggggtctatggtttgcgaagtgtgtcagtacgagtgcgaaacagccaaggagctcgagtcgcacaggaaaagctgttccatcggatcatgcccctattgtctgaacccaagtgaagcaaccacatctgccttacaggctcatttcaaggtatgcaaactgactagccggtttcaggagaatctacgtaagtccctcaccgtctacgaacctatgcaaggttgttatcgcacgctgtcacttttcagatacaggagccggtttttcgtgggcttggtttggtgcgtgctgctcgtcctggagttaattgtgtgggcggcatctgccgagacccagaacctgaatgctgggtggacagacactgcccacggatccggcatcatacccatgaaaaccgatcttgaattggactttagtctcccaagctctgcatcctatacataccgacgccagctgcagaaccccgccaatgagcaagaaaagatccctttccacctacagctgtcaaagcaggtaattcatgctgagatccaacacctcggtcattggatggatgccacttttaacctgaaaaccgcattccactgttatgggagttgcgaaaagtacgcgtacccatggcagacggctggctgttttattgagaaagactatgagtacgaaacaggatggggctgcaatccgcccgattgccctggggtgggaaccggttgtactgcctgcggcgtttatcttgacaagttgaaaagcgtcgggaaggtgttcaagatcgtgtcgctgagatacacaaggaaagtctgtatacagttaggaaccgagcagacttgcaagaccgttgattccaacgactgtctcattacaacgtctgtgaaagtgtgcctgatcggcaccattagcaagttccaaccatcagatactcttctgtttttgggtcccctccagcaagggggcctgatcttcaaacagtggtgtacaaccacatgccagtttggagaccctggcgacataatgagtactccaaccgggatgaagtgtcccgaactaaatggatccttccggaaaaagtgcgcatttgccacgacaccggtatgtcagttcgatggcaacaccatctctggttataagcgcatgattgctactaaagacagctttcagtccttcaatgtcaccgagcctcatatctcaacaagcgccctggaatggattgatccagacagttctctcagagatcacatcaacgtgatagtttccagggacctgagctttcaggatctttcggagactccctgccaaattgacttggcaaccgcttcaatcgatggggcctggggatctggcgtgggtttcaatctggtctgcacagtgagtttaacggagtgttccgcgtttctcaccagcatcaaggcctgcgacgctgcaatgtgttacggctctactacagccaacctggttcgtgggcagaacaccattcacatcgtgggaaaaggcgggcatagcggatccaagttcatgtgctgtcacgatactaaatgctcaagtacaggccttgtagctgccgcacctcatctggaccgggtcaccggttataatcaggcggatagcgacaagatttttgacgatggggcccccgaatgtggaatgtcttgctggttcaagaaatccggcgagtggatactaggtgtgctcaacggcaattggatggtggtcgctgttctggtggtattgctgatcttatcaattctcctgttcacgctttgttgcccacgaagacctagttacaggaaggaacacaaaccctga

SEQ ID NO: 10142 - RNA, 3447 nt, synthetic construct
  misc_feature 1..3447: note = derived and/or modified CDS sequence (opt3) from PUUV(13891)__U22418.1__GP
  source 1..3447: mol_type = other RNA
atgggcaagatcattcccgtgtgcctgtacctccttttcctgtgtttgttactgtggaacagaggggacgccaggaatctaaacgagctcaaaatggaatgccctcacaccataggactgggtcagggccttgtcatcgggagcgttgagctgccaccggtgcccttgacacaagtagaatccctcaagctggagtcttcatgtaattttgatctgcatacgagtactagctcccagcagtctttcaccaaatggacatgggaaattaagaacgacctcgctgagaatactcaggcatcgtcaaccagctttcaaacaaaaagttccgagatcaacttacggggactgtgccttattcctccattggtgatcgaaaccgccgcgcgcactcgaaagacaatagcttgtttcgatctgtcttgcaatcagaccgcctgtcagcccacggtctttctaatcggccctattcagacttgcatcaccacaaagagctgtctcctgggtcttggggaccaacgtattcaggtgaactatgagaaaacttactgcgtttccggacagctggtggaaggcgtctgtttcaatccagtgcacaccatggcattgtcacagcccagtcatacatatgatatcgtaaccgttatggtgagatgctttctcatagtcaagaaagtgagcacgggcgactctatgaagctggagaaatccttcgagactttagtgcaaaagacagggtgcaccggaaacggttttcagggctactatgtctgtctggttgggtcaagcagtgaacctctctacattccaactcttgatgactataggtctgccgagatcctgtcccggatggctttcgcaccgcacggagaagatcatgacgtggagaagaatgccattagcgctatgcgcatcgtaggcaaagtgacaggtaaggccccctcgaccgaatcttccgatacgatccaggggattgcgttttcaggaaaccctttgtacaccagtacaggcgtcctaactgcaaaagacgatccagtgtacatatgggcccccggcatcattatggaggggaatcacagcgtttgcgacaagaaaaccctgcctctcacatggactggattcatcccactgcccggtgagatagaaaagaccacacaatgtaccgtgttttgcactcttgctggcccgggggccgactgtgaggcatattccgaaacgggaattttcaacatctctagccctacatgcctgatcaatagagtccagaggttccggggcgctgagcagcagattaaatttatctgtcaacgcgtggatatggacattaccgtatactgcaacggtttgaagaaggttatactcactaaaaccctggtgatcgggcagtgtatttatacattcacctcaatctttagtttaatccccggcgtcgcccactccctggcggtggaactatgcgtcccaggactccatggctgggccactatgctgcttttgctgacattctgttttgggtggattctcatacctttctttagcatgatcctgcttaagattctgatcgcattcgcttacttgtgctctaaatataacacggattcaaagtttaaaattctcatcgagaaggtgaagcgagagtaccagaaaaccatgggaagtatggtttgcgaagtgtgtcagtatgagtgcgaaactgccaaggagctggaaagccacagaaaatcctgtcccataggttcttgcccatactgtttaaatcccgctgaggccacaacctcggcactgcaagcccatttcaaggtatgcaaactaacaagcaggtttcaggacaacctccggaagtccctgggcgcttacgagcctaagcaggggtgttatcgtactctttcattgttccgctacagaagtaggtttttcgtcggattcaattggtgcctgctcctggtgttagaactgatcgtttgggcggcatctgccgagacccagagccttaactccggctggacggataccgctcacggttcagggattatcccaatgcggacagacttggaactcgattttagcctgccgtcttccgccagttatacttaccgacgccaactacagaatcccgcaaacgagcaggagaaaattcctttccatctgcagatcagcaagcaagtgatacacgccgaaattcagcacctcggccattggatggacggaacctttaatctgaaaacagctttccactgttatggctcttgcgagaagtacgcctatccatggcagactgcagggtgttttatcgaaaaagattacgagtacgaatccggatggggttgcaatccccctgactgcccaggcgtcgggaccggatgtacggcgtgcggcgtgtatcttgataagttgaagtcagtaggtaaagccttcaagattgtgagtctgagatacacaaggaaagcctgtatccaattagggaccgagcagacttgcaagagcgttgactcgaacgactgtctcgtcacaacctccgtgaaagtgtgcctgataggcactgtctctaagtttcagcccagcgatacccttctgttcttgggaccgctcgagcagggcgggctgatctttaaacaatggtgtacaacgacctgccagttcggagaccctggcgatattatgtcaactccagttggtatgaagtgtcccgaactaagtgggtcctttcggaagaaatgcgcattcgccacaacccctgtgtgtcagtttgacggaaacacactgtctggctataagcgcatgatcgctactaaagatagcttccagtccttcaatgtgaccgagccccatatttcagccagcagtctcgaatggatcgacccagattcttccctgagagaccacataaacgtaattgtcggtagggatcttagctttcaagacttgtcggagacgccttgccaggtggatctggcaacaacctcaatcgacggcgcttgggggtctggagttggcttcaatttagtgtgcagtgtctccctcactgaatgtagcacctttctgacatctatcaaggcctgcgatagcgcgatgtgttacgggtccactaccgccaaccttctgcgtggacagaatacagtgcacattgttggcaaaggtgggcattcaggaagtaagttcatgtgctgtcacgacacgaagtgcagctctaccggcctagtggctgcagctccccatctcgaccgggtaactggttataaccaggctgattccgacaaaatctttgatgacggcgccccagagtgtgggatttcatgctggttcacaaagagtggagagtggatactgggcgtcttgaacgggaattggatggtggtggcagtcctgatcgcgttatttattttcagcatctttctcttcaccctgtgttgcccgcgaagaccttcctacgccaaagaacacaagccctga

SEQ ID NO: 10143 - RNA, 3447 nt, synthetic construct
  misc_feature 1..3447: note = derived and/or modified CDS sequence (opt3) from PUUV(CG17/Baskiria-2001)__AF442614.1__GP
  source 1..3447: mol_type = other RNA
atgggcgagctgagccccgtgtgcctctaccttctgttgcaggggttactgctatgtaacaccggagccgctagaaatctcaacgaactgaagatggagtgccctcacacaatcggtcttggccaagggctggtcgttggatccgtggaattgccatctctcccgattcagcaggtagagactctgaaactggaatcaagttgtaatttcgacctccatacgagcaccgcaggccagcaatcctttacaaagtggacttgggagataaaaggtgatttagccgagaacacccaggcgtcttcgacatcattccagaccaagagcagtgaagtgaatctgagggggctttgcttgatccccactctggtcgtggagacagctgcccggatgcgcaaaaccattgcatgttatgacctatcctgcaaccagacggtttgtcaacctactgtgtacctcatgggaccaatccagacctgcattacaactaagtcttgtctgcttagcctgggcgatcagcgaatccaggtcaattatgaaaagacctactgcgtgtccggccaattggtagaggggatatgttttaaccccatccacacaatggccctctcacagcctagtcatacctatgacattatgacgatgatggttcgttgcttcctggtgatcaaaaaggtcactagcggagattctatgaaaattgagaagaattttgaaacattagtgcagaaaaacggttgcaccgctaataacttccaaggctactatatctgtctgatagggtcctcaagcgagccactctacgtgcccgcacttgacgattacagaagtgccgaagtcctgtctaggatggcttttgcccctcacggagaggaccatgatattgaaaagaatgcggtttccgcaatgcggatcgccggcaaggtgactggtaaagctccaagcacagagtcgtctgacaccgtacaggggattgccttctccggatcaccgttgtatacgagtaccggcgtgctaacaagcaaggatgaccccgtctacatctgggcacctggcatcattatggaggggaaccactccatatgcgagaaaaagactctgccactcacctggacaggatttatctctctgcccggtgaaattgagaaaactacccagtgtacagtgttctgcacccttgctggccctggggccgattgtgaagcgtatagcgaaactggaatctttaatatatcaagtccaacgtgcctgattaaccgcgttcagagattcaggggcgccgagcaacagatcaagtttgtgtgtcagcgggtcgacatggacatcacagtgtactgcaacggtatgaaaaaggtaattttgaccaagactctcgttatcgggcagtgtatttataccttcacatccatattcagcctgatccccggcgtggcacactctttagctgtcgagctgtgcgtgccgggactacatggctgggccaccatgctcctgcttttgactttttgtttcgggtgggtcctgattcctacaatcacgatgatcctcctgaaaattcttatagcttttgcctacctgtgctcaaagtataataccgatagtaaattccgcatcttgattgaaaaggtgaaacgagagtaccaaaagactatgggaagcatggtttgcgaagtgtgtcagtacgagtgcgaaacagcaaaggagctcgagtcccacagaaaatcttgttcgatcggtagctgcccctattgtctgaacccatccgaagccaccacatcagctttacaggcgcattttaaggtatgcaaactgaccagtaggttccaggagaatctacggaagtctctcactgtctacgaacctatgcaaggctgttatcgtacgctgagcctttttcgctacagatccaggttctttgtggggttggtttggtgcgtgctgctcgtcctggagttaattgtgtgggcagcctcagctgagacccagaacctgaatgccggatggacagacactgcacacggcagcggtatcatacccatgaaaaccgatcttgaattggacttctctctcccatccagtgccagctatacataccggcgacagctgcagaaccccgctaatgagcaagaaaagatcccttttcacctacagctgtctaagcaggtaattcatgccgagatccaacacctcgggcattggatggatgcaactttcaacctgaaaaccgcgtttcactgttatggctcctgcgaaaagtacgcttacccatggcagacggccggatgtttcattgagaaagactatgagtacgaaacaggctgggggtgcaatccgcccgattgccctggagtgggtaccggctgtactgcatgcggggtttatcttgacaagttgaaatcagtcggaaaggtgttcaagatcgtgagtctgcgctacacaagaaaagtctgtatacagttaggcaccgagcagacttgcaagaccgttgatagcaacgactgtctcattacaacgtcggtgaaagtgtgcctgatcggtaccatttccaagtttcaaccatctgatactcttctgttcttggggcccctccagcagggcggactgatctttaaacagtggtgtacaaccacatgccaattcggcgaccctggggacataatgagcactccaaccggaatgaagtgtcccgaactaaatggctcatttaggaaaaagtgcgccttcgctacgacaccggtatgtcagtttgatggtaacaccatcagtgggtataagcggatgattgccactaaagactccttccagtcttttaatgtcaccgagcctcatatcagcacatccgcactggaatggattgatccagactcaagcctccgcgatcacatcaacgtgatagttagtagagacctgtctttccaggatctttccgagactccctgccaaattgacttggctaccgccagcatcgatggagcgtggggctcgggtgtgggctttaatctggtctgcacagtgtcattaacggagtgttctgccttcctcaccagtatcaaggcttgcgacgcagccatgtgttacgggtccactacagctaacctggttaggggacagaacaccattcacatcgtgggcaaagggggacatagcggctctaagtttatgtgctgtcacgatactaaatgcagctccacaggtcttgtagccgcagcgcctcatctggaccacgtcaccgggtataatcaggccgattcagacaagattttcgacgatggagctcccgaatgtggcatgagttgctggttcaagaaaagcggtgagtggatactaggcgtgctcaacgggaattggatggtggtcgccgttctggtggtattgctgatcttatctattctcctgtttacgctttgttgcccacgtcggccttcctaccgaaaggaacacaaaccctga

SEQ ID NO: 10144 - RNA, 3447 nt, synthetic construct
  misc_feature 1..3447: note = derived and/or modified CDS sequence (opt3) from PUUV(CG215/Omsk)__AF442615.1__GP
  source 1..3447: mol_type = other RNA
atgggcaagctgagccccgtgtgcctctaccttctgttgcagtgtttactgctaggggacagaggagatgccaggaacctcaatgagctgaaaatggaatgccctcacaccatcggtcttggccaagggctggtcgttggatccgtggagttgccaccggtacccattcaacaggtggaatctctcaagctggagtcaagttgtaacttcgacctgcatacaagcactgctggccagcagtcctttacgaaatggacctgggaaataaagaatgatctcgcagagaacacacaggcctcttcgacttcattccagaccaaaagcagtgaggtcaatttacggggtctgtgccttatccctacattggtggttgaaaccgcggctcgcactcgaaagacaattgcctgttatgacctgacctgcaaccagacggtgtgtcaaccaactgtctacctaatggggcccatccagacctgcgtgacaactaagtcctgtctcctgggacttggcgatcagcgtattcaggtaaattatgagaaaacctactgcgtttctggccaactggtggaaggggtctgttttaaccctatccacacaatggcattgagccagccatcccatacctatgacgtgatgacgctcatggtgagatgcttcctgataatcaagaaagtcacttcaggagatagtatgaagattgagaaaaattttgagacattagttcagaagaccggttgcactggcaacaatttccaagggtactatatctgtctgattggaagttcttccgaacccctctacgtgcctacacttgacgattacaggtcagccgaggtactgagccggatggcttttgcaccacacggcgaagaccatgatatcgagaagaacgccgtgagtaccatgcgcatagctggtaaagtcacggggagagccccgtctaccgaagcgtccgacacagtgcagggaattgcattcagcggctcgcccttgtatacttctaccggcgttctaacagccaaggatgaccctgtgtacatctgggctccagggattatcatggagggaaatcactcctcatgcgacaaaaagactctgcccctcacctggacaggttttatcagtctgcctggcgagattgaaaagaccactcagtgtacggtcttctgcacacttgccgggccaggagcagattgtgaggcttatagcgaaaccggcatatttaacatctcctctcccacttgcctgattaatagggtgcagcggttccgcggtgccgagcaacagatcaagtttgtatgtcagcgagttgacatggatataattgtgtactgcaacgggatcaaaaaggtcatcttgaccaagacactcgtgattggccagtgtatctataccttcactagcattttctcactgataccgggagtcgcgcacagtttagccgtggaactgtgcgttcctggcctacatgggtggacaacgatgctcctgcttttgaccttttgtttcggatgggtgctgatcccctttattactatgatcctcctgaaaatccttattgcattcgcttacctgtgctccaagtataacacagacagcaaatttagaatattggtagagaaggtcaaaaaggagtaccaaaagaccatgggttctatggtgtgcgaagtttgtcagtacgagtgcgaaacagccaaagagctcgaatcacacaggaagagttgtagcatcggctcctgcccatattgtctgaatccttctgaggctactacctcggccttacaggcacatttcaaagtgtgcaagctgacgagccggtttcaggagaacctacgtaaatccctcaccgtctacgaacccatgcaagggtgttatcgcacactgtcacttttcagatacaggagtaagtttttcgtgggattggtatggtgcctgctcctggtgatggagttaattgtttgggccgcttctgcggaaactcagaatctgaacagcggctggaccgatacagcacacggttccgggatcattccaatgaagactgaccttgagttggatttttcactccccagctctgcctcctatacctaccggcgacagctgcagaatcctgctaacgagcaagagaaaatcccattccacctacagataagtaagcaggtcatccatgccgaaattcaacacctgggccattggatggacgcaacgtttaatctcaaaacagccttccactgttatggaagctgcgaaaagtacgcttacccgtggcagaccgccggctgtttcatcgagaaagattatgaatacgagactgggtggggatgcaatccccctgactgcccaggtgtgggcacagggtgtaccgcatgcggagtgtatctggataaacttaagtctgtcggcaaagtttttaagattgtgtccttgaaatacactcgcaaggtgtgtatccagctgggtaccgagcagacatgcaaaacggtagactcaaacgactgtttaataaccactagcgtcaaggtgtgcatgattgggacaatcagcaaattccaaccctcggataccctcctgtttcttggccctctgcagcagggaggcttgattttcaagcagtggtgtacaactacctgccaatttggggacccaggagatatcatgtccacgcccacaggcatgaagtgtccggaactcaacggttctttcaggaaaaagtgcgcgtttgctaccactcctgtttgtcagttcgacgggaataccataagcggatataaaagaatgatcgccacaaaggattcatttcagagtttcaacgtgactgagccacatatttccgcatctgccctggaatggatcgaccccgatagctccctacgggaccacattaatgtcgtggttggccgcgatctgtcatttcaggacctcagcgagaccccttgccaagtggatctgatgacaagtacgatcgacggtgcttggggctctggggtaggattcaaccttgtctgcaccgtgtccttgactgaatgtagcccctttctgacatcgataaaagcctgcgattcagcaatgtgttacggctctaccactgtgaatttagtcagagggcagaacacagttcacattgtgggaaagggcggtcatagtgggtccaagttcatgtgctgtcacgacaccaaatgcagctctacgggactcgtagctgccgcgccacatctggacagggtgactggctataaccaggccgatagcgacaagatcttcgatgacggtgctcctgagtgtggcatgtcctgctggtttaaaaagtcaggggagtggatccttggagtcctgaatggcaactggatggtggttgcagtgctaattgccctcctgatcttgagtattctgatgttcaccttatgttgcccccgtcggccaagctaccgaaaagaacacaagccgtga

SEQ ID NO: 10145 - RNA, 3447 nt, synthetic construct
  misc_feature 1..3447: note = derived and/or modified CDS sequence (opt3) from PUUV(CG222/Omsk)__AF442616.1__GP
  source 1..3447: mol_type = other RNA
atgggcaagctgagccccgtgtgcctctaccttctgttgcagtgtttactgctaggggacagaggagatgccaggaacctcaatgagctgaaaatggaatgccctcacaccatcggtcttggccaagggctggtcgttggatccgtggagttgccaccggtacccattcaacaggtggaatctctcaagctggagtcaagttgtaacttcgacctgcatacaagcactgctggccagcagtcctttacgaaatggacctgggaaataaagaatgatctcgcagagaacacacaggcctcttcgacttcattccagaccaaaagcagtgaggtcaatttacggggtctgtgccttatccctacattggtggttgaaaccgcggctcgcactcgaaagacaattgcctgttatgacctgacctgcaaccagacggtgtgtcaaccaactgtctacctaatggggcccatccagacctgcgtgacaactaagtcctgtctcctgggacttggcgatcagcgtattcaggtaaattatgagaaaacctactgcgtttctggccaactggtggaaggggtctgttttaaccctatccacacaatggcattgagccagccatcccatacctatgacgtgatgacgctcatggtgagatgcttcctgataatcaagaaagtcacttcaggagatagtatgaagattgagaaaaattttgagacattagttcagaagaccggttgcactggcaacaatttccaagggtactatatctgtctgattggaagttcttccgaacccctctacgtgcctacacttgacgattacaggtcagccgaggtactgagccggatggcttttgcaccacacggcgaagaccatgatatcgagaagaacgccgtgagtaccatgcgcatagctggtaaagtcacggggagagccccgtctaccgaagcgtccgacacagtgcagggaattgcattcagcggctcgcccttgtatacttctaccggcgttctaacagccaaggatgaccctgtgtacatctgggctccagggattatcatggagggaaatcactcctcatgcgacaaaaagactctgcccctcacctggacaggttttatcagtctgcctggcgagattgaaaagaccactcagtgtacggtcttctgcacacttgccgggccaagggcagattgtgaggcttatagcgaaaccggaatatttaacatctcctctcccacttgcctgattaatcgggtgcagcgcttccgaggcgccgagcaacagatcaagtttgtatgtcagagagttgacatggatataattgtgtactgcaacggtatcaaaaaggtcatcttgaccaagacactcgtgattgggcagtgtatctataccttcactagcattttctcactgataccgggcgtcgcgcacagtttagccgtggaactgtgcgttcctggactacatggctggacaacgatgctcctgcttttgaccttttgtttcgggtgggtgctgatcccctttattactatgatcctcctgaaaatccttattgcattcgcttacctgtgctccaagtataacacagacagcaaatttaggatattggtagagaaggtcaaaaaggagtaccaaaagaccatgggatctatggtgtgcgaagtttgtcagtacgagtgcgaaacagccaaagagctcgaatcacaccggaagagttgtagcatcggttcctgcccatattgtctgaatccttctgaggctactacctcggccttacaggcacatttcaaagtgtgcaagctgacgagccgttttcaggagaacctacgcaaatccctcaccgtctacgaacccatgcaaggctgttatagaacactgtcacttttcaggtaccggagtaagtttttcgtggggttggtatggtgcctgctcctggtgatggagttaattgtttgggccgcttctgcggaaactcagaatctgaacagcggatggaccgatacagcacacggctccggtatcattccaatgaagactgaccttgagttggatttttcactccccagctctgcctcctatacctaccgacgccagctgcagaatcctgctaacgagcaagagaaaatcccattccacctacagataagtaagcaggtcatccatgccgaaattcaacacctggggcattggatggacgcaacgtttaatctcaaaacagccttccactgttatggcagctgcgaaaagtacgcttacccgtggcagaccgccggatgtttcatcgagaaagattatgaatacgagactggctgggggtgcaatccccctgactgcccaggagtgggtacaggctgtaccgcatgcggggtgtatctggataaacttaagtctgtcggaaaagtttttaagattgtgtccttgaaatacactagaaaggtgtgtatccagctgggcaccgagcagacatgcaaaacggtagactcaaacgactgtttaataaccactagcgtcaaggtgtgcatgattggtacaatcagcaaattccaaccctcggataccctcctgtttcttgggcctctgcagcagggcggattgattttcaagcagtggtgtacaactacctgccaatttggcgacccaggggatatcatgtccacgcccacaggaatgaagtgtccggaactcaacggctctttcaggaaaaagtgcgcgtttgctaccactcctgtttgtcagttcgacggtaataccataagcgggtataaacggatgatcgccacaaaggattcatttcagagtttcaacgtgactgagccacatatttccgcatctgccctggaatggatcgaccccgatagctccctacgcgaccacattaatgtcgtggttggaagagatctgtcatttcaggacctcagcgagaccccttgccaagtggatctgatgacaagtacgatcgacggcgcttggggttctggcgtagggttcaaccttgtctgcaccgtgtccttgactgaatgtagcgcctttctgacatcgataaaagcatgcgattcagctatgtgttacggatctaccactgtgaatttagtcaggggccagaacacagttcacattgtggggaagggaggccatagtggttccaagttcatgtgctgtcacgacaccaaatgcagctctacggggctcgtagccgcggctcccccactggaccgtgtgactggatataaccaggccgatagcgacaagatcttcgatgacggcgcacctgagtgtggtatgtcctgctggtttaaaaagtcaggcgagtggatccttggggtcctgaatggaaactggatggtggttgccgtgctaattgctctcctgatcttgagtattctgatgttcaccttatgttgcccccggcgaccaagctacagaaaagaacataagccgtga

SEQ ID NO: 10146 - RNA, 3447 nt, synthetic construct
  misc_feature 1..3447: note = derived and/or modified CDS sequence (opt3) from PUUV(CRF161)__AF367061.1__GP
  source 1..3447: mol_type = other RNA
atgggcaagctgagccccgtgtgcctctaccttctgttgcagtgtttactgctaggggacagaggagatgccaggaacctcaatgagctgaaaatggaatgccctcacaccatcggtcttggccaagggctggtcgttggatccgtggagttgccaccggtacccattcaacaggtggaatctctcaagctggagtcaagttgtaacttcgacctgcatacaagcactgctggccagcaatcctttacgaaatggacctgggaaataaagaatgatctcgtcgagaacacacaggcatcttcgacttcattccagaccaaaagcagtgaggtgaatttacggggtctgtgccttatccctacattggttgtggaaaccgccgcgcgcactcgaaagacaattgcttgttatgacctgacctgcaaccagacggtctgtcaaccaactgtgtacctaatggggcccatccagacctgcattacaactaagtcctgtctcctgggacttggcgatcagcgtatccaggtaaattatgagaaaacctactgcgtttctggccaactggtggaaggggtctgttttaaccctatacacacaatggccttgagccagccatcccatacctatgacgtgatgacgctcatggtgagatgcttcctgatcattaagaaagtcacttcaggagatagtatgaagatcgagaaaaattttgagacattagttcagaagaccggttgcactggcaacaatttccaagggtactatatttgtctgatcggatctagctccgaacccctctacgtgcctacacttgacgattacaggtcagcagaggtactgagccggatggcctttgctccacacggcgaagaccatgatatagagaagaacgcagtgagtaccatgcgcattgccggtaaagtcgctgggagagccccgtctacggaagcgtccgacaccgtgcagggaatcgcattcagcggctcgcccttgtatacatctactggcgttctaaccgccaaggatgaccctgtgtacatttgggctccagggatcatcatggagggaaatcactcctcatgcgacaaaaagacactgcccctcacttggaccggttttattagtctgcctggcgagatacagaaaacaacccagtgtactgtcttctgcacgcttgccgggccaagggcagattgtcaggcttatagcgaaacaggaatctttaacatttcctctccgacctgcctgatcaatcgggtgcagcgcttccgaggcgccgagcagcagataaagtttgtatgtcaaagagttgacatggatattatcgtgtactgcaacggtatcaaaaaggtcattttgactaagaccctcgtgatcgggcagtgtatttatacattcaccagcatattctcactgatccccggcgtcgcgcacagtttagccgtggaactgtgcgttcctggactacatggctggactacaatgctcctgcttttgacgttttgtttcgggtgggtgctgattccctttatcaccatgatcctcctgaaaattcttatagcattcgcttacctgtgctccaagtataacactgacagcaaatttaggatcttggtagagaaggtcaaaaaggaataccagaagacaatgggatctatggtgtgcgaggtttgtcagtacgagtgcgaaaccgccaaagagctcgaatcacaccggaagagttgtagcattggttcctgcccatattgtctgaatccttctgaggctacaacttcggccttacaagcacatttcaaagtgtgcaagctgaccagccgttttcaggaaaacctacgcaaatccctcacggtctacgagcccatgcagggctgttatagaaccctgtcacttttcaggtaccggagtaagtttttcgtggggttggtatggtgcctgctcctggtgatggagttaatcgtttgggccgcttctgcggaaacacagaatctgaacagcggatggactgataccgcacacggctccggtattatcccaatgaagacagaccttgagttggatttttcactccccagctctgcctcctatacttaccgacgccaactgcagaatcctgctaacgaacaggagaaaataccattccacctacaaatcagtaagcaggtcattcatgccgagatccagcacctggggcattggatggacgcaacctttaatctcaaaacggccttccactgttatggcagctgcgaaaagtacgcttacccgtggcagacagccggatgtttcattgagaaagattatgaatacgagaccggctgggggtgcaatccccctgactgcccaggagtgggtactggctgtacagcatgcggggtgtatctggataaacttaagtctgtcggaaaggtttttaagatcgtgtccttgaaatacaccagaaaggtgtgtatacaactgggcactgaacagacctgcaaaacagtagactcaaacgactgtttaattacgaccagtgtcaaggtgtgcatgatcggtactattagcaaattccagccctcggatacactcctgatccttgggcctctgcagcaaggcggattgatatttaagcagtggtgtaccacaacttgccagttcggcgacccaggggatatcatgtccacccccacgggaatgaagtgtccggagctcaacggctcttttaggaaaaagtgcgcgttcgctacaacccctgtttgtcagtttgacggtaatactattagcgggtataaacggatgatcgccaccaaggattcattccaaagttttaacgtgacagagccacatatttccgcatctgccctggaatggatcgaccccgatagctccctacgcgaccacataaatgtcgtggttggaagagatctgtcattccaggacctcagcgagactccttgccaggtggatctgatgaccagtacaattgacggcgcttggggttctggcgtagggtttaaccttgtctgcacggtgtccttgaccgaatgtagcgccttcctgacttcgatcaaagcatgcgattcagctatgtgttacggatctacaaccgccaatttagtgaagggccaaaacactgtccacatggttgggaagggaggccatagtggttccaaatttatgtgctgtcacgacacaaagtgcagctctaccgggctcgtggcggccgctccccatctggacagggtaacgggatataaccaggcagatagcgacaaaatcttcgatgacggcgccccagagtgtggtatgtcctgctggttcaagaaatcaggcgaatggattcttggggtgctgaatggaaactggatggtcgtggctgttctaatcgccctcctgattttgagtatactgatgtttactttatgttgccctcgtcggcccagctaccgaaaggagcacaagccatga

SEQ ID NO: 10147 - RNA, 3447 nt, synthetic construct
  misc_feature 1..3447: note = derived and/or modified CDS sequence (opt3) from PUUV(CRF308/Omsk)__AF442617.1__GP
  source 1..3447: mol_type = other RNA
atgggcaagctgagccccgtgtgcctctaccttctgttgcagtgtttactgctaggggacagaggagatgccaggaacctcaatgagctgaaaatggaatgccctcacaccatcggtcttggccaagggctggtcgttggatccgtggagttgccaccggtacccattcaacaggtggaatctctcaagctggagtcaagttgtaacttcgacctgcatacaagcactgctggccagcagtcctttacgaaatggacctgggaaataaagaatgatctcgcagagaacacacaggcctcttcgacttcattccagaccaaaagcagtgaggtcaatttacggggtctgtgccttatccctacattggtggttgaaaccgcggctcgcactcgaaagacaattgcctgttatgacctgacctgcaaccagacggtgtgtcaaccaactgtctacctaatggggcccatccagacctgcattacaactaagtcctgtctcctgggacttggcgatcagcgtatccaggtgaattatgagaaaacctactgcgtatctggccaactggttgaaggggtgtgttttaaccctatacacacaatggcattgagccagccatcccatacctatgacgtcatgacgctcatggtgagatgcttcctgatcattaagaaagtgacttcaggagatagtatgaagatcgagaaaaattttgagacattagtccagaagaccggttgcactggcaacaatttccaagggtactatatttgtctgatcggatctagctccgaacccctctacgttcctacacttgacgattacaggtcagccgaggtgctgagccggatggcttttgcaccacacggcgaagaccatgatatagagaagaacgccgtaagtaccatgcgcattgctggtaaagtggccgggagagcgccgtctacggaagcatccgacaccgtccagggaatcgccttcagcggctcgcccttgtatacatctactggcgtgctaaccgctaaggatgaccctgtttacatttgggccccagggatcatcatggagggaaatcactcctcatgcgacaaaaagacactgcccctcacttggaccggttttattagtctgcctggcgagatagaaaagacaacccagtgtactgtgttctgcacgcttgcagggccaggagctgattgtgaggcctatagcgaaacaggcatctttaacatttcctctccgacctgcctgatcaatagggtccagcggttccgcggtgcggagcaacagataaagtttgtgtgtcagcgagtagacatggatattatcgtttactgcaacgggatcaaaaaggtgattttgactaagaccctcgtcatcggccagtgtatttatacattcaccagcatattctcactgatccccggaattgcccacagtttagcagtggaactgtgcgtccctggcctacatgggtggactacaatgctcctgcttttgacgttttgtttcggatgggtgctgatcccctttatcaccatgattctcctgaaaatacttatcgctttcgcctacctgtgctccaagtataacactgacagcaaatttagaattttggttgagaaggtgaaaaaggagtaccaaaagacaatgggttctatggtatgcgaagtctgtcagtacgagtgcgaaaccgctaaagagctcgaatcacacaggaagagttgtagcatcggctcctgcccatattgtctgaatccttctgaggccacaacttcggcattacaggcccatttcaaagtgtgcaagctgaccagccggtttcaggagaacctacgtaaatccctcacggtttacgaacccatgcaagggtgttatcgcaccctgtcacttttcagatacaggagtaagtttttcgtgggattggtctggtgcctgctcctggtgatggagttaattgtatgggctgcgtctgcagaaacacagaatctgaacagcggctggactgataccgcccacggttccgggatcataccaatgaagacagaccttgagttggatttttcactccccagctctgcttcctatacttaccggcgacagctgcagaatcctgccaacgagcaagagaaaatcccattccacctacagattagtaaacaggtgatccatgcagaaattcaacacctgggccattggatggacgccacctttaatctcaaaacggctttccactgttatggaagctgcgaaaagtacgcctacccgtggcagacagcaggctgtttcatcgagaaagattatgaatacgagaccgggtggggatgcaatccccctgactgcccaggtgttggcactgggtgtacagcgtgcggagtctatctggataaacttaagtctgtgggcaaagtgtttaagatagtctccttgaaatacacccgcaaggtttgtattcagctgggtactgagcagacctgcaaaacagtggactcaaacgactgtttaatcacgaccagtgtgaaggtatgcatgattgggactatcagcaaattccaaccctcggatacactcctgtttcttggccctctgcagcagggaggcttgatattcaagcagtggtgtaccacaacttgccaatttggggacccaggagatatcatgtccacccccacgggcatgaagtgtccggaactcaacggttctttcaggaaaaagtgcgcttttgccacaacccctgtctgtcagttcgacgggaatactattagcggatataaaagaatgatcgcaaccaaggattcatttcagagtttcaacgtgacagagccacatatttccgcctctgctctggaatggatcgaccccgatagctccctacgggaccacataaatgttgtggtcggccgcgatctgtcatttcaggacctcagcgagactccttgccaagtggatctgatgaccagtacaattgacggtgcctggggctctggggttggattcaaccttgtgtgcacggtatccttgaccgaatgtagcgcatttctgacttcgatcaaggcttgcgattcagccatgtgttacggctctacaaccgcgaatttagtcagagggcagaacactgtgcacatcgtgggaaagggcggtcatagtgggtccaagttcatgtgctgtcacgacacaaaatgcagctctaccggactcgtcgccgctgcaccccatctggacagggttacgggctataaccaggccgatagcgacaagattttcgatgacggtgctccagagtgtggcatgtcctgctggtttaaaaagtcaggggagtggatccttggagtgctgaatggcaactggatggtagtggccgtcctaattgcactcctgatattgagtatcctgatgttcactttatgttgccctcgtcggcccagctaccgaaaagaacacaagccatga

SEQ ID NO: 10148 - RNA, 3447 nt, synthetic construct
  misc_feature 1..3447: note = derived and/or modified CDS sequence (opt3) from PUUV(Mu/07/1219)__KJ994777.1__GP
  source 1..3447: mol_type = other RNA
atggagaagatcattcccgtgtgcctgtacctccctttcctttgtctgttgttatggagcagaggcgacaccaggaacctgaatgaactaaaaatggagtgcccacacacaatagggctcggacagggtctggtcatcggctccattgaacttccgcccgttcctctgatccaagtggagtctttgaagctcgaatcaagttgtaactttgatctgcatactagcacgtcctctcagcaggccttcaccaaatggacatgggaggtaaagtcggacctggctgagaatactcaggcatcaagcaccagttttcaaacaaaatcctctgaagtgaacctccgggggttatgcctggtcccaccccttgtgattgagaccgccgcgcgcactcgaaagacaatcgcttgtttcgatttgagctgcaatcagaccacgtgtcagcctactgtttttctgatgggaccaatacagacctgcatcacaactaagtcctgtctactcggcctgggtgaccaacgtattcaggtgaactatgaaaagacctactgcgtctcagggcagcttatcgagggaatttgtttcaatcccgtgcacacaatggccctgagtcagcctagccatacctatgatatcgtaacggttatggtgagatgctttttgatagtcaagaaagtgactacaggcgactctatgaagattgagaaatccttcgaaaccctcgtgcaaaagactggctgcacagataacgggtttcagggatactatgtctgtctgatcggttcaagcagtgagccattatacattccgaccctggacgattataggtctgcagaagttctctcccggatggccttcgctccccacggcgaggaccatgatatcgaaaagaatgcaatcagcgccatgcgcattgtggggaaagtaacgggaaaggctccttcgaccgagtcttccgacacagtgcagggcatagccttttcaggtaacccactttacactagcaccggggtcctgacagcgaaagatgaccccgtgtacgtttgggcacctggaatcatgatggagggcaatcacagcgtgtgcgaaaagaaaactttgccactaacctggacaggcttcattcccctgccgggggagatcgaaaagaccactcaatgtacggtcttttgcacactcgccggacctggtgctgactgtgaggcctattccgaaaccggcatattcaacatttctagccccacttgcctgatcaatagagtgcagaggttccgcggggcagagcagcagatcaaatttatttgtcaacgggtagatatggacatcaccgtttactgcaacggacttaagaaggtgattctgacaaaaaccttggtcataggccagtgtatctatactttcacatcaatttttagtctcatcccaggtgtggctcactccctggccgtcgagttatgcgtgcctgggctgcatggctgggcgacgatgctactcctgcttaccttctgttttggatggatcttgattcccttctttgccatgatactgctcaaggttctgatcgcacttgcttacctgtgcagcaaatataatactgattctaagttcaaagtgttgattgaaaaggtaaagaaagagtaccagaagacaatgggctcaatggtctgcgaagtgtgtcagtatgagtgcgaaaccgccaaagagctcgagagtcaccgaaagagctgtccaatggggtcctgcccctactgtctgaaccctgctgaagccacaacttctgcattacaagcccattttaaagtttgcaagctgacctcgagattccaggacaacctaaggaagagtctcggagcttacgagccaaaacagggttgttatcggacgctgtccctttttcgttaccgctcaagattctttgtgggcttcatctggtgcttgctgctcgtcctggaattaattgtgtgggcggcaagtgccgagacccagaatctgaactctgggtggacagatactgctcacggaagcggcgtaatcccgatgaggaccgaccttgagttggatttctccctcccctcaagcgcctcttatacataccggcgacaactgcagaatcctgcaaacgaacaggagaagataccatttcacctacagatctccaaacaagtgattcatgccgaaatccagcacctgggtcattggatggacgggactttcaatctcaagaccgcttttcactgttatggcagttgcgagaaatacgcctatccctggcagacggcaggatgtttcgttgaaaaggattacgagtacgagagcggctgggggtgcaaccctgcggactgcccaggagtcggtacaggctgtaccgcttgcggggtgtatctggataaacttaaatctgtgggaaaggcctttaaaattgtctccttgcgctacactagaaaggcatgtatccaactgggcacagaacagacctgcaaaaatgttgactcaaacgactgtttagtgactaccagtgtgaaggtatgcctcataggtacagtcagcaaattccagccctcggatacgctgctttttctggggccgttggagcagggcggactcattttcaagcaatggtgtaccactacatgccagtttggcgaccctggggatatcatgtccaccccagtgggaatgaagtgtcccgaactgtctggcagcttcaggaaaaagtgcgcctttgctacaactcctgtttgtcagttcgacggtaataccatttcagggtataaacggatgatcgccacgaaggatagttttcagtccttcaacgtgacagagccccatatatctgcaagctccctagaatggatcgacccagattcaagcctgcgcgaccacattaatgtcatcgtgggaagagatctcagtttccaagacctgtctgagaccccttgccaggttgatcttactaccacatccattgacggcgcttggggtagcggcgtggggtttaacttgatctgctcggtatcactgactgagtgttctaccttcttaacaagtataaaagcctgcgattccgcgatgtgttacggaagcacgaccgccaatctcgtcaggggccagaacactgtgcacattgtggggaagggaggccattctggtagcaagtttatgtgctgtcacgacacaaaatgctcctcaaccgggctggtcgctgcagctccccatcttgaccgtgttactggatataatcaggccgatagtgacaagatcttcgatgacggcgccccagaatgtggtatcagctgctggtttacaaaatctggcgagtggattctgggggtgctaaacggaaactggatggtagtggcagtcctcgtggcgctgttcatcttgtccatttttctgttcaccttatgttgcccgcggcgaccttcatacgccaaggaacacaaaccctga

SEQ ID NO: 10149 - RNA, 3447 nt, synthetic construct
  misc_feature 1..3447: note = derived and/or modified CDS sequence (opt3) from PUUV(Puu/Kazan)__Z84205.1__GP
  source 1..3447: mol_type = other RNA
atgggcaagctgagccccgtgtgcctctaccttctgttgcaggggttactgctattcaacaccggaacagccagaaatctcaacgagctgaaaatggaatgtcctcacactatcggtcttggccaagggctggtcgttggatccgtggagttgccaccggtacccattcaacaggtggaaacgctcaagctggagtcttcatgcaattttgacctgcataccagtacagctggccagcaagcattcactaaatggacctgggaaataaagggtgatctcgccgagaacacacaggcgagctccacctcttttcagactaaatcgtcagaggtcaatttaagggggctgtgtcttatccctacattggtgattgaaaccgctgcccggatgcgcaagacgatcgcatgctatgacctgagctgtaaccagactgtttgccaaccaaccgtgtacctaatgggacccattcagacatgtatcactaccaagagttgcctcctgggccttggcgatcagcgaatacaggtcaattatgagaaaacatactgtgtgtccgggcaactggtagaaggagtttgcttcaaccctatccacaccatggccttgtctcagccaagccatacgtatgacattgtgactatgatggtccgttgttttctcgtgatcaagaaagtgacatccggtgattcaatgaagattgagaaaaatttcgagaccctggtccagaagaacggctgcactgctaatagttttcaagggtactatatctgcttaataggatctagctccgaacccctgtacgttcctacactcgacgattacagatcagcagaggtgcttagcaggatggccttcgctccacacggcgaagaccatgatgtagagaagaacgccattagtgcgctgcggatcgcaggtaaagtgaccgggaaggccccgtctacggaatccagcgacaccgtccagggagtggctttttcgggctctcccttgtatacatccactggcgttctaaccgccaaagatgaccctgtgtacatttgggcaccagggatcatcatggagggaaatcactcagtctgtgagaagaaaacactgcccctcacttggaccggtttcattagtctgcctggcgaaatagagaagacaacccagtgcactgtgttttgtacgcttgctgggccaggagccgattgcgaagcgtatagcgagacaggcatcttcaacatttcctctcccacctgtctgatcaatcgcgtacagagatttaggggtgccgaacaacagataaaattcgtttgccagcgggtggacatggacattactgtctactgtaacggggtgaagaaggtcatcttgaccaaaacactcgtgatcggccagtgcatttataccttcactagcatcttttcactgattccgggagttgcacacagtttagctgtggagctgtgtgtacctggcctacatgggtgggccacaatgctcctgcttttgacgttctgctttggatgggtcctgatacccaccatcactatgattctcctgaagatccttatcgctttcgcctacctgtgttccaaatataacacagatagcaagtttcgcattttgatagagaaagtgaagaaggaataccagaaaaccatgggttctatggtttgcgaggtgtgccagtacgaatgtgagacagcaaaggaactcgagtcacaccgaaaaagttgcagcatcggctcctgtccatattgcctgaatccttctgaggccactacctcggctttacaggcgcatttcaaggtctgtaaactgacgagcaggattcaggaaaacctaagaaagtccctcaccgtgtacgagcccatgcaagggtgctatcggacactgtcactttttcgttaccgcagtagattctttgtaggattggtgtggtgtgttctgctcgtcctggaattaatcgtgtgggcagcctctgctgagactcagaatctgaacgccggctggaccgacacagcacacggtagcgggattatcccaatgaagactgatcttgagttggacttctccctcccctcaagcgcctcttatacctacaggcggcagctgcagaatcctgctaacgaacaagagaatataccatttcacctacagatctccaaacaggtgattcatgccgaaatccaacacctgggccattggatggatgcaacgttcaacctcaagacagcgtttcactgctatggaagttgtgagaaatacgcttacccgtggcagaccgccggctgcttcgtcgaaaaggactatgagtacgagactgggtggggatgtaatccccctgattgcccaggtgttggcacagggtgcaccgcatgtggagcctatctggacaaacttaagagcgtgggcaaggtgttcaaaattgtatctttgcgatacactcgcaaggtctgcatccagctgggtaccgaacagacatgtaaaacggtggattccaacgactgcttaataaccacttcagttaaggtgtgtctcattgggacaatcagtaaatttcaacccagcgataccctgcttttcctgggccctttgcagcagggaggcctcatttttaagcagtggtgcacaactacctgtcaattcggggacccaggagacatcatgtcgacgcccacaggcatgaaatgcccggatctgaatggttcctttagaaagaagtgtgctttcgccaccactcctgtctgccagtttgacgggaacaccatatctggatataaaaggatgatcgcaacaaaggatagcttccagtcatttaatgtgactgagccacatattagtgcttccgccctagaatggatcgaccccgattctagcctgcgggaccacattaacgttatcgtgtcccgcgatctctcattccaggacctgagcgagaccccttgtcaaatagatcttagtacagcgtctattgacggcgcctggggttccggcgtagggtttaatttggtctgcacggtgagcctgaccgaatgctcggctttcttaacttcaatcaaagcatgtgatgccgctatgtgctacggatctacaaccgccaacctcgtgagaggccagaacactatccacattgtcgggaagggaggccatagtggttccaaatttatgtgttgccacgacacaaagtgtagcaccacggggctggttgcagcggctccccatcttgatagggtgactggatataatcaggccgactctgacaagatcttcgatgacggcgccccagagtgcggtatgagctgttggttcaaaaagtccggcgagtggattctgggggtactaaacggaaattggatggtggtcgcagtgctcatagctctgttgatcctgtcaattttactctttaccctgtgctgtcctcgtcggcccagttaccgaaaagaacacaagccatga

SEQ ID NO: 10150 - RNA, 3447 nt, synthetic construct
  misc_feature 1..3447: note = derived and/or modified CDS sequence (opt3) from PUUV(PUUV/Ardennes/Mg156/2011)__KT247603.1__GP
  source 1..3447: mol_type = other RNA
atgggcaagatcattcccgtgtgcctgtacctccttttcctgtgtttgttactgtgggacagaggggataccaggaacctaaatgagctcaaaatggaatgccctcacacaataggactgggtcagggccttgtcatcgggagcgttgagctgccaccggtgcccttgactcaagtagaatccctcaagctggagtcttcatgtaactttgacctgcatacgagtaccagctcccagcagtctttcacaaaatggacttgggaaatgaaggtggatctcgccgagaatacccaggcttcgtcaaccagctttcaaacaaaaagttccgagattaacttacggggactgtgccttgtccctccattggtgatcgaaactgcagcccgcacacgaaagaccattgcgtgtttcgacctgtcttgcaatcagacggcttgtcagcccactgtttttctaatcggccctatacagacctgcatcacaactaagagctgtctcctgggtcttggggatcaacgtattcaggtgaactatgagaaaacctactgcgtctccggacagctggtggaaggcatctgtttcaatccagtacacacaatggccttgtcacagcccagtcatacctatgacattgttacggtgatggtcagatgctttctcatcgtgaagaaagtgagcactggcgattctatgaagctggagaaatccttcgagacattagtccaaaagaccgggtgcactggaaacggttttcagggctactatgtttgtctgatagggtcaagcagtgaacctctctacattccaacacttgacgattataggtctgcagaggtgctgtcccggatggccttcgctccgcacggagaagaccatgatatcgagaagaatgcaattagcgccatgcgcatcgtaggcaaagtgaccggtaaggctccctcgacggaatcttccgacaccgtccaggggatcgccttttcaggaaaccctttgtacacaagtactggcgtgctaaccgcgaaagatgacccaatttacatatgggcacccggcatcattatggaggggaatcacagcgtttgcgacaagaaaacactgcctctcacttggaccggattcatcccactgcccggtgagatagaaaagacaacccaatgtactgtgttttgcacgcttgccggcccgggggctgattgtgaggcctattccgaaacaggaattttcaacatctctagccctacctgcctgatcaatagagtccagaggttccggggcgcagagcagcagattaaatttatctgtcaacgcgtggacatggatattactgtatactgcaacggtttgaagaaggttatactcaccaaaacactggtgatcgggcagtgtatttataccttcacttcaatctttagtttaatccccggcgtcgctcactccctggccgtggaactatgcgtcccaggactccatggctgggcgacaatgctgcttttgctgacgttctgttttgggtggattctcatacctttctttagcatgatcctgcttaagattctgatcgccttcgcatacttgtgctctaaatataataccgactcaaagtttaaaattctcatcgagaaggtgaagaaagagtaccagaagactatgggaagtatggtttgcgaagtgtgtcagtatgagtgcgaaacagctaaagagctggaaagccaccgaaagtcctgtcccatgggttcttgcccatactgtttaaaccccgccgaggctaccacatcggccctgcaagcacatttcaaagtatgcaagctaactagcagatttcaggataacctcaggaagtccctgggcgcctacgagcctaaacaggggtgttatcggaccctttcattgttccgttaccgcagtagatttttcgtcggattcatatggtgctttctgctcgtgctggaattaatcgtttgggctgcgtctgcagagacgcagaatctgaacagcggctggaccgacacagcccacggttccgggattatcccaatgaggactgatcttgaattggacttctcactcccgagctctgcttcctatacctaccggcgacaactgcagaatcccgccaacgagcaggagaagattccttttcacctacagatcagtaaacaagtgatacatgcagaaattcagcacctgggccattggatggatggaacattcaatctcaagactgcctttcactgttatggcagctgcgagaaatacgcttatccatggcagaccgccgggtgtttcgtcgaaaaggactacgagtacgaatctggatggggttgcaatccccctgattgcccaggcgtggggacgggatgtacagcatgcggcgtatatctggacaaacttaaatccgtgggtaaggcgtttaaaatcgtttcattgcgctacaccagaaaggcttgtattcaactggggactgagcagacatgcaaaagtgtcgacagcaacgattgtttagtgaccacttcggtgaaggtctgcctcatcggcaccgtttccaaattccagccctctgacacactgctttttctgggaccgttggagcagggcgggctcatattcaagcaatggtgtacgaccacttgccagtttggagatcctggcgacatcatgagcacaccagtgggtatgaagtgtcccgaactgtcagggagtttcaggaaaaagtgcgcctttgcaaccacacctgtgtgtcagttcgatggaaacactctatccggctataaacggatgattgccaccaaggactctttccagagctttaatgtaacggagccccatatctccgcttcaagcctggaatggattgatccagacagttctctccgcgatcacatcaacgtcatagtgggtagagacctgtccttccaagatcttagcgagacaccttgccaggttgacttggccacctcgtcaattgatggcgcatgggggtctggagtgggctttaatctggtctgcagtgtgtccttaactgaatgtagcaccttcctcacatctatcaaggcttgcgacagcgccatgtgttacgggtccactaccgcgaacctgcttaggggacagaatacagttcacatcgtgggcaagggtgggcattcaggaagtaagtttatgtgctgtcacgacacgaaatgcagctctaccggcctggtagccgctgcaccccatctagatcgtgtcactggttataaccaggccgactccgataagattttcgacgatggcgctccagagtgtgggatctcatgctggtttacaaaaagtggagagtggattctcggcgtgctgaatgggaactggatggtggtcgccgttttggtggcactgttcatattaagcatctttctcttcaccctgtgttgcccgcggcgaccttcctacgcgaaggaacacaaaccctga

SEQ ID NO: 10151 - RNA, 3447 nt, synthetic construct
  misc_feature 1..3447: note = derived and/or modified CDS sequence (opt3) from PUUV(PUUV/Ardennes/Mg75/2011)__KT247602.1__GP
  source 1..3447: mol_type = other RNA
atgggcaagatcattcccgtgtgcctgtacctccttttcctgtgtttgttactgtgggacagaggggataccaggaacctaaatgagctcaaaatggaatgccctcacacaataggactgggtcagggccttgtcatcgggagcgttgagctgccaccggtgcccttgactcaagtagaatccctcaagctggagtcttcatgtaactttgacctgcatacgagtaccagctcccagcagtctttcacaaaatggacttgggaaatgaaggtggatctcgccgagaatacccaggcttcgtcaacatcttttcaaaccaaaagttccgagattaacttacggggactgtgccttgtccctccattggtgatcgaaactgcagcccgcacacgaaagaccattgcgtgtttcgacctgtcttgcaatcagacggcttgtcagcccactgtttttctaatcggccctatacagacctgcatcacaactaagagctgtctcctgggtcttggggatcaacgtattcaggtgaactatgagaaaacctactgcgtctccggacagctggtggaaggcatctgtttcaatccagtacacacaatggccttgtcacagcccagtcatacctatgacattgttacggtgatggtcagatgctttctcatcgtgaagaaagtgagcactggcgattctatgaagctggagaaatccttcgagacattagtccaaaagaccgggtgcactggaaacggttttcagggctactatgtttgtctgatagggtcaagcagtgaacctctctacattccaacacttgacgattataggtctgcagaggtgctgtcccggatggccttcgctccgcacggagaagaccatgatatcgagaagaatgcaattagcgccatgcgcatcgtaggcaaagtgaccggtaaggctccctcgacggaatcttccgacaccgtccaggggatcgccttttcaggaaaccctttgtacacaagtactggcgtgctaaccgcgaaagatgacccaatttacatatgggcacccggcatcattatggaggggaatcacagcgtttgcgacaagaaaacactgcctctcacttggaccggattcatcccactgcccggtgagatagaaaagacaacccaatgtactgtgttttgcacgcttgccggcccgggggctgattgtgaggcctattccgaaacaggaattttcaacatctctagccctacctgcctgatcaatagagtccagaggttccggggcgcagagcagcagattaaatttatctgtcaacgcgtggacatggatattactgtatactgcaacggtttgaagaaggttatactcaccaaaacactggtgatcgggcagtgtatttataccttcacttcaatctttagtttaatccccggcgtcgctcactccctggccgtggaactatgcgtcccaggactccatggctgggcgacaatgctgcttttgctgacgttctgttttgggtggattctcatacctttctttagcatgatcctgcttaagattctgatcgccttcgcatacttgtgctctaaatataataccgactcaaagtttaaaattctcatcgagaaggtgaagaaagagtaccagaagactatgggaagtatggtttgcgaagtgtgtcagtatgagtgcgaaacagctaaagagctggaaagccaccgaaagtcctgtcccatgggttcttgcccatactgtttaaaccccgccgaggctaccacatcggccctgcaagcacatttcaaagtatgcaagctaactagcagatttcaggataacctcaggaagtccctgggcgcctacgagcctaaacaggggtgttatcggaccctttcattgttccgttaccgcagtagatttttcgtcggattcatatggtgctttctgctcgtgctggaattaatcgtttgggctgcgtctgcagagacgcagaatctgaacagcggctggaccgacacagcccacggttccgggattatcccaatgaggactgatcttgaattggacttctcactcccgagctctgcttcctatacctaccggcgacaactgcagaatcccgccaacgagcaggagaagattccttttcacctacagatcagtaaacaagtgatacatgcagaaattcagcacctgggccattggatggatggaacattcaatctcaagactgcctttcactgttatggcagctgcgagaaatacgcttatccatggcagaccgccgggtgtttcgtcgaaaaggactacgagtacgaatctggatggggttgcaatccccctgattgcccaggcgtggggacgggatgtacagcatgcggcgtatatctggacaaacttaaatccgtgggtaaggcgtttaaaatcgtttcattgcgctacaccagaaaggcttgtattcaactggggactgagcagacatgcaaaagtgtcgacagcaacgattgtttagtgaccacttcggtgaaggtctgcctcatcggcaccgtttccaaattccagccctctgacacactgctttttctgggaccgttggagcagggcgggctcatattcaagcaatggtgtacgaccacttgccattttggagatcctggcgacatcatgagcacaccagtgtcaatgaagtgtcccgaactgagtggttccttcaggaaaaagtgcgcctttgcaaccacacctgtgtgtcagttcgatgggaacactctatctggatataaacggatgattgccaccaaggacagcttccagtcctttaatgtaacggagccccacatctcagctagcagtctggaatggattgatccagactcttccctccgcgatcacatcaacgtcatagtgggcagagacctgagcttccaggatctttcggagacaccttgccaagttgacttggccacctcatctattgatggtgcatggggcagtggggtgggatttaatctggtctgctccgtgagcttaactgaatgttctaccttcctcacaagcatcaaggcttgcgactccgccatgtgttacggctcaactaccgcgaacctgcttagggggcagaatacagttcatatcgtgggaaagggcggtcacagtgggagcaagtttatgtgctgtcatgacacgaaatgcagctccaccggactggtagccgctgcaccccacctagatcgtgtcactggctataaccaggccgactcagataagattttcgacgatggtgctccagagtgtggcatcagttgctggtttacaaaaagcggggagtggattctcggagtgctgaatggcaactggatggtggtcgccgttttggtggcactgttcatattatccatctttctcttcaccctgtgttgcccgcggcgaccttcttacgcgaaggaacacaaaccctga

SEQ ID NO: 10152 - RNA, 3447 nt, synthetic construct
  misc_feature 1..3447: note = derived and/or modified CDS sequence (opt3) from PUUV(PUUV/Jura/Mg2/2010)__KT247598.1__GP
  source 1..3447: mol_type = other RNA
atgggcaagatcattcccgtgtgcctgtacctccttttcctgtgtttgttactgtggaacagaggggacaccaggaatctaaacgagctcaaaatggaatgccctcacacaataggactgggtcagggccttgtcatcgggagcgttgagctgccaccggtgcccttgactcaagtagaatccctcaagctggagtcttcatgtaattttgatctgcatacgagtaccagctcccagcagtctttcacaaaatggacttgggaaatgaagtcggacctcgccgagaacacccaggcttcaagcacaagttttcaaaccaaatcctctgagattaatttacggggactgtgccttgtgcctccattggtcatcgaaactgcagcccgcacacgaaagaccattgcgtgtttcgatctgagctgcaaccagacggcttgtcagcccactgtgtttctaatcggccctatacagacctgcctcacaactaagtcctgtctgcttggtctgggggaccaacgtatccaggttaattatgagaaaacctactgcgtgtcaggacagttggtcgaaggcgtgtgtttcaacccaattcacacaatggccctcagtcagcccagccatacctatgatatcgtaacggttatggtgagatgctttctgattgtcaagaaagtgtctactggcgactccatgaagatcgagaaatcattcgagacattagtgcaaaagaccgggtgcactggaaatggttttcagggctactatgtctgtctgatagggagcagttctgaacctctctacattccaacacttgatgactataggtccgcagaggttctgagccggatggccttcgctccgcacggagaagatcatgacatcgagaagaacgcaatttcggccatgcgcatcgtgggcaaagtaaccggtaaggctccctctacggaatcctcagataccgtgcaggggatcgcctttagtggaaatcctttgtacacaagcactggcgtcctaaccgcgaaagacgatccaatttacatatgggcacccggcatcattatggaggggaaccactccgtgtgcgagaagaaaacactgcctctcacttggaccggattcatcccactgcccggtgaaatagagaagacaacccaatgtactgtgttttgcacgcttgccggcccgggggctgactgtgaagcctattctgagacaggaattttcaatatcagctcacctacctgcctgatcaacagagttcagaggttccggggcgcagaacagcagattaaatttatctgtcaacgcgtcgacatggatattactgtgtactgcaatggtttgaagaaggtaatactcaccaaaacactggttatcgggcagtgtatttataccttcacaagtatcttttccttaatccccggcgtggctcacagcctggccgtcgagctatgcgtgccaggactccatggctgggcgactatgctgcttttgctgacgttctgttttgggtggattctcatacctttcaccgccatgctgcttctgaagatcttgattgcatttgcttacctctgctctaaatataacactgactcaaagttcaaaatcctgattgagaaggtcaagaaagaataccagaagacaatgggaagtatggtgtgcgaggtttgtcagtatgaatgcgagaccgccaaagaattagagagccaccgaaagtcctgtcccatgggttcttgcccatactgtctgaaccccgctgaggccacaacttcggcactacaagcccattttaaagtgtgcaagctcaccagcagattccaggataatctgaggaagtcccttggcgcttacgaacctaaacaggggtgttatcggacgttgtcactgtttcgttaccgcagtagattctttgtaggactcgtctggtgcttcctgttagtgctggagcttatcatatgggcggcatctgccgaaacccagaacttgaatagcggctggacagacactgctcacggttccggggttatcccaatgaggaccgatctcgagctggacttctcactaccgagctctgcctcctatacataccggcgacaactgcagaaccccgcaaatgagcaggaaaagattccttttcacctccagatcagtaaacaagtgattcatgccgagatccagcacctgggccattggatggatggaactttcaaccttaagaccgcttttcactgttatggcagctgcgaaaaatacgcctatccatggcagacggcagggtgtttcgtcgagaaggactacgaatacgagtctggatggggttgcaatccccctgattgcccaggcgtggggacaggatgtaccgcgtgcggcgtatatttggacaagctgaaatccgtgggtaaggcttttcgcatagtttcattaaaatacactagaaaggcctgtattcaactcgggacagagcagacctgcaaaagtgtcgatagcaacgactgtctggtgactacctcggtgaaggtctgccttatcggcacagtttccaaattccagccctctgacacgctgttgtttctcggaccgctggaacagggcgggctaattttcaagcaatggtgtaccactacatgccagtttggagatcctagggacatcatgagcaccccagtgggcatgcggtgtcccgagctgtcaggtagtttccgcaagaaatgcgcatttgccacaactcctgtgtgtcagttcgatgggaataccatatccggatataagagaatgatcgctacgaaagactcttttcagagcttcaacgtaacagaaccccatatttccgcctcaagcctcgagtggatcgatccagacagttctctgagggatcacattaatgtcatcgtgggccgtgacctttccttccaagatttgagcgaaaccccttgccaggttgacctgactaccacatcgatagatggtgcatggggctcaggggtgggatttaacttaatttgctctgtcagtctcactgagtgttccaccttcctgacaagcatcaaggcttgcgactctgccatgtgttacggcagcacgaccgcgaatcttatgcgggggcagaacactatccacattgtgggaaaaggcggtcattccgggtcaaagtttatgtgctgtcacgatacaaagtgcagtagcaccggactggttgccgctgcaccccatctagaccgagtgactggctataatcaggccgactctgataaaatcttcgacgatggtgctccagagtgtggcatttcctgctggtttacaaagtcaggggaatggatactcggagtactgaacggcaactggatggtcgtggccgtgttggtcgttctgttcatcttaagtatttttctcttcaccctgtgttgcccgagaaggcctagctacgcaaaagagcacaagccctga

SEQ ID NO: 10153 - RNA, 3447 nt, synthetic construct
  misc_feature 1..3447: note = derived and/or modified CDS sequence (opt3) from PUUV(PUUV/Jura/Mg214/2010)__KT247599.1__GP
  source 1..3447: mol_type = other RNA
atgggcaagatcattcccgtgtgcctgtacctccttttcctgtgtttgttactgtggaacagaggggacaccaggaatctaaacgagctcaaaatggaatgccctcacacaataggactgggtcagggccttgtcatcgggagcgttgagctgccaccggtgcccttgactcaagtagaatccctcaagctggagtcttcatgtaattttgatctgcatacgagtaccagctcccagcagtctttcacaaaatggacttgggaaatgaagtcggacctcgccgagaacacccaggcttcaagcacaagttttcaaaccaaatcctctgagattaatttacggggactgtgccttgtgcctccattggtcatcgaaactgcagcccgcacacgaaagaccattgcgtgtttcgatctgagctgcaaccagacggcttgtcagcccactgtgtttctaatcggccctatacagacctgcctcacaactaagtcctgtctgcttggtctgggggaccaacgtatccaggttaattatgagaaaacctactgcgtgtcaggacagttggtcgaaggcgtgtgtttcaacccaattcacacaatggccctcagtcagcccagccatacctatgatatcgtaacggttatggtgagatgctttctgattgtcaagaaagtgtctactggcgactccatgaagatcgagaaatcattcgagacattagtgcaaaagaccgggtgcactggaaatggttttcagggctactatgtctgtctgatagggagcagttctgaacctctctacattccaacacttgatgactataggtccgcagaggttctgagccggatggccttggctccgcacggagaagatcatgacatcgagaagaacgcaatttcggccatgcgcatcgtgggcaaagtaaccggtaaggctccctctacggaatcctcagataccgtgcaggggatcgccttcagtggaaatcctctatacacaagcactggcgtcctgaccgcgaaagacgatccaatttacatatgggcacccggcatcattatggaggggaaccactccgtgtgcgagaagaaaacactccctctgacttggaccggatttatcccacttcccggtgaaatagagaagacaacccaatgtactgttttctgcacgctggccggcccgggggctgactgtgaagcctattctgagacaggaatttttaatatcagctcacctacctgcttgatcaacagagtgcagaggttccggggcgcagaacagcagattaaattcatctgtcaacgcgtcgacatggatattactgtgtactgcaatggtctcaagaaggtaatactgaccaaaacattagttatcgggcagtgtatttatacctttacaagtatcttctccctgatccccggcgtggctcacagcctagccgtcgagctctgcgtgccaggactgcatggctgggcgactatgcttttgctgctcacgttttgtttcgggtggattctgataccttttaccgccatgcttctgttgaagatcctcattgcattcgcttacctgtgctctaaatataacactgactcaaagtttaaaatcttaattgagaaggtcaagaaagaataccacaagagtatgggaagcatggtgtgcgaggtttgtcagtatgaatgcgagacagccaaagaactggagtcccatcgaaagtcttgtcccatgggttcgtgcccatactgtctaaaccccgctgaggccaccacaagcgcactccaggcccacttcaaagtgtgcaagctgacttccagatttcaagataatcttaggaagtcattgggcgcttacgaacctaaacaggggtgttatcggaccctgagtctcttccgttaccgctctagatttttcgtaggactggtctggtgctttttactggtgcttgagttgatcatatgggcggcaagcgccgaaacgcagaacctcaattccggctggaccgacacagctcacggttcaggggttatcccaatgaggactgatctggagctagacttcagcctgccgtcttccgccagttatacctaccggcgacagctccaaaaccccgcaaatgagcaggaaaagattcctttccatctgcagatcagcaaacaggtgattcacgccgagatccaacatcttggccactggatggatggaacatttaacttgaagactgctttccattgttatggctcttgcgaaaaatacgcctatccatggcagaccgcagggtgttttgtcgagaaggactacgaatacgagtccggatggggttgcaatccccctgattgcccaggcgtggggacgggatgtacagcgtgcggcgtatatctggacaagttaaaatcagtgggtaaggctttccgcatagttagtctcaaatacaccagaaaggcctgtattcagctggggactgagcaaacatgcaaaagcgtcgattcgaacgactgtcttgtgaccacttccgtgaaggtctgcctgatcggcaccgtttctaaatttcagcccagcgacacactcttgttcctgggaccgctagaacagggcgggctgatttttaagcagtggtgtacgaccacttgccaattcggagatcctggcgacatcatgtcaacaccagtgggtatgaggtgtcccgagctcagtgggtcctttcggaagaaatgcgcattcgccaccacacctgtgtgtcagtttgatggaaatactatatctggctataagcgcatgatcgctaccaaagacagcttccagtcctttaacgtaacggaaccccacatttcagccagcagtctggagtggatcgatccagactcttcccttagagatcacattaatgtcatcgtgggtagggacttgagcttccaggatctgtcggaaacaccttgccaagttgacttaaccactacctcaatagatggcgcatgggggtctggagtgggcttcaacctcatttgcagtgtctccctgacagagtgtagcacttttcttacctctatcaaggcttgcgacagcgccatgtgttacgggtccacaacggcgaatctgatgcgtggacagaacaccatccatattgtgggcaaaggtgggcactcaggaagtaagttcatgtgctgtcatgatactaagtgcagctctacaggcctagttgccgctgcaccccacctcgaccgggtgaccggttataatcaggccgactccgataaaatctttgacgatggcgctccagagtgtgggatttcatgctggttcactaagagtggagaatggatactgggcgtattgaacgggaactggatggtcgtggccgtgctggtcgttttatttatcctcagcattttcctgtttacactttgttgcccgcgaagaccttcctacgcaaaagagcacaagccctga

SEQ ID NO: 10154 - RNA, 3447 nt, synthetic construct
  misc_feature 1..3447: note = derived and/or modified CDS sequence (opt3) from PUUV(PUUV/Orleans/Mg23/2010)__KT247600.1__GP
  source 1..3447: mol_type = other RNA
atgggcaagatcattcccgtgtgcctgtacctccttttcagatgtctgttgttatgggacagggggaacgcccggaatctgaacgagctaaaaatggaatgccctcacaccataggactcggtcagggcctggtcatcgggagcgttgagcttccaccggtgcccctgacacaaattgaatccttgaagctcgagtcttcatgtaattttgatctgcatacttcaacgagctcccagcagtctttcaccaaatggacatgggaaatcaagtcggacctggctgagaacactcaggcatcaagcaccagttttcaaacaaaatcctctgaggtaaatctccgcggattatgcctggtgcctccacttgtcattgaaaccgccgcgcgaactcgtaagacaatcgcttgtttcgatttgagctgcaaccagaccgcctgtcagcccacggtgtttctgataggccctatccagacttgcattaccacaaagtcctgtctactcggtctgggggaccaaagaatccaggttaattatgagaaaacttactgcgtgtcaggacagcttattgaaggcatctgtttcaacccagtccacaccatggcactgagtcagcccagccatacatatgatgtggtaaccgttatggtgaggtgctttttgatagtcaagaaagtgtctacgggcgactccatgaagattgagaaatcattcgagactctcgtgcaaaagacagggtgcaccggaaatggttttcagggctactatgtctgtctgatcgggagcagttctgaacctttatacattccaactctggatgactatcggtccgccgaggttctcagccgcatggctttcgcaccgcacggagaagatcatgacatcgagaagaacgccatctcggctatgagaattgtgggcaaagtaacaggtaaggccccctctaccgaagcgtccgatacggtgcaggggatagcattttcaggaaatcctctttacaccagtacaggcgtcctgactgccaaagacgatccaatctacatttgggctcccggcatcataatggaggggaaccacagcgtgtgcgagaagaaaaccttgcctctaacatggactggattcattccactgcccggtgaaatcgagaagaccacacaatgtaccgtgttttgcactctcgccggcccgggggcagactgtgaggcttattccgaaacgggaatcttcaatatttctagccctacatgcctgatcaacagggttcagcggttccgcggcgccgaacagcagattaaatttatatgtcaacgagtcgacatggatatcaccgtgtactgcaatggtcttaagaaggtaattctgactaaaaccttcatcatcgggcagtgtatttatacatttacctcaatattcagtttgatccccggcgttgcgcactccctcgccgtggagctgtgcgtcccaggattacatggctgggcaactatgctgctactcctgacattttgtttcgggtgggtgcttattccctttttcagcatgatcttgctgaagattctcatcgcttttgcctacctgtgctctaaatataacacggactcaaagttcagaatacttatcgagaaagtcaagagggaataccagaagaccatgggaagtatggtgtgcgaggtttgtcagtatgaatgcgagactgctaaagaactggagagccaccggaagtcctgtcctatgggttcttgcccatactgtttgaaccccgccgaggcaacaacctcggccctccaagctcattttaaagtgtgcaagctgacaagccgtttccaggataatttacgcaaatccctgggcgcgtacgaacctaagcaggggtgttatagaactctatcactctttaggtaccggagtcgattcttcgtaggatttatttggtgcttcctgcttgtcttggagctgatcatttgggcagcctctgctgaaacccagaacctcaatagcggctggacggacaccgcccacggttccggggtgatcccaatgcgcacagatctggagttagacttttcactgccgagctctgcatcctatacttacagaaggcaacttcagaaccccgccaatgagcaggaaaagatacctttccacttgcagattagtaaacaagttatccatgctgagattcagcacctcggccattggatggatggaacctttaacctgaagacagccttccactgttatggcagctgcgaaaaatacgcatatccatggcagactgcggggtgttttatcgagaaggactacgaatacgagtctggatggggttgcaatccccctgattgcccaggcgtggggaccggatgtacggcttgcggcgtctatctagacaaactgaagtccgtgggtaaggccttcaaaatagtatcactccggtacacacgcaaggcatgtatccaactggggaccgagcagacttgcaaaagtgtggatagcaacgactgtcttgttacaacctcggtcaaggtgtgcttgattggcactgtgtccaaatttcagccctctgacaccctgttattcctcggaccgctggaacagggcgggcttatctttaagcaatggtgtacaacgacctgccatttcggagatcctggcgacattatgagcactccagccggtatgaaatgtcccgagctgtcagggagttttacaaagaagtgcgctttcgcccctacccccgtctgtcagttcgatggagacacaacttccggctataaaaagatgatcgcaaccaaagattcttttcagagcttcaatgttacggaaccacacatatccgctagtagcttggagtggattgaccctgatagaagtctcagggaccacatcaacgtgatcgtgggtcgtgatctgtcttttcaggacctatccgaaacaccctgccaagtagatctgaccactaccagcattgacggcgcctgggggtcgggagtcggcttcaatctcatctgctcagtgtctctgacagagtgtagtacttttcttacctccattaaggcgtgcgatagcgccatgtgttacgggtctacaacggctaacttgctgcggggacagaataccgttcatatagtgggcaaaggtgggcacagcggatccaagttcatgtgctgtcatgacactaagtgctcaagtacaggcttagtcgcagccgctccacacctcgaccgagtgaccggttataaccaggccgatagcgacaaaatctttgatgacggcgcaccggagtgtgggatttcttgctggctgactaagtccggagaatggatccttggcgttctgaatgggaactggatggtggtagcggtcctagtggccctcttcatcttttcaattttcctgtttacattgtgttgccctagaaggcccagttacgctaaagagcacaagccatga

SEQ ID NO: 10155 - RNA, 3447 nt, synthetic construct
  misc_feature 1..3447: note = derived and/or modified CDS sequence (opt3) from PUUV(PUUV/Orleans/Mg29/2010)__KT247601.1__GP
  source 1..3447: mol_type = other RNA
atgggcaagatcattcccgtgtgcctgtacctccttttcagatgtctgttgttatgggacagggggaacgcccggaatctgaacgagctaaaaatggaatgccctcacaccataggactcggtcagggcctggtcatcgggagcgttgagcttccaccggtgcccctgacacaaattgaatccttgaagctcgagtcttcatgtaattttgatctgcatacttcaacgagctcccagcagtctttcaccaaatggacatgggaaatcaagtcggacctggctgagaacactcaggcatcaagcaccagttttcaaacaaaatcctctgaggtaaatctccgcggattatgcctggtgcctccacttgtcattgaaaccgccgcgcgaactcgtaagacaatcgcttgtttcgatttgagctgcaaccagaccgcctgtcagcccacggtgtttctgataggccctatccagacttgcattaccacaaagtcctgtctactcggtctgggggaccaaagaatccaggttaattatgagaaaacttactgcgtgtcaggacagcttgtcgaaggcgtgtgtttcaacccaattcacaccatggcactgagtcagcccagccatacatatgatatcgtaaccgttatggtgaggtgctttttgatagtcaagaaagtgtctacgggcgactccatgaagattgagaaatcattcgagactctcgtgcaaaagacagggtgcaccggaaatggttttcagggctactatgtctgtctgatcgggagcagttctgaacctttatacattccaactctggatgactatcggtccgccgaggttctcagccgcatggctttcgcaccgcacggagaagatcatgacatcgagaagaacgccatctcggctatgagaattgtgggcaaagtaacaggtaaggccccctctaccgaagcgtccgatacggtgcaggggatagcattttcaggaaatcctctttacaccagtacaggcgtcctgactgccaaagacgatccaatctacatttgggctcccggcatcataatggaggggaaccacagcgtgtgcgagaagaaaaccttgcctctaacatggactggattcattccactgcccggtgaaatcgagaagaccacacaatgtaccgtgttttgcactctcgccggcccgggggcagactgtgaggcttattccgaaacgggaatcttcaatatttctagccctacatgcctgatcaacagggttcagcggttccgcggcgccgaacagcagattaaatttatatgtcaacgagtcgacatggatatcaccgtgtactgcaatggtcttaagaaggtaattctgactaaaaccttcatcatcgggcagtgtatttatacatttacctcaatattcagtttgatccccggcgttgcgcactccctcgccgtggagctgtgcgtcccaggattacatggctgggcaactatgctgctactcctgacattttgtttcgggtgggtgcttattccctttttcagcatgatcttgctgaagattctcatcgcttttgcctacctgtgctctaaatataacacggactcaaagttcagaatacttatcgagaaagtcaagagggaataccagaagaccatgggaagtatggtgtgcgaggtttgtcagtatgaatgcgagactgctaaagaactggagagccaccggaagtcctgtcctatgggttcttgcccatactgtttgaaccccgccgaggcaacaacctcggccctccaagctcattttaaagtgtgcaagctgacaagccgtttccaggataatttacgcaaatccctgggcgcgtacgaacctaagcaggggtgttatagaactctatcactctttaggtaccggagtcgattcttcgtaggatttatttggtgcttcctgcttgtcttggagctgatcatttgggcagcctctgctgaaacccagaacctcaatagcggctggacggacaccgcccacggttccggggtgatcccaatgcgcacagatctggagttagacttttcactgccgagctctgcatcctatacttacagaaggcaacttcagaaccccgccaatgagcaggaaaagatacctttccacttgcagattagtaaacaagttatccatgctgagattcagcacctcggccattggatggatggaacctttaacctgaagacagccttccactgttatggcagctgcgaaaaatacgcatatccatggcagactgcggggtgttttatcgagaaggactacgaatacgagtctggatggggttgcaatccccctgattgcccaggcgtggggaccggatgtacggcttgcggcgtctatctagacaaactgaagtccgtgggtaaggccttcaaaatagtatcactccggtacacacgcaaggcatgtatccaactggggaccgagcagacttgcaaaagtgtggatagcaacgactgtcttgttacaacctcggtcaaggtgtgcttgattggcactgtgtccaaatttcagccctctgacaccctgttattcctcggaccgctggaacagggcgggcttatctttaagcaatggtgtacaacgacctgccatttcggagatcctggcgacattatgagcactccagccggtatgaaatgtcccgagctgtcagggagttttagaaagaagtgcgctttcgcccctacacccgtctgtcacttcgatggaaaaaccatctccggctataagaggatgatagcaacaaaagactcttttcagagcttcaatgttactgaaccacacatttccgctagtagcttggagtggatcgatcctgacagttctctccgtgatcatatcaacgtgattgtgggtcgggacctgtcctttcaggatctaagcgaaaccccctgccaggtagacctgacgacaacctcgatcgatggcgcctgggggtcaggagtcggcttcaatctcatttgctctgtgagtctgactgagtgttccacctttcttacaagcataaaggcgtgcgactctgccatgtgttacgggagcactaccgctaacttgctgcgaggacaaaatacagttcacatcgtgggcaaaggtgggcattccggatcaaagttcatgtgctgtcacgatacgaagtgcagtagcaccggcttagtcgcagccgctccacacctcgacagagtgactggttataaccaggccgactctgataaaatttttgacgatggcgcaccggagtgtgggatctcctgctggctgacaaagtcaggagaatggattcttggcgttctgaatgggaactggatggtggtagcggtcctagtggccctcttcatctttagtatattcctgtttaccttgtgttgccctaggcgccccagctacgctaaagagcataagccatga

SEQ ID NO: 10156 - RNA, 3447 nt, synthetic construct
  misc_feature 1..3447: note = derived and/or modified CDS sequence (opt3) from PUUV(Vranica)__U14136.1__GP
  source 1..3447: mol_type = other RNA
atgggcaagctgagccccgtgtgcctctaccttttcctgcagtgtttgttactgtggaacagagggtccgccaggaatctaaacgagctcaaaatggaatgccctcacaccatcggactgggtcaaggccttgtcattgggtctgttgagctgccaccggtgcccatacagcaggtagaatcattgaagctcgagagtagctgtaattttgacctgcatacatccactgctacgcagcaatctttcaccaaatggacatgggaaatgaaggatgacctggcagagaacactcaggcctcgtcaaccagctttcagacaaaaagttccgaggtgaatctccggggattatgcctgatccctccacttgtcgtggaaaccgcgtctcgcactcgaaagacaattgcttgtttcgatatcagctgcaaccagaccgtttgtcaacccacggtgtatttggtcggccctattcagacttgcatcaccacaaagtcctgtctgctaggtctcggggaccagcgtatacaggtgaattacgagaaaacttattgcgtatcaggacaactgatcgaaggcgtttgttttaacccagtgcacaccagagcccttagtcagcccagccatacatacgatattgtcaccatgatggtgaggtgcttcctggtggtcaagaaagttacgtctggcgactccatgaagatcgagaaaaattttgagactttggtgcagaagacagattgcaacgcaaatgggttccaaggatattacatttgtctcgtaggttcaagcagtgaacctctgtatgtgccaaccttagacgattaccggtctgccgaggtcctgtcccgcatggcttttgcaccgcacggcgaagaccatgatgtggagagaaacgccgttagcgctctcaggatcgtggggaaggtcactggaaaagccccctcgacagaagcgtctgacaccgtgcagggcatagcattctccggttcacctctttacacgagtaccggggtactgacagccaaggataatccagtttatatttggagccccggaatcattatggagggcaaccactccgtgtgcgagaaaaagactttgcctctaacctggacaggctttatcccactgcccggggaaatcgagaaaactccgcagtgtaccgtcttctgcacactcgctggacctggtgccgactgtgaagcatactctgagaccggcatttttaatataagctcacccacttgcctgcttaaccgggtgcagcgcttccgaggggctgaacaacagatcaagttcgtctgtcagagagtggacatggatattacggtttattgcaacggaatgaaaaaggtgatcctgacaaagaccttggtaataggccagtgtatttacacttttaccagtatcttctccctcatcccaggtattgcccacagcctggcggtcgagttatgcgtgcctgggctgcatggctgggccacagttctactcctgcttaccttttgtttcggatggatcttgattccctttatagcaatgatcctgctcaaaattctgatcgctttcgcctatctttgctctaagtacaatactgactcaaaatttaagatcctgattgagaaagtgaagaaggaatatcagaaaacaatgggcagtatggtctgcgaggtgtgtcaatacgaatgcgagacggctaaggaattggagagccacaggaaatcctgtccaatagggtcttgcccctactgtctcaacccttcggaggccaccactagcgcactgcaggcccatttcaaggtatgcaaattaacatcccggtttcaggataatctgcgtaagtcactagctgcgtatgaaccaaagcaaggatgttaccgcaccctcagtctgttcagatataggtctcggtttttcgtgggttttatctggtgcattcttttggttctggagctcgtcatctgggcagccagcgctgaaacacagaacctgaatagtggctggactgacaccgcccacgggtcaggagtggtgccgatgcgaacggatttagagctggacttcagccttccctcttccgcaagttacacctatcgcagacagttgcagaaccctgccaatgagcacgagaaaattccattccatctccaaatcagcaagcaggtcatacacgctgaaatccagcatctgggccactggatggatgccacatttaacctaaaaactgcattccattgttacggtctgtgcgaaaagtatgcgtacccctggcaaaccgctgggtgctttttcgagaaagactacgaatttgagtctggctggggatgtaatcctccagattgccccggcattgggacaggatgtactgcctgcggtgtttatctcgacaagctgaagtccgtgggcaaagtgttcaagatcatttcacttaggtacacccggaaagcatgtatccagttggggacggagcagacatgcaagagtgtagatagcaacgactgtctggtcaccacttcgataaaagtgtgcttaattggaacagtttccaagtttcagccgtctgacaccctcctgttccttggccctctggaacaaggtgggttgatctttaaacagtggtgtactaccacatgccagttcggcgatccaggagacattatgagcacgctcaccggcatgaagtgtcccgagctgaatgggtcatttcgcaagaaatgcgccttcgctactacacctgtgtgtcagtttgatggaaacaccatcagtggctataagagaatgatggccacaaaagactccttccaatctttcaatgtcactgaaccccacataagcacctccgcactagagtggatcgatccagactcaagcctgagggatcacattaacgtggttgtgagtcgtgacctctcttttcaggatctgtccgaaacgccttgccaggtagaccttacaaccagctcgatcgatggtgcttgggggtcaggagtcggcttcaatttggtgtgcactgtgtctctgaccgagtgtcccacatttttaacttccattaaggcctgcgactccgcgatgtgttacggtagcaccacaacgaacctcgtccggggccagaacaccgttcatatcgtggggaaaggaggccactctgggagcaagttcatgtgctgtcatgatactaagtgctcctcaacaggactgatagccgctgcaccacaccttgaccgagtaaccggctttaatcaagccgacagtgataaaattttcgacgatggtgctccggggtgtggaatgagctgctggtttaagaaatctggcgagtggatcctgggtgtgctaaacggcaattggctcgtcgtggccgttctgatcgcattgttcattctgtccatctttttattcactctctgttgccctagaaggcccacatataccaaggaacacaaaccatga

SEQ ID NO: 10157 - RNA, 3447 nt, synthetic construct
  misc_feature 1..3447: note = derived and/or modified CDS sequence (opt3) from PUUV(CG1820/POR)__KT885051.1__GP
  source 1..3447: mol_type = other RNA
atgggcgagctgagccccgtgtgcctctaccttctgttgcaggggttactgctatgtaacaccggagccgctagaaatctcaacgaactgaagatggagtgccctcacacaatcaggcttggtcaaggcctggtcgttgggtccgtggaattgccatctctcccgattcagcaggtagagactctgaaactggaatcaagttgtaatttcgacctccatacgagcaccgcaggacagcaatcctttacaaagtggacttgggagataaaaggcgatttagccgagaacacccaggcgtcttcgacatcattccagaccaagagcagtgaagtgaatctgcggggtctttgcttgatccccactctggtcgtggagacagctgcccgcatgcgaaaaaccattgcatgttatgacctatcctgcaaccagacggtttgtcaacctactgtgtacctcatggggccaatccagacctgcattacaactaagtcttgtctgcttagcctgggagatcagcgtatccaggtcaattatgaaaagacctactgcgtgtccggccaattggtagagggcatatgttttaaccccatccacacaatggccctctcacagcctagtcatacctatgacattatgacgatgatggttagatgcttcctggtgatcaaaaaggtcactagcggggattctatgaaaattgagaagaattttgaaacattagtgcagaaaaacggatgcaccgctaataacttccaaggttactatatctgtctgataggctcctcaagcgagccactctacgtgcccgcacttgacgattacaggagtgccgaagtcctgtctcggatggcttttgcccctcacggggaggaccatgatattgaaaagaatgcggtttccgcaatgcgcatcgccggaaaggtgactggcaaagctccaagcacagagtcgtctgacaccgtacagggtattgccttctccgggtcaccgttgtatacgagtaccggagtgctaacaagcaaggatgaccccgtctacatctgggcacctggcatcattatggagggcaaccactccatatgcgagaaaaagactctgccactcacctggacagggtttatctctctgcccggagaaattgagaaaactacccagtgtacagtgttctgcacccttgctggtcctggcgccgattgtgaagcgtatagcgaaactgggatctttaatatatcaagtccaacgtgcctgattaacagagttcagaggttccggggatccgagcaacagatcaagtttgtgtgtcagcgcgtcgacatggacatcacagtgtactgcaacggcatgaaaaaggtaattttgaccaagactctcgttatcggtcagtgtatttataccttcacaagcatattctctctgatccccggggtggcccactcattagcagtcgagctgtgcgtgccgggcctacatggatgggctaccatgctcctgcttttgactttttgtttcggctgggtcctgattcctacaatcacgatgatcctcctgaaaattcttatagcctttgcttacctgtgcagtaagtataataccgatagcaaattccgaatcttgattgaaaaggtgaaaagagagtaccaaaagactatggggtccatggtttgcgaagtgtgtcagtacgagtgcgaaacagccaaggagctcgagtctcacaggaaatcgtgtagcatcggatcctgcccctattgtctgaacccatcagaagcaaccacaagtgccttacaggctcattttaaggtatgcaaactgacttctcggttccaggagaatctacgtaagagcctcaccgtctacgaacctatgcaaggttgttatcgcacgctgtccctttttagatacaggtcacggttctttgtgggcttggtttggtgcgtgctgctcgtcctggagttaattgtgtgggcggcaagcgccgagacccagaacctgaatgctgggtggacagacactgcccacggatctggcatcatacccatgaaaaccgatcttgaattggacttctccctcccaagtagcgcatcttatacataccgacgccagctgcagaaccccgccaatgagcaagaaaagatcccttttcacctacagctgtccaagcaggtaattcatgctgagatccaacacctcggtcattggatggatgccactttcaacctgaaaaccgcatttcactgttatgggtcatgcgaaaagtacgcgtacccatggcagacggctggctgtttcattgagaaagactatgagtacgaaacaggatggggctgcaatccgcccgattgccctggggtgggaaccggttgtactgcctgcggcgtttatcttgacaagttgaaaagtgtcgggaaggtgttcaagatcgtgagcctgagatacacaaggaaagtctgtatacagttaggaaccgagcagacttgcaagaccgttgattcgaacgactgtctcattacaacgtccgtgaaagtgtgcctgatcggcaccatttctaagtttcaaccaagcgatactcttctgttcttgggtcccctccagcaagggggcctgatctttaaacagtggtgtacaaccacatgccagttcggagaccctggcgacataatgtcaactccaaccgggatgaagtgtcccgaactaaatggaagttttcggaaaaagtgcgcattcgccacgacaccggtatgtcagtttgatggcaacaccatctccggttataagcgcatgattgctactaaagactctttccagagctttaatgtcaccgagcctcatatctccacatcagccctggaatggattgatccagacagcagtctcagagatcacatcaacgtgatagtttctagggacctgtccttccaggatcttagcgagactccctgccaaattgacttggcaaccgcttcgatcgatggggcctggggatcaggcgtgggttttaatctggtctgcacagtgtctttaacggagtgtagtgcgttcctcacctccatcaaggcctgcgacgctgcaatgtgttacggcagcactacagccaacctggttcgtgggcagaacaccattcacatcgtgggaaaaggcgggcattctggaagcaagtttatgtgctgtcacgatactaaatgctcctcaacaggccttgtagctgccgcacctcatctggaccgggtcaccggttataatcaggcggatagtgacaagattttcgacgatggggcccccgaatgtggaatgagctgctggttcaagaaatctggcgagtggatactaggtgtgctcaacggcaattggatggtggtcgctgttctggtggtattgctgatcttatccattctcctgtttacgctttgttgcccacgaagaccttcatacaggaaggaacacaaaccctga

SEQ ID NO: 10158 - RNA, 3447 nt, synthetic construct
  misc_feature 1..3447: note = derived and/or modified CDS sequence (opt3) from PUUV(DTK/Ufa-97)__AB297666.2__GP
  source 1..3447: mol_type = other RNA
atgggcgagctgagccccgtgtgcctctaccttctgttgcaggggttactgctatgtaacaccggagccgctagaaatctcaacgaactgaagatggagtgccctcacacagtcaggcttggtcaaggcctggttgtggggtccgtagaattgccatctctcccgatccaacaggtggagactctgaaactggaatcaagttgtaatttcgacctccatacgagcaccgcaggacagcagtcctttacaaagtggacttgggagattaaaggcgatttagccgagaacacccaggcgtcttcgacatcattccagaccaagagcagtgaagtcaatctgcggggtctttgcttgatacccactctggtggttgagacagctgcccgcatgcgaaaaaccatcgcatgttatgacctatcctgcaaccagacggtgtgtcaacctactgtctacctcatggggccaattcagacctgcatcacaactaagtcttgtctgcttagcctgggagatcagcgtattcaggtgaattatgaaaagacctactgcgtatccggccaattggttgagggcatctgttttaaccccatacacacaatggccctctcacagcctagtcatacctatgacatcatgacgatgatggtgagatgcttcctggtcattaaaaaggtgactagcggggattctatgaaaatcgagaagaattttgaaacattagtgcagaaaaacggatgcaccgctaataacttccaaggttactatatttgtctgatcggctcctcaagcgagccactctacgtccccgcacttgacgattacaggagtgccgaagttctgtctcggatggcttttgcccctcacggggaggaccatgatatagaaaagaatgcggtgtccgcaatgcgcattgccggaaaggtaactggcaaagctccaagcacagagtcgtctgacaccgtgcagggtatcgccttctccgggtcaccgttgtatacgagtaccggagtcctaacaagcaaggatgaccccgtgtacatttgggcacctggcatcatcatggagggcaaccactccatttgcgaaaagaagactctgccactcacctggacagggtttatatctctgcccggagagatcgagaaaactacccagtgtacagttttctgcacccttgctggtcctggcgccgattgtgaagcgtatagcgaaactgggatttttaatatctcaagtccaacgtgcctgataaacagagtgcagaggttccggggatccgagcaacagattaagtttgtctgtcagcgcgtggacatggacatcacagtatactgcaacggcatgaaaaaggttatcttgaccaagactctcgtgattggtcagtgtatctataccttcacaagcattttctctctgatacccggggtcgcccactcattagcagtggagctgtgcgtcccgggcctacatggatgggctaccatgctcctgcttttgactttttgtttcggctgggtgctgatccctacaattacgatgatcctcctgaaaatccttattgcctttgcttacctgtgcagtaagtataataccgatagcaaattccgaatattgatcgaaaaggttaaaagagagtaccaaaagactatggggtccatggtgtgcgaagtatgtcagtacgagtgcgaaacagccaaggagctcgagtctcacaggaaatcgtgtagcattggatcctgcccctattgtctgaacccatcagaagcaaccacaagtgccttacaggctcattttaaggtctgcaaactgacttctcggttccaggagaatctacgtaagagcctcaccgtgtacgaacctatgcaaggttgttatcgcacgctgtccctttttagatacaggtcacggttctttgttggcttggtgtggtgcgtcctgctcgtgctggagttaatcgtatgggcggcaagcgccgagacccagaacctgaatgctgggtggacagacactgcccacggatctggcattatccccatgaaaaccgatcttgaattggacttctccctcccaagtagcgcatcttatacataccgacgccagctgcagaaccccgccaatgagcaagaaaagataccttttcacctacagctgtccaaacaggtgatccatgctgagattcaacacctcggtcattggatggatgccactttcaacctgaaaaccgcatttcactgttatgggtcatgcgaaaagtacgcgtacccatggcagacggctggctgtttcatcgagaaagactatgagtacgaaacaggatggggctgcaatccgcccgattgccctggggttggaaccggttgtactgcctgcggcgtctatcttgacaagttgaaaagtgtggggaaggtgttcaagattgtcagcctgagatacacaaggaaagtttgtatccagttaggaaccgagcagacttgcaagaccgtggattcgaacgactgtctcataacaacgtccgtgaaagtatgcctgattggcaccatctctaagtttcaaccaagcgatactcttctgttcttgggtcccctccagcaagggggcctgatttttaaacagtggtgtacaaccacatgccagttcggagaccctggcgacatcatgtcaactccaaccgggatgaagtgtcccgaactaaatggaagttttcggaaaaagtgcgcattcgccacgacaccggtctgtcagtttgatggcaacaccatatccggttataagcgcatgatcgctactaaagactctttccagagctttaatgtgaccgagcctcatatttccacatcagccctggaatggatcgatccagacagcagtctcagagatcacattaacgttatcgtgtctagggacctgtccttccaggatcttagcgagactccctgccaaatagacttggcaaccgcttcgattgatggggcctggggatcaggcgtcggttttaatctggtgtgcacagtttctttaacggagtgtagtgcgttcctcacctccatcaaggcctgcgacgctgcaatgtgttacggcagcactacagccaacctggtgcgtgggcagaacaccatccacattgtaggaaaaggcgggcattctggaagcaagtttatgtgctgtcacgatactaaatgctcctcaacaggccttgtcgctgccgcacctcatctggaccgggtgaccggttataatcaggcggatagtgacaagatcttcgacgatggggcccccgaatgtggaatgagctgctggttcaagaaatctggcgagtggattctaggtgtgctcaacggcaattggatggtcgttgctgtgctggtagtgttgctgatattatccatcctcctgtttacgctttgttgcccacgaagaccttcatacaggaaggaacacaaaccctga

SEQ ID NO: 10159 - RNA, 3447 nt, synthetic construct
  misc_feature 1..3447: note = derived and/or modified CDS sequence (opt3) from PUUV(PUU/Cg-Erft)__AJ238778.1__GP
  source 1..3447: mol_type = other RNA
atgggcaagatcattcccgtgtgcctgtacctccttttcctgtgtttgttactgtggaacagaggggacgccaggaatctaaacgagctcaaaatagaatgccctcacaccatcggactgggtcagggccttgtcattgggagcgttgagctgccaccggtgcccttgacacaagtagaatccctcaagctggagtcttcatgtaattttgatctgcatacgagtactagctcccagcagcctttcaccaaatggacatgggaaatgaagtctgacctcgctgagaacactcaggcatcgtcaaccagctttcaaacaaaaagttccgagatcaatttacggggactgtgccttgtgccacccttggtcattgaaaccgccgcgcgcactcgaaagacaatcgcttgtttcgatctgtcttgcaaccagaccgcctgtcagcctacggtgtttctaataggcccaatccagacttgcattaccacaaagagctgtctcctgggtcttggggaccaacgtatccaggttaattatgagaaaacttactgcgtgtccggacagctggtcgaaggcgtgtgtttcaaccccgtacacaccatggcattgtcacagcctagtcatacatatgatattgttaccgtgatggtcagatgctttctcatcgccaagaaagtgagcacgggcgactctatgaagctggagaaatccttcgagactttagtgcaaaagacatcatgcaccgggaatggatttcagggttactatatatgtctggtcggcagcagttctgaaccactctacattccgactcttgatgactataggtccgctgaggttctgagccggatggcattcgctccccacggggaagatcatgacgtggagaagaacgccatctcggccatgcgcattatcggaaaagtaacaggcaaggcgccttctaccgaatcctcagatacgatccagggtgtggcatttagtgggaatccattgtacaccagcacaggagtcctaactgccaaagacgatcccgtgtacatttgggctcctggcataatcatggagggcaaccactccgtttgcgacaagaaaaccctgccactcacatggactgggttcattcccctgccgggagagatcgaaaagaccacacaatgtaccgtgttttgcactcttgccggtcctggcgcagactgtgaggcttattctgaaacggggatattcaatattagctcacccacatgcctgatcaacagagtccagaggttccggggagccgagcagcagatcaaatttatttgtcaacgcgtggatatggacatcaccgtatactgcaatggcttgaagaaggttattctcactaaaaccctgataatcggtcagtgtatttatacattcaccagtatcttttccttaatcccaggggtggcgcacagcctggccgtcgaactatgcgtgcctggcctccatggatgggcaactatgctgcttttgctgacattctgttttggctggattctcatacccttcttttctatgatcctgcttaagattctgatcgctttcgcctacttgtgctcaaaatataacacggatagtaagtttaaaattctcatcgagaaggtcaagaaagagtaccagaagaccatggggagcatggtgtgcgaagtttgtcactatgagtgcgaaactgctaaagagctggaatcccatcgaaagtcttgtccaatgggatcgtgcccctactgtttaaaccctgccgaggcaacaaccagcgccctgcaggctcacttcaaagtgtgcaagctaacatccagatttcaagacaatctcaggaagtcactgggtgcgtacgagccaaaacagggctgttatcggactcttagtttgttccgttaccgctctagatttttcgtagggttcatatggtgcctgctcctggtcttagaactgatcgtgtgggcagccagcgctgagacccagaaccttaattccggatggacggataccgcccacggctcaggtattatcccgatgaggacagacttggaactcgattttagcctgccctcttccgcaagttatacttaccggcgacagctacaaaaccctgccaatgagcaggagaagattccattccatctgcagatcagcaaacaggttatacacgctgaaattcaacatctcgggcactggatggacggcacctttaacctgaagacagccttccattgttatggatcttgcgagaaatacgcatatccctggcagactgcgggctgttttatcgaaaaggattacgagtacgaatccgggtggggatgcaatcctccagactgccccggtgtgggcaccgggtgtacggcttgcggagtctatcttgataagttgaaatcagtgggcaaggccttcaaaattgtaagtctgcgctacacaagaaaggcatgtatccagttaggtaccgagcaaacttgcaaaagcgtggactcgaacgactgtctcgttacaacctccgtcaaggtgtgcctgatagggactgtgtctaaatttcagccgagcgatacccttctgttcttgggccctctcgagcagggaggcctgatctttaagcagtggtgtacaacgacctgccaattcggggacccaggagatattatgtcaactcccgtcggcatgaagtgtcctgaactaaatggtagttttaggaaaaagtgcgccttcgctacaacccccgtttgtcagtttgacgggaacacactgtccggatataaacggatgatcgccactaaggattctttccagagcttcaatgtgaccgagccacacatttccgcatcaagcctcgaatggatcgaccctgatagttctctgcgcgaccacataaacgtgattgtaggcagagatctttcctttcaggacttgagcgagacgccctgccaagtcgatctggctacaacctcgatcgacggtgcctggggctcaggggtgggattcaatttagtttgctctgtgagtctcactgaatgttccacctttctgacaagcatcaaagcgtgcgattctgccatgtgttacggcagcactaccgctaaccttctgagggggcagaatacagtccatattgtgggaaagggcggtcactccgggtcaaagttcatgtgctgtcatgacacgaaatgcagtagcaccggcctagttgcagccgctccacacctcgaccgtgtgactggatataaccaggccgattctgacaagatctttgatgacggtgcaccggagtgtggcatttcctgctggttcacaaaatcaggggagtggatactgggagtattgaacggcaattggatggtcgtggcggtgctggtcgccttatttatcctcagtattttcctgtttaccctttgttgccctcggcgacccagctacgctaaggaacacaaaccatga

SEQ ID NO: 10160 - RNA, 3447 nt, synthetic construct
  misc_feature 1..3447: note = derived and/or modified CDS sequence (opt3) from PUUV(PUUV/Konnevesi/Mg_M105A/2005)__JQ319173.1__GP
  source 1..3447: mol_type = other RNA
atgggcaagagctcccccgtgtgcctgtacctcatccttcaggggctgttgttaattggagccgtcaacgctagaaatctgaacgagctaaaaatggaatgtcctcacaccataggtctcggccaagggctggttgtgggatctgtagagcttccaccggtgcccatccagcaggtcgaatcactgaagttggagagtagctgcaatttcgacctccatacatccactgcaggccagcaatcttttacgaaatggacctgggaaacaaagtcggatctggccgagaacactcaggcgtcaagcaccagtttccagacaaaatcctctgaggtgaatctgaggggtctctgtttaattcctaccctggttgtggaaactgctgcccggatgcgcaagacaatcgcatgctatgaccttagctgtaaccagaccgtctgccaaccaacggtgtacttgatggggcccattcagacttgtctgaccacaaagtcctgcctactcggactgggcgatcagcgaatccaggtaaattatgagcgtacttactgtgtttcaggccaacttgtggaaggggtctgctttaaccctatacacaccatggccctgagtcagccaagccatacatatgacatcgtgaccgtgatggtcagatgtttcttggttattaaaaaggtgacgtctggagattccatgaaaatcgagaagaattttgagactctcgtacagaaaacaggttgcaccgctaactcattccaaggctactatatttgcctggtggggagcagttctgaacccttatacgtccctactctggacgattacaggtccgcagaggtgctcagccggatggcctttgctccacacggagaagaccatgatatcgagaagaatgccatatcggcgcttcgcattgcaggcaaggttacaggtaaagccccgtctaccgaatcctcagacacggtgcaggggatcgctttcagtggaagccccctgtatacctccacaggcgtcttgactgccaaggatgaccctgtgtacatttgggcaccaggcatcatcatggaggggaaccactctgtatgtgagaaaaagaccctacccctgacatggactggatttattcctctcccaggtgaaatagagaaaaccacacagtgcaccgttttctgtactctggctggccccggggccgattgcgaagcgtatagcgagacgggaatctttaatatttcaagtccgacatgtcttatcaacagagtgcagaggttccggggcgccgaacaacagataaagtttgtctgccagcgcgtggacatggacattaccgtctactgtaatggtgtgaaaaaggttatcctgactaagaccttggtgatcgggcagtgcatttatacattcacctccatcttcagcctcattcctggcatagcacactctctggctgtagagttatgtgtccccggactgcatggctgggccactgtgctactcctgcttacattttgcttcgggtgggttttgatcccaacgattaccatgatcctgctcaaaatcctgattgcttttgcctacctttgttcaaagtataacactgatagtaaattcaagatactggtggagaaagtcaagaaggaataccagaaaacaatgggaagcatggtgtgcgaggtatgccaatacgaatgtgagaccgcaaaggaattggagtcccaccgaaaatcttgctcgatcggtagctgtccttattgcctcaacccctccgaggccacaccatcagctctgcaggcgcattttaaggtgtgtaaattaaccagtagattccaggaaaatctgaagaagtctctaactatgtacgagcccatgcaaggctgctataggacgctcagcctgtttcggtaccgttcccgcttctttgttgggcttgtctggtgtatgttgctggtgctcgaactgattgtgtgggcagcctcagctgagacccagaacttaaatgccggatggacagacactgcacacggcagcggtatcattcctatgaaagccgatctggagcttgacttctctttgccatccagtgctagctatacctacagaaggcagctccagaacccggccaatgaacaagagaagatcccctttcatctgcagatatctaaacaggtcatccacgcagaaattcaacacctagggcattggatggatgcgacattcaacctgaagactgcttttcactgctatggctcctgtgagaaatacgcctacccttggcagaccgcaggatgcttcgttgaaaaggactatgagtacgagacgggctgggggtgtaatccacccgattgccctggagtgggtacaggctgcaccgcctgtggggtgtatctcgacaagctgaaatcagtaggaaaggtcttcaaaatcgtgagtcttcggtacactcgaaaggtttgcattcagttgggcacagaacagacctgtaaaactgtggatagcaacgactgcctgatcaccacatcggtcaaggtgtgtttaataggtacgatttccaaatttcaaccatctgataccctcctgttccttgggcccctgcagcagggcggattgatctttaagcagtggtgcactacaacctgtcaattcggcgacccgggggacattatgagcacacctactggaatgaagtgcccagagctcaatggctcatttcgcaaaaagtgtgctttcgccaccacgcccgtttgccagtttgatggtaacacaatcagtgggtataaaagaatgatagcaaccaaggactccttccagtcttttaatgtgactgaacctcatatcagcacctccgctctggagtggattgatcccgactcaagcctaagggatcacatcaacgtaattgtcagtcgggacctgtctttccaggatctctccgaaacaccatgtcaaatcgacctgactgccagcgcgatagatggagcctggggctcgggtgtgggctttaatcttgtgtgcaccatttcattgacagagtgctctacgttcctgaccagtatcaaggcttgtgacgcagccatgtgctacgggtccactacaaccaacttagtccgcggacagaatactatccacgttgtgggcaaagggggacatagcggctctaagtttatgtgttgccacgatacaaaatgtagctccaccggtctcgtagctgccgcacctcatctgaacagagtgacggggttcaaccaggcggactcagataagattttcgacgacggagcccccgagtgcggcgtcagttgttggtttaaaaagagcggtgaatgggtgcttggcgttctgaatgggaactggatggtggtcgctgtgctaatcgccctcctgattttgtctatattcctgtttgcattatgctgtccaaggcgtccgtcctataaaaaggagcacaagccttga

SEQ ID NO: 10161 - RNA, 3447 nt, synthetic construct
  misc_feature 1..3447: note = derived and/or modified CDS sequence (opt3) from PUUV(PUUV/Konnevesi/Mg_M114B/2005)__JQ319175.1__GP
  source 1..3447: mol_type = other RNA
atgggcaagagctcccccgtgtgcctgtacctcatccttcaggggctgttgttattcggagccgtcaacgctagaaatctgaacgagctaaaaatggaatgtcctcacaccattggtctcggccaagggctggttgtgggatctgtagagcttccaccggtgcccatacagcaggtcgaatcactgaagttggagagtagctgcaattttgacctccatacatccactgcaggccagcaatctttcacgaaatggacctgggaaatcaagaacgatctggccgagaatacacaggcgtcgtcaactagctttcagaccaaaagttccgaggtgaacctgaggggtctctgtttaattcctacactggttgtggaaaccgctgcccggatgcgcaagactatcgcatgctatgacctttcttgtaatcagacagtctgccaaccaaccgtgtacttgatggggcccattcagacgtgtctgactaccaagagctgcctactcggactgggcgatcagcgaatccaggtaaactatgagcgtacatactgtgtttccggccaacttgtggaaggggtctgcttcaatcctatacacactatggccctgtcacagccaagtcatacctatgacatcgtgacaattatggtgagatgttttctggtcatcaaaaaggttaccagcggagataacatgaaaattgagaagaatttcgagacgctcgtgcagaaaactggttgcacagctaactcttttcaaggctactatatctgcctggtagggtcctcaagcgaacccttatacgtgcctaccctggacgattacaggagtgcagaggtcctctctcggatggccttcgctccacacggagaagaccatgatatagagaagaatgccatttccgcgcttcgcatcgcaggcaaggtgactggtaaagccccgagcacagaatcgtctgacaccgttcaggggattgctttttccggatcacccctgtatacgagtaccggcgtgttgacagccaaggatgaccctgtctacatctgggcaccaggcatcattatggaggggaaccacagcgtgtgtgagaaaaagactctacccctgacctggacaggattcatacctctcccaggtgaaatcgagaaaactacccagtgcacagtattttgtaccctggctggccccggggccgattgcgaagcgtattccgagactggaattttcaatatctctagcccgacgtgtcttataaacagagttcagaggtttcggggcgccgaacaacagattaagttcgtgtgccagcgcgtcgacatggacatcacagtgtactgtaacggtgtcaaaaaggtgatcctgaccaagactttggttattgggcagtgcatctataccttcacatcaatttttagtctcatacctggcatcgcacactccctggctgtggagttatgtgtacccggactgcatggctgggccaccgtcctactcctgcttactttctgctttgggtgggtgttgattccaacaatcacgatgatcctgctcaaaattctgatagctttcgcctacctttgtagcaagtataataccgattctaaatttaagatcctggttgagaaagtgaagaaggaataccagaaaactatgggatcaatggtctgcgaggtgtgccaatacgaatgtgagacagcaaaggaattggagagtcaccgaaaaagctgctccattggttcttgtccttattgcctcaacccctcggaggccaccccaagcgctctgcaggcgcatttcaaggtatgtaaattaacatccagatttcaggaaaatctgaagaagtcactaactatgtacgagcccatgcaaggctgctataggaccctcagtctgttccggtaccgttctcgctttttcgtggggcttgtttggtgtatgttgctggtcctcgaactgatcgtgtgggcagccagcgctgagacgcagaacttaaatgccggatggaccgacacagcacacggctccggtattatccctatgaaagccgatctggagcttgacttttcattgccaagctctgcttcctatacttacagaaggcagctccagaacccggccaatgaacaagagaagatacccttccacttgcagatcagtaaacaggtgattcatgcagaaatccaacacctagggcattggatggatgcgacctttaacctgaagacagctttccactgctatggcagctgtgagaaatacgcctacccttggcagactgcaggatgcttcgtcgaaaaggactatgagtacgagaccggctgggggtgtaatccacccgattgccctggagttggtacgggctgcacagcctgtggggtgtatctcgacaagctgaaatctgtgggaaaggtatttaaaattgtctcccttcggtacacccgaaaggtgtgcatccagttgggcactgaacagacatgtaaaaccgttgattcaaacgactgcctgataactaccagtgtgaaggtctgtttaattggtacaatcagcaaattccaaccatcggatacgctcctgtttcttgggcccctgcagcagggcggattgattttcaagcagtggtgcaccactacatgtcaatttggcgacccgggggacatcatgtccacccctacaggaatgaagtgcccagagctcaatggctctttccgcaaaaagtgtgcttttgccactacccccgtgtgccagttcgatggtaacacgataagcgggtataaaagaatgatcgcaacaaaggactcatttcagagtttcaatgttaccgaacctcatatttccacttctgctctggagtggatcgatcccgacagctccctaagggatcacattaacgtgatcgtatcacgggacctgagctttcaggatctcagtgaaaccccatgtcaaatagacctgattgcctctgcgatcgatggagcctggggctccggtgtcggcttcaatcttgtgtgcacagtgagcttgactgagtgctcgacctttctgacatcaatcaaggcttgtgacgcagccatgtgctacgggtctacgaccattaacttaatccgcggacagaacactattcacgtcgttggcaaagggggacatagtggctccaagttcatgtgttgccacgatacaaaatgtagctctaccggtctcgtggctgccgcacctcatctggacagagtaactgggttcaatcaggcggatagcgacaagatatttgacgatggagcccccgagtgcggcgtgtcctgttggttcaaaaagtcaggtgaatgggtccttggcgtgctgaacgggaattggatggttgtggctgtcctaatcgccctcctgattttgagtatctttctgttcgcattatgctgtccaaggcgtccgagctataaaaaggagcacaagccttga

SEQ ID NO: 10162 - RNA, 3447 nt, synthetic construct
  misc_feature 1..3447: note = derived and/or modified CDS sequence (opt3) from PUUV(PUUV/Konnevesi/Mg_M78B/2005)__JQ319174.1__GP
  source 1..3447: mol_type = other RNA
atgggcaagagctcccccgtgtgcctgtacctcatccttcaggggctgttgttattcggagccgtcaacgctagaaatctgaacgagctaaaaatggaatgtcctcacaccattggtctcggccaagggctggttgtgggatctgtagagcttccaccggtgcccatacagcaggtcgaatcactgaagttggagagtagctgcaattttgacctccatacatccactgcaggccagcaatctttcacgaaatggacctgggaaatcaagaacgatctggccgagaatacacaggcgtcgtcaactagctttcagaccaaaagttccgaggtgaacctgaggggtctctgtttaattcctacactggttgtggaaaccgctgcccggatgcgcaagactatcgcatgctatgacctttcttgtaatcagacagtctgccaaccaaccgtgtacttgatggggcccattcagacgtgtctgactaccaagagctgcctactcggactgggcgatcagcgaatccaggtaaactatgagcgtacatactgtgtttccggccaacttgtggaaggggtctgcttcaatcctatacacactatggccctgtcacagccaagtcatacctatgacatcgtgacaattatggtgagatgttttctggtcatcaaaaaggttaccagcggagataacatgaaaattgagaagaatttcgagacgctcgtgcagaaaactggttgcacagctaacggctttcaagggtactatatctgcctggtaggatcttcctcagaacccttatacgtgcctaccctggacgattacaggagcgcagaggtcctcagtcggatggccttcgctccacacggcgaagaccatgatatagagaagaatgccatttctgcgcttcgcatcgcaggtaaggtgactgggaaagccccgtccacagaaagctcggacaccgttcagggaattgctttttctggctcccccttgtatacgtcaaccggcgtgttgacagccaaggatgaccctgtctacatctgggcaccagggatcattatggagggaaaccacagtgtgtgtgagaaaaagactctacccctgacctggacaggtttcatacctctcccaggcgaaatcgagaaaactacccagtgcacagtattttgtaccctggctgggcccggagccgattgcgaagcgtatagcgagactggcattttcaatatctcctctccgacgtgtcttataaacagagttcagaggtttcggggtgccaagcaacagattaaattcgtgtgccagcgcgtcgacatggacatcacagtgtactgtaacggggtcaagaaggtgatcctgaccaaaactttggttattggccagtgcatctataccttcacaagcatttttagcctcatacctggaatcgcacacagtctggctgtggaattatgtgtacccggcctgcatgggtgggccaccgtcctactcctgcttactttctgctttggatgggtgttgattccaacaatcacgatgatcctgctcaagattctgatagctttcgcctacctttgttccaaatataataccgatagcaagtttaaaatcctggttgagaaggtgaagaaagagtaccaaaagactatgggttctatggtctgcgaagtgtgccagtacgagtgtgaaacagcaaaagagttggaatcacaccgaaagagttgcagcattggctcctgtccttattgcctcaacccctctgaggccaccccatcggctctgcaggcgcatttcaaagtatgtaagttaacaagcagatttcaggagaatctgaagaaatccctaactatgtacgaacccatgcaagggtgctataggaccctctcactgttccggtaccgtagtcgctttttcgtgggacttgtttggtgtatgttgctggtcctcgagctgatcgtgtgggcagcctctgctgaaacgcagaacttaaatgccggctggaccgacacagcacacggtagcgggattatccctatgaaggccgatctggagcttgacttttccttgccatcaagcgcttcttatacttacagaaggcagctccagaacccggccaatgagcaagaaaagatacccttccatctgcagatctccaaacaggtgattcacgcagagatccaacacctaggccattggatggatgcgacctttaacctgaaaacagctttccactgctatggaagttgtgaaaagtacgcctacccttggcagactgcaggctgcttcgtcgagaaggactatgaatacgagaccgggtggggatgtaatccacccgattgccctggtgttggcacggggtgcacagcctgtggagtgtatctcgacaaactgaagtcagtgggcaaagtatttaagattgtctctcttcggtacacccgaaaagtgtgcatccagttgggtactgagcagacatgtaagaccgttgattccaacgactgcctgataactacctcagtgaaagtctgtttaattgggacaatcagtaagttccaaccaagcgatacgctcctgtttcttggccccctgcagcagggaggcttgattttcaagcagtggtgcaccactacatgtcaatttggggacccgggagacatcatgtcgacccctacaggcatgaaatgcccagaactcaatggttccttccgcaagaaatgtgcttttgccactacccccgtgtgccagttcgatgggaacacgatatctggatataagagaatgatcgcaacaaaagacagctttcagtcattcaatgttaccgagcctcatattagtacttccgctctggaatggatcgatcccgactctagcctaagggatcacattaacgtgatcgtatcccgggacctgtcatttcaggatctcagcgagaccccatgtcaaatagacatgacagccagtgcgattgatggcgcctggggttctggcgtcgggttcaatctggtgtgcactgtgtcccttaccgaatgcagcacatttttgacgtcgatcaaggcttgtgacgcagccatgtgctacggatcaaccactacaaacctggtccgcggccagaacaccatccacgttgtggggaagggaggccattctggtagtaaattcatgtgttgccacgatactaagtgttccagcaaagggttagtagctgccgcacctcatctcgacagagtgacaggattcaatcaggcggattctgacaagatttttgacgatggcgcccccgagtgcggtgtcagctgttggttcaaaaagtccggcgagtgggtgctgggggttcttaacggaaattggatggtggtcgctgtgctgatcgccctactcattctgtcaatatttttgttcgcactgtgctgtccaaggcgtccgagttataagaaagaacacaagccttga

SEQ ID NO: 10163 - RNA, 3447 nt, synthetic construct
  misc_feature 1..3447: note = derived and/or modified CDS sequence (opt3) from PUUV(PUUV/Konnevesi/Mg_O78A/2005)__JQ319172.1__GP
  source 1..3447: mol_type = other RNA
atgggcaagagctcccccgtgtgcctgtacctcatccttcaggggctgttgttattcggagccgtcaacgctagaaatctgaacgagctaaaaatggaatgtcctcacaccattggtctcggccaagggctggttgtgggatctgtagagcttccaccggtgcccatacagcaggtcgaatcactgaagttggagagtagctgcaattttgacctccatacatccactgcaggccagcaatctttcacgaaatggacctgggaaatcaagtcggatctggccgagaacacacaggcgtcaagcaccagttttcagactaaatcctctgaggtgaatctgaggggtctctgtttaattcctacactggttgtggaaaccgctgcccggatgcgcaagactatcgcatgctatgaccttagctgtaaccagacagtctgccaaccaaccgtgtacttgatggggcccattcagacgtgtctgactaccaagtcctgcctactcggactgggcgatcagcgaatccaggtaaattatgagcgtacatactgtgtttcaggccaacttgtggaaggggtctgcttcaaccctatacacactatggccctgagtcagccaagccatacctatgacatcgtgacaattatggtgagatgttttctggtcatcaaaaaggttacctctggagattccatgaaaattgagaagaatttcgagacgctcgtgcagaaaactggttgcacagctaactcatttcaaggctactatatctgcctggtagggagcagttctgaacccttatacgtgcctaccctggacgattacaggtccgcagaggtcctcagccggatggccttcgctccacacggagaagaccatgatatagagaagaatgccatttcggcgcttcgcatcgcaggcaaggtgactggtaaagccccgtctacagaatcctcagacaccgttcaggggattgcttttagtggaagccccctgtatacgtccaccggcgtgttgacagccaaggatgaccctgtctacatctgggcaccaggcatcattatggaggggaaccactctgtgtgtgagaaaaagactctacccctgacctggacaggattcatacctctcccaggtgaaatcgagaaaactacccagtgcacagtattttgtaccctggctggccccggggccgattgcgaagcgtatagcgagactggaattttcaatatctcaagtccgacgtgtcttataaacagagttcagaggtttcggggcgccgaacaacagattaagttcgtgtgccagcgcgtcgacatggacatcacagtgtactgtaatggtgtcaaaaaggtgatcctgaccaagactttggttattgggcagtgcatctataccttcacatccatttttagcctcatacctggcatcgcacactctctggctgtggagttatgtgtacccggactgcatggctgggccaccgtcctactcctgcttactttctgctttgggtgggtgttgattccaacaatcacgatgatcctgctcaaaattctgatagctttcgcctacctttgttcaaagtataacaccgatagtaaatttaagatcctggttgagaaagtgaagaaggaataccagaaaactatgggaagcatggtctgcgaggtgtgccaatacgaatgtgagacagcaaaggaattggagtcccaccgaaaatcttgctcgattggtagctgtccttattgcctcaacccctccgaggccaccccatcagctctgcaggcgcatttcaaggtatgtaaattaacaagtagatttcaggaaaatctgaagaagtctctaactatgtacgagcccatgcaaggctgctataggaccctcagcctgttccggtaccgttcccgctttttcgtggggcttgtttggtgtatgttgctggtcctcgaactgatcgtgtgggcagcctcagctgagacgcagaacttaaatgccggatggaccgacacagcacacggcagcggtattatccctatgaaagccgatctggagcttgacttttctttgccatccagtgctagctatacttacagaaggcagctccagaacccggccaatgaacaagagaagatacccttccacttgcagatctctaaacaggtgattcatgcagaaatccaacacctagggcattggatggatgcgacctttaacctgaagacagctttccactgctatggctcctgtgagaaatacgcctacccttggcagactgcaggatgcttcgtcgaaaaggactatgagtacgagaccggctgggggtgtaatccacccgattgccctggagttggtacgggctgcacagcctgtggggtgtatctcgacaagctgaaatcagtgggaaaggtatttaaaattgtcagtcttcggtacacccgaaaggtgtgcatccagttgggcactgaacagacatgtaaaaccgttgatagcaacgactgcctgataactacctcggtgaaggtctgtttaattggtacaatctccaaattccaaccatctgatacgctcctgtttcttgggcccctgcagcagggcggattgattttcaagcagtggtgcaccactacatgtcaatttggcgacccgggggacatcatgagcacccctacaggaatgaagtgcccagagctcaatggctcattccgcaaaaagtgtgcttttgccactacccccgtgtgccagttcgatggtaacacgataagtgggtataaaagaatgatcgcaacaaaggactcctttcagtctttcaatgttaccgaacctcatattagcacttccgctctggagtggatcgatcccgactcaagcctaagggatcacattaacgtgatcgtaagtcgggacctgtcttttcaggatctctccgaaaccccatgtcaaatagacctgacagccagcgcgattgatggagcctggggctcgggtgtcggcttcaatcttgtgtgcactatctcattgaccgagtgctctacatttctgacgagtatcaaggcttgtgacgcagccatgtgctacgggtccaccactacaaacttagtgcgcggacagaataccattcacgtcgttggcaaagggggacatagcggctctaagttcatgtgttgccacgatactaaatgtagctccacaggtctcgtggctgccgcacctcatctgaacagagtaaccgggttcaaccaggcggactcagataagatctttgacgacggagcccccgagtgcggcgtgagttgttggttcaaaaagagcggtgaatgggtccttggcgtgctgaatgggaactggatggttgtggctgtcctaattgccctcctgatattgtctatctttctgttcgcattatgctgtccaaggcgtccgtcctataaaaaggagcacaagccttga

SEQ ID NO: 10164 - RNA, 3447 nt, synthetic construct
  misc_feature 1..3447: note = derived and/or modified CDS sequence (opt3) from PUUV(PUUV/Pieksamaki/human_kidney/2008)__JN831951.1__GP
  source 1..3447: mol_type = other RNA
atgggcaagagctcccccgtgtgcctgtacctcatccttcaggggctgttgttattcggagccgtcaacgctagaaatctgaacgagctaaaaatggaatgtcctcacaccattggtctcggccaagggctggttgtgggatctgtagagcttccaccggtgcccatacagcaggtcgaatcactgaagttggagagtagctgcaattttgacctccatacatccactgcaggccagcaatctttcacgaaatggacctgggaaatcaagtcggatctggccgagaacacacaggcgtcaagcaccagttttcagactaaatcctctgaggtgaatctgaggggtctctgtttaattcctacactggttgtggaaaccgctgcccggatgcgcaagactatcgcatgctatgaccttagctgtaaccagacagtctgccaaccaaccgtgtacttgatggggcccattcagacgtgtctgactaccaagtcctgcctactcggactgggcgatcagcgaatccaggtaaattatgagcgtacatactgtgtttcaggccaacttgtggaaggggtctgcttcaaccctatacacactatggccctgagtcagccaagccatacctatgacgtggtgacaatcatggtcagatgttttctggttattaaaaaggtgacctctggagattccatgaaaatcgagaagaatttcgagacgctcgtacagaaaactggttgcacagctaacaattttcaaggctactatatttgcctggtggggtcaagcagtgaacccttatacgtccctaccctggacgattacaggtctgcagaggtgctctcccggatggccttcgctccacacggagaagaccatgatatcgagaagaacgccataagcgcgcttcgcattgcaggcaaggttactggtaaagccccgtcgacagaatcttccgacaccgtgcaggggatcgctttttcaggaagtcccctgtatacgagcaccggcgtcttgacagccaaggatgaccctgtgtacatttgggcaccaggcatcatcatggaggggaatcactccgtatgtgagaaaaagactctacccctgacctggacaggattcattcctctcccaggtgaaatagagaaaactacccagtgcacagtgttttgtaccctggctggccccggggccgattgcgaagcgtattctgagactggaatcttcaacattagctcaccgacgtgtcttatcaatagagttcagaggtttcggggcgccgaacaacagataaagttcgtctgccagcgcgtggacatggacattacagtctactgtaacggtgtgaaaaaggttatcctgaccaagactttggtgatcgggcagtgcatttataccttcacaagtatcttttccctcattcctggcatagcacacagcctggctgtagagttatgtgtccccggactgcatggctgggccaccgtgctactcctgcttactttctgctttgggtgggttttgatcccaacaattacgatgatcctgctcaaaatcctgattgctttcgcctacctttgttctaagtataacaccgattcaaaatttaagatactggtggagaaagtcaagaaggaataccagaaaactatgggaagtatggtgtgcgaggtatgccaatacgaatgtgagacagcaaaggaattggagagccaccgaaaatcctgctctatcggttcgtgtccttattgcctcaatcccagcgaggccaccccatccgctctgcaggcgcatttcaaggtgtgtaaattaacatcaagatttcaggaaaacctgaagaagagtctaactatgtacgagcccatgcaaggctgctataggaccctctctctgttccggtaccgtagccgctttttcgttgggcttgtctggtgtatgttgctggtgctcgaactgattgtgtgggcagcctccgctgagacgcagaatttaaacgccggatggaccgacacagcacacggctcaggtatcattcctatgaaagccgatctggagcttgactttagcttgccatcttccgctagttatacttacagaaggcagctccagaatccggccaacgaacaagagaagatccccttccacttgcagataagcaaacaggtcatccatgcagaaattcaacacctagggcattggatggatgcgacctttaatctgaagacagctttccactgctatggctcttgtgagaaatacgcctacccttggcagactgcaggatgcttcgttgaaaaggactatgagtacgagaccggctgggggtgtaacccacccgattgccctggagtgggtacgggctgcacagcctgtggggtgtatctcgacaagctgaaatccgtaggaaaggtctttaaaatcgtgtcacttcggtacacccgaaaggtttgcattcagttgggcactgaacagacatgtaaaaccgtggatagtaatgactgcctgatcactaccagcgtcaaggtgtgtttaataggtacaatttcgaaattccaaccatccgatacgctcctgtttcttgggcccctgcagcagggcggattgatcttcaagcagtggtgcaccactacatgtcaatttggcgacccgggggacattatgtctacccctacaggaatgaagtgcccagagctcaacggcagcttccgcaaaaagtgtgcttttgccactacccccgtttgccagttcgatggtaatacgatctcagggtataaaagaatgatagcaacaaaggacagttttcagtccttcaacgtgaccgaacctcatatctctactagcgctctggagtggattgatcccgactcctcactaagggatcacatcaatgtaattgtcagccgggacctgagttttcaggatctctctgaaaccccatgtcaaatcgacctgacagcctccgcgatagatggagcctggggcagcggtgtgggcttcaaccttgtgtgcactatttcgttgaccgagtgctcaacatttctgacgtctatcaaggcttgtgacgcagccatgtgctacgggagtaccactacaaatttagtccgcggacagaacaccatccacgttgtgggcaaagggggacattccggcagcaagttcatgtgttgccacgatactaaatgttctagcacaggtctcgtagctgccgcacctcatctggacagagtgaccgggttcaaccaggcggattccgacaagatttttgacgatggagcccccgagtgcggcgtctcatgttggttcaggaaaagtggtgaatgggtgcttggcgttctgaatgggaactggatggtggtcgctgtgctaatcgccctcctgattttgagcatatttctgttcgcattatgctgtccacgtcggccgtcttataagaaagagcacaagccttga

SEQ ID NO: 10165 - RNA, 3447 nt, synthetic construct
  misc_feature 1..3447: note = derived and/or modified CDS sequence (opt3) from PUUV(Samara_49/CG/2005)__AB433850.2__GP
  source 1..3447: mol_type = other RNA
atgggcaagctgagccccgtgtgcctctaccttctgttgcaggggttactgctatgtaaaaccggaacagccagaaacctcaatgagctgaagatggaatgccctcacactatcggtcttggccaagggctggtcgttggatccgtggagttgccaccggtacccattcaacaggtggaaacgctcaaactggagtcttcatgtaacttcgacctgcataccagtacagctggccagcaagcatttactaagtggacctgggaaataaaaggtgatctcgccgagaatacacaggcgagctccacctctttccagactaagtcgtcagaggtcaacttaagggggctgtgccttatccctacattggtgattgaaaccgctgcccggatgcgcaagacgatcgcatgttatgacctgagctgcaatcagactgtttgtcaaccaaccgtgtacctaatgggacccattcagacatgcatcactaccaaaagttgtctcctgggccttggcgatcagcgaatacaggtcaactatgagaagacatactgcgtgtccgggcaactggtagaaggagtttgttttaatcctatccacaccatggccttgtctcagccaagccatacgtatgacattgtgactatgatggtccgttgcttcctcgtgatcaaaaaggtgacatccggtgattcaatgaaaattgagaagaactttgagaccctggtccagaagaatggctgcactgctaacagtttccaagggtactatatctgtttaataggatctagctccgaacccctgtacgttcctacactcgacgattacagatcagcagaggtgcttagcaggatggcctttgctccacacggcgaagaccatgatgtagagaaaaatgccattagtgcgctgcggatcgcaggtaaggtgaccgggaaagccccgtctacggaatccagcgacaccgtccagggaattgctttctcgggctctcccttgtatacatccactggcgtgctaaccgccaaggatgaccctgtttacatctgggcaccagggatcattatggagggaaaccactcagtgtgcgagaaaaagacactgcccctcacttggaccggttttataagtctgcctggcgaaatcgagaaaacaacccagtgtactgtcttctgcacgcttgctgggccaggagccgattgtgaagcgtatagcgagacaggcatttttaatatctcctctccgacctgcctgataaaccgcgtgcagagattcaggggtgccgaacaacagattaagtttgtatgtcagcgggttgacatggacatcactgtgtactgcaatggggtcaagaaagtgatcttgaccaagacactcgtcattggccagtgtatctataccttcactagcattttctcactgatacccggagtggcacacagtttagctgttgagctgtgcgtgcctggcctacatgggtgggccacaatgctcctgcttttgacgttttgtttcggatgggtactgatccccaccattactatgatcctcctgaaaatccttattgcttttgcctacctgtgctccaagtataacacagatagcaaattccgcatattgatcgagaaggtcaagcgagaataccagaaaaccatgggttctatggtgtgcgaggtttgtcagtacgaatgcgagacagcaaaggaactcgagtcacacaaaaagagttgtagcattggctcctgcccatattgtctgaacccttctgaggccactacctcggctttacaggcgcattttaaagtgtgcaagctgacgagcagattccaggaaaatctaaggaagtccctcaccgtctacgagcccatgcaagggtgttatcggacactgtcactttttcgttaccgcagtagattctttgtgggattggtatggtgcgtgctgctcgttctggaattaatcgtctgggcagcctctgctgagactcagaacctgaatgccggctggaccgacacagcacacggtagcgggattatcccaatgaaaactgatcttgagttggacttctccctcccctcaagcgcctcttatacctacaggcggcagctgcagaaccctgctaatgaacaagagaacataccatttcacctacagatctccaaacaggtgattcatgccgaaatccaacacctgggccattggatggatgcaacgttcaatctcaagacagcgtttcactgttatggaagttgcgagaagtacgcttacccgtggcagaccgccggctgtttcgtggaaaaagactatgagtacgagactgggtggggatgcaatccccctgattgcccaggtgtcggcacagggtgtaccgcatgcggagcctatctggacaaacttaagagcgttggcaaggtgttcaagattgtgtctttgcgatacactcgcaaagtatgtatccagctgggtaccgaacagacatgcaagacggtcgattccaacgactgtttaataaccacttcagtgaaagtttgcctcattgggacaatcagtaagtttcaacccagcgataccctgcttttcctgggccctttgcagcagggaggcctcatttttaaacagtggtgtacaactacctgccaattcggggacccaggagacatcatgtcgacgcccacaggcatgaagtgtccggatctgaacggttcctttagaaagaaatgcgctttcgccaccactcctgtgtgtcagtttgacgggaataccatatctggatataagaggatgatcgcaacaaaagatagcttccagtcatttaacgtcactgagccacatattagtgcttccgccctagaatggatcgaccccgattctagcctgcgggaccacattaatgtgatcgtttcccgcgatctctcattccaggacctgagcgagaccccttgccaaatagatcttagtacagcgtctattgacggcgcctggggttccggcgtggggtttaacttggtatgcacggtcagcctgaccgaatgttcggctttcttaacttcaatcaaggcatgcgatgccgctatgtgttacggatctacaaccgccaatctcatcagaggccagaacactattcacatcgtggggaaaggaggccatagtggttccaagtttatgtgctgtcacgacacaaagtgcagcaccacggggctggtggcagcggctccccatcttgatagggtcactggatataaccaggccgactctgacaaaattttcgatgacggcgccccagagtgtggtatgagctgctggttcaagaaatccggcgagtggatactgggggttctaaatggaaactggatggtggtagcagtgctcatcgctctgttggtcctgtcaattttactctttaccctgtgttgccctcgtcggcccagttaccgaaaggaacacaaaccatga

SEQ ID NO: 10166 - RNA, 3447 nt, synthetic construct
  misc_feature 1..3447: note = derived and/or modified CDS sequence (opt3) from PUUV(Samara_94/CG/2005)__AB433852.2__GP
  source 1..3447: mol_type = other RNA
atgggcaagctgagccccgtgtgcctctaccttctgttgcaggggttactgctatgtaacaccggaacagccagaaatctcaacgagctgaaaatcgaatgccctcacactattggtcttggccaagggctggtcgttggatccgtggagttgccaccggtacccatacaacaggtggaaacgctcaagctggagtcttcatgtaatttcgacctgcataccagtacagctggccagcaagcatttactaaatggacctgggaaatcaagggtgatctcgccgagaacacacaggcgagctccacctctttccagactaaatcgtcagaggtcaatttaagggggctgtgccttattcctacattggtgatcgaaaccgctgcccggatgcgcaagacgattgcatgttatgacctgagctgcaaccagactgtttgtcaaccaaccgtgtacctaatgggacccatccagacatgcataactaccaagagttgtctcctgggccttggcgatcagcgaatccaggtcaattatgagaaaacatactgcgtgtccgggcaactggtagaaggagtttgttttaaccctattcacaccatggccttgtctcagccaagccatacgtatgacatcgtgactatgatggtccgttgcttcctcattatcaagaaagtgacatccggtgattcaatgaagatagagaaaaattttgagaccctggtgcagaagaacgactgcactgctaatagtttccaaggctactatatttgttttatcgggtcatcttccgaacccttatacgtccctacactggatgactacagatcagcagaggttctcagcaggatggccttcgctccacacggagaagatcatgacgtggagaagaacgccattagtgcgcttcggatcgcaggcaaagtaaccggtaaggccccgtctacggaatccagcgataccgtgcaggggatcgctttttcgggatctcccctgtatacatccactggcgtcttggccgcaaaagacgatcctgtgtacatttgggctccaggcataatcatggaggggaatcactcaatttgcgagaagaaaaccctacccctgacatggactggattcatcagtctccctggtgaaatagagaagaccacacagtgtaccgtgttttgcactctggccggcccaggggcggactgtgaagcctatagcgagacgggaattttcaacatctcctctcccacatgccttatcaatcgcgttcagagatttaggggcgcagaacaacagattaaattcgtctgtcagcgggtggacatggatatcaccgtatactgcaacggtgttaagaaggtgattctgactaaaaccttggtcatagggcagtgtatctatacattcaccagcatttttagcctcatcccgggcgtggctcacagtctggccgtcgagttatgcgtgcctggactgcatggctgggctactatgctactcctgcttacattctgttttgggtgggttttgatccccacgattaccatgatactgctcaagatcctgattgccttcgcatacctttgctccaaatataacactgacagcaagtttcgcatcctgattgagaaagtgaagaaggaataccagaaaacaatgggatctatggtatgcgaggtctgtcagtacgaatgcgagaccgccaaggaattggagtcacaccgaaaaagttgtagcatcggttcctgcccatattgtctcaatccttctgaggctacaacttcggcgctgcaggcacatttcaaggtgtgcaaattaaccagcagatttcaggaaaacctgaggaagtccctaacggtttacgagcccatgcaaggctgttatcggaccctctcactgttccgttaccgcagtagatttttcgtggggcttgtctggtgcgtgttgctggtactcgaactgatagtgtgggccgcttctgccgagacacagaatttaaacgcaggatggactgataccgcccacggcagcggtatcattccaatgaagacagacctggagcttgatttttccttgccctcaagcgcttcttatacttacaggcggcagctccagaatcctgccaacgaacaagagaatatcccattccatctgcagatttccaaacaggttatccacgcagaaatacaacacctagggcattggatggacgcgacctttaacctgaagacggctttccactgttatggcagttgcgagaaatacgcctacccgtggcagacagcaggatgtttcgtcgaaaaggattatgagtacgagaccggctgggggtgcaatccccctgactgcccaggagtgggtactggctgtacagcctgcggggcttatctcgataaacttaagagcgtgggaaaggtctttaaaattgtttctctgcgatacacccgcaaggtgtgtatccagttgggcactgaacagacctgcaaaacagtggactccaacgattgtctgattacgacctcagtaaaggtctgcttaatcggtactataagtaaattccaacccagcgacacactcctgtttcttgggcctctgcagcagggcggattgatcttcaagcagtggtgtaccacaacttgccaatttggcgacccaggggatattatgtcgacccccacgggaatgaaatgtccggacctcaatggctccttcagaaagaagtgcgcctttgcaacaacccctgtgtgtcagttcgatggtaacactatctctgggtataaaaggatgattgctaccaaggacagctttcagtcattcaatgttacagagccacatatcagtgcctccgcgctggaatggatagatcccgactctagcctacgggatcacattaacgtgatcgtctcccgcgacctgtcatttcaggatctcagcgagactccttgccaaatcgacctgagtaccacatctattgatggagcctggggctccggtgtgggcttcaatcttgtttgcacggtgagcttgaccgaatgttcggcttttctgacttcaatcaaagcatgcgacgccgctatgtgttacgggtctacaaccgccaacttaattagaggacagaacactatacacatcgtaggcaaagggggacatagtggctccaagttcatgtgctgtcacgatacaaagtgcagcaccacgggtctcgtcgcagcggctccccatctggacagggtgactgggtataatcaggccgactctgataagattttcgacgatggagccccagagtgtggcatgagctgctggtttaaaaagtccggtgagtggatccttggcgtgctgaacgggaattggatggtcgttgcagtgctaattgctctcctggtattgtcaatcctgttattcaccctctgttgccctcgtcggcccagttaccgaaaagaacacaagccatga

SEQ ID NO: 10167 - RNA, 3447 nt, synthetic construct
  misc_feature 1..3447: note = derived and/or modified CDS sequence (opt3) from PUUV(Sotkamo)__NC_005223.1__GP
  source 1..3447: mol_type = other RNA
atgggcaagagctcccccgtgtgcctgtacctcatccttcaggggctgttgttattcgacaccgtcaacgccaaaaatctgaacgagctaaagatggaatgtcctcacacaattggactcggtcaaggcctggttgtggggtctgtagagcttccaccggtgcccatacagcagatcgaatcactgaaattggagagtagctgcaattttgatctccatacttccacggctggacagcaatctttcaccaagtggacatgggaaactaaaggcgacctggcagagaacacccaggcctcgtcaaccagctttcagacaaagagttccgaggtcaatctgagaggtctctgtttaattcctactctggtggttgaaacagcggctaggatgcggaagaccatcgcctgctatgatctttcttgtaaccagacggtgtgccaaccaactgtctacttgatggggcccattcagacctgtctgacaactaaaagctgcctactcggactgggcgaccagcgcatccaggtgaattatgagcgaacctactgtgtatccggccaacttgttgaaggggtgtgcttcaaccctatacacacaatggcactgtcacagccaagtcatacctatgatatcgtcacgattatggtgcgttgttttcttgtgatcaagaaagtcactagcggagactctatgaagattgagaaaaatttcgagacactcgttcagaagaccggttgcactgccaacggctttcaagggtactatatctgcctgataggatcctcaagcgaacccttatacgtgcctacactggatgactacagaagtgctgaggtactctctaggatggcattcgccccacacggcgaagatcatgacattgagaagaatgctgtgtccgcccttcggatcgcgggtaaagtcaccgggaaggcaccgagcacggaatcgtctgataccgtgcagggaattgccttttccggctcacccctgtatacaagtactggcgttttgaccgctaaagacgatcctgtgtacgtctgggccccagggatcatcatggagggaaaccacagcgtgtgtgagaagaaaacactacccctgacttggaccggtttcattcctctcccaggcgaaatagagaagacaacccagtgcactgtattttgtacgctggcagggcccggagctgactgcgaagcctattccgagacaggcatcttcaatatttctagcccgacctgtcttatcaaccgcgttcagagatttaggggtgcggaacaacagataaaattcgtgtgccagcgggtcgacatggatattactgtgtactgtaatggggtcaagaaggtgatcctgaccaaaacattggttatcggccagtgcatttataccttcacttcaatctttagtatgattcctggaatagcccactccctcgcagtggagctgtgtgtacccggcttacatgggtgggctacagtcctgctactcctgacgttctgctttggatgggtgcttatcccaaccattactatgatcttgctgaagatcctcattgccttcgcttacctgtgtagcaaatataacacagactctaagtttcgcatacttgttgagaaagtgaagaaggaataccagaaaaccatgggttcaatggtctgcgaggtgtgccaatacgaatgtgagacagccaaggaactggagagtcaccgaaaaagctgctccatcggctcttgtccttattgcttgaacccctcggaggcaactccaagcgccctccaggctcatttcaaggtatgtaaactgacctccagatttcaggaaaatttaaagaagtcactgacgatgtacgagcccatgcaagggtgctataggaccctaagtctcttccggtaccgttctcgctttttcgtgggactggtttggtgtatgcttttggtcctggaactcattgtgtgggcggcaagcgccgagacacagaacctgaatgatggctggactgacaccgctcacggttccgggatcattcctatgaaagccgatttagagctggacttttcacttccaagctctgcatcctatacatacagaaggcagttgcagaacccggccaatgaacaagagaagatccccttccacctccagataagtaaacaggtgatccatgctgaaattcaacacctgggccattggatggatgccacttttaacctaaagaccgcattccactgctatggaagctgtgagaaatacgcgtacccttggcagacggctggctgcttcgtcgaaaaggactatgagtacgagacagggtggggatgtaatccacccgattgccctggtgttggcaccgggtgcactgcctgtggagtgtatctggacaagctcaaatctgtgggcaaggtatttaaaatcgtctccctgcggtacacacgaaaggtgtgcattcagcttggtaccgggcagacttgtaaaaccgttgattcaaacgactgcttgatcacaacgagtgtgaaggtctgtctgataggcaccattagcaaattccaaccatcggacactttactctttctgggaccccttcagcagggcgggctgatcttcaagcagtggtgcacaaccacatgtcaatttggagatccgggcgacattatgtccactcctaccggtatgaagtgcccagaattgaatgggtctttccgcaaaaagtgtgcatttgccacgacacccgtgtgccagttcgatggaaacaccatcagcggctataaaagaatggttgctactaaggactcatttcagagtttcaatgtgaccgagcctcatatatccacatctgccctcgaatggatcgatctggacagctccctaagggatcacattaacgtaatcgtctcacgggacctgagctttcaggatctcagtgagactccctgtcaagtggacctgaccacatctgcaacggatggtgcttggggctccggggtgggattcaatcttgtctgcaccgttagcttgactgaatgctcggcctttctgacatcaattaaagcgtgtcacgccgctatgtgctacggctctaccactacaaacttagtgcgcgggcagaataccatccatgtagtgggaaagggcggtcacagtgggtccaagttcatgtgttgccatgacacgaaatgtagctctactggactcgtcgcagccgctccacacctggatagagtgaccggcttcaaccaggccgacagcgacaagatatttgatgacggtgcacctgagtgcggcatgtcctgttggttcaaaaagttgggggagtgggttctgggagtgctaaacggcaattggatggtcgtggcggttctcattgccctgttgatcctgtcaatctttttattcgctctctgctgtcccaggcgtccaagttataaaaaggatcacaagccgtga

SEQ ID NO: 10168 - RNA, 3447 nt, synthetic construct
  misc_feature 1..3447: note = derived and/or modified CDS sequence (opt3) from PUUV(2009)__HE801634.1__GP
  source 1..3447: mol_type = other RNA
atgggcaagagctcccccgtgtgcctgtacctcatccttcaggggctgttgttattcgacaccgtcaacgccagaaatctgaacgagctaaaaatggaatgtcctcacacaattggactcggtcaaggcctggttgtggggtctgtagagcttccaccggtgcccatacagcagatcgaatcactgaagttggagagtagctgcaattttgatctccatacttccacggctggacagcaatctttcaccaaatggacatgggaaactaagggcgacctggcagagaacacccaggcctcgtcaaccagctttcagacaaaaagttccgaggtcaatctgaggggtctctgtttaattcctactctggtggttgaaacagcggctcggatgcgcaagaccatcgcctgctatgatctttcttgtaaccagacggtgtgccaaccaactgtctacttgatggggcccattcagacctgtctgacaactaagagctgcctactcggactgggcgaccagcgaatccaggtgaattatgagcgtacctactgtgtatccggccaacttgttgaaggggtgtgcttcaaccctatacacacaatggcactgtcacagccaagtcatacctatgatatcgtcacgattatggtgagatgttttctggtgatcaaaaaggtcactagcggagactctatgaaaattgagaagaatttcgagacactcgttcagaaaaccggttgcactgccaacggctttcaagggtactatatctgcctgataggatcctcaagcgaacccttatacgtgcctacactggatgactacaggagtgctgaggtactctctcggatggcattcgccccacacggcgaagatcatgacattgagaagaatgctgtgtccgcccttcgcatcgcgggtaaggtcaccgggaaagcaccgagcacggaatcgtctgataccgtgcagggaattgccttttccggctcacccctgtatacaagtactggcgttttgaccgctaaggacgatcctgtgtacgtctgggccccagggatcatcatggagggaaaccacagcgtgtgtgagaaaaagacactacccctgacttggaccggtttcattcctctcccaggcgaaatagagaaaacaacccagtgcactgtattttgtacgctggcagggcccggagctgactgcgaagcctattccgagacaggcatcttcaatatttctagcccgacctgtcttatcaacagagttcagaggtttcggggtgcggaacaacagataaagttcgtgtgccagcgcgtcgacatggatattactgtgtactgtaatggggtcaaaaaggtgatcctgaccaagacattggttatcggccagtgcatttataccttcacttcaatctttagtctcattcctggaatagcccactccctggcagtggagttatgtgtacccggcctgcatgggtgggctacagtcctactcctgcttacgttctgctttggatgggtgttgatcccaaccattactatgatcctgctcaaaatcctgattgccttcgcttacctttgtagcaagtataacacagactctaaatttaagatactggttgagaaagtgaagaaggaataccagaaaaccatgggttcaatggtctgcgaggtgtgccaatacgaatgtgagacagccaaggaattggagagtcaccgaaaaagctgctccatcggctcttgtccttattgcctcaacccctcggaggcaactccaagcgccctgcaggctcatttcaaggtatgtaaattaacctccagatttcaggaaaatctgaagaagtcactaacgatgtacgagcccatgcaagggtgctataggaccctcagtctgttccggtaccgttctcgctttttcgtgggacttgtttggtgtatgttgctggtcctcgaactgattgtgtgggcggcaagcgccgagacacagaacttaaatgctggctggactgataccgcccacggttccgggatcattcctatgaaagcagacctggagcttgatttttcattgccaagctctgcctcctatacatacagaaggcagctccagaacccggctaatgaacaagagaagatccccttccacttgcagataagtaaacaggtgatccatgccgaaattcaacacctaggccattggatggacgcaacttttaacctgaagaccgcgttccactgctatggaagctgtgagaaatacgcttacccttggcagacggccggctgcttcgtcgaaaaggattatgagtacgagacagggtggggatgtaatccacccgactgccctggtgttggcaccgggtgcactgcatgtggagtgtatctcgataagctgaaatctgtgggcaaggtatttaaaatcgtctcccttcggtacacacgaaaggtgtgcattcagttgggtaccgaacagacttgtaaaaccgttgactcaaacgattgcctgatcacaacgagtgtgaaggtctgtttaatagggaccattagcaaattccaaccatcggacactctcctgtttcttggccccctgcagcagggaggcttgatcttcaagcagtggtgcacaaccacatgtcaatttggggacccgggagatattatgtccactcctaccggcatgaagtgcccagagctcaatggttctttccgcaaaaagtgtgcctttgctacgacacccgtgtgccagttcgacgggaacaccatcagcggatataaaagaatggttgccactaaggattcatttcagagtttcaatgtgaccgaacctcatatatccacatctgcactggagtggatcgaccccgatagctccctaagggaccacattaacgtaatcgtctcacgggatctgagctttcaggacctcagtgaaactccatgtcaagtggatctgaccacatctgctattgacggcgcctggggttccggcgtggggttcaatcttgtctgcacggttagcttgaccgagtgctcggcgtttctgacttcaatcaaagcctgtgatgctgcaatgtgctacggatctacaaccactaacttagtgcgcggccagaatacaatacacgtagtggggaagggaggccatagtggttccaagttcatgtgttgccacgacaccaaatgtagctctacggggctcgtcgccgctgcccctcatctggatagagtgactggattcaaccaggcagacagcgacaagatttttgatgacggcgcgcccgagtgcggtatgtcctgttggttcaaaaagttaggcgaatgggttctgggggtgctaaacggaaattggatggtcgtggccgttctcatcgctctgttgatcctgtcaatttttcttttcgccctctgctgtccaaggcgtccgagttataaaaaggagcacaagccttga

SEQ ID NO: 10169 - RNA, 3447 nt, synthetic construct
  misc_feature 1..3447: note = derived and/or modified CDS sequence (opt3) from PUUV(Umea/hu)__AY526218.1__GP
  source 1..3447: mol_type = other RNA
atgggcaagctgagccccgtgtgcctctaccttttcctgcagtgtttgttactgtggtccagagggtctgccaggaacctaaatgagctcaaaatggaatgccctcacaccatcggactgggtcaaggccttgtcattgggtcagttgagctgccaccggtgcccgtacaacaggtggaaagtttgaagctcgagagctcctgtaactttgacctgcatacatctactgctacgcagcaatcgttcaccaaatggacatgggaaatgaaggatgacctggcagagaatactcaggcctcaagcaccagttttcagacaaaatcctctgaggtcaacctccggggattatgcctgatacctccacttgtggttgaaaccgcgagccgcactcgaaagacaatcgcttgtttcgatatttcctgcaatcagaccgtgtgtcaacccacggtctatttggtgggccctatccagacttgcattaccacaaagtcatgtctgctaggtctcggggaccagcgtatccaggtaaactacgagaaaacttattgcgttagtggacaactggtggaaggcgtctgttttaatccagtgcacaccatggtgcttagccagccctctcatacatacgatatagtcaccatgatggttagatgcttcctggtggtaaagaaagtgacgtccggcgactcaatgaagatcgagaaaaacttggagactctcgtccagaagacagattgcaatgccaacgggtttcaaggatattacatttgtctggtgggtagcagttctgaacctttatatgttccaaccctggacgattacaggtccgcagaggtgctcagccggatggccttcgctccgcacggcgaagaccatgatatcgagcgcaatgcagtctcggcccttagaattgtggggaaggtaactggaaaagctccctctacagaagcctccgacaccatccagggcatagcgttttcaggtagtcctctgtacacgagcaccggggttttgacagcaaaggataacccagtgtatgtctggtcccccggaattatcatggagggcaatcactctgtgtgcgagaaaaagactctacctctgacctggacaggcttcattccactccccggggaaatcggaaaaactagccagtgtaccgtcttttgcacactggccggtccgggcgctgactgtgaggcctactcagaaaccgggatcttcaacattagttcccctacttgccttataaatagggcacagcggtttcgcggagctgagcaacagatcaagttcgtgtgtcagcgagttgacatggatattacggtgtattgcaacggcatgaaaaaggtaatcctgacaaagaccttggtcataggtcagtgtatttacactttcaccagcatcttttctctcatccccgggattgcccactcactggcggtggaattatgcgttccaggcctgcatggatgggccacagtgctactcctgcttaccttctgttttggctggatcttgattcctttcatagcaatgatcagtctgaaaattctcatcgcttttgcctatctgtgcagcaagtacaacactgactccaaattcaagatccttattgagaaagtcaagaaggagtatcagaaaacaatggggtctatggtgtgcgaagtatgtcagtacgagtgcgaaacggctaaggagctggaatcgcacagaaaaagctgtcccataggatcctgcccatactgtttgaatccctcagaggccaccactagcgcactccaggcccattttaaggtgtgcaaactgacatctagggttcaggataacttacggaagagtctggctgcgtatgagcctaagcaaggttgttaccgtaccctatccctcttccgctatagatcaaggtttttcgtcggctttatctggtgcattctgcttgtgttggaactgatcatttgggcagccagcgctgagacacagaatctcaactctgggtggactgacaccgcccacggatccggcatcataccaatgcggacggatctggaattagacttcagtctgccgagctctgcatcctacacctatcgacgccagcttcagaatcccgccaacgagcacgagaaaatcccttttcatttgcaaatttcaaaacaggtgatccacgctgaaattcagcatctcggtcactggatggatgccacattcaatctgaagactgcattccattgttacgggagttgcgagaagtatgcgtacccatggcaaaccgctggctgctttttcgaaaaagactacgagtttgaaagctcgtggggatgtaatccccctgattgcccaggcgtcgggacaggatgtactgcctgcggtgtttatctagacaagctgaagtccgtgggcaaagtgttcaagatcatatctctcagatacaccaggaaagcatgtattcagctggggacggagcagacatgcaagagcgtagattcaaacgactgtcttgtcaccacaagtgtgaaagtttgcttgatcggaactgtgtccaagtttcagccctctgacaccctgttattcctcggcccgctggagcaaggtgggcttatttttaaacagtggtgtactaccacatgccagttcggcgatcctggagacatcatgagcacgccaaccggcatgaagtgtcccgaactgaacgggtcctttcggaagaaatgcgccttcgctactacacctgtctgtcagtttgatggaaataccatatcaggctataagcgcatgatcgccacaaaagacagcttccaaagttttaacgtgactgatccccacatttctacctccgcattggagtggatcgacccagatagctcgctcagagaccacattaatgttgtggtatcaagggatctgtctttccaggacctaagtgaaacgccttgccaggtcgatctgacaacctccagcatcgacggtgcttgggggtctggagtgggcttcaacctcgtgtgcactgtcagcctgaccgagtgttccacatttcttacttcaataaaggcctgcgatagtgcgatgtgttacggtagcaccacaattaatttgatgcgtggccagaacacggttcatatcgtggggaaaggaggccactctgggtccaagttcatgtgctgtcatgacaccaagtgctcaagtactggactggtagccgctgcaccccacttagaccgggtgacaggctttaaccaagccgatagcgacaaaatcttcgatgacggtgctccagaatgtgggatgtcctgctggtttaagaaatctggagagtggattctcggcgtcctgaatggtaactggcttgtggttgccgtgctggtcgcactattcatcctctcgatttttctgttcaccttgtgttgcccgcgaagacctatatatgcgaaggagcacaaaccctga

SEQ ID NO: 10170 - RNA, 3447 nt, synthetic construct
  misc_feature 1..3447: note = derived and/or modified CDS sequence (opt3) from PUUV(P360)__L08755.1__GP
  source 1..3447: mol_type = other RNA
atgggcgagctgagccccgtgtgcctctgtcttctgttgcaggggttactgctatgcaacaccggagccgctagaaatctcaacgaactgaagatggagtgtcctcacacaatcaggcttggtcaaggcctggtcgttgggtccgtggaattgccatctctcccgattcagcaggtagagactctgaaactggaatcaagttgcaatttcgacctccatacgagcaccgcaggacagcaatcctttacaaagtggacttgggagataaaaggcgatttagccgagaacacccaggcgtcttcgacatcattccagaccaagagcagtgaagtgaatctgcggggtctttgtttgatccccactctggtcgtggagacagctgcccgcatgcgaaaaaccattgcatgctacgacctatcctgtaaccagacggtttgccaacctactgtgtatctcatggggccaatccagacctgtattacaactaagtcttgcctgcttagcctgggagatcagcgtatccaggtcaattacgaaaagacctattgtgtgtccggccaattggtagagggcatatgctttaaccccatccacacaatggccctctcacagcctagtcatacctacgacattatgacgatgatggttagatgcttcctggtgatcaaaaaggtcactagcggggattctatgaaaattgagaagaattttgaaacattagtgcagaaaaacggatgtaccgctaataacttccaaggttattacatctgcctgataggctcctcaagcgagccactctatgtgcccgcacttgacgattacaggagtgccgaagtcctgtctcggatggcttttgcccctcacggggaggaccatgatattgaaaagaatgcggtttccgcaatgcgcatcgccggaaaggtgactggcaaagctccaagcacagagtcgtctgacaccgtacagggtattgccttctccgggtcaccgttgtacacgagtaccggagtgctaacaagcaaggatgaccccgtctatatctgggcacctggcatcattatggagggcaaccactccatatgtgagaaaaagactctgccactcacctggacagggtttatctctctgcccggagaaattgagaaaactacccagtgcacagtgttctgtacccttgctggtcctggcgccgattgcgaagcgtacagcgaaactgggatctttaatatatcaagtccaacgtgtctgattaacagagttcagaggttccggggatccgagcaacagatcaagtttgtgtgccagcgcgtcgacatggacatcacagtgtattgtaacggcatgaaaaaggtaattttgaccaagactctcgttatcggtcagtgcatttacaccttcacaagcatattctctctgatccccggggtggcccactcattagcagtcgagctgtgtgtgccgggcctacatggatgggctaccatgctcctgcttttgactttttgcttcggctgggtcctgattcctacaatcacgatgatcctcctgaaaattcttatagcctttgcttatctgtgcagtaagtacaataccgatagcaaattccgaatcttgattgaaaaggtgaaaagagagtatcaaaagactatggggtccatggtttgtgaagtgtgccagtacgagtgtgaaacagccaaggagctcgagtctcacaggaaatcgtgcagcatcggatcctgtccctactgcctgaacccatcagaagcaaccacaagtgccttacaggctcattttaaggtatgtaaactgacttctcggttccaggagaatctacgtaagagcctcaccgtctatgaacctatgcaaggttgctaccgcacgctgtccctttttagatataggtcacggttctttgtgggcttggtttggtgtgtgctgctcgtcctggagttaattgtgtgggcggcaagcgccgagacccagaacctgaatgctgggtggacagacactgcccacggatctggcatcatacccatgaaaaccgatcttgaattggacttctccctcccaagtagcgcatcttacacatatcgacgccagctgcagaaccccgccaatgagcaagaaaagatcccttttcacctacagctgtccaagcaggtaattcatgctgagatccaacacctcggtcattggatggatgccactttcaacctgaaaaccgcatttcactgctacgggtcatgtgaaaagtatgcgtacccatggcagacggctggctgcttcattgagaaagactacgagtatgaaacaggatggggctgcaatccgcccgattgtcctggggtgggaaccggttgcactgcctgtggcgtttaccttgacaagttgaaaagtgtcgggaaggtgttcaagatcgtgagcctgagatatacaaggaaagtctgcatacagttaggaaccgagcagacttgtaagaccgttgattcgaacgactgcctcattacaacgtccgtgaaagtgtgtctgatcggcaccatttctaagtttcaaccaagcgatactcttctgttcttgggtcccctccagcaagggggcctgatctttaaacagtggtgcacaaccacatgtcagttcggagaccctggcgacataatgtcaactccaaccgggatgaagtgccccgaactaaatggaagttttcggaaaaagtgtgcattcgccacgacaccggtatgccagtttgatggcaacaccatctccggttacaagcgcatgattgctactaaagactctttccagagctttaatgtcaccgagcctcatatctccacatcagccctggaatggattgatccagacagcagtctcagagatcacatcaacgtgatagtttctagggacctgtccttccaggatcttagcgagactccctgccaaattgacttggcaaccgcttcgatcgatggggcctggggatcaggcgtgggttttaatctggtctgtacagtgtctttaacggagtgcagtgcgttcctcacctccatcaaggcctgtgacgctgcaatgtgctatggcagcactacagccaacctggttcgtgggcagaacaccattcacatcgtgggaaaaggcgggcattctggaagcaagtttatgtgttgccacgatactaaatgttcctcaacaggccttgtagctgccgcacctcatctggaccgggtcaccggttacaatcaggcggatagtgacaagattttcgacgatggggcccccgaatgcggaatgagctgttggttcaagaaatctggcgagtggatactaggtgtgctcaacggcaattggatggtggtcgctgttctggtggtattgctgatcttatccattctcctgtttacgctttgctgtccacgaagaccttcatataggaaggaacacaaaccctga

SEQ ID NO: 10171 - RNA, 3447 nt, synthetic construct
  misc_feature 1..3447: note = derived and/or modified CDS sequence (opt3) from MUV(11-1)__JX028272.1__GP
  source 1..3447: mol_type = other RNA
atgggcaagatcagccccgtgtacctgtatctccttttccaggggctgttgttatggagagacggactggccaggaacctaaatgagctcaaaatggaatgccctcacaccattggtctgggccaagggcttgtcataggatccgttgagctgccaccggtgcccttgcggcaggtagaatctctcaagctggagtcaagttgtaactttgatctgcatacaagcactgctacgcagcagtccttcaccaaatggatctgggaatctaagaatgacctcacagattcgactcaagcatcaagcaccagttaccagacaaaatccaccgaggtgaacttaaagggcctgtgccttgtccctactttggtgattgagacagccgcgcgcacccgaaagacgatcgcttgttttgacctgtcttgcaatcagactgtttgtcagccaaccgtgtatctaattggtcccatccaaacatgcataactaccaaaagctgtctcatcgggctgggagatcagcgtattcaggtcaactacgaaaagacatattgcgtgtccggccagcttgtagagggcgtttgtttcaatcctatccacaccatggccctgtcacaaccaagtcatacgtacgacgtggtcactatgatggtgagatgctttttggtggtcaaaaaggttacaagcggggattctatgaaaattgaaaagaacttcgagaccctcgtgcagaagactggatgttccaataacaattttcagggttattacgtatgcctgatcggctcaagcagtgagcccttatacgtgcctacactggacgattataggtctgcagaaatactctcccggatggccttcgctccacacggggaggaccatgatattgaacgcaacgcaatcagcgccatgagaattgtcggaaaagtgaccggcaaggctccgtcgtctgagtcctcagacacggttcaaggtgtggcctttagtgggaatcccctttacaccagcacaggagtcctgacttccaaagatgaccctgtgtatgtatgggcgccaggcatcatcatggaaggcaaccactctgtttgcgacaagaaaaccttgcccctaacatggactgggtacattcctctgccaggagagatagagaagaccacacagtgtaccgtgttctgcactctcgcaggtcccggcgccgattgtgaggcttatagcgagacggggatctttaatatttcaagtccgacatgcctgatcaacagggtccagcggttccgcggagccgaacagcaaataaaatttgtgtgtcagcgagtcgacatggatattaccgtgtactgcaacggcatcaagaaggttatccttactaaaaccctggtgattggtcagtgtatctatacattcacctccattttcagcttgatgcctggggtagcacactctctcgctgtcgagctgtgcgtgcccggcttacatggatgggccactatgctgctactcctgacattttgtttcggctggatacttatcccaacgattaccttgatcctgctcaagatcctgcttgcgtttgcctacgtttgctcaaaatacaatactgacagtaagttcaaaattctgatagaaaaggtgaagcaggagtatcaaaagacaatggggagcatggtctgtgaggtgtgccagcacgaatgcgagaccgcaaaggaattggagtcccataaaaagtcttgtcctatcggatcgtgcccctactgtctcaacccagctgaagccacaactagcgctctgcaggcccactttaaagtatgcaagttaacctccagattccaggagaatctgaggaagtcactaacggtgtatgagcccaaacaaggttgttaccggaccctcagtctgtttcgttatcgctctagatgcttcgttggccttatttggtgtatcttgctgacactcgaactgattgtctgggcagccagcgctgagactttaaacctgaatcctgggtggaccgatacagcgcacggatccggcatcgtgccaatgaagactgaccttgaattggatttttcactcccgagctctgcatcctacacctataggcggagtctgcagaaccccgccaatgagcaggaacaggtgcctttccatctacaaatagaaaaacaggtcatccacgctgagattcagcatctgggtcactggatggacgccacgtttaacctcaagacagcattccattgctacggggcctgtgaaaaatacgcttatccatggcaaaccgccggctgctttgttgagaaggatttcgagttcgaaaatggatggggctgtaatccccctgactgcccaggggtgggaactggttgcacagcatgtggcgcgtacctggataaacttaaaagcgtggggaaggtatttaaaatcgtctctttgcgatatacccgcaaggcttgcattcagctgggaactgagcagacctgtaaaaatgtggactccaacgactgcttagttacaacgtcagtgaaggtctgtctcatcggcaccataagtaaattccagcccagcgatactctgctttttctgggtccgttggaacaagggggcattatcttcaagcagtggtgcacaaccacatgtcagtttggagaccctggcgatattatgtcgactccaatcgggatgaagtgccccgagctcaatggatccttcagaaagaagtgttcttttgccaccacgcctgtgtgccagttcgacggcaacacaataagcggttacaaaaggatgatcgcaaccaaggattcatttcaaagtttcaatgttactgaaccccacatttccgcctctgctctggagtggatcgacccagatagctccctacgggaccacattaacgtggtagtcgggcgcgatctgccttttcaggacctctcagaaaccccctgtcagatcgatctgagcacaagttctatagacggagcctggggctccggtgtgggcttcaaccttgtgtgcagcgtctcgttgactgagtgctttaccttcctgaactcaattaaagcatgtgatacagctatgtgctatgggtctacgaccgccaacttagttagaggacagaatactgtgcatgtagtgggcaaagggggacacagtggctccaagttcatgtgttgccatgacacaaaatgtagcaacaccggtctcctggcggccgctccacaccttgacagggtcactgggtacaatcaagcagattctgacaaggtgtttgatgacggagccccggagtgcggcatgacatgttggttcaaaaagagcggtgaatggatcatgggcgttctgtccgggaactggatggtggtcgctgtgctaatcaccctcctggttttgtcaatttttctgttcgccttatgctgtcctcgtcgggcagcgtataaaaaggagcacaagccctga

SEQ ID NO: 10172 - RNA, 3447 nt, synthetic construct
  misc_feature 1..3447: note = derived and/or modified CDS sequence (opt3) from MUV(11-4)__JX046483.1__GP
  source 1..3447: mol_type = other RNA
atgggcaagattagccccgtgtacctgtgcctccttctgcaggggttgttactgtggagagacggactagccaggaacctcaatgagctgaaaatggaatgtcctcacaccattggtcttggccaagggctggtcataggatccgttgagttgccaccggtgcccctccggcaggtagaatctctgaagctggagtcaagttgcaacttcgatctccatacaagcactgctacgcagcagtcctttaccaaatggatctgggaatctaagaatgacttaacagattcgactcaagcatcaagcaccagttatcagacaaaatccaccgaggtgaacctgaagggcctttgtttggtccctactctggtgattgagacagccgcgcgcacccgaaagacgatcgcttgcttcgacctatcttgtaatcagactgtttgccagccaaccgtgtacctcattggtcccatccaaacatgtataactaccaaaagctgcctgatcgggcttggagatcagcgtattcaggtcaactatgaaaagacatactgtgtgtccggccagctggtagagggcgtttgctttaatcctatccacaccatggccttgtcacaaccaagtcatacgtatgacgtggtcactatgatggtgagatgtttcctcgtggtcaaaaaggttacaagcggggattctatgaaaattgaaaagaactttgagaccctggtgcagaagactggatgctccaataacaatttccagggttactatgtatgcttaatcggctcaagcagtgagcccctgtacgtgcctacactcgacgattacaggtctgcagaaatactttcccggatggcctttgctccacacggggaggaccatgatattgaacgcaacgcaatcagcgccatgagaattgtcggaaaagtgaccggcaaggctccgtcgtctgagtcctcagacacggttcaaggtatcgccttcagtgggaatcccctgtataccagcacaggagtgttgacttccaaagatgaccctgtctacgtgtgggcgccaggcatcattatggaaggcaaccactctgtatgtgacaagaaaaccctacccctgacatggactgggtatatacctctcccaggagagatcgagaagaccacacagtgcaccgttttctgtactctggcaggtcccggcgccgattgcgaggcttacagcgaaacggggattttcaatatctcaagtccgacatgtcttataaacagggtgcagcggtttcgcggagccgaacagcaaattaaattcgtctgccagcgagtggacatggatatcaccgtctattgtaacggcatcaagaaggtgattctgactaaaaccttggttatcggtcagtgcatttacacatttacctccatattcagcctcatgcctggggtggcacactctctggctgtagagttatgtgtccccggcctgcatggatgggccactatgctactcctgcttacattctgctttggctggatcttgattccaacgatcaccctgatcctcctgaagattcttctggcgttcgcctatgtgtgttcaaaatacaatactgacagtaagtttaaaatattgatcgaaaaggttaagcaggagtaccagaaaacaatggggagcatggtgtgcgaggtctgccaacacgaatgtgagaccgcaaaggaactcgagtcccataaaaagtcttgccctattggatcgtgtccctattgcctgaacccagctgaagccacaactagcgctttacaggcccacttcaaagtgtgtaagctgacctccagatttcaggagaatctaaggaagtcactcacggtatacgagcccaaacaaggttgctatcggaccctgagtcttttccgttaccgctctagatgttttgtgggcttgatctggtgcattctgctcacactggaattaatcgtttgggcagccagcgctgagactctgaaccttaatcctgggtggaccgatacagcgcacggatccggcatagtcccaatgaggactgacttggaactcgatttctcactgccgagctctgcatcctatacctaccggcgaagtctacagaaccccgccaatgagcaggagcagatcccttttcatctgcaaattgaaaaacaggtgatccacgctgagattcagcatctcggtcactggatggacgccacgttcaacctgaaaacagcatttcattgttatggggcctgcgaaaagtacgcttacccatggcaaaccgccggctgtttcgtggagaaagattttgaatttgagaatggatggggctgcaatccccctgactgcccaggggtcggaactggttgtacagcatgcggcgcgtatcttgataagttaaagagcgttgggaaagtgttcaagatcgtgtctctgcgctacaccagaaaggcttgtatacagttaggaactgagcagacctgcaagaacgtagactccaacgactgtctcgtcacaacgtcagtgaaagtttgcctgattggcaccatcagtaagtttcagcccagcgatactcttctgttcttgggtccgctcgaacaagggggcattatctttaaacagtggtgtacaaccacatgccagttcggagaccctggcgatataatgtcgactccaatcgggatgaagtgtcccgagctgaatggatcctttaggaagaaatgctctttcgccaccacgcctgtgtgtcagtttgacggcaacacaattagcggttataagcggatgatcgcaaccaaagattcattccaaagttttaatgtcactgaaccccacatttccgcctctgctctagagtggatcgacccagatagctccctgcgcgaccacataaacgtggttgtggggagagatctccctttccaggacctgtcagaaaccccctgccagattgatcttagcacaagttctatcgacggagcctggggctccggtgtaggctttaacttggtctgcagcgtgtcgctgactgagtgttcaaccttcttaacatctatcaaggcatgcgatacggctatgtgttacgggagtaccactgccaatctcgtgaggggacagaacacagtccatgttgtgggcaaagggggacactccggcagcaagtttgtatgctgtcatgacaccaagtgctctaatactggtctgcttgcggccgctccacacctggaccgtgtgacagggtataaccaagcagatagcgacaaagtcttcgatgacggagccccggagtgtggcatgacctgctggttcaagaaatccggtgaatggattatgggcgtgctatcagggaattggatggttgtggctgtcctcatcacgctgttggtgctgagtatctttttgttcgccctctgttgccctcggcgagcagcgtacaagaaagagcacaagccctga

SEQ ID NO: 10173 - RNA, 3447 nt, synthetic construct
  misc_feature 1..3447: note = derived and/or modified CDS sequence (opt3) from MUV(11-5)__JX046486.1__GP
  source 1..3447: mol_type = other RNA
atgggcaagatcagccccgtgtacctgtgcctccttctgcaggggttgttactgtggagagacggactagccaggaacctcaatgagctgaaaatggaatgtcctcacaccattggtcttggccaagggctggtcataggatccgttgagttgccaccggtgcccctccggcaggtagaatctctgaagctggagtcaagttgcaacttcgatctccatacaagcactgctacgcagcagtcctttaccaaatggatctgggaatctaagaatgacttaacagattcgactcaagcatcaagcaccagttatcagacaaaatccaccgaggtgaacctgaagggcctttgtttggtccctactctggtgattgagacagccgcgcgcacccgaaagacgatcgcttgcttcgacctatcttgtaatcagactgtttgccagccaaccgtgtacctcattggtcccatccaaacatgtataactaccaaaagctgcctgatcgggcttggagatcagcgtattcaggtcaactatgaaaagacatactgtgtgtccggccagctggtagagggcgtttgctttaatcctatccacaccatggccttgtcacaaccaagtcatacgtatgacgtggtcactatgatggtgagatgtttcctcgtggtcaaaaaggttacaagcggggattctatgaaaattgaaaagaactttgagaccctggtgcagaagactggatgctccaataacaatttccagggttactatgtatgcttaatcggctcaagcagtgagcccctgtacgtgcctacactcgacgattacaggtctgcagaaatactttcccggatggcctttgctccacacggggaggaccatgatattgaacgcaacgcaatcagcgccatgagaattgtcggaaaagtgaccggcaaggctccgtcgtctgagtcctcagacacggttcaaggtatcgccttcagtgggaatcccctgtataccagcacaggagtgttgacttccaaagatgaccctgtctacgtgtgggcgccaggcatcattatggaaggcaaccactctgtatgtgacaagaaaaccctacccctgacatggactgggtatatacctctcccaggagagatcgagaagaccacacagtgcaccgttttctgtactctggcaggtcccggcgccgattgcgaggcttacagcgaaacggggattttcaatatctcaagtccgacatgtcttataaacagggtgcagcggtttcgcggagccgaacagcaaattaaattcgtctgccagcgagtggacatggatatcaccgtctattgtaacggcatcaagaaggtgattctgactaaaaccttggttatcggtcagtgcatttacacatttacctccatattcagcctcatgcctggggtggcacactctctggctgtagagttatgtgtccccggcctgcatggatgggccactatgctactcctgcttacattctgctttggctggatcttgattccaacgatcaccctgatcctcctgaagattcttctggcgttcgcctatgtgtgttcaaaatacaatactgacagtaagtttaaaatattgatcgaaaaggttaagcaggagtaccaaaagacaatggggagcatggtgtgcgaggtctgccagcacgaatgtgagaccgcaaaggaactcgagtcccataaaaagtcttgccctattggatcgtgtccctattgcctgaacccagctgaagccacaactagcgctttacaggcccacttcaaagtgtgtaagctgacctccagatttcaggagaatctaaggaagtcactcacggtatacgagcccaaacaaggttgctatcggaccctgagtcttttccgttaccgctctagatgttttgtgggcttgatctggtgcattctgctcacactggaattagttgtctgggcagccagcgctgagactctgaaccttaatcctgggtggaccgatacagcgcacggatccggcatcgtgccaatgaggactgacttggaactcgatttctcactgccgagctctgcatcctatacctaccggcgaagtctacagaaccccgccaatgagcaggagcagataccttttcatctgcaaatcgaaaaacaggtgattcacgctgagatccagcatctcggtcactggatggacgccacgttcaacctgaaaacagcatttcattgttatggggcctgcgaaaagtacgcttacccatggcaaaccgccggctgtttcgtcgagaaagattttgaatttgagaatggatggggctgcaatccccctgactgcccaggggttggaactggttgtacagcatgcggcgcgtatcttgataagttgaaaagcgtggggaaagtgttcaagattgtatctctgcgctacaccagaaaggcttgtatccagttaggaactgagcagacctgcaagaacgtcgactccaacgactgtctcgtgacaacgtcagttaaagtgtgcctgataggcaccattagtaagtttcagcccagcgatactcttctgttcttgggtccgctcgaacaagggggcatcatttttaaacagtggtgtacaaccacatgccagttcggagaccctggcgatatcatgtcgactccaatagggatgaagtgtcccgagctgaatggatcctttaggaagaaatgctctttcgccaccacgcctgtctgtcagtttgacggcaacacaatcagcggttataagcggatgattgcaaccaaagattcattccaaagttttaatgtgactgaaccccacatctccgcctctgctctagagtggattgacccagatagctccctgcgcgaccacatcaacgttgtggtagggagagatctccctttccaggacctgtcagaaaccccctgccagatagatcttagcacaagttctattgacggagcctggggctccggtgtcggctttaacttggtgtgcagcgtgtcgctgactgagtgttcaaccttcttaacatctatcaaggcatgcgatacggctatgtgttacgggagtaccactgccaatctcgtcaggggacagaacacagttcatgtggtaggcaaagggggacactccggcagcaagtttgtgtgctgtcatgacaccaagtgctctaatactggtctgcttgcggccgctccacacctggaccgtgtcacagggtataaccaagcagatagcgacaaagtgttcgatgacggagccccggagtgtggcatgacctgctggttcaagaaatccggtgaatggatcatgggcgttctatcagggaattggatggtggtcgctgtgctcattacgctgttggttctgagtatctttttattcgccctctgttgccctcggcgagcagcgtacaagaaagagcacaagccctga

SEQ ID NO: 10174 - RNA, 3408 nt, synthetic construct
  misc_feature 1..3408: note = derived and/or modified CDS sequence (opt3) from SANGV(SA14)__NC_034516.1__GP
  source 1..3408: mol_type = other RNA
atgatcatgtggggcctgctccttctggccgctattaccttcccctgccagagcttgaagaacgtgtacgacatgaaaatagagtgtcctcactccgtcaattttggggaatcttcagttatgggaaaggtgcaattaccaagtctgagcatcacagaggcagaacagctagtaccggagtcctcttgcaacatggataatcatcagtcgctctcagtgctgcagaaagccactaagacgacctggagaaagaaggcggaccacagcaacgctggtaaggatagttatgaacttattacatccgagatccaattcaaaggcgtctgttctctgactcataagatgattgaggaaagccacaggttgcggcgctccgtgatctgctacgacctctcatgtaataccacacattgcaaacccaccctgtatatggttgtgcctgtccacagttgtaacatgatgaaaagctgcctgatagggctcggaccataccgaatccaggtggtatatgagcgtacttactgtacagttggcgtgttaaatgaaggtaaatgctttgtccccgatcagtctgtggccaacattgtgaagaatgggatcttcgacattgtctccgttcagatcatatgtttcttcattagaatcaagggatcaacctataaaattctggagacggtgaagactgcaatgaacggcaaatgcaatggcaccgatgacaaggtacaagggtactacatctgccttttgggaggtaacagcggccctatctatgtgccaagtgggacagattttagggccatggaggctctggcaaatatgctacgggctccccacggagaagaccatgatctccctggcgaggaactggcttcttactccattgccggtactatagaggggaaaatcccacacaccgcgagctcgcagaaccttgaatttacagcatattctggcattccgtcctactcaagttttagcgtccataccctgacgcaggacggacagttgtcctattctcccggcctcttccctaatctgaaccaaagcgattgtaagaaaaacgccttaccactgatctgggaggggactatagagctccccggatactatgaagctattcacccttgcaatgtgttttgtgttttctcaggtccaggcgccagttgcgaggcattttccgaagggggaatcttcaacatcacaagccccacctgtcttgtgtctaagcagaatcgcttcagagctgccgagcagcaaattacttttgtctgccagagggtggacatggacatcattatatactgtaacggccagcggaaggtaatcctgacaaaaaccttggttattggtcagtgcatctactcaatcacgagtctattcagcctgctcccgtccgtggcgcactctattgccatagaactgtgtgtccctgggtttcatggctgggcaaccgctgcccttctgacaactttctgctttggatggttgctcatcccctcgattacctatatcgtgctgttaattctgaagttcatcgctgccatatttcacaatacaactcaagagaacaaattcaaggcaatcctacgcaaaattaaggaggaatttgagaagaccaaaggcagcatggtctgtgatatctgcaagtacgaatgcgagacagggaaagaactcaaggcccataatctgtcctgtaaccagtcacagtgcccatattgtttcacccactgcgagatgactgagagtgcttttcaggcgcattacaaagtgtgtcaagcaacgcaccgattcagagaagaccttaagaagacaattacccctcagactatctctcccggatgctataggaccttgaatctgtttcggtacaaaagccgttgttatatactcacagtttggctgtgccttctgattttggagtccatcgcctgggctgcctcagcaagcgaaacctctctcaacccactgtggactgataatgcccacggtgtgggctccgtacccatgcatacagacttagagctggatttcagtctaccttctagctccaagtacacgtacaaacgcaagctcacctcaccaactaacccggagcaggctgtcagtctgcacattgaaatcgagagccaggggatagccgcagacgtgcattcgcttggacactggtatgatgcgagattgaatctgaaaacatccttccactgttacggcgcttgcaccaagtatcaatacccctggcatacagccaagtgtcactttgaacatgacttccagtatgagaactcttggggttgcaatcctccagattgccccggggttggcactggatgtaccgcatgcggcctctacctggaccagttaaaacctgtggggagcgcctataagctgatcacggtcaggtactcacggaaagtgtgtgtacagtttggagaagagaacctttgcaagaccattgatatgaacgactgtttcatgagtcgacacgtgaaagtttgcatcattggtacagtctccaagttttctcaaggcgacactttggtgttcctcgggccactggagggaggcggtctaatctttaaagattggtgtaccagcacatgccagtacggggaccccggcgatataatgtccccgcgcgacagaggattctcatgtcctgaatttccaggcagcttcaggaagaagtgcaattttgctactacccccgtgtgtgagtatagtgggaacatggtctctggatacaaaaaggttatggccacgattgattccttccagagctttaatacatcgctgatccatttcaccgaggaacggatcgaatggaaagaccctgatggcatgctccgcgaccacctgaacattcttgtgactaaggatatcgacttcgagaatttgggtgagaacccctgcaaagtggggctgcaaacatcatctattgaaggagcatggggcagtggtgtaggctttaccttagtctgccaggtgtccctcatagattgtgctagattcctgactagcatcaaggcctgcgacatggcgatttgttatggggcccagtctgttagccttgtgaggggacagaataccgtcaagatcacaggcaaagggggacactccggctcaagttttaagtgctgtcatgaggtggattgcagctctacgggtctgcaagcctccgcaccacacttggacaaagttaacgggatttcagaacaggagaatgacaaggtgtacgatgacggagcccctcagtgtggcgtaagttgctggttcgtcaaaagcggtgaatggatctccggcatactccatgggaactgggtggtggtcgttgtgctggtaatcctactgctcttttctctgattcttttgtcgatcctgtgtcccgtgcgtaagcacaagcggagctga

SEQ ID NO: 10175 - RNA, 3408 nt, synthetic construct; identical to SEQ ID NO: 10174
  misc_feature 1..3408: note = derived and/or modified CDS sequence (opt3) from SANGV(SA14)__NC_034516.1__GP
  source 1..3408: mol_type = other RNA

SEQ ID NO: 10176 - RNA, 3402 nt, synthetic construct
  misc_feature 1..3402: note = derived and/or modified CDS sequence (opt3) from SEOV(L99)__AF288298.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtggtctggaggaaaaaggcgaatcaagaattggctaaccaaaattcatttgaggtggttgagagcgaagtgagtttcaaaggcctctgcatgctgaagcaccggatggtcgaggaatcctatcgcaaccgacgttctgtgatatgttacgacctggcctgcaatagcaccttttgtaagcccacagtatatatgatcgttcctattcatgcatgcaacatgatgaaatcctgtctcatcgggttaggaccatacaggattcaggtggtctatgagagaacttactgcaccacaggcatcctgaccgagggtaagtgtttcgtgcccgataaagccgtggtctcagctcttaagcgggggatgtatgcaatagccagtatcgaaactatttgctttttcatccacaaaaagggaaatacatacaagattgttaccgctatcacgagcgccatgggctctaaatgtaacaatactgacaccaaggtgcagggctactatatatgcattatcgggggaaactccgcgcctgtatacgcaccagccggtgaggattttcgcgctatggaagtgttctcaggcattatcacaagcccccatggggaggaccacgatttgcctggagaagagatcgccacttatcaaattagtggccagatagaggcaaaaatcccacacaccgtctcttccaagagcctgaaactaattgcttttgccggtatcccgtcgtactcttccacatcaatactcgcggccagtgaagacgggagattcatttttagccccggactgttccctaatcttaaccagtccgtgtgcgataacaatgcactgccattgatctggaggggcctcatcgacctgaccggctattacgaggctgttcatccctgtaacgtgttctgcgtcttatctgggcctggagccagctgtgaggctttttcagaaggtggcattttcaatatcacgagtccaatgtgcctggtgtccaagcagaaccggtttcgcgccgcagaacaacagattagcttcatatgtcagcgagtagatatggacatcattgtttattgcaatgggcagaaaaagactatcctcacaaagacccttgtgatcggacagtgtatttacactataacatctctgttttcattgctacccggcgtcgcccacagtatcgctattgagctgtgcgtgccgggtttccatgggtgggcgaccgcagccctcctgatcacgttttgtttcggctgggtccttattcctgcttgcaccctggccatcttgctcgtgctgaaatttttcgcaaacatattacacacaagcaatcaggagaacagatttaaggccatcctgaggaaaattaaggaagagttcgagaaaactaagggatccatggtttgtgaaatctgcaagtacgaatgcgagaccctaaaagagctcaaggctcacaatctgtcttgtgtgcagggcgaatgcccctattgttttacacattgcgagccaactgaaaccgccattcaagcacactacaaagtatgtcaggcgacacatcggttccgtgaggatcttaagaaaaccgtcactcctaagaacatcgggcccggatgctatcgcacgttgaatctgttcagatacaagtcgaggtgttatatactcacaatgtggaccctgcttctgattatcgagagcattttgtgggctgcctccgcagccgaaatcccactcgtgcccctgtggactgacaacgctcacggtgttggctcagtgcctatgcataccgacttagagctggattttagtctaccatctagctccaaatacgcctataagcggcacctcacaaatccggtcaacgaccagcagtcagtgagcctgcacatagaaatcgagtctcaagggattggagcagatgtacatcaccttggccattggtacgacgctcgattgaatctgaaaacctccttccactgctacggtgcctgtactaagtatcagtacccctggcacacagcgaaatgccattttgaaaaggattatgagtacgagaacagttgggcctgtaaccctccagactgccccggggtgggcacgggatgcaccgcttgtggcctctatctggatcagttaaagcctgttgggactgcattcaaaatcattagcgtccgctactctagaaaggtgtgcgtgcagtttggagaagagtatctgtgtaaaacaatcgacatgaatgattgcttcgtcaccaggcacgccaagatatgtattatcggtacagtttccaaattttcacaaggcgacactcttttgttcctcgggccaatggaaggaggcggtatcatttttaagcattggtgcaccagtacgtgtcacttcggggatcccggcgacgtgatgggaccgaaagacaagccttttagctgcccagagttccccggccagtttcggaagaaatgtaacttcgctaccacacctatctgcgaatacgatgggaatattatatcgggatacaagaaagtgctggccactatcgactccttccagtcttttaacaccagcaatattcatttcacagatgagcgcatcgagtggagagaccccgatggcatgctaagggaccacattaacatcgtaatatcaaaggatatcgactttgaaaatctggcagagagtccatgtaaagtcggtctccaggcggccaacattgaaggggcttggggatccggcgtgggtttcactctgacctgccaagtttctcttacggagtgccctacatttttgaccagcatcaaggcctgtgatatggcaatttgctatggcgctgaatccgtgactctgtcacgtgggcagaatacagtccggatcaccggaaagggcgggcacagcggaagttctttcaaatgttgccatggcaaggagtgttccagcactggtttacaggcctcggcaccccacctcgacaaagtgaacgggatatcagagctggaaaatgagaaggtttacgatgacggagccccagaatgcggcgtgacctgttggtttaaaaagtctggtgagtgggtaatgggcattatcaacgggaattgggtcgtgcttatcgtgctgtgcgtcttgctcctgttcagtctaattctgctctccatactgtgtccggttcgaaagcataaaaagagctga

SEQ ID NO: 10177 - RNA, 3402 nt, synthetic construct
  misc_feature 1..3402: note = derived and/or modified CDS sequence (opt3) from SEOV(Rn10-134)__JF693883.2__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcgtggagagtgaagtttccttcaaaggcttgtgcatgctcaagcaccggatggtggaggaatcttatcgcaaccgacgtagcgtcatctgttacgacctggcctgcaattccaccttttgtaagcccacagtgtatatgattgtacctatccatgcatgcaacatgatgaaatcatgtctgattgggctcggaccatacagaatccaggttgtgtatgagaggacttactgcaccacaggcatattaaccgagggtaagtgtttcgtccccgataaagccgtggtgagtgctctgaagcgggggatgtatgcaatcgccagcattgaaactatctgctttttcattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggattttcgcgctatggaagtattcagcggcatcatcacaagtccccatggggaggaccacgatcttcctggagaagagattgccacttatcagatatctggccagatcgaggcaaagattccacacaccgtgtccagcaaaaatttgaagctgacagcttttgccggtatcccgtcgtactcttccacctcaatactagcggccagtgaagacgggagattcatttttagccccggactcttccctaacctgaaccagtccgtctgcgataataacgcacttccactgatctggaggggcttgatcgacctcacgggctattacgaggctgtgcatccctgtaatgttttctgcgtgctgtctgggcctggagccagctgtgaggctttttcagaaggtggcattttcaacatcacttcaccaatgtgcttagtctccaaacaaaatcggtttcgcgccgcagaacagcagattagcttcgtgtgtcaacgagtagatatggacataatcgtttattgcaacgggcagaagaaaacaattctgaccaagactctcgtgatcggacagtgtatctacacaattacctctctgttttcacttttgcccggcgtcgcccacagtatagctatcgagctatgcgtgccgggtttccatgggtgggcgacggcagccctgctcattaccttttgtttcggctgggtcctgatccctgcttgcacacttgccattctgttggtgctcaagtttttcgcaaatatcctgcacactagcaaccaggagaatagatttaaagccatattaaggaagatcaaagaagagttcgaaaagaccaaaggatccatggtttgtgagatttgcaagtacgaatgcgagacactgaaggagctaaaagctcacaacctctcttgtgtgcaaggcgaatgcccctattgttttactcattgcgagccaaccgaaacagccatccaggcacactacaaggtatgtcaggcgacccatcggttccgtgaggatctgaaaaagactgtcacgcctcagaatattgggcccggatgctatcgcacacttaacttgttcagatacaaatcgaggtgttatatcctgaccatgtggactctcctgcttataattgagagcatcctgtgggctgcctccgcagtggaaattccattggttcccctctggaccgacaatgcccacggtgtgggctcagtccctatgcatacagacctggagttagattttagtctgccatctagctcccggtacacctataagcgacacctaactaacccggtgaatgaccaacagtcagtaagcctccacatcgaaatagagtctcaggggatcggagctgatgtgcatcacctgggccattggtacgacgcccgccttaacttgaagacatccttccactgctacggtgcatgtacgaaatatcagtacccctggcacaccgctaagtgccattttgaaaaagattatgagtacgagaacagttgggcctgtaatcctccagactgccccggggttggcactggatgcacagcgtgtggcctgtatctcgatcaactgaagcctgtcgggaccgccttcaaaattatcagcgtgagatactctaggaaggtgtgcgtccagtttggagaagagtatttatgtaagacaattgacatgaacgattgcttcgttactcggcacgctaaaatctgtataattggtaccgtgtccaagttttcacagggcgacacgctgcttttcttggggccaatggaaggaggcggtatcatctttaaacattggtgcaccagtacatgtcacttcggggatcccggcgacgtgatgggaccgaaggacaaaccttttatttgcccagagttccccggccagtttcgcaagaaatgtaatttcgcaactacccctgtatgcgaatacgatgggaacatcattagcggatacaagaaggtcctcgccacaatagactcgttccaatcctttaatacttctaacatccatttcaccgatgagagaattgagtggagggaccccgatggcatgctgcgtgaccacatcaatattgtgatcagcaaagatatagactttgaaaacctagctgagaatccatgtaaggttggtctgcaggccgcaaacatcgaaggggcgtggggatcaggcgtgggtttcacgctcacatgccaggtcagtctgaccgagtgccctacttttcttacatccattaaagcctgtgatatggctatctgctatggcgccgaatctgtgaccttgagccgggggcaaaatactgttaagattaccggaaaaggcgggcactccggaagtagcttcaagtgttgccatggcaaggagtgtagtctgacaggtttacaggcatctgctccccacctcgacaaagtgaacgggatctccgagctggaaaatgagaaggtatacgatgacggagccccagaatgcggcataacgtgttggtttaaaaagagcggtgagtgggtcatgggcattatcaacgggaattgggtggtgcttatcgtcctgtgcgttttgctcctgttctcgctaattctgctctcaatactgtgtccggtgcgaaaacataagaagtcttga

SEQ ID NO: 10178 - RNA, 3402 nt, synthetic construct
  misc_feature 1..3402: note = derived and/or modified CDS sequence (opt3) from SEOV(Gou3-e5)__AF288650.1__GP
  source 1..3402: mol_type = other RNA
atgtggggcctgctccttctggccgctttggtggggcagggattagcactgaagaacgtcttcgacatgaaaatccaatgcccccacagcgttaattttggtgagacctccgtgtctggctacacagaactacctccactcccgctgcaggaggccgaacagcttgtacccgagtcaagttgtaacatggataatcatcagagcctgtccactattaacaagttgacgaaagtgatatggagaaagaaagcgaatcaagaatctgcttcgcagaactcattcgaggtcgtggagaatgaagttagctttaaggggctctgcatgctgaagcacaggatggtggaggaaagttatcggaaccgccgatccgtcatctgttacgacctggcctgcaataccacattctgtaaacctactgtgtatatgattgtaccaatccatgcatgcaacatgatgaagtcttgtctcattggattaggcccctaccgtatccaggttatatatgagagaacctactgcacaaccggtatcctgactgaggggaaatgttttgtgcctgataaggccgtcgtgagcgctcttaaaaggggaatgtatgcaattgcctccatcgaaacaatttgcttctttgtgcaccagaagggcaatacctacaagatcgtctcagctataacgagtgccatgggcagcaaatgtaacaatactgactctaaggttcaagggtactatatttgcatcattggaggtaactccgcgccagtgtacgcacccgccggcgaggatttccgggctatggaagtattttcagggatcatcaccagccctcatggagaggaccacgatttgccaggcgaagagattgccacatatcagataagtggtcagatcgaggcaaaaattccgcacactgtgtcttccaagaatctgaaactaaccgctttcgccgggatccccagctactcgtctacatccatactcgcggcctcagaagacggacgctttattttcagtcctggcctgtttccaaaccttaaccagagcgtctgcgataataacgcactgcccttgatctggagaggcctcatcgacctgaccgggtattacgaggctattcatccttgtaatgtgttctgcgttttatccggaccaggtgcctcttgtgaggctttcagcgaaggcgggatctttaacattacgtcacccatgtgcctggtgagtaagcaaaataggttccgggccgcagaacagcagatatcctttatctgtcaacgcgtcgatatggacattgtggtatattgcaacggacagaaaaagactatcctcacaaagacccttgttatcggccagtgtatttacactataacaagcctgttctctttgctaccgggtgtggcccactcaatcgctattgagctgtgcgtccctgggtttcatggctgggcgaccgcagccctcctggtgacgttctgttttggatgggtccttatccccgcttgcaccctggccgtgctcttgttcctgaaatttttcgcaaatattttacacacaagtaaccaggagaatcgatttaaggccatcctgagaaaaataaaggaagagttcgagaaaactaagggcagcatggtttgtgaaatctgcaagtacgaatgcgagaccctaaaagagctcaaggctcacaacctgtcctgtgtgcaaggggaatgcccatattgttttacacattgcgagcctactgaaaccgccattcaggcacactacaaagtatgtcaggcgacacataggttccgggaggatcttaagaaaaccgtcactccccagaatatcggaccaggttgctatcgtacgttgaacctgttccgctacaagtctagatgttatattctcacaatgtggatcctgcttctggtgatagagtcgattttgtgggctgccagcgcagccgaaatccccctcgttcctctgtggaccgacaatgctcacggcgtggggtccgtcccaatgcatactgacttagagctggatttttcactaccgagttctagcaagtacacctataaaaggcacctcacaaaccccgtgaatgaccaacagtccgtatcactgcacattgaaatcgagagccagggaataggcgccgatgtgcatcaccttggtcattggtacgacgcacggttgaacctgaagacctctttccactgctacggggcttgtactaaatatcagtacccttggcacacagccaagtgccattttgaaaaagattatgagtacgagaactcctgggcgtgtaatccacccgactgccctggcgttggaacgggctgcaccgggtgtggactctatctggatcaattaaagccagtcggtactgccttcaagatcattagtgtgcgatacagccgcaaagtgtgcgtccagtttggcgaagagtatctgtgtaagacaatcgacatgaacgattgcttcgttaccagacacgctaaaatttgtatcatagggacagtgtctaagttttcccagggagacactcttttgttcctcggccccatggaaggtgggggcattatctttaaacattggtgcacctcaacgtgtcacttcggagatccgggcgacgtgatggggcctaaggacaaaccatttatctgccccgagttccctggacagtttaggaagaagtgtaatttcgcaaccacacccgtatgcgaatacgatggcaacgtcattagtggttaccggaaagtgctggccactatcgacagcttccaatcgtttaatacctccaacgttcatttcacagatgagcgcattgagtggaaggacccagatgggatgctaagagaccacataaatatcgtgatttctaaagatatcgactttgaaaacctggctgagaatccttgtaaggtcggactccaggccgcaaacattgaaggcgcgtggggtagcggcgtggggttcactctgacctgccaggtttcacttacggagtgccccacatttttgaccagtatcaaagcctgtgatatggctatatgctatggagccgaatccgtgactctgtctaggggccaaaatacaatcaagattaccgggcgtggaggccacagcggttcctcattcaagtgttgccatgggaaagagtgtagcgcaaacggattacaggctagtgccccacacctcgacaaggtaaatggcatctctgagctggaaaacgagaaagtctacgatgacggtgcaccggaatgcggcattacttgttggtttaagaaatccggggagtgggtgatgggaatcataaatggcaactgggtggtccttattgttctgtgcgtgttgctcctgttcagcctaatcctgctctcgatcctgtgtcctgtacggaagcataagaaatcatga

SEQ ID NO: 10179 - RNA, 3402 nt, synthetic construct
  misc_feature 1..3402: note = derived and/or modified CDS sequence (opt3) from SEOV(China)__EU163437.1__GP
  source 1..3402: mol_type = other RNA
atgtggagcctgctccttctggccgctttggtgggccaggggttcgcattaaagaacgtctttgacatgagaatccaatgcccccactccgttaaattcggagagacctctgtgtcaggttacacagaactgcctccactaagtctccaggaggccgaacagctggtaccggagagctcctgtaatatggataaccatcagtctctttcgactattaataagctgacgaaagtgatatggaggaagaaagcgaaccaagaatcagctaatcagaacagctttgagatcttggagagtgaagtctccttcaagggcctctgcatgctgaagcaccggatggtggaggaatcttatcgcaatcgacgtagcgttatttgttacgacctggcctgcaactccaccttttgtaaacccacagtgtatatgatcgtccctattcatgcatgcaatatcatgaagtcatgtctcatagggttaggaccatacagaatccaggtggtatatgagaggacttactgcaccacaggcattctgaccgagggtaaatgtttcgttcccgataaggccgtggtcagtgctcttaaacgggggatgtatgcaatcgccagcattgaaactatctgctttttcatacaccagaagggaaacaagtacaaaattgtgacagctatcacctctgccatgggctccaagtgtaataacacggacactaaagtgcaaggctactatatttgcatcatcgggggaaattcagcgcctgtctacgcaccagccggtgaggattttcgcgctatggaagttttcagcggcattataaccagtccccatggggaggaccacgatttgcctggagaagagatcgccacatatcagatttctggccagatcgaggcaaagataccacacactgtgtccagccagaacctgaaactaaccgcttttgccggtattccgtcgtactcttccacatcaatcctcgcggccagtgaagacgggagattcatctttagccccggactgttccctaatcttaaccaatccgtatgcgataacaatgcactgccattgatttggaggggcctcatcgacctgaccggctattacgaggctgtgcatccctgtaacgtcttctgcgtgttatctgggcctggagccagctgtgaagccttttcagagggtggcattttcaatataacgagtccaatgtgcctggtttccaagcagaaccggtttcgcgccgcagaacagcaaatcagcttcatttgtcagcgagtggatatggacatcatcgtctattgcaatgggcagaaaaagactattctcacaaagacccttgtgataggacagtgtatctacactattacatctctgttttcattgctacccggcgtagcccacagtatcgctattgagctgtgcgttccgggtttccatgggtgggcgaccgcagccctcctgatcacgttttgtttcggctgggtgcttatacctgcttgcaccctggccatcttgctcgtcctgaaatttttcgcaaacattttacaaacaagcaatcaggagaacagatttaaggccatcctgaggaaaattaaggaagagttcgagaaaactaagggatccatggtgtgtgaaatctgcaagtacgaatgcgagaccctaaaagagctcaaggctcacaatctgtcttgtgtccagggcgaatgcccctattgttttacacactgcgagccaactgaaaccgccatacaggcacattacaaagtgtgtcaagcgacacaccggttccgtgaggatcttaagaaaaccgttactcctcagaacattgggcccggatgctatcgcacgttgaatctgttcagatacaagtcgaggtgttatatcctcacaatgtggaccctgcttctgattatcgagagcatattgtgggctgcctccgcagccgaaatcccactcgtgcccctgtggactgacaacgctcatggtgtaggctcagtccctatgcacaccgacttagagctggattttagtctaccatctagctccaagtacacatataaacggcatctcaccaatccggtgaacgaccagcagtcagttagcctgcacattgaaatcgagtctcaagggattggagccgatgtgcaccatcttggccactgctacgacgcacgattgaatctgaagacttccttccattgttacggtgcttgcacaaaatatcagtacccctggcacacggccaagtgtcactttgaaaaagattatgagtacgagaacagttgggcgtgcaaccctccagactgccccggggtcggcaccggatgtactgcctgcggcctctatctggatcagttaaagcctgtggggacagctttcaagatcataagcgtacgctactctagaaaagtgtgtgttcagtttggagaagagtatctgtgcaagaccattgacatgaatgattgtttcgtcacaaggcatgcaaaaatctgcatcattggtactgtgtccaagttttcacaaggcgacacccttttgttcctcgggccaatggaaggaggcggtatcatttttaaacactggtgtacgagtacctgccatttcggggatcccggcgacgtgatgggaccgaaggacaaaccttttatatgtccagagttccccggccagtttcggaagaagtgcaacttcgccacaactcctgtctgtgaatacgatgggaatatcattagcggatacaaaaaggttctggctaccatcgactcgttccagtcctttaaccgctcttatattcacttcacagatgagagaatcgagtggagggaccccgatggcatgctacgtgaccatataaatatcgtgattagcaaagatatcgactttgaaaacctggccgagaatccatgcaaggtgggtctccaagcagcgaacattgaaggggcctggggactgggcgtaggtttcactcttacctgccaggtctcattgacggagtgtcctacatttctgaccagtatcaaggcttgcgatatggccatatgttacggcgcagaatccgtgactttatctcgggggcagaatacagttaaaattaccggaaagggcgggcacagcggatcctcattcaaatgctgtcacggcaaggagtgcagcagtactggtctccaggcttctgctccccatctggacaaagtgaacgggatctccgagcttgaaaatgagaaggtctatgatgacggagcaccagaatgtggcattacctgctggtttaaaaagagcggtgagtgggtgatgggcatcataaacgggaattgggttgtgctgatcgtattgtgtgtcctcctgctattctcgctgattctcctgtcaatcctttgcccggtgcgaaagcacaaaaagtcttga

SEQ ID NO: 10180 - RNA, 3402 nt, synthetic construct
  misc_feature 1..3402: note = derived and/or modified CDS sequence (opt3) from SEOV(DPRK08)__JX853576.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcgtggagagtgaagtttccttcaaaggcttgtgcatgctcaagcaccggatggtggaggaatcttatcgcaaccgacgtagcgtcatctgttacgacctggcctgcaattccaccttttgtaagcccacagtgtatatgattgtacctatccatgcatgcaacatgatgaaatcatgtctgattgggctcggaccatacagaatccaggttgtgtatgagaggacttactgcaccacaggcatattaaccgagggtaagtgtttcgtccccgataaagccgtggtgagtgctctgaagcgggggatgtatgcaatcgccagcattgaaactatctgctttttcattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggattttcgcgctatggaagtattcagcggcatcatcacaagtccccatggggaggaccacgatcttcctggagaagagattgccacttatcagatatctggccagatcgaggcaaagattccacacaccgtgtccagcaaaaatttgaagctgacagcttttgccggtatcccgtcgtactcttccacctcaatactagcggccagtgaagacgggagattcatttttagccccggactcttccctaacctgaaccagtccgtctgcgataataacgcacttccactgatctggaggggcttgatcgacctcacgggctattacgaggctgtgcatccctgtaatgttttctgcgtgctgtctgggcctggagccagctgtgaagccttttcagagggtggcattttcaacatcacttcaccaatgtgcttagtctccaaacaaaatcggtttcgcgccgcagaacagcagattagcttcgtgtgtcaacgagtagatatggacataatcgtttattgcaacgggcagaagaaaacaattctgaccaagactctcgtgatcggacagtgtatctacacaattacctctctgttttcacttttgcccggcgtcgcccacagtatagctatcgagctatgcgtgccgggtttccatgggtgggcgacggcagccctgctcattaccttttgtttcggctgggtcctgatccctgcttgcacacttgccattctgttggtgctcaagtttttcgcaaatatcctgcacactagcaaccaggagaatagatttaaagccatattaaggaagatcaaagaagagttcgaaaagaccaaaggatccatggtttgtgagatttgcaagtacgaatgcgagacactgaaggagctaaaagctcacaacctctcttgtgtgcaaggcgaatgcccctattgttttactcattgcgagccaaccgaaacagccatccaggcacactacaaggtatgtcaggcgacccatcggttccgtgaggatctgaaaaagactgtcacgcctcagaatattgggcccggatgctatcgcacacttaacttgttcagatacaaatcgaggtgttatatcctgaccatgtggactctcctgcttataattgagagcatcctgtgggctgcctccgcagccgaaattccattggtgcccatctggaccgacaatgctcacggtgttggctcagtgcctatgcatacagacctcgagctggattttagtttaccatctagctccaagtacacctataagcggcacctgactaacccggtcaatgaccaacagtcagtgagcctacacatagaaatcgagtctcaggggattggagccgatgtacatcacctcggccattggtacgacgcacgactgaaccttaaaacatccttccactgctacggtgcttgtacgaagtatcagtacccctggcacaccgccaaatgccattttgaaaaggattatgagtacgagaacagttgggcgtgtaatcctccagactgccccggggtgggcactggatgcacagcctgtggcttgtatctggatcaactcaaacctgttgggaccgctttcaagatcattagcgtccgctactctagaaaggtgtgcatgcagtttggagaagagtatctgtgtaaaacaatcgacatgaacgattgcttcgtgactaggcacgcaaagatatgtattatcggtaccgtctccaaattttcacagggcgacacgttactgttccttgggccaatggaaggaggcggtatcatttttaagcattggtgcaccagtacatgtcacttcggggatcccggcgacgttatgggaccgaaagacaagccttttatctgcccagagttccccggccagtttcggaaaaagtgtaatttcgccactacccctgtgtgcgaatacgatgggaacattataagcggatacaagaaagtgttggctacaatcgactcgttccaatcctttaatacttctaacattcatttcaccgatgagcgcatcgagtggagagaccccgatggcatgctcagggaccacattaatatcgtaataagcaaggatatcgactttgaaaacctggccgagaatccatgtaaagtcggtctacaggcagcgaacattgaaggggcctggggatcaggcgtgggtttcacgctgacatgccaggttagtctcaccgagtgccctacttttctgacatccatcaaggcttgtgatatggccatttgctatggcgcagaatctgtgacccttagccgtgggcaaaatactgtcaaaatcaccggaaagggcgggcactccggaagtagcttcaagtgttgccatggcaaagagtgtagttctacaggtttgcaggcttccgctccccacctggacaaggtgaacgggataagcgagttagaaaatgagaaagtttacgatgacggagcaccagaatgcggcgtgacgtgttggtttaagaaatcgggtgagtgggtaatgggcattatcaacgggaattgggtcgtgctcatcgtgctgtgcgtccttctgttgttctcactcattctgctatctatactgtgtccggttcggaagcataagaaaagttga

SEQ ID NO: 10181 - RNA, 3402 nt, synthetic construct
  misc_feature 1..3402: note = derived and/or modified CDS sequence (opt3) from SEOV(Fj372/2013)__KP645197.1__GP
  source 1..3402: mol_type = other RNA
atgtggagcctgctccttctggccgctttggtgggccccgggttcgcattaaagaacgtctttgacatgagaatccagtgccctcactccgttaatttcggagagacctctgtgtcaggttacacagaactgccaccgctaagtctccaagaggccgaacagctggtacccgagagctcctgtaacatggataatcatcagtctctttcgactattaacaaactgacgaaggtgatatggcagaaaaaggcgaatcaagaatcagctaaccagaatagctttgaggtcgtggagagtgaagtttccttcaaaggcttgtgcatgctcaagcacaggatggtggaggaatcttatcggaaccgccgaagcgtcatctgttacgacctggcctgcaattccaccttttgtaagcctacagtgtatatgattgtaccaatccatgcatgcaacatgatgaaatcatgtctgattgggctcggaccctaccgtatccaggttgtgtatgagagaacttactgcaccacaggcatattaaccgagggtaagtgtttcgtccctgataaagccgtggtgagtgctctgaagagggggatgtatgcaatcgccagcattgaaactatctgctttttcattcaccagaaaggaaatacatacaagatcgtcaccgctataacgtctgccatgggctccaagtgtaacaatactgacaccaaagttcaaggctactatatttgcatcattgggggaaactcagcgccagtgtacgcacccgccggtgaggattttcgggctatggaagtattcagcggcatcatcacaagtcctcatggggaggaccacgatcttccaggagaagagattgccacttatcagatatctggccagatcgaggcaaagattccgcacaccgtgtccagcaaaaatttgaagctgacagcttttgccggtatcccctcgtactcttccacctcaatactagcggccagtgaagacgggcgcttcatttttagccctggactcttcccaaacctgaaccagtccgtctgcgataataacgcacttcccctgatctggagaggcttgatcgacctcacgggctattacgaggctgtgcatccttgtaatgttttctgcgtgctgtctgggccaggagccagctgtgaggctttttcagaaggtggcattttcaacatcacttcacccatgtgcttagtctccaaacaaaataggtttcgggccgcagaacagcagattagcttcgtgtgtcaacgcgtagatatggacataatcgtttattgcaacgggcagaagaaaacaattctgaccaagactctcgtgatcggacagtgtatctacacaattacctctttgttttcactgttgccgggcgtcgcccacagtatagctatcgagctatgcgtgcctggtttccatgggtgggcgacggcagccctgctcattaccttttgtttcggctgggtcctgatccccgcttgcacacttgccattctgttggtgctcaagtttttcgcaaatatcctgcacactagcaaccaggagaatcgatttaaagccatattaagaaagatcaaagaagagttcgaaaagaccaaaggatccatggtttgtgagatttgcaagtacgaatgcgagacactgaaggagctaaaagctcacaacctctcttgtgtgcaaggcgaatgcccatattgttttactcattgcgagcctaccgaaacagccatccaggcacactacaaggtatgtcaggcgacccataggttccgggaggatctgaaaaagactgtcacgccccagaatattgggccaggatgctatcgtacacttaacttgttccgctacaaatcgagatgttatatcctgaccatgtggactctcctgcttataattgagagcatcctgtgggctgcctccgcagccgaaattcccttggtgcctctctggaccgacaatgctcacggtgttggctcagtgccaatgcatacagacctggagttagattttagtctgccgtctagctccaagtacacctataagaggcacctaactaaccccgtcaatgaccaacagtcagtgagcctccacatcgaaatagagtctcaggggatcggagccgatgtacatcacctgggccattggtacgacgcacggcttaacttgaaaacatccttccactgctacggtgcttgtacgaagtatcagtacccttggcacaccgccaaatgccattttgaaaaggattatgagtacgagaacagttgggcgtgtaatccacccgactgccctggggtgggcactggatgcacagcctgtggcctgtatctcgatcaactgaaaccagttgggaccgctttcaagattatcagcgtccgatactctcgcaaggtgtgcgtgcagtttggagaagagtatttatgtaaaacaattgacatgaacgattgcttcgtcactagacacgcaaagatctgtataattggtaccgtttccaaattttcacagggcgacacgctgcttttcttggggcccatggaaggaggcggtatcatctttaagcattggtgcaccagtacatgtcacttcggggatccgggcgacgtgatgggacctaaagacaagccatttatttgccccgagttccctggccagtttaggaaaaagtgtaatttcgccactacccccgtgtgcgaatacgatgggaacatcattagcggatacaagaaagtactcgctacaatagactcgttccaatcctttaatacttctaacatccatttcaccgatgagcggattgagtggcgcgacccagatggcatgctgagagaccacatcaatattgtcatcagcaaggatatagactttgaaaacctagccgagaatccttgtaaagtgggtctgcaggcagcgaacatcgaaggggcctggggatcaggcgttggtttcacgctcacatgccaggtgagtctgaccgagtgccccacttttcttacatccattaaggcttgtgatatggccatctgctatggcgcagaatctgtcaccttgagcagggggcaaaatactgtgaaaattaccggaaagggcgggcactccggaagtagcttcaagtgttgccatggcaaagagtgtagttctacaggtctgcaggcttccgccccacacttagacaaggttaacgggatcagcgagctcgaaaatgagaaagtgtacgatgacggagcaccggaatgcggcataacgtgttggtttaagaaatcgggtgagtgggtaatgggcattatcaacgggaattgggtcgtgctgatcgtgctttgcgtcctgcttctcttctcactgattctactgtctatactctgtcctgttcgtaagcataagaaaagttga

SEQ ID NO: 10182 - RNA, 3402 nt, synthetic construct
  misc_feature 1..3402: note = derived and/or modified CDS sequence (opt3) from SEOV(HeB38)__JN377554.1__GP
  source 1..3402: mol_type = other RNA
atgtggagcctgctccttctggccgctttggtgggccaggggttcgcattaaagaacgtctttgacatgagaatccaatgcccccactccgttaaattcggagagacctctgtgtcaggttacacagaactgcctccactaagtctccaggaggccgaacagctggtaccggagagctcctgtaatatggataaccatcagtctctttcgactattaataagctgacgaaagtgatatggcaaaagaaagcgaaccaggaatcagctaatcagaacagctttgaggtcgccgagagtgaagtgtccttcaagggcttgtgcatgctcaagcacaggatggttgaggaatcttatcggaatcgccgaagcgtgatctgttacgacctggcatgcaactccaccttttgtaaacccacagtctatatgattgtgcctatccatgcctgcaatatgatgaagtcatgtctgattgggctcggaccataccgtatccaggtagtttatgagagaacttactgcaccacaggcatattaaccgagggtaaatgtttcgtgcccgataaggctgtcgtgagtgcactgaaaagggggatgtatgccatcgctagcattgaaactatctgctttttcattcaccaaaagggaaacacatacaagatcgtgaccgccataacgtctgcgatgggctccaaatgtaataacactgacaccaaggtccagggctactatatttgcatcattgggggaaattcagcacctgtttacgccccaagcggtgaggattttcgggctatggaagtgttcagtggcatcatcatgtctccccatggggaggaccacgatcttcctggagaagagattgccacatatcagatatccggccagatcgaggcaaaaattccacacactgtaagctcgaagaacttgaaactgaccgcttttgccggtatcccgtcttactcctcaacaagtatactagcggccagcgaagacgggcgcttcatcttttcccccggactcttccctaatctgaaccaatctgtgtgcgataacaatgcacttccactgatttggagaggcttgatcgacctcaccggctattacgaggctgtccatccctgtaacgtgttctgcgttctgagcgggcctggagcctcatgtgaagcctttagtgagggtggcattttcaatatcacgtccccaatgtgcttagtgagcaagcagaacaggtttcgggccgcagaacagcaaatttctttcgtctgtcagcgcgtggatatggacataatcgtatattgcaatgggcagaaaaagactattctgacaaagaccctcgttatcggacagtgtatctacactattacatcactttttagtctgttgcccggcgtggcccacagcatagctatcgagctatgcgtcccgggtttccatgggtgggcgaccgcagccctgctcattacgttttgtttcggctgggtgctgatccctgcttgcacccttgccattctgttggtcctcaaatttttcgcaaacatcctgcacacatccaatcaagagaaccgatttaaggccatattaagaaaaatcaaggaagagttcgagaaaactaagggatctatggtgtgtgaaatttgcaagtacgaatgcgagaccctgaaagagctaaaggctcacaatctctcgtgtgttcagggcgaatgcccctattgttttacacattgcgagccaactgaaaccgccatccaggcacactacaaagtgtgtcaggcgacacataggttccgggaggatctgaagaaaaccgtaactcctcaaaacattgggcccggatgctatcgtacgcttaatttgttccgctacaagagcagatgttatatcctgacaatgtggaccctcctgcttataattgagtccatcctgtgggctgcctcagcagccgaaattccattggtccccctctggactgacaacgctcacggtgtgggcagtgttcctatgcataccgacctggagttagatttttctctgccaagctcctcaaagtacacatataaaaggcacctaaccaatccggtgaacgaccagcagagcgtctctctccacatcgaaatagagtcccaggggatcggagccgatgtgcatcacctgggccattggtacgacgcacggcttaatttgaagacttcattccactgctacggtgcttgtacaaaatatcaatacccctggcacacggccaagtgccattttgaaaaagattatgagtacgagaacagctgggcgtgtaaccctccagactgccccggggtaggcaccggatgcactgcctgtggcctgtatctcgatcagctgaagcctgtggggacagctttcaagattatctctgttcgatactcccgcaaagtctgcgtgcagtttggagaagagtatttatgtaagaccattgacatgaatgattgcttcgtgacaagacacgcaaaaatctgtataattggtactgtctcaaagtttagtcagggcgacaccctgcttttcttggggccaatggaaggaggcggtatcatctttaaacattggtgcacgagcacctgtcacttcggggatcccggcgacgttatgggaccgaaggacaaaccttttatttgcccagagttccccggccaatttaggaagaagtgtaacttcgccacaactcctgtgtgcgaatacgatgggaatatcatttcgggatacaaaaaggtgctcgctaccatagactccttccagtcttttaacacaagcaatatccatttcactgatgagcggattgagtggcgcgaccccgatggcatgctgagagaccacatcaacattgtaatctcaaaagatatagactttgaaaatctagccgagaacccatgtaaggtcggtctgcaggcagcgaatatcgaaggggcctggggaagtggcgtgggtttcaccctcacgtgccaagtttccctgacagagtgccctacctttcttacttctattaaggcttgtgatatggccatctgctatggcgcagaaagcgtgacattgctgagggggcagaacaccgtcaaaattactggaaagggcgggcactccggaagtagcttcaaatgttgccatggcaaggagtgtagttctaccggtttacaggcttccgctccccacctcgacaaagtgaatgggatcagcgagctggaaaacgagaaggtttacgatgacggagcaccagaatgcggcataacatgttggtttaaaaagtcgggtgagtgggtgatgggcattatcaatgggaactgggtagtccttatcgtgctgtgcgtgttgctcctgttctcactaattctgctctctatactgtgtccggtccgtaagcataaaaagagttga

SEQ ID NO: 10183 - RNA, 3402 nt, synthetic construct
  misc_feature 1..3402: note = derived and/or modified CDS sequence (opt3) from SEOV(JiangxiXinjianRn-07-2011)__KP859513.1__GP
  source 1..3402: mol_type = other RNA
atgtggagcctgctccttctggccgctttggtgggccagtgcttcgcattaaagaacgtctttgacatgagaatccaatgtccccactccgttaatttcggggagacctctgtgtcaggatacacagaactgcctccactaagtctccaggaggccgaacagctggtaccggagagctcctgcaacatggataatcatcagtctctttcgactattaacaaactgacgaaggtgatatggaggaaaaaggcgaatcaagaatcagctaaccagaatagctttgaggtcgtggagagtgaagtttccttcaaaggtttgtgtatgctcaagcaccggatggtggaggaatcttatcgcaaccgacgtagcgtcatctgctacgacctggcctgtaattccaccttttgcaagcccacagtgtatatgattgtacctatccatgcatgtaacatgatgaaatcatgcctgattggcctcgggccatacagaatccaggttgtgtatgagaggacttactgtaccacaggaatattaaccgagggcaagtgcttcgtccccgataaagccgtggtgagtgctctgaagcggggtatgtatgcaatcgccagcattgaaactatctgctttttcattcaccagaaagggaatacatacaagatcgtcaccgctataacgtctgccatgggatccaagtgtaacaatactgacaccaaagttcaaggctactatatttgcatcattggcgggaactcagcgcctgtgtacgcaccagccggagaggattttcgcgctatggaagtattcagcggtatcatcacaagtccccatggcgaggaccacgatcttcctggggaagagattgccacttatcagatatctggacagatcgaggcaaagattccacacaccgtgtccagcaaaaatttgaagctgacagcttttgccggcatcccgtcgtactcttccacctcaatactagcggccagtgaagacggtagattcatttttagccccgggcttttccctaacctgaaccagtccgtctgtgataataacgcacttccactgatctggaggggattgatcgacctcacgggctattacgaggctgtgcatccctgcaatgttttctgtgtgctgtctggccctggggccagctgcgaagccttttcagagggaggtattttcaacatcacttcaccaatgtgtttagtctccaaacaaaatcggtttcgcgccgcagaacagcagattagcttcgtgtgccaacgagtagatatggacataatcgtttattgtaacggccagaagaaaacaattctgaccaagactctcgtgatcgggcagtgcatctacacaattacctctctcttttcactgttgcccggagtcgcccacagtatagctatcgagctatgtgtgccgggcttccatggttgggcgacggcagccctgctcattaccttttgcttcgggtgggtcctgatccctgcttgtacacttgccattctgttggtgctcaagtttttcgcaaatatcctgcacactagcaaccaggagaatagatttaaagccatattaaggaagatcaaagaagagttcgaaaagaccaaaggctccatggtttgcgagatttgcaagtacgaatgtgagacactgaaggagctaaaagctcacaacctctcttgcgtgcaaggagaatgtccctattgctttactcattgtgagccaaccgaaacagccatccaggcacactacaaggtatgccaggcgacccatcggttccgtgaggatctgaaaaagactgtcacgcctcagaatattggccccgggtgttatcgcacacttaacttgttcagatacaaatcgaggtgctatatcctgaccatgtggactctcctgcttataattgagagcatcctgtgggctgcctccgcagccgaaattccattggtgcccctctggaccgacaatgctcacggagttggttcagtgcctatgcatacagacctggagttagattttagtctgccatctagctccaagtacacctataagcggcacctaactaacccggtcaatgaccaacagtcagtgagcctccacatcgaaatagagtctcagggcatcggggccgatgtacatcacctgggacattggtacgacgcacgacttaacttgaaaacatccttccactgttacggcgcttgcacgaagtatcagtacccctggcacaccgccaaatgtcattttgaaaaggattatgagtacgagaacagttgggcgtgcaatcctccagactgccccggtgtggggactggctgtacagcctgcggactgtatctcgatcaactgaaacctgttggcaccgctttcaagattatcagcgtccgctactctagaaaggtgtgtgtgcagtttggggaagagtatttctgcaaaacaattgacatgaacgattgttttgtcactaggcacgcaaagatctgcataattggaaccgtttccaaattctcacagggtgacacgttactgtttcttggcccaatggaagggggaggcatcatcttcaagcattggtgtaccagtacatgccactttggtgatcccggggacgtgatgggcccgaaagacaagcctttcatttgtccagagtttcccggacagttccggaaaaagtgcaatttcgccactacccctgtgtgtgaatacgatggcaacatcattagcgggtacaagaaagtattggctacaatagactcgtttcaatccttcaatacttctaacatccattttaccgatgagcgcattgagtggagagaccccgatggaatgctcagggaccacatcaatattgtcatcagcaaggatatagacttcgaaaacctggccgagaatccatgcaaagtgggcctacaggcagcgaacatcgaaggtgcctgggggtcaggagttggctttacgctgacatgccaggtgagtctcaccgagtgtcctactttcctgacatccattaaggcttgcgatatggccatctgttatggtgcagaatctgtcacccttagccgtggccaaaatactgtgaaaattaccgggaagggaggccactccgggagtagctttaagtgctgtcatggaaaagagtgcagttctacaggcttgcaggcttccgctccccacctggacaaggttaacggtatcagcgagttagaaaatgagaaagtgtacgatgacggggcaccagaatgtggaataacgtgctggttcaagaaatcgggcgagtgggtaatgggtattatcaacggcaattgggtcgtgctcatcgtgctgtgtgtccttctgttgttttcactcattctgctatctatactgtgcccggttcggaagcataagaaaagttga

SEQ ID NO: 10184 - RNA, 3402 nt, synthetic construct
  misc_feature 1..3402: note = derived and/or modified CDS sequence (opt3) from SEOV(LYON/Rn/FRA/2013/LYO852)__KF387724.1__GP
  source 1..3402: mol_type = other RNA
atgtggagcctgctccttctggccgctttggcaggccaggggttcgccttaaagaacgtgtttgacatgagaatccaatgcccccactccgtcaatttcggagagacctctgtttcaggttacacagaactgcctccactaagtctccaggaggcggaacagctggtgccggagagctcctgtaacatggataatcatcagtctctttcgactattaacaaactgacgaaggtaatatggaggaaaaaggctaatcaagaatcagccagccagaacagttttgaggtggtcgagtccgaagtgtctttcaaaggcttgtgcatgctccggcaccgcatggttgaggaaagctataagaatcgacgttccgtgatctgttacgacctggcatgcaactcaaccttttgtaagcccacagtctatatgattgtgcctatccatgcctgcaatatgatgaaaagttgtctgattgggctcggaccatacagaatccaggtagtttatgagaggacttactgcaccacaggcatattaaccgagggtaagtgtttcgtgcccgataaagctgtcgtgagcgcactgaagcgggggatgtatgccatcgcttctattgaaactatctgctttttcattcaccagaaaggaaacacatacaagatcgtgaccgccataacgtccgcgatgggctcaaagtgtaataacactgacaccaaagtccaaggctactatatttgcatcattgggggaaatagcgcacctgtttacgccccagctggtgaggattttcgcgccatggaagtgttcagtggcatcatcacatctccccatggggaggaccacgatcttcctggagaagagattgcaacttatcagatatccggccagatcgaggctaagattccacacaccgtaagctcgaaaaacttgaagctgacagcctttgcgggtatcccgtcttactcctcaaccagtatactagccgcaagcgaagacgggagattcatttttagccccggactcttccctaatctgaaccagtctgtgtgcgataacaatgcccttccactgatctggaggggcttgatcgacctcacgggctattacgaggctgtccatccctgtaacgtgttctgcgttctgagcgggcctggagcttcatgtgaagcctttagtgagggtggcattttcaatatcacttccccaatgtgcttagtgagcaaacaaaaccggtttcgcgcagccgaacagcagatttctttcgtctgtcaacgagtggatatggacataatcgtatattgcaatgggcagaagaaaacaattctgaccaagactctcgttatcggacagtgtatctacacaattacctcactttttagtctgttgcccggcgtggctcacagcatagcgatcgagctatgcgtcccgggtttccatgggtgggcaacggccgctctgctcattaccttttgtttcggctgggtgctgatccctgcctgcacacttgcaattctgttggtcctcaagtttttcgccaacatcctgcacacttccaatcaggagaacagatttaaagctatattaaggaagatcaaagaagagttcgaaaagaccaaaggatctatggtgtgtgagatttgcaagtacgaatgcgagacactgaaggagctaaaagcccacaatctctcgtgtgttcaaggcgaatgcccctattgttttactcattgcgagccaaccgaaacagcaatccaggcgcactacaaggtgtgtcaggctacccatcggttccgtgaggatctgaaaaagactgtaacgcctcagaacattgggcccggatgctatcgcacacttaatttgttcagatacaaatccaggtgttatatcctgaccatgtggactctcctgcttataattgagtccatcctgtgggccgcatcagccgctgaaattccattggtccccctctggaccgacaacgcccacggtgtgggcagtgttcctatgcatacagacctggagttagatttttctctgccaagctcctcaaagtacacctataagcggcacctaactaatccggtgaacgaccaacagagcgtctctctccacatcgaaatagagtcccaggggatcggagcagatgtgcatcacctgggccattggtacgacgctcgacttaatttgaaaacaagtttccactgctacggtgcctgtacgaagtatcagtacccctggcacaccgcgaaatgccattttgaaaaggattatgagtacgagaacagctgggcctgtaaccctccagactgccccggggtaggcactggatgcacagcttgtggcctgtatctcgatcaactgaaacctgtggggaccgcattcaagattatctctgttcgctactccagaaaggtctgcgtgcagtttggagaagagtatttatgtaaaacaattgacatgaatgattgcttcgtgactaggcacgccaagatctgtataattggtaccgtctcaaaatttagtcagggcgacacgctgcttttcttggggccaatggaaggaggcggtatcatctttaagcattggtgcaccagcacatgtcacttcggggatcccggcgacgttatgggaccgaaagacaagccttttatttgcccagagttccccggccagtttcggaaaaagtgtaacttcgctactacccctgtgtgcgaatacgatgggaatatcatttcgggatacaagaaagtgctcgccacaatagactccttccaatcttttaacactagcaatatccatttcaccgatgagcgcattgagtggagagaccccgatggcatgctgagggaccacatcaacattatcatatcaaaggatatcgactttgaaaatctagcagagaacccatgtaaagtaggtctgcaggcggccaatattgaaggggcttggggaagtggcgtcggtttcacgctcacatgccaggtgtccctgaccgagtgccctacttttcttacatctatcaaggcctgtgatatggcaatttgctatggcgctgaaagcgttaccttgtcccgtgggcaaaacactgtgaaaatcaccggaaagggcgggcactcaggaagcagtttcaagtgttgccatggcaaagagtgttctctgacaggtttacaggcctccgcaccccacctcgacaaggtcaatgggataagcgagctggaaaacgagaaagtgtacgatgacggagccccagaatgcggcattacgtgttggtttaagaaatcgggtgagtgggttatgggcatcatcaatgggaactgggtggtacttattgtcctgtgcgtgttcttgctcttttcactgatactactgtctatcctctgtccggtgcggaagcataagaaaagttga

SEQ ID NO: 10185 - RNA, 3402 nt, synthetic construct
  misc_feature 1..3402: note = derived and/or modified CDS sequence (opt3) from SEOV(Seoul-Baxter/NYC-D1_M)__KJ950863.1__GP
  source 1..3402: mol_type = other RNA
atgtggagcctgctccttctggccgctttggtgggccaggggttcgcattaaagaacgtctttgacatgaaaatccaatgcccccactccgttaatttcggagagacctctgtgtcaggttacacagaactgcctccactaagtctccaggaggccgaacagctggtaccggagagctcctgtaacatggataatcatcagtctctttcgactattaacaagctgacgaaagtgatatggagaaagaaagcgaatcaagaatcagctaaccagaatagctttgaggtcgccgagagtgaagtgtccttcaagggcttgtgcatgctcaagcacaggatggttgaggaatcttatcggaaccgccgaagcgtgatctgttacgacctggcatgcaattccaccttttgtaaacccacagtctatatgattgtgcctatccatgcctgcaacatgatgaagtcatgtctgattgggctcggaccataccgtatccaggtagtttatgagagaacttactgcaccacaggcatattaaccgagggtaaatgtttcgtgcccgataaggctgtcgtgagtgcactgaaaagggggatgtatgccatcgctagcattgaaactatctgctttttcattcaccagaagggaaatacatacaagatcgtgaccgccataacgtctgcgatgggctccaaatgtaacgacactgataccaaggtccaaggctactatatttgcatcattgggggaaattcagcacctgtttacgccccagctggtgaggactttcgggccatggaagtgttcagcggcatcatcacaagtccccatggggaggatcacgaccttcctggagaagagattgcaacttatcagatatctggccagatcgaggctaaaattccacacaccgtatccagcaagaacttgaaactgacagcctttgcgggtatcccgtcgtactcttccacctcaatactagccgcaagtgaagatgggcgcttcatttttagccccggactcttccctaatctgaaccagtccgtgtgcgacaacaatgcccttccactggtctggagaggcttgatcgatctcacgggctattacgaggccgtgcatccctgtaacgttttctgcgtgctgtctgggcctggagctagctgtgaagccttttcagagggtggcatcttcaatattacttcaccaatgtgcttagtctccaagcaaaacaggtttcgggcagccgaacagcagatcagcttcgtgtgtcaacgcgtagacatggatattatagtttattgcaatgggcagaaaaagacaatcctgaccaagactctcgtgattggacagtgtatctacacaatcacctctttgttttcactgttgcccggcgtcgctcacagtattgcgatagagctatgcgtgccgggtttccatgggtgggcaacggccgctctgctcatcaccttttgtttcggctgggtcctgattcctgcctgcacacttgcaatcctgttggtgctcaaatttttcgccaacattctgcacactagcaatcaggagaaccgatttaaggctatcttaagaaaaataaaggaagagttcgagaaaaccaagggatccatggtttgtgaaatctgcaagtacgaatgcgagacactgaaagagctaaaggcccacaatctctcttgtgtgcaaggcgaatgcccctattgttttactcattgcgagccaaccgaaacagcaattcaggcgcactacaaagtatgtcaggctacccataggttccgggaggacctgaagaaaactgtcacgcctcagaacatcgggcccggatgctatcgtacacttaatttgttccgctacaagtcgagatgttatattctgaccatgtggactctcctgcttatcatagagagcattctgtgggccgcatccgccgctgaaatcccattggtgcccctctggaccgacaacgcccacggtgttggctcagtgcctatgcatacagatctggagttagactttagtctgccatctagctccaagtacacctataaaaggcacctaactaatccggtcaacgatcaacagtcagtgagcctccacattgaaatcgagtctcaggggataggagcagacgtacatcacctgggccattggtacgatgctcggcttaatttgaagacatccttccactgctacggtgcctgtacgaaatatcagtacccctggcacaccgcgaagtgccattttgaaaaagactatgagtacgagaacagttgggcctgtaaccctccagattgccccggggtgggcactggatgcacagcttgtggcctgtatctcgaccaactgaagcctgttgggaccgcattcaagatcattagcgtccgatactctcgcaaagtgtgcttacagtttggagaagagtatctgtgtaagacaatcgatatgaatgactgcttcgtgactagacacgtcaaaatttgtatcataggtaccgtttccaagttttcacagggcgatacgcttttgttcctcgggccaatggaaggaggcggtattatctttaaacattggtgcaccagtacatgtcacttcggggaccccggcgacgtgatgggaccgaaggataaaccttttatctgcccagagttccccggccagtttaggaagaagtgtaacttcgccactacccctgtgtgcgaatacgacgggaatattatcagcggatacaaaaaggtactggctacaattgattcgttccaatcctttaacacttctaatatacatttcaccgacgagcggatcgagtggcgcgatcccgacggcatgctaagagatcacattaacatcgtcattagcaaagacatcgattttgaaaatctggccgagaacccatgtaaggtgggtctccaggcagcgaatatagaaggggcctggggatcaggcgttggtttcacgctgacatgccaggtgagtcttaccgagtgccctacttttcttacatccatcaaggcttgtgacatggccatttgctatggcgcagaatctgtcaccctgagcagggggcaaaacactgtgaaaatcaccggaaagggcgggcactccggaagtagcttcaaatgttgccatggcaaggagtgtagttctacaggtttacaggcttccgctccccacctcgataaagttaatgggattagcgagctggaaaacgagaaggtgtacgacgatggagcaccagaatgcggcatcacgtgttggtttaaaaagtcgggtgagtgggtaatgggcataattaatgggaactgggtcgtgcttatcgtgctgtgcgtcttgctcctgttctcactaatcctgctctctattctgtgtccggttcgtaagcataaaaagagttga

SEQ ID NO: 10186 - RNA, 3402 nt, synthetic construct
  misc_feature 1..3402: note = derived and/or modified CDS sequence (opt3) from SEOV(Singapore/06(RN41))__GQ274942.1__GP
  source 1..3402: mol_type = other RNA
atgtggagcctgctccttctggccgctttggcaggccaggggttcgccttaaagaacgtgtttgacatgagaatccaatgcccccactccgtcaatttcggagagacctctgtttcaggttacacagaactgcctccactaagtctccaggaggcggaacagctggtgccggagagctcctgtaacatggataatcatcagtctctttcgactattaacaaactgacgaaggtaatatggaggaaaaaggctaatcaagaatcagccagccagaacagttttgaggtggtcgagtccgaaatctctttcaaaggcttgtgcatgctcaagcaccggatggtggaggaaagctatcgcaatcgacgttccgttatttgttacgacctggcatgcaactcaaccttttgtaagcccacagtgtatatgatcgtccctattcatgcctgcaatatgatgaaaagttgtctgatcgggctcggaccatacagaatacaggtggtatatgagaggacttactgcaccacaggcatcttaaccgagggtaagtgtttcgttcccgataaagctgtggtcagcgcactgaagcgggggatgtatgccattgcttctatcgaaactatttgctttttcatccaccagaaaggaaacacatacaagatagtgaccgccattacgtccgcgatgggctcaaagtgtaataacactgacaccaaagtgcaaggctactatatctgcattatcgggggaaatagcgcacctgtctacgccccagctggtgaggattttcgcgccatggaagttttcagtggcatcattacatctccccatggggaggaccacgatcttcctggagaagagatagcaacttatcagatctccggccagattgaggctaagatcccacacaccgtgagctcgaaaaacttgaagctgacagcctttgcgggtataccgtcttactcctcaaccagtattctagccgcaagcgaagacgggagattcatcttttcccccggactcttccctaatctgaaccagtctgtatgcgataacaatgctttgccactgatctggaggggcttgattgacctcacgggctattacgaggccgtgcatccctgtaacgtcttctgcgtgctgagcgggcctggagcttcatgtgaagcctttagtgagggtggcatcttcaatattacttccccaatgtgcttagttagcaaacaaaaccggtttcgcgcagccgaacagcagatatctttcgtgtgtcaacgagtcgatatggacatcattgtgtattgcaatgggcagaagaaaacaatcctgaccaagactctcgtaatcggacagtgtatttacacaataacctcactttttagtctgttgcccggcgttgctcacagcatcgcgattgagctatgcgtgccgggtttccatgggtgggcaacggccgctctgctcatcaccttttgtttcggctgggtcctgattcctgcctgcacacttgcaatcctgttggtgctcaagtttttcgccaacatactgcacacttccaatcaggagaacagatttaaagctatcttaaggaagattaaagaagagttcgaaaagaccaaaggatctatggtctgtgagatctgcaagtacgaatgcgagacactgaaggagctaaaagcccacaatctctcgtgtgtgcaaggcgaatgcccctattgttttactcattgcgagccaaccgaaacagcaattcaggcgcactacaaggtttgtcaggctacccatcggttccgtgaggatctgaaaaagactgtgacgcctcagaacatcgggcccggatgctatcgcacacttaatttgttcagatacaaatccaggtgttatatactgaccatgtggactctcctgcttattatcgagagcattctgtgggccgcatcagccgctgaaatcccattggtacccctctggaccgacaacgcccacggtgtcggcagtgtgcctatgcatacagacctggagttagatttttctctgccaagctcctcaaagtacacctataagcggcacctaactaatccggttaacgaccaacagagcgtgtctctccacatagaaatcgagtcccaggggattggagcagatgtccatcacctgggccattggtacgacgctcgacttaatttgaaaacaagtttccactgctacggtgcctgtacgaagtatcagtacccctggcacaccgcgaaatgccattttgaaaaggattatgagtacgagaacagctgggcctgtaaccctccagactgccccggggtgggcactggatgcacagcttgtggcctgtatctcgatcaactgaaacctgtagggaccgcattcaagatcatttctgtgcgctactccagaaaggtttgcgtccagtttggagaagagtatttatgtaaaacaatcgacatgaatgattgcttcgtgactaggcacgccaagatatgtattatcggtaccgtgtcaaaatttagtcagggcgacacgctgcttttcttggggccaatggaaggaggcggtatcatttttaagcattggtgcaccagcacatgtcacttcggggatcccggcgacgtcatgggaccgaaagacaagccttttatctgcccagagttccccggccagtttcggaaaaagtgtaacttcgctactacccctgtttgcgaatacgatgggaatattatatcgggatacaagaaagtgctcgccacaatcgactccttccaatcttttaacactagcaatattcatttcaccgatgagcgcatcgagtggagagaccccgatggcatgctgagggaccacattaacatcgtgatatcaaaggatatcgactttgaaaatctagcagagaacccatgtaaagtaggtctgcaggcggccaatattgaaggggcttggggaagtggcgtcggtttcacgctcacatgccaggtgtccctgaccgagtgccctacttttcttacatctatcaaggcctgtgatatggcaatttgctatggcgctgaaagcgttaccttgtcccgtgggcaaaacactgtgaaaatcaccggaaagggcgggcactcaggaagcagtttcaagtgttgccatggcaaagagtgttcttccacaggtctgcaggccagcgcaccccacttagacaaggtcaatgggatatcggagctcgaaaacgagaaagtgtacgatgacggagccccagaatgcggcattacgtgttggtttaagaaatcaggtgagtgggttatgggcatcatcaatgggaactgggtggtactgattgtcctttgcgtgctgcttctcttctctctgatactactgagtatcctctgtccggtgcggaagcataagaaatcctga

SEQ ID NO: 10187 - RNA, 3402 nt, synthetic construct
  misc_feature 1..3402: note = derived and/or modified CDS sequence (opt3) from SEOV(11CSG)__AB618131.1__GP
  source 1..3402: mol_type = other RNA
atgtggagcctgctccttctggccgctttggcaggccaggggttcgccttaaagaacgtgtttgacatgagaatccaatgcccccactccgtcaatttcggagagacctctgtttcaggttacacagaactgcctccactaagtctccaggaggcggaacagctggtgccggagagctcctgtaacatggataatcatcagtctctttcgactattaacaaactgacgaaggtaatatggaggaaaaaggctaatcaagaatcagccagccagaacagttttgaggtggtcgagtccgaagtgtctttcaaaggcttgtgcatgctcaagcaccggatggttgaggaaagctatcgcaatcgacgttccgtgatctgttacgacctggcatgcaactcaaccttttgtaagcccacagtctatatgattgtgcctatccatgcctgcaatatgatgaaaagttgtctgattgggctcggaccatacagaatccaggtagtttatgagaggacttactgcaccacaggcatattaaccgagggtaagtgtttcgtgcccgataaagctgtcgtgagcgcactgaagcgggggatgtatgccatcgcttctattgaaactatctgctttttcgtgcaccagaaaggaaacacatacaagattgtcaccgccatcacgtccgcgatgggctcaaagtgtaataacactgacaccaaagttcaaggctactatatatgcattatcgggggaaatagcgcacctgtgtacgccccagctggtgaggattttcgcgccatggaagtattcagtggcattatcacatctccccatggggaggaccacgatcttcctggagaagagatcgcaacttatcagatttccggccagatagaggctaagtttccacacaccgtgagctcgaaaaacttgaagctgacagccttcgcgggtatcccgtcttactcctcaaccagtattctagccgcaagcgaagacgggagatttatcttctcccccggactcttccctaatctgaaccagtctgtctgcgataacaatgcccttccactgatatggaggggcttgattgacctcacgggctattacgaggctgtgcatccctgtaacgtgttttgcgttctgagcgggcctggagcttcatgtgaagccttcagtgagggtggcatctttaatatcacttccccaatgtgcttagtcagcaaacaaaaccggttccgcgcagccgaacagcagatttcttttgtgtgtcaacgagtagatatggacatcattgtttattgcaatgggcagaagaaaacaatactgaccaagactctcgtgatcggacagtgtatttacacaatcacctcacttttcagtctgttgcccggcgtcgctcacagcatcgcgattgagctatgcgtgccgggttttcatgggtgggcaacggccgctctgctcataaccttctgttttggctgggtcctgatccctgcctgcacacttgcaattctgttggtgctcaagttctttgccaacatcctgcacacttccaatcaggagaacagattcaaagctattttaaggaagatcaaagaagagtttgaaaagaccaaaggatctatggtttgtgagatatgcaagtacgaatgcgagacactgaaggagctaaaagcccacaatctctcgtgtgtgcaaggcgaatgcccctattgtttcactcattgcgagccaaccgaaacagcaatccaggcgcactacaaggtatgtcaggctacccatcggttccgtgaggatctgaaaaagactgtcacgcctcagaacattgggcccggatgctatcgcacacttaatttgtttagatacaaatccaggtgttatatcctgaccatgtggactctcctgcttattatcgagagcatactgtgggccgcatcagccgctgaaattccattggtgcccctctggaccgacaacgcccacggtgttggcagtgtgcctatgcatacagacctggagttagatttctctctgccaagctcctcaaagtacacctataagcggcacctaactaatccggtcaacgaccaacagagcgtgtctctccacatcgaaattgagtcccaggggatcggagcagatgtacatcacctgggccattggtacgacgctcgacttaatttgaaaacaagttttcactgctacggtgcctgtacgaagtatcagtacccctggcacaccgcgaaatgccatttcgaaaaggattatgagtacgagaacagctgggcctgtaaccctccagactgccccggggtgggcactggatgcacagcttgtggcctgtatctcgatcaactgaaacctgttgggaccgcatttaagataatctctgtccgctactccagaaaggtgtgcgtgcagttcggagaagagtatttatgtaaaacaattgacatgaatgattgctttgtcactaggcacgccaagatctgtattatcggtaccgtttcaaaattcagtcagggcgacacgctgctctttttggggccaatggaaggaggcggtataattttcaagcattggtgcaccagcacatgtcactttggggatcccggcgacgtgatgggaccgaaagacaagcctttcatctgcccagagtttcccggccagttccggaaaaagtgtaacttcgctactacccctgtgtgcgaatacgatgggaatacaatctcgggatacaagaaagtactcgccactattgactcctttcaatctttcaacaccagcaatatccattttacggatgagcgcattgagtggagagaccccgatggcatgctgagggaccacataaacatcgtcatttcaaaggatatcgacttcgaaaatctagcagagaacccatgtaaagtgggtctgcaggcggccaatattgaaggggcttggggaagtggcgttggttttacacttacctgccaggtgtccctgactgagtgccctacattccttacctctatcaaggcctgtgatatggcaatatgctatggcgctgaaagcgtcactttgtcccgtgggcaaaacaccgtgaaaatcacaggaaagggcgggcactcaggaagcagttttaagtgttgccatggcaaagagtgttcttccacgggtctgcaggccagcgcaccccacttagacaaggttaatgggatttcggagctcgaaaacgagaaagtgtacgatgacggagccccagaatgcggcatcacctgttggttcaagaaatcaggtgagtgggtaatgggcattatcaatgggaactggatagtcctgattgtgctttgcgtgctgttgctcttttctctgatcctactgagtatcctctgtccggtccggaagcataagaaatcctga

SEQ ID NO: 10188 - RNA, 3402 nt, synthetic construct
  misc_feature 1..3402: note = derived and/or modified CDS sequence (opt3) from SEOV(5CSG)__AB618130.1__GP
  source 1..3402: mol_type = other RNA
atgtggagcctgctccttctggccgctttggcaggccaggggttcgccttaaagaacgtgtttgacatgagaatccaatgcccccactccgtcaatttcggagagacctctgtttcaggttacacagaactgcctccactaagtctccaggaggcggaacagctggtgccggagagctcctgtaacatggataatcatcagtctctttcgactattaacaaactgacgaaggtaatatggaggaaaaaggctaatcaagaatcagccagccagaacagttttgaggtggtcgagtccgaagtgtctttcaaaggcttgtgcatgctcaagcaccggatggttgaggaaagctatcgcaatcgacgttccgtgatctgttacgacctggcatgcaactcaaccttttgtaagcccacagtctatatgattgtgcctatccatgcctgcaatatgatgaaaagttgtctgattgggctcggaccatacagaatccaggtagtttatgagaggacttactgcaccacaggcatattaaccgagggtaagtgtttcgtgcccgataaagctgtcgtgagcgcactgaagcgggggatgtatgccatcgcttctattgaaactatctgctttttcattcaccagaaaggaaacacatacaagatcgtgaccgccataacgtccgcgatgggctcaaagtgtaataacactgacaccaaagtccaaggctactatatttgcatcattgggggaaatagcgcacctgtttacgccccagctggtgaggattttcgcgccatggaagtgttcagtggcatcatcacatctccccatggggaggaccacgatcttcctggagaagagattgcaacttatcagatatccggccagatcgaggctaagattccacacaccgtaagctcgaaaaacttgaagctgacagcctttgcgggtatcccgtcttactcctcaaccagtatactagccgcaagcgaagacgggagattcatttttagccccggactcttccctaatctgaaccagtctgtgtgcgataacaatgcccttccactgatctggaggggcttgatcgacctcacgggctattacgaggctattcatccctgtaacgtcttctgcgtgctgagcgggcctggagcttcatgtgaagcctttagtgagggtggcatcttcaatattacttccccaatgtgcttagttagcaaacaaaaccggtttcgcgcagccgaacagcagatatctttcgtgtgtcaacgagtcgatatggacatcattgtgtattgcaatgggcagaagaaaacaatcctgaccaagactctcgtaatcggacagtgtatttacacaataacctcactttttagtctgttgcccggcgttgctcacagcatcgcgattgagctatgcgtgccgggtttccatgggtgggcaacggccgctctgctcatcaccttttgtttcggctgggtcctgattcctgcctgcacacttgcaatcctgttggtgctcaagtttttcgccaacatactgcacacttccaatcaggagaacagatttaaagctatcttaaggaagattaaagaagagttcgaaaagaccaaaggatctatggtctgtgagatctgcaagtacgaatgcgagacactgaaggagctaaaagcccacaatctctcgtgtgtgcaaggcgaatgcccctattgttttactcattgcgagccaaccgaaacagcaattcaggcgcactacaaggtttgtcaggctacccatcggttccgtgaggatctgaaaaagactgtgacgcctcagaacatcgggcccggatgctatcgcacacttaatttgttcagatacaaatccaggtgttatatactgaccatgtggactctcctgcttattatcgagtccattctgtgggccgcatcagccgctgaaatcccattggtacccctctggaccgacaacgcccacggtgtcggcagtgtgcctatgcatacagacctggagttagatttttctctgccaagctcctcaaagtacacctataagcggcacctaactaatccggttaacgaccaacagagcgtgtctgtccacatagaaatcgagtcccaggggattggagcagatgtgcatcacctcggccattggtacgacgctcgactgaatcttaaaacaagtttccactgctacggtgcctgtacgaagtatcagtacccctggcacaccgcgaaatgccattttgaaaaggattatgagtacgagaacagctgggcctgtaaccctccagactgccccggggtaggcactggatgcacagcttgtggcttgtatctggatcaactcaaacctgtggggaccgcattcaagatcatttctgttcgctactccagaaaggtctgcgtgcagtttggagaagagtatctgtgtaaaacaatcgacatgaatgattgcttcgtgactaggcacgccaagatatgtattatcggtaccgtctcaaaatttagtcagggcgacacgttactgttccttgggccaatggaaggaggcggtatcatttttaagcattggtgcaccagcacatgtcacttcggggatcccggcgacgttatgggaccgaaagacaagccttttatctgcccagagttccccggccagtttcggaaaaagtgtaacttcgctactacccctgtgtgcgaatacgatgggaatacaatttcgggatacaagaaagtgttggccactatagactccttccaatcttttaacaccagcaatatccatttcacggatgagcgcattgagtggagagaccccgatggcatgctcagggaccacatcaacattgtaatctcaaaggatatagactttgaaaatctggcagagaacccatgtaaagtcggtctacaggcggccaatatcgaaggggcttggggaagtggcgtgggtttcacactgacctgccaggtttccctcactgagtgccctacatttctgacctctattaaggcctgtgatatggcaatctgctatggcgctgaaagcgtgactctttcccgtgggcaaaacaccgtcaaaattacaggaaagggcgggcactcaggaagcagtttcaagtgttgccatggcaaagagtgttcttccacgggtttgcaggccagcgcaccccacctggacaaggtgaatgggatctcggagttagaaaacgagaaagtttacgatgacggagccccagaatgcggcataacctgttggtttaagaaatcaggtgagtgggtgatgggcattatcaatgggaactgggtagtcctcatcgtgctgtgcgtgcttctgttgttctctctcattctgctaagtatactgtgtccggtccggaagcataagaaatcctga

SEQ ID NO: 10189 - RNA, 3402 nt, synthetic construct
  misc_feature 1..3402: note = derived and/or modified CDS sequence (opt3) from SEOV(80-39)__S47716.1__GP
  source 1..3402: mol_type = other RNA
atgtggagcctgctccttctggccgctttggtgggccaggggttcgcattaaagaacgtctttgacatgagaatccaatgcccccactccgttaaattcggagagacctctgtgtcaggttacacagaactgcctccactaagtctccaggaggccgaacagctggtaccggagagctcctgtaatatggataaccatcagtctctttcgactattaataagctgacgaaagtgatatggaggaagaaagcgaaccaagaatcagctaatcagaacagctttgagttgatggagagtgaagtctccttcaagggcctctgcatgctgaagcaccggatggtggaggaatcttatcgcaatcgacgtagcgttatctgttacgacctggcctgcaactccaccttttgtaaacccacagtgtatatgattgtccctatccatgcatgcaatatgatgaagtcatgtctcattgggttaggaccatacagagtgcaggtagtttatgagaggacttactgcaccacaggcatcctgaccgagggtaaatgtttcgtgcccgataaggccgtcgtgagtgctcttaaacgggggatgtatgcaatagccagcatcgaaactatttgctttttcatccaccagaagggaaacacatacaagattgtgaccgctatcacgtctgccatgggctccaaatgtaataacactgacaccaaggtccaaggctactatatatgcattatcgggggaaattcagcgcctgtttacgcaccagccggtgaggattttcgcgctatggaagtgttcagcggcattatcacaagtccccatggggaggaccacgatttgcctggagaagagatcgccacttatcagatttctggccagatagaggcaaaaatcccacacaccgtatccagcaagaacctgaaactaacagcttttgccggtattccgtcgtactcttccacctcaatcctcacggcgagtgaagacgggagattcatatttagccccggactgttccctaatcttaaccagtccgtgtgcgataacaatgccctgccattgatttggaggggcctcatcgacctgactggctattacgaggcagtccatccctgtaacgtgttctgcgttttatctgggcctggagctagctgtgaagccttttcagagggtggcatcttcaatattacaagtccaatgtgcctggtgtccaagcaaaaccggtttcgcgctgccgaacagcagatcagcttcgtctgtcaacgagtggatatggacattatagtatattgcaatgggcagaaaaagaccatcctcactaagacacttgttattggacagtgtatctacaccatcacgtctctgttttcattgctacccggcgtggcacacagtattgccatagagctgtgcgtcccgggtttccatgggtgggctaccgcggcactcctgatcacattttgtttcggctgggtgcttattcctgcctgcactctggctatcttgctcgtcctgaaatttttcgccaacattttacacaccagcaatcaggagaacagatttaaggcaatcctgaggaaaataaaggaagagttcgagaaaacaaagggatccatggtgtgtgaaatctgcaagtacgaatgcgagactctaaaagagctcaaggcccacaatctgtcttgtgttcaaggcgaatgcccctattgttttacccattgcgagccaacagaaaccgctattcaggcccactacaaagtgtgtcaggcaactcatcggttccgtgaggatcttaagaaaacggtaacacctcagaacatcgggcccggatgctatcgcaccttgaatctgttcagatacaagtcgaggtgttatattctcactatgtggaccctgcttctgatcatagagagcattttgtgggcggcttccgccgcagaaatcccactcgtccccctgtggacagacaacgcccacggtgtgggctcagttcctatgcataccgacttagagctggattttagtctaccatctagctcccggtacacttataagcgacacctcacaaatccggtgaacgaccaacagtcagtcagcctgcacattgaaatcgagtctcaggggataggagctgatgtgcatcaccttggccattggtacgacgcccgcttgaatctgaaaacgtccttccactgctacggtgcatgtaccaagtatcagtacccctggcacactgctaaatgccattttgaaaaggattatgagtacgagaacagttgggcctgtaaccctccagactgccccggggtaggcacaggatgcaccgcgtgtggcctctatctggatcaattaaaacctgtggggacagccttcaagatcattagcgttagatactctaggaaggtctgcgtgcagtttggagaagagtatctgtgtaaaactatcgacatgaatgattgcttcgtgacccggcacgctaagatttgtatcataggtacggtctccaaattttcacagggcgacacccttttgttcctcgggccaatggaaggaggcggtattatctttaagcattggtgcacaagtacttgtcacttcggggatcccggcgacgttatgggaccgaaagacaagccttttatctgcccagagttccccggccagtttcgcaaaaagtgtaacttcgcaaccacacctgtgtgcgaatacgatgggaatattatcagcggatacaagaaagtgctggccactattgactcgttccaatcctttaacacctctaatatacatttcacggatgagagaatcgagtggagggaccccgatggcatgctacgtgaccacattaacatcgtaattagcaaggatatcgactttgaaaatctggctgagaacccatgtaaagtcggtctccaggccgcaaatatagaaggggcgtggggatcaggcgtgggtttcacactgacctgccaggttagtcttactgagtgccctacatttttgacctccatccgggcctgtgatatggctatttgctatggcgccgaatctgtgactctgagccgagggcaaaacaccgtcaagatcacaggaaaaggcgggcactccggaagctcattcaagtgttgccatggcaaggagtgtagtttaacgggtctccaggcatctgctccccacctggacaaagtgaatgggatttccgagcttgaaaacgagaaggtttacgatgacggagccccagaatgcggcatcacctgttggtttaaaaagagcggtgagtgggtgatgggcataattaatgggaactgggtagtcctgatcgtgttgtgcgtgctcctgctattctcgctgatcctcctgtcaattctttgtccggtcagaaaacataagaagtcttga

SEQ ID NO: 10190 - RNA, 3402 nt, synthetic construct
  misc_feature 1..3402: note = derived and/or modified CDS sequence (opt3) from SEOV(93HBQ3)__KM115585.1__GP
  source 1..3402: mol_type = other RNA
atgtggagcctgctccttctggccgctttggtgggccaggggttcgcattaaagaacgtctttgacatgagaatccaatgcccccactccgttaaattcggagagacctctgtgtcaggttacacagaactgcctccactaagtctccaggaggccgaacagctggtaccggagagctcctgtaatatggataaccatcagtctctttcgactattaataagctgacgaaagtgatatggcaaaagaaagcgaaccaggaatcagctaatcagaacagctttgaggtcgccgagagtgaagtgtccttcaagggcttgtgcatgctcaagcacaggatggttgaggaatcttatcggaatcgccgaagcgtgatctgttacgacctggcatgcaactccaccttttgtaaacccacagtctatatgattgtgcctatccatgcctgcaatatgatgaagtcatgtctgattgggctcggaccataccgtatccaggtagtttatgagagaacttactgcaccacaggcatattaaccgagggtaaatgtttcgtgcccgataaggctgtcgtgagtgcactgaaaagggggatgtatgccatcgctagcattgaaactatctgctttttcattcaccaaaagggaaacacatacaagatcgtgaccgccataacgtctgcgatgggctccaaatgtaataacactgacaccaaggtccagggctactatatttgcatcattgggggaaattcagcacctgtttacgccccaagcggtgaggattttcgggctatggaagtgttcagtggcatcatcatgtctccccatggggaggaccacgatcttcctggagaagagattgccacatatcagatatccggccagatcgaggcaaaaattccacacactgtaagctcgaagaacttgaaactgaccgcttttgccggtatcccgtcttactcctcaacaagtatactagcggccagcgaagacgggcgcttcatcttttcccccggactcttccctaatctgaaccaatctgtgtgcgataacaatgcacttccactgatttggagaggcttgatcgacctcaccggctattacgaggctgtccatccctgtaacgtgttctgcgttctgagcgggcctggagcctcatgtgaagcctttagtgagggtggcattttcaatatcacgtccccaatgtgcttagtgagcaagcagaacaggtttcgggccgcagaacagcaaatttctttcgtctgtcagcgcgtggatatggacataatcgtatattgcaatgggcagaaaaagactattctgacaaagaccctcgttatcggacagtgtatctacactattacatcactttttagtctgttgcccggcgtggcccacagcatagctatcgagctatgcgtcccgggtttccatgggtgggcgaccgcagccctgctcattacgttttgtttcggctgggtgctgatccctgcttgcacccttgccattctgttggtcctcaaatttttcgcaaacatcctgcacacatccaatcaagagaaccgatttaaggccatattaagaaaaatcaaggaagagttcgagaaaactaagggatctatggtgtgtgaaatttgcaagtacgaatgcgagaccctgaaagagctaaaggctcacaatctctcgtgtgttcagggcgaatgcccctattgttttacacattgcgagccaactgaaaccgccatccaggcacactacaaagtgtgtcaggcgacacataggttccgggaggatctgaagaaaaccgtaactcctcaaaacattgggcccggatgctatcgtacgcttaatttgttccgctacaagagcagatgttatatcctgacaatgtggaccctcctgcttataattgagtccatcctgtgggctgcctcagcagccgaaattccattggtccccctctggactgacaacgctcacggtgtgggcagtgttcctatgcataccgacctggagttagatttttctctgccaagctcctcaaagtacacatataaaaggcacctaaccaatccggtgaacgaccagcagagcgtctctctccacatcgaaatagagtcccaggggatcggagccgatgtgcatcacctgggccattggtacgacgcacggcttaatttgaagacttcattccactgctacggtgcttgtacaaaatatcaatacccctggcacacggccaagtgccattttgaaaaagattatgagtacgagaacagctgggcgtgtaaccctccagactgccccggggtaggcaccggatgcactgcctgtggcctgtatctcgatcagctgaagcctgtggggacagctttaaagattatctctgttcgatactcccgcaaagtctgcgtgcagttcggagaagagtatctgtgtaagaccattgacatgaatgattgctttgtgacaagacacgcaaaaatctgtataattggtactgtctcaaagttcagtcagggcgacacccttttgtttctcgggccaatggaaggaggcggtatcatcttcaaacattggtgcacgagcacctgtcactttggggatcccggcgacgttatgggaccgaaggacaaacctttcatttgcccagagtttcccggccaattcaggaagaagtgtaactttgccacaactcctgtgtgcgaatacgatgggaatatcatttcgggatacaaaaaggtgctggctaccatagactccttccagtctttcaacacaagcaatatccattttactgatgagcggattgagtggcgcgaccccgatggcatgctaagagaccacatcaacattgtaatctcaaaagatatagacttcgaaaatctggccgagaacccatgtaaggtcggtctccaggcagcgaatatcgaaggggcctggggaagtggcgtgggttttaccctgacgtgccaagtttcccttacagagtgccctaccttcttgacttctattaaggcttgtgatatggccatctgctatggcgcagaaagcgtgacactgttaagggggcagaacaccgtcaaaattactggaaagggcgggcactccggaagtagctttaaatgttgccatggcaaggagtgtagttctaccggtctccaggcttccgctccccacctggacaaagtgaatgggatcagcgagcttgaaaacgagaaggtttacgatgacggagcaccagaatgcggcataacatgttggttcaaaaagtcgggtgagtgggtgatgggcattatcaatgggaactgggtagtcctgatcgtgttgtgcgtgctcctgctattttcactgattctcctgtctatactttgtccggtccgtaagcataaaaagagttga

SEQ ID NO: 10191 - RNA, 3402 nt, synthetic construct
  misc_feature 1..3402: note = derived and/or modified CDS sequence (opt3) from SEOV(93HBQ4)__KM115586.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaagctgacgaaggtgatatggaggaaaaaggcgaatcaagaatcagctaaccagaatagctttgaggtcgccgagagtgaagtgtccttcaaaggcttgtgcatgctcaagcaccggatggttgaggaatcttatcgcaaccgacgtagcgtgatctgttacgacctggcatgcaattccaccttttgtaagcccacagtctatatgattgtgcctatccatgcctgcaacatgatgaaatcatgtctgattgggctcggaccatacagaatccaggtagtttatgagaggacttactgcaccacaggcatattaaccgagggtaagtgtttcgtgcccgataaagctgtcgtgagtgcactgaagcgggggatgtatgccatcgctagcattgaaactatctgctttttcattcaccagaaaggaaatacatacaagatcgtgaccgccataacgtctgcgatgggctccaagtgtaacaatactgacaccaaagtccaaggctactatatttgcatcattgggggaaactcagcacctgtttacgccccaagcggtgaggattttcgcgctatggaagtgttcagtggcatcatcatgtctccccatggggaggaccacgatcttcctggagaagagattgccacatatcagatatccggccagatcgaggcaaagattccacacactgtaagctcgaaaaatttgaagctgaccgcttttgccggtatcccgtcttactcctcaacaagtatactagcggccagcggggactccagattcatttttagccccggactcttccctaacctgaaccagagcgtgtgcgataataacgcacttccactgatctggaggggcttgatcgacctcaccggctattacgaagctgtccatccctgtaatgtgttctgcgttctgtcagggcctggagccagttgtgaggctttttccgaaggtggcattttcaacatcacgagcccaatgtgcttagtgtctaaacaaaatcggtttcgcgccgcagagcagcagatttcattcgtctgtcaacgagtggatatggacataatcgtatattgcaacgggcagaagaaaactattctgacaaagaccctcgttatcggacagtgtatctacactattacaagtctttttagcctgttgcccggcgtggcccactccatagctatcgaactatgcgtcccgggtttccatgggtgggcgaccgcagccctgctcattacgttttgtttcggctgggtgctgatccctgcttgcacccttgccattctgttggtcctcaagtttttcgcaaatatcctgcacacatctaaccaggagaatagatttaaagccatattaaggaagatcaaagaggagttcgaaaagactaaaggatcgatggtgtgtgaaatttgcaagtacgagtgcgaaaccctgaaggagctaaaagctcacaacctcagctgtgttcaaggcgagtgcccctattgttttacacattgcgaaccaactgagaccgccatccaggcacactacaaggtgtgtcaggcgacacatcggttccgtgaagatctgaaaaagaccgtaactcctcagaatattgggcccggatgctatcgcacgcttaacttgttcagatacaaatccaggtgttatatcctgacaatgtggaccctcctgcttataattgagtcaatcctgtgggctgccagtgcagccgagattccattggtccccctctggactgacaatgctcacggtgtgggctctgttcctatgcataccgacctggaattagattttagcctgccatcctcaagcaagtacacatataagcggcacctaaccaacccggtgaatgaccaacagtctgtctccctccacatcgagatagaaagtcaggggatcggagccgatgtgcatcacctgggccattggtacgacgcacgacttaacttgaaaactagcttccactgctacggtgcttgtacaaagtatcagtacccctggcacacggccaaatgccattttgagaaggattatgaatacgagaactcttgggcgtgtaatcctccagactgccccggggtaggcaccggatgcactgcctgtggcctgtatctcgatcaactgaaacctgtggggacagctttcaagattatctccgttcgctactcaagaaaggtctgcgtgcagtttggagaggaatatttatgtaaaaccattgacatgaacgattgcttcgtgacaaggcacgcaaagatctgtataattggtactgtcagtaaatttagccagggcgacaccctgcttttcttggggccaatggagggaggcggtatcatctttaagcattggtgcacgtcgacctgtcacttcggggatcccggcgacgttatgggaccgaaagacaagccttttatttgcccagagttccccggccagtttcggaaaaagtgtaatttcgccacaactcctgtgtgcgaatacgatgggaacatcatttccggatacaagaaagtgctcgctaccatagactctttccaatcttttaatacatcaaacatccatttcactgatgaaaccattgagtggcgcgaccccgatggcatgctgagagaccacatcaatattgtaatcagtaaggatatagactttgagaacctagccgaaaatccatgtaaagtcggtctgcaggcagcgaacatcgagggggcctggggatccggcgtgggtttcacgctcacatgccaggtttctctgaccgaatgccctacttttcttacaagcattaaggcttgtgatatggccatctgctatggcgcagagtccgtgaccttgtcaagggggcaaaatactgtcaaaattaccggaaagggcgggcacagcggaagttctttcaagtgttgccatggcaaagaatgttccagcacaggtctgcaggcttcggcaccccacttagacaaggtgaacgggatctcagagctcgagaatgaacgtgtttacgatgacggagccccagagtgcggcataacgtgttggtttaaaaagtctggtgaatgggtgatgggcattatcaacgggaattgggtagtcctgatcgtgctttgcgtgctgctcttgttcagtctgattctactgtccatactctgtccggtccggaaacataaaaagagctga

SEQ ID NO: 10192 - RNA, 3402 nt, synthetic construct
  misc_feature 1..3402: note = derived and/or modified CDS sequence (opt3) from SEOV(B1)__AB457790.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcgtggagagtgaagtttccttcaaaggcttgtgcatgctcaagcaccggatggtggaggaatcttatcgcaaccgacgtagcgtcatctgttacgacctggcctgcaattccaccttttgtaagcccacagtgtatatgattgtacctatccatgcatgcaacatgatgaaatcatgtctgattgggctcggaccatacagaatccaggttgtgtatgagaggacttactgcaccacaggcatattaaccgagggtaagtgtttcgtccccgataaagccgtggtgagtgctctgaagcgggggatgtatgcaatcgccagcattgaaactatctgctttttcattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggattttcgcgctatggaagtattcagcggcatcatcacaagtccccatggggaggaccacgatcttcctggagaagagattgccacttatcagatatctggccagatcgaggcaaagattccacacaccgtgtccagcaaaaatttgagactgacagcttttgccggtatcccgtcgtactcttccacctcaatactagcggccagtgaagacgggaggttcatttttagccccggactcttccctaacctgaaccagtccgtctgcgataataacgcacttccactgatctggcggggcttgatcgacctcacgggctattacgaggctgtgcatccctgtaatgttttctgcgtgctgtctgggcctggagccagctgtgaagccttttcagagggtggcattttcaacatcacttcaccaatgtgcttagtctccaagcaaaatcgctttcgagccgcagaacagcagattagcttcgtgtgtcaaagagtagatatggacataatcgtttattgcaacgggcagaaaaagacaattctgaccaaaactctcgtgatcggacagtgtatctacacaattacctctctgttttcacttttgcccggcgtcgcccacagtatagctatcgagctatgcgtgccgggtttccatgggtgggcgacggcagccctgctcattaccttttgtttcggctggatcctgattcctgcttggacacttgccatcctgttggtcctcaagtttttcgcaaatatactgcacactagcaaccaggagaataggtttaaggccatcttacggaaaattaaggaagagttcgagaaaaccaagggatccatggtgtgcgaaatctgtaaatacgaatgcgagacactgaaggagctaaaggctcacaacctctcttgcgttcaaggcgaatgtccctattgctttactcattgtgagccaaccgaaacagccattcaggcacactacaaaatctgccaggcgacccatcgtttccgcgaggatctgaagaaaactgtgacgcctcagaatatagggcccggatgttatagaacacttaacttgttcaggtacaagtcgcggtgctatattctgaccatgtggactctcctgcttatcattgagagcatcctgtgggctgcctccgcagccgaaataccattggtacccctctggaccgacaatgctcacggtgtcggctcagtgcctatgcatacagacctggagttagattttagtctgccatctagctccaaatacacctataagcgacacctaactaacccggttaatgaccaacagtcagtgagcctccacatcgaaattgagtctcaggggatcggagccgatgtccatcacctgggccattggtacgacgcacgccttaacttgaagacatccttccactgttacggtgcttgcacgaaatatcagtacccctggcacaccgccaagtgtcattttgaaaaagattatgagtacgagaacagttgggcgtgcaatcctccagactgtcccggggtgggcactggatgcacagcctgcggcctgtatctcgatcaactgaagcctgtagggaccgctttcaaaattatcagcgtgagatactctaggaaggtttgtgtccagtttggagaagagtatttatgcaagacaatagacatgaacgattgtttcgtgactcggcacgcaaaaatttgcatcatcggtaccgtgtccaagttttcacagggcgacacgctgcttttcttggggccaatggaaggaggcggtattatctttaaacattggtgtaccagtacatgccacttcggggatcccggcgacgtcatgggaccgaaggacaaaccttttatttgtccagagttccccggccagtttcgcaagaaatgcaatttcgccactacccctgtttgtgaatacgatgggaacataatcagcggatacaagaaggtgctcgctacaattgactcgttccaatcctttaatacttctaacatccatttcaccgatgagagaattgagtggagggaccccgatggcatgctgcgtgaccacatcaatatagtgatcagcaaagatattgactttgaaaacctagccgagaatccatgcaaggtaggtctgcaggcagcgaacatcgaaggggcctggggatcaggcgtcggtttcacgctcacatgtcaggtgagtctgaccgagtgccctacttttcttacatccattaaggcttgcgatatggccatctgttatggcgcagaatctgttaaattgagccgggggcaaaataccgtgaaaataactggaaagggcgggcactccggaagtagcttcaagtgctgtcatggcaaagagtgcagttctaccggtctgcaggcttccgctccccacttagacaaggtcaacgggattagcgagctcgaaaatgagaaagtgtacgatgacggagcaccagaatgtggcgttacatgctggtttaagaaatcgggtgagtgggtgatgggcatcatcaacgggaattgggtagtcctgattgtgctttgtctgttgctcctgttctcactaatactgctctctatcctgtgcccggtgcgaaagcataagaaaagttga

SEQ ID NO: 10193 - RNA, 3402 nt, synthetic construct
  misc_feature 1..3402: note = derived and/or modified CDS sequence (opt3) from SEOV(B1)__AB457791.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggcagaaaaaggcgaatcaagaatcagctaaccagaatagctttgaggtcgtggagagtgaagtttccttcaaaggcttgtgcatgctcaagcacaggatggtggaggaatcttatcggaaccgccgaagcgtcatctgttacgacctggcctgcaattccaccttttgtaagcccacagtgtatatgattgtacctatccatgcatgcaacatgatgaaatcatgtctgattgggctcggaccataccgtatccaggttgcctatgagagaacttactgcaccacaggcatattaaccgagggtaagtgtttcgtgcccgataaagctgtcgtgagtgcactgaagagggggatgtatgccatcgctagcattgaaactatctgctttttcattcaccaaaaaggaaatacatacaagatcgtgaccgccataacgtctgcgatgggctccaagtgtaacaatactgacaccaaagtccagggctactatatttgcatcattgggggaaactcagcacctgtttacgccccagctggtgaggattttcgggccatggaagtgttcagcggcatcatcacaagtccccatggggaggaccacgatcttcctggagaagagattgcaacttatcagatatctggccagatcgaggctaagattccacacaccgtatccagcaaaaatttgcgcctgacagcctttgcgggtatcccgtcgtactcttccacctcaatactagccgcaagtaaggacgggagattcatttttagccccggactcttccctaacctgaaccaatccgtgtgcgataataacgcccttccactgatctggaggggcttgatcgacctcacgggctattacgaagctgtccatccctgtaatgtgttctgcgttctgtctgggcctggagctagctgtgaggccttttcagaaggtggcattttcaacatcacttcaccaatgtgcttagtgtccaaacagaatcggtttcgcgcagccgagcagcaaattagcttcgtctgtcagcgagtggatatggacataatcgtatattgcaacgggcagaagaaaacaattctgaccaagactctcgttatcggacagtgtatctacacaattacctctcttttctcactgttgcccggcgtggctcacagtatagcgatcgaactatgcgtcccgggtttccatgggtgggcaacggccgctctgctcattaccttttgtttcggctggatcctgattcctgcctgcacacttgcaatcctgttggtgctcaagtttttcgccaatatactgcacactagcaaccaagagaatagatttaaagctatcttaaggaagattaaagaggaatttgagaagaccaaaggatccatggtctgtgaaatctgcaagtacgagtgcgaaacactgaaggagctaaaagcccacaacctctcttgtgtgcagggcgagtgcccctattgttttactcattgcgaaccaaccgagacagcaattcaggcgcactacaagatctgtcaggctacccatcggttccgtgaagatctgaaaaagactgttacgcctcaaaatatagggcccggatgctatcgcacacttaacttgttcagatacaaatcgaggtgttatattctgaccatgtggactctcctgcttatcattgagagcatcctgtgggccgcatccgccgctgagataccattggtgcccctctggaccgacaatgcccacggtgtaggctcagtccctatgcatacagacctggaattagattttagtctgccatctagctccaagtacacctataagcggcacctaactaacccggtgaatgaccagcagtcagttagcctccacatcgagattgaatctcaggggatcggagcagatgtgcatcacctgggccattggtacgacgctcgacttaacttgaaaacatccttccactgctacggtgcctgtacgaagtatcaatacccctggcacaccgcgaaatgccattttgagaaggattatgaatacgagaacagttgggcctgtaatcctccagactgccccggggtcggcactggatgcacagcttgtggcctgtatctcgatcagctgaaacctgtggggaccgcattcaagattatcagcgtacgctactctagaaaggtgtgcgttcagtttggagaggaatatttatgtaaaacaatagacatgaacgattgcttcgtcactaggcacgccaagatttgtatcatcggtaccgtgtccaaattttcacagggcgacacgctgcttttcttggggccaatggagggaggcggtattatctttaagcattggtgcaccagtacatgtcacttcggggatcccggcgacgtgatgggaccgaaagacaagccttttatttgcccagagttccccggccaatttcggaaaaagtgtaatttcgctactacccctgtctgcgaatacgatgggaacataatcagcggatacaagaaagttctcgccacaattgactcgttccagtcctttaatacttctaacatccatttcaccgatgaacgcattgagtggagagaccccgatggcatgctgagggaccacatcaatatagtgatcagcaaggatattgactttgagaacctagcagaaaatccatgtaaagtgggtctgcaggcggccaacatcgagggggcttggggatcaggcgtaggtttcacgctcacatgccaagtcagtctgaccgaatgccctacttttcttacatccattaaggcctgtgatatggcaatctgctatggcgctgagtctgtgaccttgagccgtgggcagaatactgttaaaataaccggaaagggcgggcactccggaagtagcttcaagtgttgccatggcaaagaatgtagttctacaggtctgcaggcctccgcaccccacttagacaaggtgaacgggattagcgagctcgagaatgaaaaagtctacgatgacggagccccagagtgcggcgtgacgtgttggtttaagaaatcgggtgaatgggttatgggcatcatcaacgggaattgggtggtactgattgtcctttgcctgttgctcctgttctcactaatactgctctctatcctgtgtccgattcggaagcataagaaaagttga

SEQ ID NO: 10194 - RNA, 3402 nt, synthetic construct
  misc_feature 1..3402: note = derived and/or modified CDS sequence (opt3) from SEOV(B1)__AB457792.1__GP
  source 1..3402: mol_type = other RNA
atgtggagcctgctccttatggccgctctggtgggccaggggttcgcattgaagaacgtctttgacatgagaatccaatgcccccactccgttaatttcggagagacctctgtgtcaggttacacagaattacctccactgagtctacaggaggccgaacagctcgtaccggagagctcctgtaacatggataatcatcagtctctgtcgactattaacaaacttacgaaggtgatatggcagaaaaaggcgaatcaagaatcagctaaccagaatagctttgaggtcgtggagagtgaagtttccttcaaaggcctgtgcatgttgaagcacaggatggtggaggaatcttatcggaaccgccgaagcgtcatctgttacgacctcgcctgcaattccaccttttgtaagcccacagtgtatatgattgtacctatccatgcatgcaacatgatgaaatcatgtctgattgggctgggaccataccgtatccaggttgcctatgagagaacttactgcaccacaggcatactcaccgagggtaagtgtttcgtgcccgataaagctgtcgtgagtgcattaaagagggggatgtatgccatcgctagcattgaaactatctgctttttcattcaccaaaaaggaaatacatacaagatcgtgaccgccataacgtctgcgatgggctccaagtgtaacaatactgacaccaaagtccagggctactatatttgcatcattgggggaaactcagcacctgtttacgccccagctggtgaggattttcgggccatggaagtgttcagcggcatcatcacaagtccccatggggaggaccacgatctgcctggagaagagattgcaacttatcagatatctggccagatcgaggctaagattccacacaccgtatccagcaaaaatcttcgcttgacagcctttgcgggtatcccgtcgtactcttccacctcaatactggccgcaagtaaggacgggagattcatttttagccccggactattccctaacctcaaccaatccgtgtgcgataataacgctctgccacttatctggaggggcctgatcgacttgacgggctattacgaagccgtccatccctgtaatgtgttctgcgttctctctgggcctggagctagctgtgaggccttttcagaaggtggcattttcaacatcacttcaccaatgtgcctggtgtccaaacagaatcggtttcgcgcagccgagcagcaaattagcttcgtctgtcagcgagtggatatggacataatcgtatattgcaacgggcagaagaaaacaattttaaccaagactctggttatcggacagtgtatctacacaattacctctctcttttcacttctgcccggcgtggctcacagtatagcgatcgaattgtgcgtcccgggtttccatgggtgggcaacggccgctctactgattaccttttgtttcggctggatcctcattcctgcctgcacactggcaatccttctggtgttgaagtttttcgccaatatactccacactagcaaccaagagaatagatttaaagctatcctgaggaagattaaagaggagttcgaaaagaccaaaggatccatggtctgtgaaatctgcaagtacgagtgcgaaacattaaaggagctgaaagcccacaacctatcttgtgtgcagggcgagtgcccctattgttttactcattgcgaaccaaccgagacagcaattcaggcgcactacaagatctgtcaggctacccatcggttccgtgaagatctcaaaaagactgttacgcctcaaaatatagggcccggatgctatcgcacactgaaccttttcagatacaaatcgaggtgttatattttgaccatgtggactctgctcctgatcattgagagcatcctttgggccgcatccgccgctgagataccactggtgcccttgtggaccgacaatgcccacggtgtaggctcagtccctatgcatacagacctcgaactggattttagtttaccatctagctccaagtacacctataagcggcacctgactaacccggtgaatgaccagcagtcagttagcctacacatcgagattgaatctcaggggatcggagcagatgtgcatcacctcggccattggtacgacgctcgactgaaccttaaaacatccttccactgctacggtgcctgtacgaagtatcaatacccctggcacaccgcgaaatgccattttgagaaggattatgaatacgagaacagttgggcctgtaatcctccagactgccccggggtcggcactggatgcacagcttgtggcttgtatctggatcagctcaaacctgtggggaccgcattcaagattatcagcgtacgctactctagaaaggtgtgcgttcagtttggagaggaatatctgtgtaaaacaatagacatgaacgattgcttcgtcactaggcacgccaagatttgtatcatcggtaccgtgtccaaattttcacagggcgacacgttactgttccttgggccaatggagggaggcggtattatctttaagcattggtgcaccagtacatgtcacttcggggatcccggcgacgtgatgggaccgaaagacaagccttttatttgcccagagttccccggccaatttcggaaaaagtgtaatttcgctactacccctgtctgcgaatacgatgggaacataatcagcggatacaagaaagttttggccacaattgactcgttccagtcctttaatacttctaacatccatttcaccgatgaacgcattgagtggagagaccccgatggcatgctcagggaccacatcaatatagtgatcagcaaggatattgactttgagaacctggcagaaaatccatgtaaagtgggtctacaggcggccaacatcgagggggcttggggatcaggcgtaggtttcacgctgacatgccaagtcagtctcaccgaatgccctacttttctgacatccattaaggcctgtgatatggcaatctgctatggcgctgagtctgtgacccttagccgtgggcagaatactgttaaaataaccggaaagggcgggcactccggaagtagcttcaagtgttgccatggcaaagaatgtagttctacaggtttgcaggcctccgcaccccacctggacaaggtgaacgggattagcgagttagagaatgaaaaagtctacgatgacggagccccagagtgcggcgtgacgtgttggtttaagaaatcgggtgaatgggttatgggcatcatcaacgggaattgggtggtactcattgtcctgtgccttctgctcttgttctcactgatactactgtctatcctctgtccgattcggaagcataagaaaagttga

SEQ ID NO: 10195 - RNA, 3402 nt, synthetic construct
  misc_feature 1..3402: note = derived and/or modified CDS sequence (opt3) from SEOV(B1)__AB457793.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggcagaaaaaggcgaatcaagaatcagctaaccagaatagctttgaggtcgtggagagtgaagtttccttcaaaggcttgtgcatgctcaagcacaggatggtggaggaatcttatcggaaccgccgaagcgtcatctgttacgacctggcctgcaattccaccttttgtaagcccacagtgtatatgattgtacctatccatgcatgcaacatgatgaaatcatgtctgattgggctcggaccataccgtatccaggttgcctatgagagaacttactgcaccacaggcatattaaccgagggtaagtgtttcgtgcccgataaagctgtcgtgagtgcactgaagagggggatgtatgccatcgctagcattgaaactatctgctttttcattcaccaaaaaggaaatacatacaagatcgtgaccgccataacgtctgcgatgggctccaagtgtaacaatactgacaccaaagtccagggctactatatttgcatcattgggggaaactcagcacctgtttacgccccagctggtgaggattttcgggccatggaagtgttcagcggcatcatcacaagtccccatggggaggaccacgatcttcctggagaagagattgcaacttatcagatatctggccagatcgaggctaagattccacacaccgtatccagcaaaaatttgcgcctgacagcctttgcgggtatcccgtcgtactcttccacctcaatactagccgcaagtaaggacgggcatttcatttttagccccggactcttccctaacctgaaccaatccgtgtgcgataataacgcccttccactgatctggagaggcttgatcgacctcacgggctattacgaagctgtccacccctgtaatgtgttctgcgttctgtctgggcctggagctagctgtgaggccttttcagaaggtggcattttcaacatcacttcaccaatgtgcttagtgtccaaacagaataggtttcgggcagccgagcagcaaattagcttcgtctgtcagcgcgtggatatggacataatcgtatattgcaacgggcagaagaaaacaattctgaccaagactctcgttatcggacagtgtatctacacaattacctctcttttctcactgttgcccggcgtggctcatagtatagcgatcgaactatgcgtcccgggtttccacgggtgggcaacggccgctctgctcattaccttttgtttcggctggatcctgattcctgcctgcacacttgcaatcctgttggtgctcaagtttttcgccaatatactgcacactagcaaccaagagaatcgatttaaagctatcttaagaaagattaaagaggaatttgagaagaccaaaggatccatggtctgtgaaatctgcaagtacgagtgcgaaacactgaaggagctaaaagcccataacctctcttgtgtgcagggcgagtgcccctattgttttactcactgcgaaccaaccgagacagcaattcaggcgcattacaagatctgtcaggctacccacaggttccgggaagatctgaaaaagactgttacgcctcaaaatatagggcccggatgctatcgtacacttaacttgttccgctacaaatcgagatgttatattctgaccatgtggactctcctgcttatcattgagagcatcctgtgggccgcatccgccgctgagataccattggtgcccctctggaccgacaatgcccatggtgtaggctcagtccctatgcacacagacctggaattagattttagtctgccatctagctccaagtacacctataagaggcacctaactaacccggtgaatgaccagcagtcagttagcctccatatcgagattgaatctcaggggatcggagcagatgtgcaccatctgggccactggtacgacgctcggcttaacttgaaaacatccttccactgctacggtgcctgtacgaagtatcaatacccctggcataccgcgaaatgccactttgagaaggattatgaatacgagaacagttgggcctgtaatcctccagactgccccggggtcggcactggatgcacagcttgtggcctgtatctcgatcagctgaaacctgtggggaccgcattcaagattatcagcgtacgatactctcgcaaggtgtgcgttcagtttggagaggaatatttatgtaaaacaatagacatgaacgattgcttcgtcactagacatgccaagatttgtatcatcggtaccgtgtccaaattttcacagggcgacacgctgcttttcttggggccaatggagggaggcggtattatctttaagcactggtgcaccagtacatgtcatttcggggatcccggcgacgtgatgggaccgaaagacaagccttttatttgcccagagttccccggccaatttaggaaaaagtgtaatttcgctactacccctgtctgcgaatacgatgggaacataatcagcggatacaagaaagttctcgccacaattgactcgttccagtcctttaatacttctaacatccacttcaccgatgaacggattgagtggcgcgaccccgatggcatgctgagagaccacatcaatatagtgatcagcaaggatattgactttgagaacctagcagaaaatccatgtaaagtgggtctgcaggcggccaacatcgagggggcttggggatcaggcgtaggtttcacgctcacatgccaagtcagtctgaccgaatgccctacttttcttacatccattaaggcctgtgatatggcaatctgctatggcgctgagtctgtgaccttgagcagggggcagaatactgttaaaataaccggaaagggcgggcattccggaagtagcttcaagtgttgccacggcaaagaatgtagttctacaggtctgcaggcctccgcaccccatttagacaaggtgaacgggattagcgagctcgagaatgaaaaagtctacgatgacggagccccagagtgcggcgtgacgtgttggtttaagaaatcgggtgaatgggttatgggcatcatcaacgggaattgggtggtactgattgtcctttgcctgttgctcctgttctcactaatactgctctctatcctgtgtccgattcgtaagcacaagaaaagttga

SEQ ID NO: 10196 - RNA, 3402 nt, synthetic construct
  misc_feature 1..3402: note = derived and/or modified CDS sequence (opt3) from SEOV(B1)__AB457794.1__GP
  source 1..3402: mol_type = other RNA
atgtggagcctgctccttatggccgctctggtgggccaggggttcgcattgaagaacgtctttgacatgagaatccaatgcccccactccgttaatttcggagagacctctgtgtcaggttacacagaattacctccactgagtctacaggaggccgaacagctcgtaccggagagctcctgtaacatggataatcatcagtctctgtcgactattaacaaacttacgaaggtgatatggcagaaaaaggcgaatcaagaatcagctaaccagaatagctttgaggtcgtggagagtgaagtttccttcaaaggcctgtgcatgttgaagcacaggatggtggaggaatcttatcggaaccgccgaagcgtcatctgttacgacctcgcctgcaattccaccttttgtaagcccacagtgtatatgattgtacctatccatgcatgcaacatgatgaaatcatgtctgattgggctgggaccataccgtatccaggttgcctatgagagaacttactgcaccacaggcatactcaccgagggtaagtgtttcgtgcccgataaagctgtcgtgagtgcattaaagagggggatgtatgccatcgctagcattgaaactatctgctttttcattcaccaaaaaggaaatacatacaagatcgtgaccgccataacgtctgcgatgggctccaagtgtaacaatactgacaccaaagtccagggctactatatttgcatcattgggggaaactcagcacctgtttacgccccagctggtgaggattttcgggccatggaagtgttcagcggcatcatcacaagtccccatggggaggaccacgatctgcctggagaagagattgcaacttatcagatatctggccagatcgaggctaagattccacacaccgtatccagcaaaaatcttcgcttgacagcctttgcgggtatcccgtcgtactcttccacctcaatactggccgcaagtaaggacgggcatttcatttttagccccggactattccctaacctcaaccaatccgtgtgcgataataacgctctgccacttatctggagaggcctgatcgacttgacgggctattacgaagccgtccacccctgtaatgtgttctgcgttctctctgggcctggagctagctgtgaggccttttcagaaggtggcattttcaacatcacttcaccaatgtgcctggtgtccaaacagaataggtttcgggcagccgagcagcaaattagcttcgtctgtcagcgcgtggatatggacataatcgtatattgcaacgggcagaagaaaacaattttaaccaagactctggttatcggacagtgtatctacacaattacctctctcttttcacttctgcccggcgtggctcatagtatagcgatcgaattgtgcgtcccgggtttccacgggtgggcaacggccgctctactgattaccttttgtttcggctggatcctcattcctgcctgcacactggcaatccttctggtgttgaagtttttcgccaatatactccacactagcaaccaagagaatcgatttaaagctatcctgagaaagattaaagaggagttcgaaaagaccaaaggatccatggtctgtgaaatctgcaagtacgagtgcgaaacattaaaggagctgaaagcccataacctatcttgtgtgcagggcgagtgcccctattgttttactcactgcgaaccaaccgagacagcaattcaggcgcattacaagatctgtcaggctacccacaggttccgggaagatctcaaaaagactgttacgcctcaaaatatagggcccggatgctatcgtacactgaaccttttccgctacaaatcgagatgttatattttgaccatgtggactctgctcctgatcattgagagcatcctttgggccgcatccgccgctgagataccactggtgcccttgtggaccgacaatgcccatggtgtaggctcagtccctatgcacacagacctcgaactggattttagtttaccatctagctccaagtacacctataagaggcacctgactaacccggtgaatgaccagcagtcagttagcctacatatcgagattgaatctcaggggatcggagcagatgtgcaccatctcggccactggtacgacgctcggctgaaccttaaaacatccttccactgctacggtgcctgtacgaagtatcaatacccctggcataccgcgaaatgccactttgagaaggattatgaatacgagaacagttgggcctgtaatcctccagactgccccggggtcggcactggatgcacagcttgtggcttgtatctggatcagctcaaacctgtggggaccgcattcaagattatcagcgtacgatactctcgcaaggtgtgcgttcagtttggagaggaatatctgtgtaaaacaatagacatgaacgattgcttcgtcactagacatgccaagatttgtatcatcggtaccgtgtccaaattttcacagggcgacacgttactgttccttgggccaatggagggaggcggtattatctttaagcactggtgcaccagtacatgtcatttcggggatcccggcgacgtgatgggaccgaaagacaagccttttatttgcccagagttccccggccaatttaggaaaaagtgtaatttcgctactacccctgtctgcgaatacgatgggaacataatcagcggatacaagaaagttttggccacaattgactcgttccagtcctttaatacttctaacatccacttcaccgatgaacggattgagtggcgcgaccccgatggcatgctcagagaccacatcaatatagtgatcagcaaggatattgactttgagaacctggcagaaaatccatgtaaagtgggtctacaggcggccaacatcgagggggcttggggatcaggcgtaggtttcacgctgacatgccaagtcagtctcaccgaatgccctacttttctgacatccattaaggcctgtgatatggcaatctgctatggcgctgagtctgtgacccttagcagggggcagaatactgttaaaataaccggaaagggcgggcattccggaagtagcttcaagtgttgccacggcaaagaatgtagttctacaggtttgcaggcctccgcaccccatctggacaaggtgaacgggattagcgagttagagaatgaaaaagtctacgatgacggagccccagagtgcggcgtgacgtgttggtttaagaaatcgggtgaatgggttatgggcatcatcaacgggaattgggtggtactcattgtcctgtgccttctgctcttgttctcactgatactactgtctatcctctgtccgattcgtaagcacaagaaaagttga

SEQ ID NO: 10197 - RNA, 3402 nt, synthetic construct
  misc_feature 1..3402: note = derived and/or modified CDS sequence (opt3) from SEOV(B-1)__X53861.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcgtggagagtgaagtttccttcaaaggcttgtgcatgctcaagcaccggatggtggaggaatcttatcgcaaccgacgtagcgtcatctactatgacctggccgggaatagcaccttttgtaagcccacagtgtacatgattgtacctatccatgcatgcaacatgatgaaatcatgtctgattggactcggcccatatagaatccaggttgtgtacgagaggacttattgcaccacaggtatattaaccgaggggaagtgtttcgtccccgataaagccgtggtgagtgctctgaagcggggaatgtacgcaatcgccagcattgaaactatctgctttttcattcaccagaaatggaataagtacaagatcgtcacagctataacctctgccatgggctccaaatgtaacaatacggacactaaggttcaaggctattacatttgcatcattgggggaaactcagcgcctgtgtatgcaccagccggtgaggattttcgcgctatggaagtattcagcggcatcatcaccagtccccatggggaggaccacgatcttcctggagaagagattgccacataccacatatctggccagatcgaggcaaaaattccacatactgtgtccagcaagaatttgagactggctgcctttgcgggtatcccgtcgtattcttccacctcaatactagccgcaagtgaagacgggaggttcatttttagccccggactcttccctaacctgaaccagtccgtctgtgataataacgctttgccactgatctggcggggcttgatcgacctcacaggctactatgaggccgtgcacccctgcaatgttttctgcgtgctgtctgggcctggagctagctgtgaagccttttcagagggtggcattttcaacatcaccagtccaatgtgcttagtctccaaacagaatcgctttcgagcagccgaacaacagattagcttcgtgtgtcagagagtagatatggacataatcgtttactgcaacgggcaaaagaaaacgattctgactaagacactcgtgatcggacagtgtatctacaccattacttctctttttagtctgttgcccggcgtcgctcatagtatagcgatcgagctatgcgtgccgggtttccacgggtgggcaacagccgctctgctcattaccttttgtttcggctgggtcctgatccctgcctgcacgcttgcaattctgttggtgctcaagtttttcgccaatatcctgcacaccagcaaccaggagaataggtttaaagctatattacggaagatcaaagaagagttcgaaaagcgtaaaggatccatggtttgtgagatttgcaagtatgaatgtgagacactgaaggagctaaaagcccataacctctcttgcgtgcagggcgaatgcccctactgttttactcactgcgagccaaccgaaacagcaatccaagcgcattataaggtatgtcaggctactcaccgcttcagagaggatctgaaaaagaccgtcacacctcagaatattgggcccggatgctacaggacccttaacttgttccggtataaatcgcgatgttacatcctgactatgtggacgctcctgcttataattgagagcatcctgtgggccgcatccgccgctgaaattccattggtgcccctctggacagacaatgcccatggtgttggctcagtgcctatgcacaccgacctggagttagattttagtctgccatctagctccaagtatacttacaagcgccacctaaccaacccggtcaatgaccagcaatcagtgagcctccatatcgaaatagagtctcaggggatcggagcagatgtacaccatctgggccactggtacgacgctagacttaacttgaaaacatccttccactgctatggtgcctgtaccaagtaccagtatccctggcatactgcgaaatgccactttgaaaaggattacgagtatgagaacagttgggcctgtaatcctccagactgccccggggtgggcacaggatgtacggcttgcggcctgtacctcgatcagctgaaacctgttgggaccgcattcaagattatcagcgtcaggtattctcggaaggtgtgcgtgcaatttggagaggaacatttatgtaaaactattgacatgaacgattgcttcgtcacacgccacgccaagatctgtataattggtaccgtttccaaattttcacagggcgacacactgcttttcttggggccaatggaaggaggcggtatcatctttaagcattggtgcacttcaacctgtcacttcggggatcccagagacgtgatgggcccgaaagacaagccttttatttgcccagagttccccggacagtttaggaaaaagtgtaatttcgctacgacccctgtgtgcgaatacgatggcaacatcattagcgggtacaagaaagtactcgccacaatagactcgttccagtcctttaatacttctaacatccacttcaccgatgagcgtattgagtggcgggaccccgatggaatgctgcgagaccatatcaatattgtcatcagcaaggatatagactttgaaaacctagcagagaatccatgtaaagtgggcctgcaagcggccaacatcgaaggtgcttgggggtcaggagttggcttcacactcacttgccaggtgagtctgaccgagtgtcctacgtttcttacatccattaaggcctgcgatatggcaatctgctatggtgctgaatctgtcaccttgagcagaggccagaatactgtgaaaattacagggaagggaggccactccgggtcatccttcaagtgttgccatggaaaagagtgtagttctaccggcctgcaagcctccgcaccccacttagacaaggttaacggtatcagcgagctcgaaaatgagaaagtgtacgatgacggggccccagaatgcggagtaacttgttggtttaagaaatcgggcgagtgggtcatgggtataattaacggcaattgggtggtgctgatcgtcctttgcgttctgcttctcttctcactgatcctactgtctattctctgtccggtgaggaagcataagaaaagttga

SEQ ID NO: 10198 - RNA, 3402 nt, synthetic construct
  misc_feature 1..3402: note = derived and/or modified CDS sequence (opt3) from SEOV(BjHD01)__DQ133505.1__GP
  source 1..3402: mol_type = other RNA
atgtggagcctcctgttccttgccgctctggtgggccaggggtttgcattgaagaacgtcttcgacatgagaatccaatgcccccactccgttaattttggagagacctctgtgtcaggttacacagaattacctccactgagtctacaggaggccgaacagctcgtaccggagagctcctgtaacatggataatcatcagtctctgtcgactattaacaaacttacgaaggtgatatggaggaaaaaggcgaatcaagaatcagctaaccagaatagcttcgaggtcgtggagagtgaagtttcctttaaaggcctgtgcatgttgaagcaccggatggtggaggaatcttatcgcaaccgacgtagcgtcatctgttacgacctcgcctgcaattccaccttctgtaagcccacagtgtatatgattgtacctatccatgcatgcaacatgatgaaatcatgtctgattgggctgggaccatacagaatccaggttgtgtatgagaggacttactgcaccacaggcatactcaccgagggtaagtgttttgtccccgataaagccgtggtgagtgctttaaagcgggggatgtatgcaatcgccagcattgaaactatctgcttctttattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggatttccgcgctatggaagtatttagcggcatcatcacaagtccccatggggaggaccacgatctgcctggagaagaggtggccacttatcagatttctggccagatagaggcaaagatcccacacaccgtctccagcaaaaatcttaagttgacagctttcgccggtattccgtcgtactcttccacctcaatcctggcggccagtgaagacgggagatttatattcagccccggactattccctaacctcaaccagtccgtgtgcgataataacgcactgccacttatttggaggggcctgatcgacttgacgggctattacgaggctgttcatccctgtaatgtgttttgcgtcctctctgggcctggagccagctgtgaagccttctcagagggtggcatctttaacattacttcaccaatgtgcctggtgtccaaacaaaatcggttccgcgccgcagaacagcagatcagctttgtatgtcaacgagttgatatggacattatagtgtattgcaacgggcagaagaaaacaatcttaaccaagactctggtcattggacagtgtatctacacaatcacctctctcttctcacttctgcccggcgtggcccacagtattgctatagagttgtgcgtcccgggttttcatgggtgggcgacggcagccctactgatcaccttctgttttggctgggtgctcattcctgcttgcacactggccatccttctggttttgaagttctttgcaaatattctccacactagcaaccaggagaatagattcaaagccatcctgaggaagataaaagaagagtttgaaaagaccaaaggatccatggtgtgtgagatctgcaagtacgaatgcgagacattaaaggagctgaaagctcacaacctatcttgtgtacaaggcgaatgcccctattgtttcactcattgcgagccaaccgaaacagccattcaggcacactacaaggtctgtcaggcgacccatcggttccgtgaggatctcaaaaagactgtgacgcctcagaatatcgggcccggatgctatcgcacactgaacctttttagatacaaatcgaggtgttatattttgaccatgtggactctgctcctgatcatagagagcattctttgggctgcctccgcagccgaaatcccactggttcccttgtggaccgacaatgctcacggtgtgggctcagtccctatgcatacagacctcgagctggatttcagtttaccatctagctccaagtacacctataagcggcacctgactaacccggtgaatgaccaacagtcagtaagcctacacattgaaatcgagtctcaggggataggagccgatgtgcatcacctcggccattggtacgacgcacgactgaaccttaaaacatcctttcactgctacggtgcttgtacgaagtatcagtacccctggcacaccgccaaatgccatttcgaaaaggattatgagtacgagaacagttgggcgtgtaatcctccagactgccccggggttggcactggatgcacagcctgtggcttgtatctggatcaactcaaacctgtcgggaccgcttttaagatcattagcgtgcgctactctagaaaggtgtgcgtccagttcggagaagagtatctgtgtaaaacaatcgacatgaacgattgctttgttactaggcacgcaaagatttgtatcataggtaccgtgtccaaattctcacagggcgacacgttactgtttcttgggccaatggaaggaggcggtattatcttcaagcattggtgcaccagtacatgtcactttggggatcccggcgacgtgatgggaccgaaagacaagcctttcatctgcccagagtttcccggccagttccggaaaaagtgtaatttcgccactacccctgtatgcgaatacgatgggaacattatcagcggatacaagaaagtcttggctacaattgactcgtttcaatccttcaatacttctaacatacattttaccgatgagcgcatcgagtggagagaccccgatggcatgctcagggaccacattaatatcgtgattagcaaggatatcgacttcgaaaacctggccgagaatccatgtaaagttggtctacaggcagcgaacatagaaggggcctggggatcaggcgtgggttttacgctgacatgccaggtcagtctcaccgagtgccctactttcctgacatccatcaaggcttgtgatatggccatttgctatggcgcagaatctgtgacccttagccgtgggcaaaatactgttaaaatcaccggaaagggcgggcactccggaagtagctttaagtgttgccatggcgaggagtgtagttctacaggtttgcaggcttccgctccccacctggacaaagtgaacgggattagcgaattagagaatgaaaaggtatacgatgacggagcaccagagtgcggcgtcacgtgttggttcaaaaagtcgggtgagtgggtgatgggcatcataaacgggaattgggtggtcctcattgttctgtgcgtgcttctgttgttttcactcatcctgctatctatcctgtgtccggtacggaaacataagaagagttga

SEQ ID NO: 10199 - RNA, 3402 nt, synthetic construct
  misc_feature 1..3402: note = derived and/or modified CDS sequence (opt3) from SEOV(Cherwell)__KM948593.1__GP
  source 1..3402: mol_type = other RNA
atgtggagcctgctccttctggccgctttggtgggccaggggtccgcattaaagaacgtcttcgacatgagaatccaatgcccccactctgttaattttggagagacctcagtgagtggttacacagaactgcctccactaagcctccaggaggccgaacagctggtaccggagtcctcttgtaacatggataatcatcagtcgctttcaactattaacaaactgacgaaggtgatatggaggaaaaaggcgaatcaagaaagcgctaaccagaatagtttcgaggtcgtggagtccgaagtttcttttaaaggcttgtgcatgctcaagcaccggatggtggaggaaagctatcgcaaccgacgttccgtcatctgttacgacctggcctgcaattcaaccttctgtaagcccacagtgtatatgattgtacctatccatgcatgcaacatgatgaaaagttgtctgattgggctcggaccatacagaatccaggttgtgtatgagaggacttactgcaccacaggcatattaaccgagggtaagtgttttgtccccgataaagccgtggtgagcgctctgaagcgggggatgtatgcaatcgcctctattgaaactatctgcttctttattcaccagaaaggaaatacatacaagatcgtcaccgctataacgtccgccatgggctcaaagtgtaacaatactgacaccaaagttcaaggctactatatttgcatcattgggggaaacagcgcgcctgtgtacgcaccagccggtgaggatttccgcgctatggaagtatttagtggcatcatcacatctccccatggggaggaccacgatcttcctggagaagagattgccacttatcagatatccggccagatcgaggcaaagattccacacaccgtgagctcgaaaaatttgaagctgacagctttcgccggtatcccgtcttactcctcaaccagtatactagcggccagcgaagacgggagatttattttctcccccggactctttcctaacctgaaccagtctgtctgcgataataacgcacttccactgatctggaggggcttgatcgacctcacgggctattacgaggctgtgcatccctgtaatgttttctgcgtgctgagcgggcctggagcctcatgtgaggctttcagtgaaggtggcatttttaacatcacttccccaatgtgcttagtcagcaaacaaaatcggttccgcgccgcagaacagcagatttcttttgtgtgtcaacgagtagatatggacataatcgtttattgcaacgggcagaagaaaacaattctgaccaagactctcgtgatcggacagtgtatctacacaattacctcacttttcagtctgttgcccggcgtcgcccacagcatagctatcgagctatgcgtgccgggttttcatgggtgggcgacggcagccctgctcattaccttctgttttggctgggtcctgatccctgcttgcacacttgccattctgttggtgctcaagttctttgcaaatatcctgcacacttccaaccaggagaatagattcaaagccatattaaggaagatcaaagaagagtttgaaaagaccaaaggatctatggtttgtgagatttgcaagtacgaatgcgagacactgaaggagctaaaagctcacaacctctcgtgtgtgcaaggcgaatgcccctattgtttcactcattgcgagccaaccgaaacagccatccaggcacactacaaggtatgtcaggcgacccatcggtttcgtgaggatctgaaaaagactgtcacgcctcccaatattgggccaggatgctatcgcacacttaacttgttcagatacaaatccaggtgttatatcctgaccatgtggactctcctgcttataattgagagcatcctgtgggctgcctcagcagccgaaattcccttggtgcctctctggaccgacaatgctcacggtgttggcagtgtgccaatgcatacagacctggagttagatttctctctgccgagctcctcaaagtacacctataagcggcacctaactaaccccgtcaatgaccagcaaagcgtgtctctccacatcgaaatagagtcccaggggatcggagccgatgtacatcacctgggccattggtacgacgcacgacttaacttgaaaacaagttttcactgctacggtgcttgtacgaagtatcagtacccttggcacaccgccaaatgccatttcgaaaaggattatgagtacgagaacagctgggcgtgtaatccacccgactgccctggggtgggcactggatgcacagcctgtggcgtttatctggatcagctcaaaccagtcgggaccgcttttaagattgtgtctgtgcgctactccagaaaggtctgcgttcaattcggagaagagtatctgtgtaaaacaatcgacatgaacgattgctttgtgactaggcacgcaaagatttgtatcataggtaccgtgtcaaaattcagtcagggcgacacgttactgtttcttgggcccatggaaggaggcggtattatcttcaagcattggtgcaccagcacatgtcactttggggatccgggcgacgtaatgggacctaaagacaagccattcatctgccccgagtttcctggccagttccggaaaaagtgtaattttgccactacccccgtctgcgaatacgatgggaacattatctcgggatacaagaaagtgttggctacaattgactccttccagtctttcaatactagcaacatacattttaccgatgagcgcatcgagtggagagacccagatggcatgctcagggaccacattaatatcgttatttcaaaggatatcgacttcgaaaacctggccgagaatccttgtaaagtgggtctacaagcagcgaacatagaaggggcctggggaagtggcgtcggttttacgctgacatgccaggtgtccctcaccgagtgccccactttcctgacatctatcaaggcttgtgatatggccatttgctatggcgcagaaagcgttaccctttcccgtgggcagaatactgtgaaaatcaccggaaagggcgggcactcaggaagcagttttaagtgttgccatggcaaagagtgttcttccacaggtttgcaagctagcgccccacacctggacaaggtaaacgggatttcggagttagaaaatgagaaagtctacgatgacggagcaccggaatgcggcgtgacgtgttggttcaagaaatcatctgagtgggtgatgggtatcataaacggcaattgggtcgttctcattgtgctgtgcgtacttctgttgtttagtctcatcctgctatccatcctgtgtcctgtgcggaagcataagaaaagctga

SEQ ID NO: 10200 - RNA, 3402 nt, synthetic construct
  misc_feature 1..3402: note = derived and/or modified CDS sequence (opt3) from SEOV(HaixingRn40)__GU592924.1__GP
  source 1..3402: mol_type = other RNA
atgtggagcctgctctttcttgccgctctggtgggccaggggtttgcattgaagaacgtcttcgacatgagaatccaatgcccccactccgttaattttggagagacctctgtgtcaggttacacagaattacctccactgagtctacaggaggccgaacagctcgtaccggagagctcctgtaacatggataatcatcagtctctgtcgactattaacaaacttacgaaggtgatatggaggaaaaaggcgaatcaagaatcagctaaccagaatagcttcgaggtcgtggagagtgaagtttcctttaaaggcctgtgcatgttgaagcaccggatggtggaggaatcttatcgcaaccgacgtagcgtcatctgttacgacctcgcctgcaattccaccttctgtaagcccacagtgtatatgattgtacctatccatgcatgcaacatgatgaaatcatgtctgattgggctgggaccatacagaatccaggttgtgtatgagaggacttactgcaccacaggcatactcaccgagggtaagtgttttgtccccgataaagccgtggtgagtgctttaaagcgggggatgtatgcaatcgccagcattgaaactatctgcttctttattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggatttccgcgctatggaagtatttagcggcatcatcacaagtccccatggggaggaccacgatctgcctggagaagagattgccacttatcagatatctggccagatcgaggcaaagattccacacaccgtgtccagcaaaaatcttaagttgacagctttcgccggtatcccgtcgtactcttccacctcaatactggcggccagtgaagacgggagatttattttcagccccggactattccctaacctcaaccagtccgtctgcgataataacgcactgccacttatctggaggggcctgatcgacttgacgggctattacgaggctgtgcatccctgtaatgttttctgcgtgctctctgggcctggagccagctgtgaggctttctcagaaggtggcatttttaacatcacttcaccaatgtgcctggtctccaaacaaaatcggttccgcgccgcagaacagcagattagctttgtgtgtcaacgagtagatatggacataatcgtttattgcaacgggcagaagaaaacaattttaaccagaactctggtgatcggacagtgtatctacacaattacctctctcttctcacttctgcccggcgtcgcccacagtatagctatcgagttgtgcgtgccgggttttcatgggtgggcgacggcagccctactgattaccttctgttttggctgggtcctcatccctgcttgcacactggccattcttctggtgttgaagttctttgcaaatatcctccacactagcaaccaggagaataggttcaaggccatactgcggaaaatcaaggaagagtttgagaaaaccaagggatccatggtttgtgaaatttgcaaatacgaatgcgagacattaaaggagctgaaggctcacaacctatcttgtgtgcaaggcgaatgcccctattgtttcactcattgcgagccaaccgaaacagccatccaggcacactacaaagtatgtcaggcgacccatcgtttccgcgaggatctcaagaaaactgtcacgcctcagaatattgggcccggatgctatagaacactgaacctttttaggtacaagtcgcggtgttatatcttgaccatgtggactctgctcctgataattgagagcatcctttgggctgcctccgcagccgaaattccactggtgcccttgtggaccgacaatgctcacggtgttggctcagtgcctatgcatacagacctcgagctggatttcagtttaccatctagctccaaatacacctataagcgacacctgactaacccggtcaatgaccaacagtcagtgagcctacacatcgaaatagagtctcaggggatcggagccgatgtacatcacctcggccattggtacgacgcacgcctgaaccttaagacatcctttcactgctacggtgcttgtacgaaatatcagtacccctggcacaccgccaagtgccatttcgaaaaagattatgagtacgagaacagttgggcgtgtaatcctccagactgccccggggtgggcactggatgcacagcctgtggcttgtatctggatcaactcaagcctgttgggaccgcttttaaaattatcagcgtcagatactctaggaaggtgtgcgtgcagttcggagaagagtatctgtgtaagacaattgacatgaacgattgctttgtcactcggcacgcaaaaatctgtataattggtaccgtttccaagttctcacagggcgacacgttactgtttcttgggccaatggaaggaggcggtatcatcttcaaacattggtgcaccagtacatgtcactttggggatcccggcgacgtgatgggaccgaaggacaaacctttcatttgcccagagtttcccggccagttccgcaagaaatgtaatttcgccactacccctgtgtgcgaatacgatgggaacatcattagcggatacaagaaggtattggctacaatagactcgtttcaatccttcaatacttctaacatccattttaccgatgagagaattgagtggagggaccccgatggcatgctccgtgaccacatcaatattgtcatcagcaaagatatagacttcgaaaacctgggtcagaatccatgtaaggtggggctacaggccgcaaacatcgagggagcgtggggctcaggtgttggctttacgctgacatgccaagtgagtctcaccgaatgccctactttcctgacatccattaaagcctgtgatatggctatctgctatggggccgagtctgtcacccttagccggggacagaatactgtgaagattaccggcaaagggggacactccggcagtagctttaagtgttgccatggtaaggaatgtagttctacagggttgcaggcatccgctccccacctggacaaagttaacggaatcagcgatttagagaatgagaaggtgtacgacgatggcgccccagaatgcggtgtaacgtgttggttcaaaaagtcgggcgagtgggtcatggggataattaacggaaattgggtggtgctcatcgtcctgtgcgttcttctgttgttttcactcatcctgctatctattctgtgtccggtgcgaaaacataagaagagttga

SEQ ID NO: 10201 - RNA, 3402 nt, synthetic construct
  misc_feature 1..3402: note = derived and/or modified CDS sequence (opt3) from SEOV(HBQ17)__KM233655.1__GP
  source 1..3402: mol_type = other RNA
atgtggagcctcctgttcgtggccgctcttatcggccaggggtttgcactggagaacgccttcgacatgagaattaggtgcccccactccgtccattttggagaaacctctgtttcaggttacacagagttgcctccattaagtctgcaagaagcggagcagctagtgccggaaagctcctgtaatatggataaccaccagtctctctcgactataaataagctgacgaaagtaatctggcggaagaaagctaaccaggagtcagccaatcaaaacagcttcgaggtggtcgaaagtgcacttaagattaaaggcctgtgcatgttgaagcatcgcatggtggaggaatcctatcgaaatcgtagatctgttatctgttacgacctcgcctgcaacagcaccttttgtaagcccacagtgtatatgattgtccctatccacgcttgcaatatgatgaaatcctgtctgatagggctgggaccatacaggatccaggtggtatatgagcggacttactgcaccacaggcattctcaccgagggtaagtgtttcgttcccgataaagcagtggtctcagccttaaagcgcgggatgtatgctatcgccagtattgaaactatctgctttttcatacatcagaaaggaaacacatacaagattgtgaccgcgatcacgagcgcaatgggctctaagtgtaataacactgacaccaaagtgcagggctactatatttgcatcatcgggggaaattccgcccctgtctacgctccagccggtgaggattttagagcaatggaagttttctcaggcattataacaagcccccacggggaggaccacgatctgcctggagaagagatcgctacttatcaaattagtggccagatcgaggccaagataccacataccgtgtcttccaaaaaccttaagttgacagcgtttgccggtattccgagctactcgtctacctccatcctggcagcttcagaagacgggaggttcatctttagtcccggactattccctaatctcaaccagagcgtatgcgataacaatgccctgccacttatttggcggggcctgatcgacttgacgggctattacgaggctgtgcacccctgtaacgtcttctgcgtgctctccgggcctggagcctcttgtgaagcatttagcgagggtggcattttcaatataacttcaccaatgtgcctggttagtaaacagaaccgctttcgagccgctgaacaacagatctccttcgtgtgtcagagagtcgatatggacattatcgtgtattgcaatgggcaaaagaaaacaatcttaaccaagactctggtaattggacagtgtatatacacaatcaccagcctcttttctcttctgcccggcgttgcgcattcaattgcaatcgagttgtgcgtgccgggtttccacgggtgggccacggctgccctactgattaccttttgtttcggctgggtcctcatccctgcatgcacactggccatacttctggtgttgaagtttttcgctaacatcctccacaccagtaatcaggagaacaggtttaaagccattctgcggaagatcaaagaagagttcgaaaagactaaaggaagcatggtctgtgagatttgcaagtacgaatgcgagacattaaaggagctgaaagcacataatctatcctgtgtgcagggcgaatgcccctattgttttactcactgcgagccaaccgaaacagcgatccaagctcattacaaggtttgtcaggccacccaccgtttccgcgaggatctcaaaaagactgtgacgcctcagaacatagggcccggatgctatagaacactgaatcttttcaggtacaaatctcggtgttatattttgaccatgtggactctgctcctgatcattgagtcgatcctttgggcagccagcgctgccgaaataccactggtacccttgtggaccgacaacgcacatggtgtcggctccgtgcctatgcacacagacctcgagctggatttttcattaccaagttctagcaagtacacctataagcgacacctgactaatccggttaacgaccagcaatccgtgtcactacatatcgaaattgagagccaggggatcggagctgatgtccaccatctcggccactggtacgacgcccgcctgaatcttaaaacatctttccactgctacggtgcgtgtacgaagtatcagtacccctggcataccgccaaatgccactttgaaaaggattatgagtacgagaactcctgggcttgtaaccctccagactgccccggggtgggcactggatgcacagcatgtggcttgtatctggatcagctcaaacctgtagggaccgccttcaagattatcagtgtgagatacagcaggaaggtttgcgtccaatttggagaagagtatctgtgtaaaacaatagacatgaatgattgcttcgtgactcggcatgctaagatttgtatcatcggtaccgtgtctaaattttcccagggcgacacgttactgttccttgggccaatggaaggaggcggtattatctttaagcactggtgcacctcaacatgtcatttcggggatcccggcgacgtcatgggaccgaaagacaagccttttatttgcccagagttccccggccagtttcgcaaaaagtgtaacttcgccactacccctgtttgcgaatacgatgggaatataatcagtggatacaagaaagtgttggcaacaattgacagcttccagtcgtttaacacttccaatatccacttcaccgatgagagaattgagtggagggaccccgatggcatgctccgtgaccacatcaacatagtgatctctaaggatattgactttgaaaatctggcggagaacccatgtaaagtaggtctacaagccgctaatatcgaaggggcctggggaagcggcgtcggtttcacgctgacatgccaggtgtcactcaccgagtgccctacttttctgacaagtattaaggcatgtgatatggctatctgctatggcgccgaatccgttaccctttctcgggggcagaacactgtgaaaataaccggaaagggcgggcatagcggatcctcattcaagtgttgccacggcaaagagtgtagcagtacaggtttgcaagcatctgctccccatctggacaaggtcaatgggatttccgagttagaaaacgagaaagtgtacgatgacggagccccagaatgcggcgttacgtgttggtttaagaaaagcggtgagtgggtgatgggcatcatcaatgggaactgggtagtcctcattgtgctgtgcgtgcttctgttgttctcgctcatactgctatcaatcctgtgtccggtccgaaagcacaagaaatcttga

SEQ ID NO: 10202 - RNA, 3402 nt, synthetic construct
  misc_feature 1..3402: note = derived and/or modified CDS sequence (opt3) from SEOV(HBQ20)__KM233656.1__GP
  source 1..3402: mol_type = other RNA
atgtggagcctcctgttccttgccgctctggtgggccaggggtttgcattgaagaacgtcttcgacatgagaatccaatgcccccactccgttaattttggagagacctctgtgtcaggttacacagaattacctccactgagtctacaggaggccgaacagctcgtaccggagagctcctgtaacatggataatcatcagtctctgtcgactattaacaaacttacgaaggtgatatggaggaaaaaggcgaatcaagaatcagctaaccagaatagcttcgaggtcgtggagagtgaagtttcctttaaaggcctgtgcatgttgaagcaccggatggtggaggaatcttatcgcaaccgacgtagcgtcatctgttacgacctcgcctgcaattccaccttctgtaagcccacagtgtatatgattgtacctatccatgcatgcaacatgatgaaatcatgtctgattgggctgggaccatacagaatccaggttgtgtatgagaggacttactgcaccacaggcatactcaccgagggtaagtgttttgtccccgataaagccgtggtgagtgctttaaagcgggggatgtatgcaatcgccagcattgaaactatctgcttctttattcaccagaaaggaaatacatacaagatcgtcaccgttataacgtctgctatgggctccaagtgtaacaatactgacaccaaagtgcaaggctactatatttgcatcattgggggaaactcagcccctgtatacgcgccagccggtgaggatttccgcgcaatggaagtgtttagcggcatcatcacaagtccccatggggaggaccacgatctgcctggagaagagattgctacttatcagatatctggccagatcgaggccaagattccacacaccgtctccagcaaaaatcttaagttgacagcattcgctggtatcccgtcgtactcttccacctcaatactggccgcgagtgaagacgggagatttattttcagccccggactattccctaacctcaaccagtccgtgtgcgataataacgccctgccacttatctggaggggcctgatcgacttgacgggctattacgaggcagttcatccctgtaatgtgttttgcgtcctctctgggcctggagctagctgtgaagccttctcagagggtggcatttttaacatcacttcaccaatgtgcctggtgtccaaacaaaatcggttccgcgctgccgaacagcagattagctttgtatgtcaacgagttgatatggacataatcgtgtattgcaacgggcagaagaaaacaattttaaccaagactctggtcatcggacagtgtatctacacaattacctctctcttctcacttctgcccggcgtggcacacagtatagccatcgagttgtgcgtcccgggttttcatgggtgggctacggcggcactactgattaccttctgttttggctgggtgctcatccctgcctgcacactggctattcttctggttttgaagttctttgccaatatcctccacactagcaaccaggagaatagattcaaagcaatactgaggaagatcaaagaagagtttgaaaagaccaaaggatccatggtgtgtgagatttgcaagtacgaatgcgagacattaaaggagctgaaagcccacaacctatcttgtgtacaaggcgaatgcccctattgtttcactcattgcgagccaaccgaaacagctatccaggcccactacaaggtctgtcaggcaacccatcggttccgtgaggatctcaaaaagactgtgacgcctcagaatattgggcccggatgctatcgcacactgaacctttttagatacaaatcgaggtgttatatcttgaccatgtggactctgctcctgataattgagagcatcctttgggcggcttccgccgcagaaattccactggttcccttgtggaccgacaatgcccacggtgtgggctcagtccctatgcatacagacctcgagctggatttcagtttaccatctagctccaagtacacctataagcggcacctgactaacccggtgaatgaccaacagtcagtaagcctacacatcgaaatagagtctcaggggatcggagctgatgtgcatcacctcggccattggtacgacgcccgactgaaccttaaaacatcctttcactgctacggtgcatgtacgaagtatcagtacccctggcacaccgctaaatgccatttcgaaaaggattatgagtacgagaacagttgggcctgtaatcctccagactgccccggggttggcactggatgcacagcgtgtggcttgtatctggatcaactcaaacctgtcgggaccgcctttaagattatcagcgtgcgctactctagaaaggtgtgcgtccagttcggagaagagtatctgtgtaaaacaattgacatgaacgattgctttgttactaggcacgctaagatctgtataattggtaccgtgtccaaattctcacagggcgacacgttactgtttcttgggccaatggaaggaggcggtatcatcttcaagcattggtgcaccagtacatgtcactttggggatcccggcgacgtgatgggaccgaaagacaagcctttcatttgcccagagtttcccggccagttccggaaaaagtgtaatttcgcaactacccctgtatgcgaatacgatgggaacatcattagcggatacaagaaagtcttggccacaatagactcgtttcaatccttcaatacttctaacatccattttaccgatgagcgcattgagtggagagaccccgatggcatgctcagggaccacatcaatattgtgatcagcaaggatacggacttcgaaaacctggctgagaatccatgtaaagttggtctacaggccgcaaacatagaaggggcgtggggatcaggcgtgggttttacactgacctgccaggtcagtctcactgagtgccctacattcctgacctccatcaaggcctgtgatatggctatttgctatggcgccgaatctgtgactcttagccgtgggcaaaataccgttaaaatcacaggaaagggcgggcactccggaagtagctttaagtgttgccatggcaaagagtgtagttctacgggtttgcaggcatccgctccccacctggacaaggtgaacgggattagcgagttagaaaatgagaaagtatacgatgacggagccccagaatgcggcgtcacctgttggttcaagaaatcgggtgagtgggtgatgggcatcataaacgggaattgggtggtcctcattgttctgtgcgtgcttctgttgttttcactcatcctgctatctatcctgtgtccggtacggaagcataagaaaagttga

SEQ ID NO: 10203 - RNA, 3402 nt, synthetic construct
  misc_feature 1..3402: note = derived and/or modified CDS sequence (opt3) from SEOV(HBQ43)__KM233657.1__GP
  source 1..3402: mol_type = other RNA
atgtggagcctcctgttccttgccgctctggtgggccagggggtcgcattgaagaacgtttttgacatgagaatccaatgcccccactccgtgaatttcggagagacctctgtatcaggttacacagaattacctccactgagtctacaggaggccgaacagctcgtgccggagagctcctgtaacatggataatcatcagtctctgtcgactattaacaaacttacgaaggtcatatggaggaaaaaggcgaatcaagaatcagctaaccagaatagctttgaggtggttgagagtgaagtgtccttcaaaggcctgtgcatgttgaagcaccggatggtcgaggaatcttatcgcaaccgacgtagcgtgatctgttacgacctcgcctgcaattccaccttttgtaagcccacagtatatatgattgttcctatccatgcatgcaacatgatgaaatcatgtctgattgggctgggaccatacagaatccaggtggtctatgagaggacttactgcaccacaggcatactcaccgagggtaagtgtttcgtgcccgataaagccgtggtcagtgctttaaagcgggggatgtatgcaatcgccagcattgaaactatctgctttttcattcaccagaaaggaaatacatacaagatcgttaccgctataacgtctgccatgggctccaagtgtaacaatactgacaccaaagtgcaaggctactatatttgcatcattgggggaaactcagcgcctgtatacgcaccagccggtgaggattttcgcgctatggaagtgttcagcggcatcatcacaagtccccatggggaggaccacgatctgcctggagaagagattgccacttatcagatatctggccagatcgaggcaaagattccacacaccgtctccagcaaaaatcttaagttgacagcttttgccggtatcccgtcgtactcttccacctcaatactggcggccagtgaagacgggagattcatttttagccccggactattccctaacctcaaccagtccgtgtgcgataataacgcactgccacttatctggaggggcctgatcgacttgacgggctattacgaggctgttcatccctgtaatgtgttctgcgtcctctctgggcctggagccagctgtgaagccttttcagagggtggcattttcaacatcacttcaccaatgtgcctggtgtccaaacaaaatcggtttcgcgccgcagaacagcagattagcttcgtatgtcaacgagttgatatggacataatcgtgtattgcaacgggcagaagaaaacaattttaaccaagactctggtcatcggacagtgtatctacacaattacctctctcttttcacttctgcccggcgtggcccacagtatagctatcgagttgtgcgtcccgggtttccatgggtgggcgacggcagccctactgattaccttttgtttcggctgggtgctcatccctgcttgcacactggccattcttctggttttgaagtttttcgcaaatatcctccacactagcaaccaggagaatagatttaaagccatactgaggaagatcaaagaagagttcgaaaagaccaaaggatccatggtgtgtgagatttgcaagtacgaatgcgagacattaaaggagctgaaagctcacaacctatcttgtgtacaaggcgaatgcccctattgttttactcattgcgagccaaccgaaacagccatccaggcacactacaaggtctgtcaggcgacccatcggttccgtgaggatctcaaaaagactgtgacgcctcagaatattgggcccggatgctatcgcacactgaaccttttcagatacaaatcgaggtgttatatcttgaccatgtggactctgctcctgataattgagagcatcctttgggctgcctccgcagccgaaattccactggttcccttgtggaccgacaatgctcacggtgtgggctcagtccctatgcatacagacctcgagctggattttagtttaccatctagctccaagtacacctataagcggcacctgactaacccggtgaatgaccaacagtcagtaagcctacacatcgaaatagagtctcaggggatcggagccgatgtgcatcacctcggccattggtacgacgcacgactgaaccttaaaacatccttccactgctacggtgcttgtacgaagtatcagtacccctggcacaccgccaaatgccattttgaaaaggattatgagtacgagaacagttgggcgtgtaatcctccagactgccccggggttggcactggatgcacagcctgtggcttgtatctggatcaactcaaacctgtcgggaccgctttcaagattatcagcgtgcgctactctagaaaggtgtgcgtccagtttggagaagagtatctgtgtaaaacaattgacatgaacgattgcttcgttactaggcacgcaaagatctgtataattggtaccgtgtccaaattttcacagggcgacacgttactgttccttgggccaatggaaggaggcggtatcatctttaagcattggtgcaccagtacatgtcacttcggggatcccggcgacgtgatgggaccgaaagacaagccttttatttgcccagagttccccggccagtttcggaaaaagtgtaatttcgccactacccctgtatgcgaatacgatgggaacatcattagcggatacaagaaagtcttggctacaatagactcgttccaatcctttaatacttctaacatccatttcaccgatgagcgcattgagtggagagaccccgatggcatgctcagggaccacatcaatattgtgatcagcaaggatatagactttgaaaacctggccgagaatccatgtaaagttggtctacaggcagcgaacatcgaaggggcctggggatcaggcgtgggtttcacgctgacatgccaggtcagtctcaccgagtgccctacttttctgacatccattaaggcttgtgatatggccatctgctatggcgcagaatctgtgacccttagccgtgggcaaaatactgttaaaattaccggaaagggcgggcactccggaagtagcttcaagtgttgccatggcaaagagtgtagttctacaggtttgcaggcttccgctccccacctggacaaggtgaacgggtttagcgagttagaaaatgagaaagtatacgatgacggagcaccagaatgcggcgtcacgtgttggttcaagaaatcgggtgagtgggtgatgggcatcataaacgggaattgggtggtcctcattgttctgtgcatccttctgttgttttcactcatcctgctatctattctgtgtccggtgcggaagcataagaaaagttga

SEQ ID NO: 10204 - RNA, 3402 nt, synthetic construct
  misc_feature 1..3402: note = derived and/or modified CDS sequence (opt3) from SEOV(HBQ5)__KM233653.1__GP
  source 1..3402: mol_type = other RNA
atgtggagcctgctctttcttgccgctctggtgggccaggggtttgcattgaagaacgtcttcgacatgagaatccaatgcccccactccgttaattttggagagacctctgtgtcaggttacacagaattacctccactgagtctacaggaggccgaacagctcgtaccggagagctcctgtaacatggataatcatcagtctctgtcgactattaacaaacttacgaaggtgatatggaggaaaaaggcgaatcaagaatcagctaaccagaatagcttcgaggtcgtggagagtgaagtttcctttaaaggcctgtgcatgttgaagcaccggatggtggaggaatcttatcgcaaccgacgtagcgtcatctgttacgacctcgcctgcaattccaccttctgtaagcccacagtgtatatgattgtacctatccatgcatgcaacatgatgaaatcatgtctgattgggctgggaccatacagaatccaggttgtgtatgagaggacttactgcaccacaggcatactcaccgagggtaagtgttttgtccccgataaagccgtggtgagtgctttaaagcgggggatgtatgcaatcgccagcattgaaactatctgcttctttattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggatttccgcgctatggaagtatttagcggcatcatcacaagtccccatggggaggaccacgatctgcctggagaagagattgccacttatcagatatctggccagatcgaggcaaagattccacacaccgtgtccagcaaaaatcttaagttgacagctttcgccggtatcccgtcgtactcttccacctcaatactggcggccagtgaagacgggagatttattttcagccccggactattccctaacctcaaccagtccgtctgcgataataacgcactgccacttatctggaggggcctgatcgacttgacgggctattacgaggctgtgcatccctgtaatgttttctgcgtgctctctgggcctggagccagctgtgaagccttctcagagggtggcatttttaacatcacttcaccaatgtgcctggtctccaaacaaaatcggttccgcgccgcagaacagcagattagctttgtgtgtcaacgagtagatatggacataatcgtttattgcaacgggcagaagaaaacaattttaaccaagactctggtgatcggacagtgtatctacacaattacctctctcttctcacttctgcccggcgtcgcccacagtatagctatcgagttgtgcgtgccgggttttcatgggtgggcgacggcagccctactgattaccttctgttttggctgggtcctcatccctgcttgcacactggccattcttctggtgttgaagttctttgcaaatatcctccacactagcaaccaggagaatagattcaaagccatactgaggaagatcaaagaagagtttgaaaagaccaaaggatccatggtttgtgagatttgcaagtacgaatgcgagacattaaaggagctgaaagctcacaacctatcttgtgtgcaaggcgaatgcccctattgtttcactcattgcgagccaaccgaaacagccatccaggcacactacaaggtatgtcaggcgacccatcggttccgtgaggatctcaaaaagactgtcacgcctcagaatattgggcccggatgctatcgcacactgaacctttttagatacaaatcgaggtgttatatcttgaccatgtggactctgctcctgataattgagagcatcctttgggctgcctccgcagccgaaattccactggtgcccttgtggaccgacaatgctcacggtgttggctcagtgcctatgcatacagacctcgagctggatttcagtttaccatctagctccaagtacacctataagcggcacctgactaacccggtcaatgaccaacagtcagtgagcctacacatcgaaatagagtctcaggggatcggagccgatgtacatcacctcggccattggtacgacgcacgactgaaccttaaaacatcctttcactgctacggtgcttgtacgaagtatcagtacccctggcacaccgccaaatgccatttcgaaaaggattatgagtacgagaacagttgggcgtgtaatcctccagactgccccggggtgggcactggatgcacagcctgtggcttgtatctggatcaactcaaacctgttgggaccgcttttaagattatcagcgtccgctactctagaaaggtgtgcgtgcagttcggagaagagtatctgtgtaaaacaattgacatgaacgattgctttgtcactaggcacgcaaagatctgtataattggtaccgtttccaaattctcacagggcgacacgttactgtttcttgggccaatggaaggaggcggtatcatcttcaagcattggtgcaccagtacatgtcactttggggatcccggcgacgtgatgggaccgaaagacaagcctttcatttgcccagagtttcccggccagttccggaaaaagtgtaatttcgccactacccctgtgtgcgaatacgatgggaacatcattagcggatacaagaaagtattggctacaatagactcgtttcaatccttcaatacttctaacatccattttaccgatgagcgcattgagtggagagaccccgatggcatgctcagggaccacatcaatattgtcatcagcaaggatatagacttcgaaaacctggccgagaatccatgtaaagtgggtctacaggcagcgaacatcgaaggggcctggggatcaggcgttggttttacgctgacatgccaggtgagtctcaccgagtgccctactttcctgacatccattaaggcttgtgatatggccatctgctatggcgcagaatctgtcacccttagccgtgggcaaaatactgtgaaaattaccggaaagggcgggcactccggaagtagctttaagtgttgccatggcaaagagtgtagttctacaggtttgcaggcttccgctccccacctggacaaggttaacgggatcagcgagttagaaaatgagaaagtgtacgatgacggagcaccagaatgcggcgtaacgtgttggttcaagaaatcgggtgagtgggtcatgggcataattaacgggaattgggtggtgctcatcgtcctgtgcgttcttctgttgttttcactcatcctgctatctattctgtgtccggtgcggaagcataagaaaagttga

SEQ ID NO: 10205 - RNA, 3402 nt, synthetic construct
  misc_feature 1..3402: note = derived and/or modified CDS sequence (opt3) from SEOV(HBT14)__KM233658.1__GP
  source 1..3402: mol_type = other RNA
atgtggagcctgctctttcttgccgctctggtgggccaggggtttgcattgaagaacgtcttcgacatgagaatccaatgcccccactccgttaattttggagagacctctgtgtcaggttacacaggcttacctccactgagtctacaggaagccgagcagctcgtaccggaaagctcctgtaacatggataatcatcagtctctgtcgattataaacaaacttactaaggtgatctggaggaaaaaggcgaatcaagagtcagctaaccagaatagcttcgaagtcgtggagagtgaggtttcctttaaagggctgtgcatgttgaagcaccggatggtggaagagtcttatcgcaaccgacgtagcgtcatttgttacgacctcgcctgcaattccacgttctgtaagcccaccgtgtatatgatcgtacctattcatgcatgcaacatgatgaaatcatgtctgatcggactgggcccatacagaatacaggttgtgtatgaaaggacatactgcactaccggtatcctcacagaggggaagtgttttgtccccgataaagccgtggtgagtgctttaaagcggggaatgtatgcaattgccagcatcgagaccatttgcttctttatccaccagaaaggcaatacttacaagatagtcacagctattacctctgccatgggctccaagtgtaacaatacggacactaaagttcaagggtactatatctgcattatcggaggtaactcagcgcctgtgtacgcaccagccggcgaagatttccgcgctatggaggtatttagcgggatcattaccagtccccatggagaagaccacgatctgcctggcgaggaaatagccacatatcagatctctggtcagattgaggcaaagatcccacacactgtgtccagcaaaaatcttaagttgaccgctttcgccgggataccgtcgtactcttccacatcaattctggcggccagtgaggacggaagatttatcttcagccccggcctattccctaacctcaaccagtccgtctgcgataataacgcactgccacttatctggaggggcctgattgacttgaccgggtattacgaagctgtgcatccctgtaatgttttctgcgtgctctctggacctggtgccagctgtgaggctttctcagaaggcgggatctttaacattacgagtccaatgtgcctggtctccaaacaaaatcggttccgcgccgcagagcagcagatatcatttgtgtgtcaacgagtagatatggacatcattgtttattgcaacggacagaagaaaactatcttaacaaagaccctggtgatcggccagtgtatttacactataacatctctcttctcacttctgcccggtgtcgcccacagtatcgctattgaattgtgcgtgccggggtttcatggctgggcgaccgcagccctactgatcacgttctgttttggatgggtcctcattcctgcttgcaccctggccatccttctggtgttgaagttctttgcaaatatactccacacaagcaaccaggagaatagattcaaagccatcctgaggaagattaaagaggaatttgagaagactaaaggctccatggtttgtgaaatctgcaagtacgagtgcgaaaccttaaaggagctgaaagctcacaacctatcttgtgtgcaaggggagtgcccctattgtttcacacattgcgaaccaactgagaccgccattcaggcacactacaaggtatgtcaggcgacacatcggttccgtgaagatctcaaaaagaccgtcactcctcagaatatcggacccggttgctatcgcacgctgaacctttttagatacaaatcgaggtgttatatattgacaatgtggaccctgctcctgattatcgagagcattctttgggctgcctccgcagccgagatcccactggtgcccttgtggactgacaatgctcacggcgttgggtcagtgcctatgcataccgacctcgaactggatttcagtttaccatctagctccaagtacacatataagcggcacctgaccaacccggtcaatgaccaacagtcagtgagcctacacatagagatcgaatctcagggaattggcgccgatgtacatcacctcggtcattggtacgacgcacgactgaaccttaaaacttcctttcactgctacggggcttgtacaaagtatcagtacccctggcacacggccaaatgccatttcgagaaggattatgaatacgagaacagttgggcgtgtaatcctccagactgccccggcgtgggaaccggctgcactgcctgtgggttgtatctggatcaactcaaacctgttggaacagcttttaagatcattagcgtccgctactctagaaaggtgtgcgtgcagttcggtgaggaatatctgtgtaaaaccatcgacatgaacgattgctttgtcacaaggcacgcaaagatatgtattatcggcactgtttccaaattctcacagggggacaccttactgtttcttggaccaatggagggcggtgggatcattttcaagcattggtgcacgagtacctgtcactttggcgatcccggagacgtgatgggcccgaaagacaagcctttcatctgcccagaatttcccgggcagttccggaaaaagtgtaatttcgccacaactcctgtgtgcgagtacgatggaaacattataagcggctacaagaaagtattggctaccatcgactcgtttcaatccttcaatacatctaacattcattttactgatgaacgcatcgagtggagagaccccgatggtatgctcagggaccacattaatatcgtcataagcaaggatatcgacttcgagaacctggccgaaaatccatgtaaagtggggctacaggcagcgaacattgagggagcctggggctcaggtgttggctttaccctgacgtgccaggtgagtctcacagaatgccctaccttcctgacttccatcaaggcttgtgatatggccatttgctatggggcagagtctgtcacacttagccgtggacaaaataccgtgaaaatcactggcaaagggggacactccggcagcagctttaagtgttgccatggtaaggaatgtagttctaccgggttgcaggcttccgcaccccacctggacaaggttaacggaataagcgagttagagaatgaaaaagtgtacgatgacggcgccccagagtgcggtgtaacatgttggttcaagaaatcgggcgaatgggtcatggggattatcaacggaaattgggtggtgctcatcgtcctgtgcgttcttctgttgttttcactcattctgctatctatactgtgtccggtgcggaagcataagaaaagttga

SEQ ID NO: 10206 - RNA, 3402 nt, synthetic construct
  misc_feature 1..3402: note = derived and/or modified CDS sequence (opt3) from SEOV(HBT-3)__KM233661.1__GP
  source 1..3402: mol_type = other RNA
atgtggagcctactcttccttgccgctctggtgggccaggggtttgcattgaagaacgtcttcgacatgagaatccaatgcccccactccgttaattttggagagacctctgtgtcaggttacacagaattacctccactgagtctacaggaggccgaacagctcgtaccggagagctcctgtaacatggataatcatcagtctctgtcgactattaacaaacttacgaaggtgatatggaggaaaaaggcgaatcaagaatcagctaaccagaatagcttcgaggtcgtggagagtgaagtttcctttaaaggcctgtgcatgttgaagcaccggatggtggaggaatcttatcgcaaccgacgtagcgtcatctgttacgacctcccctgcaattccaccttctgtaagcctacagtgtatatgattgtaccaatccatgcctgcaacatgatgaaatcatgtctgattgggctgggaccctacagaatccaggttgtgtatgagaggacttactgcaccacaggcatactcaccgagggtaagtgttttgtccctgataaagcagtggtgagtgccttaaagcgggggatgtatgctatcgcaagcattgaaactatctgcttctttattcaccagaaaggaaatacatacaagatcgtcaccgccataacgtctgctatgggctccaagtgtaacaatactgacaccaaagttcaaggctactatatttgcatcattgggggaaactcagccccagtgtacgcgcccgccggtgaggatttccgcgcaatggaagtatttagcggcatcatcacaagtcctcatggggaggaccacgatctgccaggagaagagattgctacttatcagatatctggccagatcgaggccaagattccgcacaccgtgtccagcaaaaatcttaagttgacagcattcgctggtatcccctcgtactcttccacctcaatactggccgcgagtgaagacgggagatttattttcagccctggactattcccaaacctcaaccagtccgtctgcgataataacgccctgccccttatctggaggggcctgatcgacttgacgggctattacgaggcagtgcatccttgtaatgtgttttgcgttctctctgggccaggagctagctgtgaagccttctcagagggtggcatttttaacatcacttcacccatgtgcctggtctccaaacaaaatcggttccgcgctgccgaacagcagattagctttgtgtgtcaacgagtagatatggacataatcgtttattgcaacgggcagaagaaaacaattttaaccaagactctggtgatcggacagtgtatctacacaattacctctctcttctcacttctgccgggcgtcgcacacagtatagccatcgagttgtgcgtgcctggttttcatgggtgggctacggcggcactactgattaccttctgttttggctgggtcctcatccccgcctgcacactggctattcttctggtgttgaagttctttgccaatatcctccacactagcaaccaggagaatagattcaaagcaatactgaggaagatcaaagaagagtttgaaaagaccaaaggatccatggtttgtgagatttgcaagtacgaatgcgagacattcaaggagttaaaagcccacaacctgtcttgtgtgcaaggcgaatgcccatattgtttcactcattgcgagcctaccgaaacagctatccaggcccactacaaggtatgtcaggcaacccatcggtttcgtgaggatctgaaaaagactgtcacgccccagaatattgggccaggatgctatcgcacactcaacctgttcagatacaaatcgaggtgttatatccttaccatgtggactttgctgctcataattgagagcatcctgtgggcggcttccgccgcagaaattccccttgtgcctctgtggaccgacaatgcccacggtgttggctcagtgccaatgcatacagacttggagctcgattttagtctgccgtctagctccaagtacacctataagcggcacttaactaaccccgtcaatgaccaacagtcagtgagcctgcacatcgaaatagagtctcaggggatcggagctgatgtacatcacctaggccattggtacgacgcccgactcaacctgaaaacatccttccactgctacggtgcatgtacgaagtatcagtacccttggcacaccgctaaatgccattttgaaaaggattatgagtacgagaacagttgggcctgtaatccacccgactgccctggggtgggcactggatgcacagcgtgtggcctttatttggatcaactgaaaccagttgggaccgccttcaagattatcagcgtccgctactctagaaaggtgtgcgtgcagtttggagaagagtatctctgtaaaacaattgacatgaacgattgcttcgtcactaggcacgctaagatctgtataattggtaccgtttccaaattttcacagggcgacacgctgttattcctggggcccatggaaggaggcggtatcatctttaagcattggtgcaccagtacatgtcacttcggggatccgggcgacgtgatgggacctaaagacaagccatttatttgccccgagttccctggccagttccggaaaaagtgtaattttgcaactacccccgtgtgcgaatacgatgggaacatcattagcggatacaagaaagtacttgccacaatagactcgttccaatcctttaatacttctaacatccatttcaccgatgagcgcattgagtggagagacccagatggcatgttgagggaccacatcaatattgtcatcagcaaggatatagactttgaaaacctcgctgagaatccttgtaaagtgggtctgcaggccgcaaacatcgaaggggcgtggggatcaggcgttggtttcacgctaacatgccaggtgagtctgaccgagtgccccacttttctcacatccattaaggcctgtgatatggctatctgctatggcgccgaatctgtcaccctgagccgtgggcaaaatactgtgaaaattaccggaaagggcgggcactccggaagtagcttcaagtgttgccatggcaaagagtgtagttctacaggtcttcaggcatccgctccacacttggacaaggttaacgggatcagcgagctggaaaatgagaaagtgtacgatgacggagccccggaatgcggcgtaacgtgttggtttaagaaatcgggtgagtgggtcatgggcataattaacgggaattgggtggtgttaatcgtcctctgcgttctgcttctgttctcattgatcctcctgtctattctatgtcctgtgcggaagcataagaaaagttga

SEQ ID NO: 10207 - RNA, 3402 nt, synthetic construct
  misc_feature 1..3402: note = derived and/or modified CDS sequence (opt3) from SEOV(HBT49)__KM233659.1__GP
  source 1..3402: mol_type = other RNA
atgtggagcctgctctttcttgccgctctggtgggccaggggtttgcattgaagaacgtcttcgacatgagaatccaatgcccccactccgttaattttggagagacctctgtgtcaggttacacagaattacctccactgagtctacaggaggccgaacagctcgtaccggagagctcctgtaacatggataatcatcagtctctgtcgactattaacaaacttacgaaggtgatatggaggaaaaaggcgaatcaagaatcagctaaccagaatagcttcgaggtcgtggagagtgaagtttcctttaaaggcctgtgcatgttgaagcaccggatggtggaggaatcttatcgcaaccgacgtagcgtcatctgttacgacctcgcctgcaattccaccttctgtaagcccacagtgtatatgattgtacctatccatgcatgcaacatgatgaaatcatgtctgattgggctgggaccatacagaatccaggttgtgtatgagaggacttactgcaccacaggcatactcaccgagggtaagtgttttgtccccgataaagccgtggtgagtgctttaaagcgggggatgtatgcaatcgccagcattgaaactatctgcttctttattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggatttccgcgctatggaagtatttagcggcatcatcacaagtccccatggggaggaccacgatctgcctggagaagagattgccacttatcagatatctggccagatcgaggcaaagattccacacaccgtgtccagcaaaaatcttaagttgacagctttcgccggtatcccgtcgtactcttccacctcaatactggcggccagtgaagacgggagatttattttcagccccggactattccctaacctcaaccagtccgtctgcgataataacgcactgccacttatctggaggggcctgatcgacttgacgggctattacgaggctgtgcatccctgtaatgttttctgcgtgctctctgggcctggagccagctgtgaagccttctcagagggtggcatttttaacatcacttcaccaatgtgcctggtctccaaacaaaatcggttccgcgccgcagaacagcagattagctttgtgtgtcaacgagtagatatggacataatcgtttattgcaacgggcagaagaaaacaattttaaccaagactctggtgatcggacagtgtatctacacaattacctctctcttctcacttctgcccggcgtcgcccacagtatagctatcgagttgtgcgtgccgggttttcatgggtgggcgacggcagccctactgattaccttctgttttggctgggtcctcatccctgcttgcacactggccattcttctggtgttgaagttctttgcaaatatcctccacactagcaaccaggagaatagattcaaagccatactgaggaagatcaaagaagagtttgaaaagaccaaaggatccatggtttgtgagatttgcaagtacgaatgcgagacattaaaggagctgaaagctcacaacctatcttgtgtgcaaggcgaatgcccctattgtttcactcattgcgagccaaccgaaacagccatccaggcacactacaaggtatgtcaggcgacccatcggttccgtgaggatctcaaaaagactgtcacgcctcagaatattgggcccggatgctatcgcacactgaacctttttagatacaaatcgaggtgttatatcttgaccatgtggactctgctcctgataattgagagcatcctttgggctgcctccgcagccgaaattccactggtgcccttgtggaccgacaatgctcacggtgttggctcagtgcctatgcatacagacctcgagctggatttcagtttaccatctagctccaagtacacctataagcggcacctgactaacccggtcaatgaccaacagtcagtgagcctacacatcgaaatagagtctcaggggatcggagccgatgtataccatctcggccactggtacgacgcacgactgaaccttaaaacatcctttcattgctatggtgcttgtacgaagtaccagtatccctggcacaccgccaaatgccacttcgaaaaggattacgagtatgagaacagttgggcgtgtaatcctccagactgccccggggtgggcactggatgcacagcctgtggcttgtacctggatcaactcaaacctgttgggaccgcttttaagattatcagcgtccgctattctagaaaggtgtgcgtgcagttcggagaagagtacctgtgtaaaacaattgacatgaacgattgctttgtcactaggcatgcaaagatctgtataattggtaccgtttccaaattctcacagggcgacacgttactgtttcttgggccaatggaaggaggcggtatcatcttcaagcactggtgcaccagtacatgtcattttggggatcccggcgacgtgatgggaccgaaagacaagcctttcatttgcccagagtttcccggccagttccggaaaaagtgtaatttcgccactacccctgtgtgcgaatacgatgggaacatcattagcggatataagaaagtattggctacaatagactcgtttcaatccttcaatacttctaacatccactttaccgatgagcgcattgagtggagagaccccgatggcatgctcagggaccatatcaatattgtcatcagcaaggatatagacttcgaaaacctggccgagaatccatgtaaagtgggtctacaggcagcgaacatcgaaggggcctggggatcaggcgttggttttacgctgacatgccaggtgagtctcaccgagtgccctactttcctgacatccattaaggcttgtgatatggccatctgctacggcgcagaatctgtcacccttagccgtgggcaaaatactgtgaaaattaccggaaagggcgggcactccggaagtagctttaagtgttgccacggcaaagagtgtagttctacaggtttgcaggcttccgctccccatctggacaaggttaacgggatcagcgagttagaaaatgagaaagtgtatgatgacggagcaccagaatgcggcgtaacgtgttggttcaagaaatcgggtgagtgggtcatgggcataattaacgggaattgggtggtgctcatcgtcctgtgcgttcttctgttgttttcactcatcctgctatctattctgtgtccggtgcggaagcacaagaaaagttga

SEQ ID NO: 10208 - RNA, 3402 nt, synthetic construct
  misc_feature 1..3402: note = derived and/or modified CDS sequence (opt3) from SEOV(HBT50)__KM233660.1__GP
  source 1..3402: mol_type = other RNA
atgtggagcctgctctttcttgccgctctggtgggccaggggtttgcattgaagaacgtcttcgacatgagaatccaatgcccccactccgttaattttggagagacctctgtgtcaggttacacagaattacctccactgagtctacaggaggccgaacagctcgtaccggagagctcctgtaacatggataatcatcagtctctgtcgactattaacaaacttacgaaggtgatatggaggaaaaaggcgaatcaagaatcagctaaccagaatagcttcgaggtcgtggagagtgaagtttcctttaaaggcctgtgcatgttgaagcaccggatggtggaggaatcttatcgcaaccgacgtagcgtcatctgttacgacctcgcctgcaattccaccttctgtaagcccacagtgtatatgattgtacctatccatgcatgcaacatgatgaaatcatgtctgattgggctgggaccatacagaatccaggttgtgtatgagaggacttactgcaccacaggcatactcaccgagggtaagtgttttgtccccgataaagccgtggtgagtgctttaaagcgggggatgtatgcaatcgccagcattgaaactatctgcttctttattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggatttccgcgctatggaagtatttagcggcatcatcacaagtccccatggggaggaccacgatctgcctggagaagagattgccacttatcagatatctggccagatcgaggcaaagattccacacaccgtgtccagcaaaaatcttaagttgacagctttcgccggtatcccgtcgtactcttccacctcaatactggcggccagtgaagacgggagatttattttcagccccggactattccctaacctcaaccagtccgtctgcgataataacgcactgccacttatctggaggggcctgatcgacttgacgggctattacgaggctgtgcatccctgtaatgttttctgcgtgctctctgggcctggagccagctgtgaagccttctcagagggtggcatttttaacatcacttcaccaatgtgcctggtctccaaacaaaatcggttccgcgccgcagaacagcagattagctttgtgtgtcaacgagtagatatggacataatcgtttattgcaacgggcagaagaaaacaattttaaccaagactctggtgatcggacagtgtatctacacaattacctctctcttctcacttctgcccggcgtcgcccacagtatagctatcgagttgtgcgtgccgggttttcatgggtgggcgacggcagccctactgattaccttctgttttggctgggtcctcatccctgcttgcacactggccattcttctggtgttgaagttctttgcaaatatcctccacactagcaaccaggagaatagattcaaagccatactgaggaagatcaaagaagagtttgaaaagaccaaaggatccatggtttgtgagatttgcaagtacgaatgcgagacattaaaggagctgaaagctcacaacctatcttgtgtgcaaggcgaatgcccctattgtttcactcattgcgagccaaccgaaacagccatccaggcacactacaaggtatgtcaggcgacccatcggttccgtgaggatctcaaaaagactgtcacgcctcagaatattgggcccggatgctatcgcacactgaacctttttagatacaaatcgaggtgttatatcttgaccatgtggactctgctcctgataattgagagcatcctttgggctgcctccgcagccgaaattccactggtgcccttgtggaccgacaatgctcacggtgttggctcagtgcctatgcatacagacctcgagctggatttcagtttaccatctagctccaagtacacctataagcggcacctgactaacccggtcaatgaccaacagtcagtgagcctacacatcgaaatagagtctcaggggatcggagccgatgtacatcacctcggccattggtacgacgcacgactgaaccttaaaacatcctttcactgctacggtgcttgtacgaagtatcagtacccctggcacaccgccaaatgccatttcgaaaaggattatgagtacgagaacagttgggcgtgtaatcctccagactgccccggggtgggcactggatgcacagcctgtggcttgtatctggatcaactcaaacctgttgggaccgcttttaagattatcagcgtccgctactctagaaaggtgtgcgtgcagttcggagaagagtatctgtgtaaaacaattgacatgaacgattgctttgtcactaggcacgcaaagatctgtataattggtaccgtttccaaattctcacagggcgacacgttactgtttcttgggccaatggaaggaggcggtatcatcttccggcattggtgcaccagtacatgtcactttggggatcccggcgacgtgatgggaccgaaggacaaacctttcatttgcccagagtttcccggccagttccgcaagaaatgtaatttcgccactacccctgtgtgcgaatacgatgggaacatcattagcggatacaagaaggtattggctacaatagactcgtttcaatccttcaatacttctaacatccattttaccgatgagagaattgagtggagggaccccgatggcatgctccgtgaccacatcaatattgtcatcagcaaagatatagacttcgaaaacctggccgagaatccatgtaaggtgggtctacaggcagcgaacatcgaaggggcctggggatcaggcgttggttttacgctgacatgccaggtgagtctcaccgagtgccctactttcctgacatccattaaggcttgtgatatggccatctgctatggcgcagaatctgtcacccttagccgggggcaaaatactgtgaaaattaccggaaaaggcgggcactccggaagtagctttaagtgttgccatggcaaggagtgtagttctacaggtttgcaggcttccgctccccacctggacaaagttaacgggatcagcgagttagaaaatgagaaggtgtacgatgacggagcaccagaatgcggcgtaacgtgttggttcaaaaagtcgggtgagtgggtcatgggcataattaacgggaattgggtggtgctcatcgtcctgtgcgttcttctgttgttttcactcatcctgctatctattctgtgtccggtgcgaaaacataagaagagttga

SEQ ID NO: 10209 - RNA, 3402 nt, synthetic construct
  misc_feature 1..3402: note = derived and/or modified CDS sequence (opt3) from SEOV(HuludaoRn101)__GU592923.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtggtctggaggaaaaaggcgaatcaagaatcagctaaccagaatagctttgaggtggttgagagtgaagtgtccttcaaaggcttgtgcatgctcaagcaccggatggtcgaggaatcttatcgcaaccgacgtagcgtgatatgttacgacctggcctgcaattccaccttttgtaagcccacagtatatatgatcgttcctattcatgcatgcaacatgatgaaatcatgtctgatcgggctcggaccatacaggattcaggtggtctatgagagaacttactgcaccacaggcatcttaaccgagggtaagtgtttcgtgcccgataaagccgtggtcagtgctctgaagcgggggatgtatgcaatagccagcatcgaaactatttgctttttcatccaccagaaaggaaatacatacaagattgttaccgctatcacgtctgccatgggctccaagtgtaacaatactgacaccaaagtgcaaggctactatatatgcattatcgggggaaactcagcgcctgtatacgcaccagccggtgaggattttcgcgctatggaagtgttcagcggcattatcacaagtccccatggggaggaccacgatcttcctggagaagagatcgccacttatcagatttctggccagatagaggcaaagatcccacacaccgtctccagcaaaaatttgaagctgattgcttttgccggtatcccgtcgtactcttccacatcaatactagcggccagtgaagacagcagattcatttttagccccgggttgttccctaacctgaaccagtctgtgtgcgataataacgcacttccactgatctggaggggattgatcgacctcaccggctattacgagacggttcatccctgtaatgtgttctgcgtcctgagcggccctggggcttcatgtgaagcctttagtgagggaggtattttcaacatcacttccccaatgtgcttagtgagcaaacaaaatcggtttcgcgctgccgaacagcagatttctttcatatgtcaacgagtagatatggacatcattgtttattgcaacggccagaagaaaacaatcctgaccaagactctcgtgatcgggcagtgtatttacacaataacctcactttttagtctgttgcccggagtcgcacacagcatcgccattgagctatgcgtgccgggcttccatggttgggctacggcggcactgctcatcaccttttgtttcgggtgggtcctgattcctgcctgcacacttgctatcctgttggtgctcaagtttttcgccaatatactgcacacttccaaccaggagaatagatttaaagcaatcttaaggaagattaaagaagagttcgaaaagaccaaaggctctatggtttgtgagatctgcaagtacgaatgcgagacactgaaggagctaaaagcccacaacctctcgtgtgtgcaaggagaatgcccctattgttttactcattgcgagccaaccgaaacagctattcaggcccactacaaggtatgtcaggcaacccatcggttccgtgaggatctgaaaaagactgtcacgcctcagaatatcggccccgggtgctatcgcacacttaacttgttcagatacaaatccaggtgttatatactgaccatgtggactctcctgcttattatcgagtccattctgtgggcggcttcagccgcagaaatcccattggtgcccctctggaccgacaatgcccacggagttggtagtatacctatgcatacagacctggagttagatttttctctgccaagctcctcaaagtacacctataagcggcacctaactaacccggtgaatgaccaacagagcgtctctctccacatcgaaattgagtcccagggcatcggggctgatgtgcatcacctgggacattggtacgacgcccgacttaacttgaaaacaagtttccactgctacggcgcatgtacgaagtatcagtacccctggcacaccgctaaatgccattttgaaaaggattatgagtacgagaacagctgggcctgtaatcctccagactgccccggtgtagggactggctgcacagcgtgtggactgtatctcgatcaactgaaacctgtgggcaccgccttcaagattatctctgttcgctactccagaaaggtctgcgtgcagtttggggaagagtatttatgtaaaacaatagacatgaacgattgcttcgtgactaggcacgctaagatttgtatcatcggaaccgtctcaaaatttagtcagggtgacacgctgcttttcttgggcccaatggaagggggaggcattatctttaagcattggtgcaccagcacatgtcacttcggtgatcccggggacgttatgggcccgaaagacaagccttttatttgcccagagttccccggacagtttcggaaaaagtgtaatttcgcaactacccctatatgcgaatacgatggcaacatcatttcggggtacaagaaagtgctcgccacaatcgactccttccaatcttttaatactagcaacattcatttcaccgatgagcgcatcgagtggagagaccccgatggaatgctgagggaccacataaatgtggtaatctcaaaggatattgactttgaaaacctagctgagaatccatgtaaagtcggcctgcaggccgcaaacatcgaaggtgcgtgggggagtggagtgggcttcacgctcacatgccaggtttccctgaccgagtgccctacttttcttacatctattaaggcctgtgatatggctatctgctatggtgccgaaagcgtgaccttgtcccgtggccaaaatactgtccggataaccgggaaaggaggccactcagggagcagtttcaagtgttgccatggaaaggagtgttcttccacaggcctgcaggcaagcgctccccacttagacaaagtgaacggtatttcggagctcgaaaatgagaaggtttacgatgacggggccccagaatgcggagtgacgtgttggtttaaaaagtcaggcgagtgggtaatgggtatcatcaacggcaattgggtcgtgctgattgtgctttgcgtcctgctcctcttctctctgatactactgagtatcctctgtccggttcgaaaacataagaagtcctga

SEQ ID NO: 10210 - RNA, 3402 nt, synthetic construct
  misc_feature 1..3402: note = derived and/or modified CDS sequence (opt3) from SEOV(Humber)__JX879768.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcgtggagagtgaagtttccttcaaaggcttgtgcatgctcaagcaccggatggtggaggaatcttatcgcaaccgacgtagcgtcatctgttacgacctggcctgcaattccaccttttgtaagcccacagtgtatatgattgtacctatccatgcatgcaacatgatgaaatcatgtctgattgggctcggaccatacagaatccaggttgtgtatgagaggacttactgcaccacaggcatattaaccgagggtaagtgtttcgtccccgataaagccgtggtgagtgctctgaagcgggggatgtatgcaatcgccagcattgaaactatctgctttttcgtccaccagaaaggaaatacatacaagattgttaccgctatcacgtctgccatgggctccaagtgtaacaatactgacaccaaagtgcaaggctactatatatgcattatcgggggaaactcagcgcctgtatacagcccagccggtgaggattttcgcgcaatggaagtgttcagtggcattatcacatctccccatggggaggaccacgatcttcctggagaagagatcgctacttatcagatttccggccagatagaggccaagatcccacacaccgtcagctcgaaaaatttgaagctgacagcatttgctggtattccgtcttactcctcaaccagtatcctagccgcgagcgaagacgggagattcatattttcccccggactcttccctaacctgaaccagtctgtgtgcgataataacgcccttccactgatttggaggggcttgatcgacctcacgggctattacgaggcagttcatccctgtaatgtgttctgcgtcctgagcgggcctggagcttcatgtgaagcctttagtgagggtggcatcttcaacattacttccccaatgtgcttagtgagcaaacaaaatcggtttcgcgctgccgaacagcagatctctttcatttgtcaacgagtagatatggacataatcgtttattgcaacgggcagaagaaaacaattctgaccaagactctcgtgatcggacagtgtatctacacaattacctcactttttagtctgttgcccggcgtcgcacacagcatagccatcgagctatgcgtgccgggtttccatgggtgggctacggcggcactgctcattaccttttgtttcggctgggtcctgatccctgcctgcacacttgctgtgctgttggttctcaagtttttcgccaatattctgcacacttccaaccaggagaatagatttaaagcaatcttaaggaagataaaagaagagttcgaaaagaccaaaggatctatggtgtgtgagatctgcaagtacgaatgcgagacactgaaggagctaaaagcccacaacctctcgtgtattcaaggcgaatgcccctattgttttactcattgcgagccaaccgaaacagctatccaggcccactacaaggtatgtcaggcaacccatcggttccgtgaggatctgaaaaagactgtcacgcctcccaatattgggccaggatgctatcgcacacttaacttgttcagatacaaatccaggtgttatatcctgaccatgtggactctcctgcttataattgagagcatcctgtgggcggcttcagccgcagaaattcccttggtgcctctctggaccgacaatgcccacggtgttggcagtgtgccaatgcatacagacctggagttagatttttctctgccgagctcctcaaagtacacctataagcggcacctaactaaccccgtcaatgaccagcaaagcgtgtctctccacatcgaaatagagtcccaggggatcggagctgatgtacatcacctgggccattggtacgacgcccgacttaacttgaaaacaagtttccactgctacggtgcatgtacgaagtatcagtacccttggcacaccgctaaatgccattttgaaaaggattatgagtacgagaacagctgggcctgtaatccacccgactgccctggggtgggcactggatgcacagcgtgtggcctgtatctcgatcagctgaaaccagttgggaccgccttcaagattatctctgtccgctactccagaaaggtgtgcgtgcaatttggagaagagtatttatgtaaaacaattgacatgaacgattgcttcgtcactaggcacgctaagatctgtataattggtaccgtttcaaaatttagtcagggcgacacgctgcttttcttggggcccatggaaggaggcggtatcatctttaagcattggtgcaccagcacatgtcacttcggggatccgggcgacgtgatgggacctaaagacaagccatttatttgccccgagttccctggccagtttcggaaaaagtgtaatttcgcaactacccccgtgtgcgaatacgatgggaacatcatttcgggatacaagaaagtactcgccacaatagactccttccagtcttttaatactagcaacatccatttcaccgatgagcgcattgagtggagagacccagatggcatgctgagggaccacatcaatattatcatatcaaaggatatcgactttgaaaacctagctgagaatccttgtaaagtcggtctgcaagccgcaaacattgaaggggcgtggggaagtggcgtgggtttcacgctcacatgccaggtttccctgaccgagtgccccacttttcttacatctatcaaggcctgtgatatggctatttgctatggcgccgaaagcgtgaccttgtcccgtgggcagaatactgtcaaaatcaccggaaagggcgggcactcaggaagcagtttcaagtgttgccatggcaaagagtgttcttccaacggtctgcaagcaagcgctccacacttagacaaggtgaatgggatatcggagctcgaaaacgagaaagtttacgatgacggagccccggaatgcggcgtgacatgttggtttaagaaatcaggtgagtgggtaatgggcattatcaatgggaactgggtcgtgctgatcgtgctttgcgtcctgctcttgttctctctgattctactgagtatactctgtcctgttcggaagcataagaaatcctga

SEQ ID NO: 10211 - RNA, 3402 nt, synthetic construct
  misc_feature 1..3402: note = derived and/or modified CDS sequence (opt3) from SEOV(Humber)__KM948597.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcgtggagagtgaagtttccttcaaaggcttgtgcatgctcaagcaccggatggtggaggaatcttatcgcaaccgacgtagcgtcatctgttacgacctggcctgcaattccaccttttgtaagcccacagtgtatatgattgtacctatccatgcatgcaacatgatgaaatcatgtctgattgggctcggaccatacagaatccaggttgtgtatgagaggacttactgcaccacaggcatattaaccgagggtaagtgtttcgtccccgataaagccgtggtgagtgctctgaagcgggggatgtatgcaatcgccagcattgaaactatctgctttttcgtccaccagaaaggaaatacatacaagattgttaccgctatcacgtctgccatgggctccaagtgtaacaatactgacaccaaagtgcaaggctactatatatgcattatcgggggaaactcagcgcctgtatacagcccagccggtgaggattttcgcgcaatggaagtgttcagtggcattatcacatctccccatggggaggaccacgatcttcctggagaagagatcgctacttatcagatttccggccagatagaggccaagatcccacacaccgtcagctcgaaaaatttgaagctgacagcatttgctggtattccgtcttactcctcaaccagtatcctagccgcgagcgaagacgggagattcatattttcccccggactcttccctaacctgaaccagtctgtgtgcgataataacgcccttccactgatttggaggggcttgatcgacctcacgggctattacgaggcagttcatccctgtaatgtgttctgcgtcctgagcgggcctggagcttcatgtgaagcctttagtgagggtggcatcttcaacattacttccccaatgtgcttagtgagcaaacaaaatcggtttcgcgctgccgaacagcagatctctttcatttgtcaacgagtagatatggacataatcgtttattgcaacgggcagaagaaaacaattctgaccaagactctcgtgatcggacagtgtatctacacaattacctcactttttagtctgttgcccggcgtcgcacacagcatagccatcgagctatgcgtgccgggtttccatgggtgggctacggcggcactgctcattaccttttgtttcggctgggtcctgatccctgcctgcacacttgctgtgctgttggttctcaagtttttcgccaatattctgcacacttccaaccaggagaatagatttaaagcaatcttaaggaagataaaagaagagttcgaaaagaccaaaggatctatggtgtgtgagatctgcaagtacgaatgcgagacactgaaggagctaaaagcccacaacctctcgtgtattcaaggcgaatgcccctattgttttactcattgcgagccaaccgaaacagctatccaggcccactacaaggtatgtcaggcaacccatcggttccgtgaggatctgaaaaagactgtcacgcctcccaatattgggccaggatgctatcgcacacttaacttgttcagatacaaatcaaggtgttatatcctgaccatgtggactctcctgcttataattgagtccatcctgtgggcggcttcagccgcagaaattcccttggtgcctctctggaccgacaatgcccacggtgttggcagtgtgccaatgcatacagacctggagttagatttttctctgccgagctcctcaaagtacacctataagcggcacctaactaaccccgtcaatgaccagcaaagcgtgtctctccacatcgaaatagagtcccaggggatcggagctgatgtacatcacctgggccattggtacgacgcccgacttaacttgaaaacaagtttccactgctacggtgcatgtacgaagtatcagtacccttggcacaccgctaaatgccattttgaaaaggattatgagtacgagaacagctgggcctgtaatccacccgactgccctggggtgggcactggatgcacagcgtgtggcctgtatctcgatcagctgaaaccagttgggaccgccttcaagattatctctgtccgctactccagaaaggtgtgcgtgcaatttggagaagagtatttatgtaaaacaattgacatgaacgattgcttcgtcactaggcacgctaagatctgtataattggtaccgtttcaaaatttagtcagggcgacacgctgcttttcttggggcccatggaaggaggcggtatcatctttaagcattggtgcaccagcacatgtcacttcggggatccgggcgacgtgatgggacctaaagacaagccatttatttgccccgagttccctggccagtttcggaaaaagtgtaatttcgcaactacccccgtgtgcgaatacgatgggaacatcatttcgggatacaagaaagtactcgccacaatagactccttccagtcttttaatactagcaacatccatttcaccgatgagcgcattgagtggagagacccagatggcatgctgagggaccacatcaatattatcatatcaaaggatatcgactttgaaaacctagctgagaatccttgtaaagtcggtctgcaagccgcaaacattgaaggggcgtggggaagtggcgtgggtttcacgctcacatgccaggtttccctgaccgagtgccccacttttcttacatctatcaaggcctgtgatatggctatttgctatggcgccgaaagcgtgaccttgctgcgtgggcagaatactgtcaaaatcaccggaaagggcgggcactccggaagcagcttcaagtgttgccatggcaaagagtgtagttctaacggtttacaagcatccgctccacacctcgacaaggtgaatgggataagcgagctggaaaacgagaaagtttacgatgacggagccccggaatgcggcgtgacatgttggtttaagaaatcgggtgagtgggtaatgggcattatcaatgggaactgggtcgtgcttatcgtgctgtgcgtcttgctcctgttctcactaattctgctctctatactgtgtcctgttcggaagcataagaaaagttga

SEQ ID NO: 10212 - RNA, 3402 nt, synthetic construct
  misc_feature 1..3402: note = derived and/or modified CDS sequence (opt3) from SEOV(K24-e7)__AF288652.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtggtctggaggaaaaaggcgaatcaagaatcagctaaccagaatagctttgaggtggttgagagtgaagtgtccttcaaaggcttgtgcatgctcaagcaccggatggtcgaggaatcttatcgcaaccgacgtagcgtgatatgttacgacctggcctgcaattccaccttttgtaagcccacagtatatatgatcgttcctattcatgcatgcaacatgatgaaatcatgtctgatcgggctcggaccatacaggattcaggtggtctatgagagaacttactgcaccacaggcatcttaaccgagggtaagtgtttcgtgcccgggaaagccgtggtcagtgctctgaagcggggaatgtatgcaatagccagcatcgaaactatttgctttttcatccaccagaaaggcaatacatacaagattgttaccgctatcacgtctgccatgggctccaagtgtaacaatactgataccaaagtgcaagggtactatatatgcattatcggaggtaactcagcgcctgtatacgcaccagccggcgaggactttcgcgctatggaagtgttcagcgggattatcacaagtccccatggagaggatcacgaccttcctggcgaagagatcgccacttatcagatttctggtcagatagaggcaaagatcccacacaccgtctccagcaaaaatttgaagctgattgcttttgccgggatcccgtcgtactcttccacatcaatactagcggccagtgaagatggaagattcatttttagccccggcctcttccctaacctgaaccagtccgtgtgcgacaataacgcacttccactgatctggaggggcttgatcgatctcaccgggtattacgaggctgttcatccctgtaatgtgttccgggtcctgtctggacctggtgccagctgcgaagccttttcagagggcgggattttcaacatcacgagtccaatgtgtttagtgtccaaacaaaatcgctttcgagccgcagaacagcagattagcttcatatgccaaagagtagacatggatatcattgtttattgtaacggacagaagaaaactatcctgacaaagaccctcgtgatcggccagtgcatttacactataacatctttgttttcactgttgcccggtgtcgcccacagtatcgctattgagctatgtgtgccggggttccatggctgggcgaccgcagccctgctcatcacgttttgcttcggatgggtcctgattcctgcttgtacccttgccatcctgttggtgctcaagtttttcgcaaatatactgcacacaagcaaccaggagaataggtttaaagccatcttacggaagattaaagaagagttcgaaaagactaaaggctccatggtttgcgagatctgtaagtacgaatgcgagaccctgaaggagctaaaagctcacaacctctcttgcgtgcaaggggaatgtccctattgctttacacattgtgagccaactgaaaccgccattcaggcacactacaaggtatgccaggcgacacatcgtttccgcgaggacctgaaaaagaccgtcactcctcagaatatcggacccggttgttatagaacgcttaacttgttcaggtacaaatcgcggtgctatatactgacaatgtggaccctcctgcttattatcgagagcattctgtgggctgcctccgcagccgaaatcccattggtgcccctctggactgataatgctcacggcgttgggtcagtgcctatgcataccgacctggagttagactttagtctgccatctagctccaagtacacatataagcgacacctaaccaacccggtcaatgatcaacagtcagtgagcctccacatagaaatcgagtctcagggaattggcgccgacgtacatcacctgggtcattggtacgatgcacgccttaacttgaaaacttccttccactgttacggggcttgcacaaagtatcagtacccctggcacacggccaaatgtcattttgaaaaggactatgagtacgagaacagttgggcgtgcaatcctccagattgtcccggcgtgggaaccggctgcactgcctgcgggctgtatctcgaccaactgaaacctgttggaacagctttcaagatcattagcgtcagatactctaggaaggtgtgtatgcagtttggtgaagagtatttatgcaaaaccatcgatatgaacgactgtttcgtgacacggcacgcaaagatatgcattatcggcactgtctccaaattttcacagggggataccctgcttttcttgggaccaatggaaggcggtgggatcatttttaagcattggtgtacgagtacctgccacttcggcgaccccggagatgttatgggcccgaaagacaagccttttatctgtccagagttccccgggcagtttcgcaaaaagtgcaatttcgccacaactcctatttgtgaatacgacggaaacataatcagcggctacaagaaagtgctcgctaccattgattcgttccaatcctttaatacatctaacatccatttcactgacgagagaattgagtggagggatcccgacggtatgctgcgtgatcacatcaatatagtgatcagcaaggacattgattttgaaaacctagccgagaatccatgcaaagtagggctgcaggcagcgaacatcgaaggagcctggggctcaggtgtcggcttcaccctcacgtgtcaggtgagtctgacagagtgccctacctttcttacttccattaaggcttgcgacatggccatctgttatggggcagaatctgttacattgagccggggacaaaataccgtgcgaataactggcagagggggacactccggcagctcattcaaatgctgtcatggtaaggagtgcagttctaccgggctgcaggcttccgctccccacttagataaggtcaacggaattagcgagctcgaaaatgagaaagtgtacgacgatggcgcaccagaatgtggtgttacatgctggtttaagaaatcgggcgagtgggtgatggggatcatcaacggaaattgggtagtcctgattgtgctttgtgtgctgcttctcttctcactgatactactgtctatcctctgcccggtcaggaagcataaaaagagttga

SEQ ID NO: 10213 - RNA, 3402 nt, synthetic construct
  misc_feature 1..3402: note = derived and/or modified CDS sequence (opt3) from SEOV(K24-v2)__AF288654.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtggtctggaggaaaaaggcgaatcaagaatcagctaaccagaatagctttgaggtggttgagagtgaagtgtccttcaaaggcttgtgcatgctcaagcaccggatggtcgaggaatcttatcgcaaccgacgtagcgtgatatgttacgacctggcctgcaattccaccttttgtaagcccacagtatatatgatcgttcctattcatgcatgcaacatgatgaaatcatgtctgatcgggctcggaccatacaggattcaggtggtctatgagagaacttactgcaccacaggcatcttaaccgagggtaagtgtttcgtgcccgatactgccgtggtcagtgctctgaaacgggggatgtatgcaatagccagcatcgaaacaatttgctttttcatccaccagaagggaaatacctacaaaattgttacggctatcacttctgccatgggctccaagtgtaacaataccgacacaaaggtgcaaggctactatatatgcattatcgggggaaactcagcgcctgtatacgcaccagccggtgaggattttcgcgctatggaagtgttcagcggcattatcacttcaccccatggggacgatcacgaccttcctggagaggaaatcgccccatatcagatttctggccagatagaggcaaaaatcccgcacaccgtctccagcaagaatttgaaactgattgcttttgccggtatcccctcgtactcttccacatcaatactagcggccagtgaggatgggagattcatttttagccctggactcttcccaaacctgaaccagtccgtgtgcgacaataacgcacttcccctgatctggaggggcttgatcgatctcaccggctattacgaagctgttcatccttgtaatgtgttctgcgtcctgtctgggccaggagccagctgtgaggctttttcagaaggtggcattttcaacatcacgagtcccatgtgcttagtgtccaagcaaaatcggtttcgcgccgcagagcagcagattagcttcatatgtcaacgagtagacatggatatcattgtttattgcaacgaccagaaaaagactatcctgacaaaaaccctcgtgatcgggcagtgtatttacactataacatctttgttttcactgttgccgggagtcgcccacagtatcgctattgaactatgcgtgcctggcttccatggttgggcgaccgcagccctgctcatcacgttttgtttcgggtgggtcctgattcccgcttgcacccttgccatcctgttggtgctcaagtttttcgcaaatatactgcacacaagcaaccaggagaatagatttaaggccatcttaaggaaaattaaggaggaatttgagaaaactaagggctccatggtttgtgaaatctgcaaatacgagtgcgaaaccctgaaggagctaaaggctcacaacctctcttgtgtgcaaggagagtgcccatattgtttcacacattgcgaacctactgagaccgccattcaggcacactacaaagtatgtcaggcgacacatcggttccgtgaagacctgaagaaaaccgtcactccccagaatatcggcccagggtgctatcgcacgcttaacttgttcagatacaagtcgaggtgttatatactgacaatgtggaccctcctgcttattatcgagagcattctgtgggctgcctccgcagccgagatccccttggtgcctctctggactgataatgctcacggagttggttcagtgccaatgcataccgacctggaattagattttagtctgccgtctagctccaaatacacatataagcggcacctaaccaaccccgtcaatgaccaacagtcagtgagcctccacatagagatcgaatctcagggcattggggccgatgtacatcacctgggacattggtacggcgcacgacttaacttgaagacttccttccactgctacggtgcttgtacaaaatatcagtacccttggcacacggccaagtgccattttgagaaagactatgaatacgagaacagttgggcgtgtaatccacccgattgccctggggtgggcaccggatgcactgcctgtggcctgtatctcgaccaactgaagccagttgggacagctttcaaaatcattagcgtccgctactctagaaaggtgtgcatgcagtttggagaggaatatttatgtaagaccatcgatatgaacgactgcttcgtgacaaggcacgcaaaaatatgtattatcggtactgtctccaagttttcacagggcgataccctgcttttcttggggcccatggagggaggcggtatcatttttaaacattggtgcacgagtacctgtcacttcggggacccgggcgacgttatgggacctaaggataaaccatttatctgccccgagttccctggccagtttcggaagaaatgtaatttcgccacaactcccatttgcgaatacgacgggaacataatcagcggatacaagaaggtgctcgctaccattgattcgttccaatcctttaatacatctaacatccatttcactgacgaacgcattgagtggagagatccagacggcatgctgagggatcacatcaatatagtgatcagcaaagacattgattttgagaacctagccgaaaatccttgtaaggtaggtctgcaggcagcgaacatcgagggggcctggggatcaggcgtcggtttcaccctcacgtgccaggtgagtctgacagaatgccccacctttcttacttccattaaggcttgtgacatggccatctgctatggcgcagagtctgttacattgagccgtgggcaaaataccgtgcggataactggaaaaggcgggcactccggaagtagcttcaaatgttgccatggcaaggaatgtagttctaccggtctgcaggcttccgccccacacttagataaggtcaacgggattagcgagctcgagaatgaaaaagtgtacgacgatggagcaccggagtgcggcgttacatgttggtttaagaaatcgggtgaatgggtgatgggcatcatcaacgggaattgggtagtcctgattgtgctttgcgtgctgcttctcttctcactgatactactgtctatcctctgtcctgtccgaaagcataaaaagagttga

SEQ ID NO: 10214 - RNA, 3402 nt, synthetic construct
  misc_feature 1..3402: note = derived and/or modified CDS sequence (opt3) from SEOV(KI-83-262)__D17592.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcgtggagagtgaagtttccttcaaaggcttgtgcatgctcaagcaccggatggtggaggaatcttatcgcaaccgacgtagcgtcatctgttacgacctggcctgcaattccaccttttgtaagcccacagtgtatatgattgtacctatccatgcatgcaacatgatgaaatcatgtctgattgggctcggaccatacagaatccaggttgtgtatgagaggacttactgcaccacaggcatattaaccgagggtaagtgtttcgtccccgataaagccgtggtgagtgctctgaagcgggggatgtatgcaatcgccagcattgaaactatctgctttttcattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggattttcgcgctatggaagtattcagcggcatcatcacaagtccccatggggaggaccacgatcttcctggagaagagattgccacttatcagatatctggccagatcgaggcaaagattccacacaccgtgtccagcaaaaatttgaagctgacagcttttgccggtatcccgtcgtactcttccacctcaatactagcggccagtgaagacgggagattcatttttagccccggactcttccctaacctgaaccagtccgtctgcgataataacgcacttccactgatctggaggggcttgatcgacctcacgggctattacgaggctgtgcatccctgtaatgttttctgcgtgctgtctgggcctggagccagctgtgaagccttttcagagggtggcattttcaacatcactagcccaatgtgcttagtctccaaacaaaatcggtttcgcgccgcagaacagcagattagcttcgtgtgtcaacgagtagatatggacataatcgtttattgcaacgggcagaagaaaacaattctgaccaagactctcgtgatcggacagtgtatctacacaattacctctttgttttcactgttgcccggcgtcgcccacagtatagctatcgagctatgcgtgccgggtttccatgggtgggcgacggcagccctgctcattaccttttgtttcggctgggtcctgatccctgcttgcacacttgccattctgttggtgctcaagtttttcgcaaatatcctgcacactagcaaccaggagaatagatttaaagccatattaaggaagatcaaagaagagttcgaaaagaccaaaggatccatggtttgtgagatttgcaagtacgaatgcgagacactgaaggagctaaaagctcacaacctctcttgtgtgcaaggcgaatgcccctattgttttactcattgcgagccaaccgaaacagccatccaggcacactacaaggtatgtcaggcgacccatcggttccgtgaggatctgaaaaagactgtcacgcctcagaatattgggcccggatgctatcgcacactttcgttgttcagatacaaaagtaggtgttatatcctgaccatgtggactctcctgcttataattgagtccatcctgtgggctgcctcagcagccgaaattccattggtgcccctctggaccgacaacgctcacggtgttggcagtgtgcctatgcatacagacctggagttagatttttctctgccaagctcctcaaagtacacctataagcggcacctaactaatccggtcaacgaccaacagagcgtgtctctccacatcgaaatagagtcccaggggatcggagccgatgtacatcacctgggccattggtacgacgcacgacttaatttgaaaacaagtttccactgctacggtgcttgtacgaagtatcagtacccctggcacaccgccaaatgccattttgaaaaggattatgagtacgagaacagctgggcgtgtaaccctccagactgccccggggtgggcactggatgcacagcctgtggcctgtatctcgatcaactgaaacctgttgggaccgctttcaagattatctctgtccgctactccagaaaggtgtgcgtgcagtttggagaagagtatttatgtaaaacaattgacatgaatgattgcttcgtcactaggcacgcaaagatctgtataattggtaccgtttcaaaatttagtcagggcgacacgctgcttttcttggggccaatggaaggaggcggtatcatctttaagcattggtgcaccagcacatgtcacttcggggatcccggcgacgtgatgggaccgaaagacaagccttttatttgcccagagttccccggccagtttcggaaaaagtgtaacttcgccactacccctgtgtgcgaatacgatgggaatatcatttcgggatacaagaaagtactcgctacaatagactccttccaatcttttaacactagcaatatccatttcaccgatgagcgcattgagtggagagaccccgatggcatgctgagggaccacatcaacattgtcatctcaaaggatatagactttgaaaatctagccgagaacccatgtaaagtgggtctgcaggcagcgaatatcgaaggggcctggggaagtggcgttggtttcacgctcacatgccaggtgtccctgaccgagtgccctacttttcttacatctattaaggcttgtgatatggccatctgctatggcgcagaaagcgtcaccttgtcccgtgggcaaaacactgtgaaaattaccggaaagggcgggcactcaggaagcagtttcaagtgttgccatggcaaagagtgttcttccacaggtctgcaggctagcgctccccacttagacaaggttaatgggatctcggagctcgaaaacgagaaagtgtacgatgacggagcaccagaatgcggcataacgtgttggtttaagaaatcaggtgagtgggtaatgggcattatcaatgggaactgggtcgtgctgatcgtgctttgcgtcctgcttctcttctctctgattctactgagtatactctgtccggttcggaagcataagaaatcctga

SEQ ID NO: 10215 - RNA, 3402 nt, synthetic construct
  misc_feature 1..3402: note = derived and/or modified CDS sequence (opt3) from SEOV(KI-85-1)__D17593.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcgtggagagtgaagtttccttcaaaggcttgtgcatgctcaagcaccggatggtggaggaatcttatcgcaaccgacgtagcgtcatctgttacgacctggcctgcaattccaccttttgtaagcccacagtgtatatgattgtacctatccatgcatgcaacatgatgaaatcatgtctgattgggctcggaccatacagaatccaggttgtgtatgagaggacttactgcaccacaggcatattaaccgagggtaagtgtttcgtccccgataaagccgtggtgagtgctctgaagcgggggatgtatgcaatcgccagcattgaaactatctgctttttcattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggattttcgcgctatggaagtattcagcggcatcatcacaagtccccatggggaggaccacgatcttcctggagaagagattgccacttatcagatatctggccagatcgaggcaaagattccacacaccgtgtccagcaaaaatttgaagctgacagcttttgccggtatcccgtcgtactcttccacctcaatactagcggccagtgaagacgggagattcatttttagccccggactcttccctaacctgaaccagtccgtctgcgataataacgcacttccactgatctggaggggcttgatcgacctcacgggctattacgaggctgtgcatccctgtaatgttttctgcgtgctgtctgggcctggagccagctgtgaggctttttcagaaggtggcattttcaacatcacttcaccaatgtgcttagtctccaaacaaaatcggtttcgcgccgcagaacagcagattagcttcgtgtgtcaacgagtagatatggacataatcgtttattgcaacgggcagaagaaaacaattctgaccaagactctcgtgatcggacagtgtatctacacaattacctctttgttttcactgttgcccggcgtcgcccacagtatagctatcgagctatgcgtgccgggtttccatgggtgggcgacggcagccctgctcattaccttttgtttcggctgggtcctgatccctgcttgcacacttgccattctgttggtgctcaagtttttcgcaaatatcctgcacactagcaaccaggagaatagatttaaagccatattaaggaagatcaaagaagagttcgaaaagaccaaaggatccatggtttgtgagatttgcaagtacgaatgcgagacactgaaggagctaaaagctcacaacctctcttgtgtgcaaggcgaatgcccctattgttttactcattgcgagccaaccgaaacagccatccaggcacactacaaggtatgtcaggcgacccatcggttccgtgaggatctgaaaaagactgtcacgcctcagaatattgggcccggatgctatcgcacacttaacttgttcagatacaaatcgaggtgttatatcctgaccatgtggactctcctgcttataattgagagcatcctgtgggctgcctccgcagccgaaattccattggtgcccctctggaccgacaatgctcacggtgttggctcagtgcctatgcatacagacctggagttagattttagtctgccatctagctccaagtacacctataagcggcacctaactaacccggtcaatgaccaacagtcagtgagcctccacatcgaaatagagtctcaggggatcggagccgatgtacatcacctgggccattggtacgacgcacgacttaacttgaaaacatccttccactgctacggtgcttgtgccaagtatcagtacccctggcacacggcgaaatgccattttgaaaaggattatgagtacgagaacagttgggcctgtaatcctccagactgccccggggtgggcaccggatgcactgcttgtggcctgtatctcgatcaactgaaacctgttgggacagcattcaagattatcagcgtccgctactctagaaaggtgtgcgtgcagtttggagaagagtatttatgtaaaaccattgacatgaacgattgcttcgtcacaaggcacgccaagatctgtataattggtactgtttccaaattttcacagggcgacaccctgcttttcttggggccaatggaaggaggcggtatcatctttaagcattggtgcacgagtacctgtcacttcggggatcccggcgacgtgatgggaccgaaagacaagccttttatttgcccagagttccccggccagtttcggaaaaagtgtaatttcgctacaactcctgtgtgcgaatacgatgggaacatcattagcggatacaagaaagtactcgccaccatagactcgttccaatcctttaatacatctaacatccatttcactgatgagcgcattgagtggagagaccccgatggcatgctgagggaccacatcaatattgtcatcagcaaggatatagactttgaaaacctagcagagaatccatgtaaagtgggtctgcaggcggccaacatcgaaggggcttggggatcaggcgttggtttcaccctcacgtgccaggtgagtctgacagagtgccctacctttcttacttccattaaggcctgtgatatggcaatctgctatggcgctgaatctgtcacattgagccgtgggcaaaataccgtgaaaattactggaaagggcgggcactccggaagtagcttcaagtgttgccatggcaaagagtgtagttctaccggtctgcaggcctccgcaccccacttagacaaggttaacgggatcagcgagctcgaaaatgagaaagtgtacgatgacggagccccagaatgcggcataacatgttggtttaagaaatcgggtgagtgggtaatgggcattatcaacgggaattgggtcgtgctgatcgtgctttgcgtcctgcttctcttctcatttattctgctatctatactgtgtccggttcggaagcataagaaaagttga

SEQ ID NO: 10216 - RNA, 3402 nt, synthetic construct
  misc_feature 1..3402: note = derived and/or modified CDS sequence (opt3) from SEOV(KI-88-15)__D17594.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgagatcgtcgagagtgaagtgtccttcaaaggcttgtgcatgctcaagcaccggatggttgaggaatcttatcgcaaccgacgtagcgtgatttgttacgacctggcctgcaattccaccttttgtaagcccacagtctatatgatcgtgcctattcatgcatgcaacatgatgaaatcatgtctgatcgggctcggaccatacagaatacaggtagtttatgagaggacttactgcaccacaggcatcttaaccgagggtaagtgtttcgtgcccgataaagccgtcgtgagtgctctgaagcgggggatgtatgcaattgccagcatcgaaactatttgctttttcatccaccagaaaggaaatacatacaagatagtgaccgctattacgtctgccatgggctccaagtgtaacaatactgacaccaaagtccaaggctactatatctgcattatcgggggaaactcagcgcctgtttacgcaccagccggtgaggattttcgcgctatggaagtgttcagcggcatcattacaagtccccatggggaggaccacgatcttcctggagaagagatagccacttatcagatctctggccagattgaggcaaagatcccacacaccgtatccagcaaaaatttgaagctgacagcttttgccggtataccgtcgtactcttccacctcaattctagcggccagtgaagacgggagattcatctttagccccggactcttccctaacctgaaccagtccgtgtgcgataataacgcacttccactgatctggaggggcttgattgacctcacgggctattacgaggctgtccatccctgtaatgtgttctgcgttctgtctgggcctggagccagctgtgaagccttttcagagggtggcatcttcaacattacttcaccaatgtgcttagtgtccaaacaaaatcggtttcgcgccgcagaacagcagatcagcttcgtctgtcaacgagtggatatggacataattgtatattgcaacgggcagaagaaaacaatcctgaccaagactctcgttatcggacagtgtatttacacaataacctctttgttttcactgttgcccggcgtggcccacagtatcgctattgagctatgcgtcccgggtttccatgggtgggcgacggcagccctgctcatcaccttttgtttcggctgggtgctgattcctgcttgcacacttgccatcctgttggtcctcaagtttttcgcaaatatactgcacactagcaaccaggagaatagatttaaagccatcttaaggaagattaaagaagagttcgaaaagaccaaaggatccatggtgtgtgagatctgcaagtacgaatgcgagacactgaaggagctaaaagctcacaacctctcttgtgttcaaggcgaatgcccctattgttttactcattgcgagccaaccgaaacagccattcaggcacactacaaggtgtgtcaggcgacccatcggttccgtgaggatctgaaaaagactgtaacgcctcagaatatcgggcccggatgctatcgcacacttaacttgttcagatacaaatcgaggtgttatatactgaccatgtggactctcctgcttattatcgagagcattctgtgggctgcctccgcagccgaaatcccattggtccccctctggaccgacaatgctcacggtgtgggctcagttcctatgcatacagacctggagttagattttagtctgccatctagctccaagtacacctataagcggcacctaactaacccggtgaatgaccaacagtcagtcagcctccacatagaaatcgagtctcaggggattggagccgatgtgcatcacctgggccattggtacgacgcacgacttaacttgaaaacatccttccactgctacggtgcttgtacgaagtatcagtacccctggcacaccgccaaatgccattttgaaaaggattatgagtacgagaacagttgggcgtgtaatcctccagactgccccggggtaggcactggatgcacagcctgtggcctgtatctcgatcaactgaaacctgtggggaccgctttcaagatcattagcgttcgctactctagaaaggtctgcgtgcagtttggagaagagtatttatgtaaaacaatcgacatgaacgattgcttcgtgactaggcacgcaaagatatgtattatcggtaccgtctccaaattttcacagggcgacacgctgcttttcttggggccaatggaaggaggcggtatcatttttaagcattggtgcaccagtacatgtcacttcggggatcccggcgacgttatgggaccgaaagacaagccttttatctgcccagagttccccggccagtttcggaaaaagtgtaatttcgccactacccctgtgtgcgaatacgatgggaacattataagcggatacaagaaagtgctcgctacaatcgactcgttccaatcctttaatacttctaacattcatttcaccgatgagcgcatcgagtggagagaccccgatggcatgctgagggaccacattaatatcgtaataagcaaggatatcgactttgaaaacctagccgagaatccatgtaaagtcggtctgcaggcagcgaacattgaaggggcctggggatcaggcgtgggtttcacgctcacatgccaggttagtctgaccgagtgccctacttttcttacatccatcaaggcttgtgatatggccatttgctatggcgcagaatctgtgaccttgagccgtgggcaaaatactgtcaaaatcaccggaaagggcgggcactccggaagtagcttcaagtgttgccatggcaaagagtgtagttctacaggtctgcaggcttccgctccccacttagacaaggtgaacgggataagcgagctcaaaaatgaaaaggtttacgatgacggagcaccagagtgcggcattacgtgttggtttaaaaagtcgggtgaatgggtgatgggcatcatcaacgggaattgggtagtcctgattgtgctttgcgtgctgcttctcttctcatttatactgctatctatcctgtgtccggtccggaagcataaaaagagttga

SEQ ID NO: 10217 - RNA, 3402 nt, synthetic construct
  misc_feature 1..3402: note = derived and/or modified CDS sequence (opt3) from SEOV(LongwanRn581)__GU592930.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcgtggagagtgaagtttccttcaaaggcttgtgcatgctcaagcaccggatggtggaggaatcttatcgcaaccgacgtagcgtcatctgttacgacctggcctgcaattccaccttttgtaagcccacagtgtatatgattgtacctatccatgcatgcaacatgatgaaatcatgtctgattgggctcggaccatacagaatccaggttgtgtatgagaggacttactgcaccacaggcatattaaccgagggtaagtgtttcgtccccgataaagccgtggtgagtgctctgaagcgggggatgtatgcaatcgccagcattgaaactatctgctttttcattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggattttcgcgctatggaagtattcagcggcatcatcacaagtccccatggggaggaccacgatcttcctggagaagagattgccacttatcagatatctggccagatcgaggcaaagattccacacaccgtgtccagcaaaaatttgaagctgacagcttttgccggtatcccgtcgtactcttccacctcaatactagcggccagtgaagacgggagattcatttttagccccggactcttccctaacctgaaccagtccgtctgcgataataacgcacttccactgatctggaggggcttgatcgacctcacgggctattacgaggctgtgcatccctgtaatgttttctgcgtgctgtctgggcctggagccagctgtgaagccttttcagagggtggcattttcaacatcacttcaccaatgtgcttagtctccaaacaaaatcggtttcgcgccgcagaacagcagattagcttcgtgtgtcaacgagtagatatggacataatcgtttattgcaacgggcagaagaaaacaattctgaccaagactctcgtgatcggacagtgtatctacacaattacctctttgttttcactgttgcccggcgtcgcccacagtatagctatcgagctatgcgtgccgggtttccatgggtgggcgacggcagccctgctcattaccttttgtttcggctgggtcctgatccctgcttgcacacttgccattctgttggtgctcaagtttttcgcaaatatcctgcacactagcaaccaggagaatagatttaaagccatattaaggaagatcaaagaagagttcgaaaagaccaaaggatccatggtttgtgagatttgcaagtacgaatgcgagacactgaaggagctaaaagctcacaacctctcttgtgtgcaaggcgaatgcccctattgttttactcattgcgagccaaccgaaacagccatccaggcacactacaaggtatgtcaggcgacccatcggttccgtgaggatctgaaaaagactgtcacgcctcagaatattgggcccggatgctatcgcacacttaacttgttcagatacaaatcgaggtgttatatcctgaccatgtggactctcctgcttataattgagagcatcctgtgggctgcctccgcagccgaaattccattggtgcccctctggaccgacaatgctcacggtgttggctcagtgcctatgcatacagacctggagttagattttagtctgccatctagctccaagtacacctataagcggcacctaactaacccggtcaatgaccaacagtcagtgagcctccacatcgaaatagagtctcaggggatcggagccgatgtacatcacctgggccattggtacgacgcacgacttaacttgaaaacatccttccactgctacggtgcttgtacgaagtatcagtacccctggcacaccgccaaatgccattttgaaaaggattatgagtacgagaacagttgggcgtgtaatcctccagactgccccggggtgggcactggatgcacagcctgtggcctgtatctcgatcaactgaaacctgttgggaccgctttcaagattatcagcgtccgctactctagaaaggtgtgcgtgcagtttggagaagagtatttatgtaaaacaattgacatgaacgattgcttcgtcactaggcacgcaaagatctgtataattggtaccgtttccaaattttcacagggcgacacgctgcttttcttggggccaatggaaggaggcggtatcatctttaagcattggtgcaccagtacatgtcacttcggggatcccggcgacgtgatgggaccgaaagacaagccttttatttgcccagagttccccggccagtttcggaaaaagtgtaatttcgccactacccctgtgtgcgaatacgatgggaacatcattagcggatacaagaaagtactcgctacaatagactcgttccaatcctttaatacttctaacatccatttcaccgatgagcgcattgagtggagagaccccgatggcatgctgagggaccacatcaatattgtcatcagcaaggatatagactttgaaaacctagccgagaatccatgtaaagtgggtctgcaggcagcgaacatcgaaggggcctggggatcaggcgttggtttcacgctcacatgccaggtgagtctgaccgagtgccctacttttcttacatccattaaggcttgtgatatggccatctgctatggcgcagaatctgtcaccttgagccgtgggcaaaatactgtgaaaattaccggaaagggcgggcactccggaagtagcttcaagtgttgccatggcaaagagtgtagttctacaggtctgcaggctaacgctccccacttagacaaggttaatgggatctccgagctcgaaaacgagaaagtgtacgatgacggagcaccagaatgcggcgtaacgtgttggtttaagaaaagcggtgagtgggtcatgggcataattaatgggaactgggtggtgctgatcgtcctttgcgttctgcttctcttctcgctgatcctactgtcaattctctgtccggtgcggaagcataagaaatcttga

SEQ ID NO: 10218 - RNA, 3402 nt, synthetic construct
  misc_feature 1..3402: note = derived and/or modified CDS sequence (opt3) from SEOV(RuianRn180)__GU592931.1__GP
  source 1..3402: mol_type = other RNA
atgtggagcctgctcatcgtggccgctcttgtcggccaggggttcgcactgaagaacgtttttgacatgagaatacaatgcccccactccgtgaatttcggagagacctctgtatcaggttacacagaattgcctccattaagtctgcaggaggccgaacagctagtgccggagagctcctgtaacatggataatcatcagtctctctcgactataaacaaactgacgaaggtcatctggaggaaaaaggcgaatcaagaatcagctaaccagaatagctttgaggtggttgagagtgaagtgtccttcaaaggcctttgcatgctgaagcaccggatggtcgaggaatcttatcgcaaccgacgtagcgtgatttgttacgacttggcctgcaattccaccttttgtaagcccacagtatatatgatcgttcctattcatgcatgcaacatgatgaaatcatgtctcatcgggctgggaccatacagaatacaggtggtctatgagaggacttactgcaccacaggcatcctgaccgagggtaagtgtttcgtgcccgataaagccgtggtcagtgctctcaagcgggggatgtatgcaattgccagcatcgaaactatttgctttttcatccaccagaaaggaaatacatacaagatagttaccgctattacgtctgccatgggctccaagtgtaacaatactgacaccaaagtgcaaggctactatatctgcattatcgggggaaactcagcgcctgtatacgcaccagccggtgaggattttcgcgctatggaagtgttcagcggcatcattacaagtccccatggggaggaccacgatttacctggagaagagatagccacttatcagatctctggccagattgaggcaaagatcccacacaccgtctccagcaaaaatctgaaacttacagcttttgccggtataccgtcgtactcttccacctcaattttggcggccagtgaagacgggagattcatctttagccccggactgttccctaacctaaaccagtccgtgtgcgataataacgcactcccactgatctggaggggccttattgacctgacgggctattacgaggctgttcatccctgtaatgtgttctgcgtcttgtctgggcctggagccagctgtgaagccttttcagagggtggcatcttcaacattacttcaccaatgtgcctcgtgtccaaacaaaatcggtttcgcgccgcagaacagcagattagcttcatctgtcaacgagtagatatggacattatcgtttattgcaacgggcagaagaaaacaatcctgaccaagactttagtgattggacagtgtatatacacaatcacctctctgttttcactccttcccggcgtcgcccacagtattgctatcgagctgtgcgtgccgggtttccatgggtgggcgacggcagccttgctaattaccttttgtttcggctgggtcctgatccctgcttgcacactcgccatactgcttgtgctgaagtttttcgcaaatatcttgcacactagcaaccaggagaatagatttaaagccattctcaggaagatcaaagaagagttcgaaaagaccaaaggatccatggtttgtgagatttgcaagtacgaatgcgagacactgaaggagttaaaagctcacaacctgtcttgtgtgcaaggcgaatgcccctattgttttactcattgcgagccaaccgaaacagccatccaggcacactacaaggtatgtcaggcgacccatcggttccgtgaggatctaaagaagactgtcacgcctcagaatatagggcccggatgctatcgcacactcaacctgttcagatacaaatcgaggtgttatattcttaccatgtggactttgctgctcatcattgagagcatcctgtgggctgcctccgcagccgaaataccacttgtgcccctgtggaccgacaatgctcacggtgttggctcagtgcctatgcatacagacttggagctcgattttagtctgccatctagctccaagtacacctataagcggcacttaactaacccggtcaatgaccaacagtcagtgagcctgcacatcgaaattgagtctcaggggatcggagccgatgtacatcacctaggccattggtacgacgcacgactcaacctgaaaacatccttccactgctacggtgcttgtacgaagtatcagtacccctggcacaccgccaaatgccattttgaaaaggattatgagtacgagaacagttgggcgtgtaatcctccagactgccccggggtgggcactggatgcacagcctgtggcctttatttggatcaactgaaacctgttgggaccgctttcaagattatcagcgtccgctactctagaaaggtgtgcgtgcagtttggagaagagtatctctgtaaaacaatagacatgaacgattgcttcgtcactaggcacgcaaagatttgtatcatcggtaccgtttccaaattttcacagggcgacacgctgttattcctggggccaatggaaggaggcggtattatctttaagcattggtgcaccagtacatgtcacttcggggatcccggcgacgtgatgggaccgaaagacaagccttttatttgcccagagttccccggccagtttcggaaaaagtgtaatttcgccactacccctgtgtgcgaatacgatgggaacataatcagcggatacaagaaagtacttgctacaattgactcgttccaatcctttaatacttctaacatccatttcaccgatgagcgcattgagtggagagaccccgatggcatgttgagggaccacatcaatatagtcatcagcaaggatattgactttgaaaacctcgccgagaatccatgtaaagtgggtctgcaggcagcgaacatcgaaggggcctggggatcaggcgttggtttcacgctaacatgccaggtgagtctgaccgagtgccctacttttctcacatccattaaggcttgtgatatggccatctgctatggcgcagaatctgtcaccctgagccgtgggcaaaatactgtgaaaataaccggaaagggcgggcactccggaagtagcttcaagtgttgccatggcaaagagtgtagttctacaggtcttcaggcttccgctccccacttggacaaggttaacgggattagcgagctggaaaatgagaaagtgtacgatgacggagcaccagaatgcggcgtaacgtgttggtttaagaaatcgggtgagtgggtcatgggcatcatcaacgggaattgggtggtgttaattgtcctctgcgttctgcttctgttctcattgatactcctgtctatcctatgtccggtgcggaagcataagaaaagttga

SEQ ID NO: 10219 - RNA, 3402 nt, synthetic construct
  misc_feature 1..3402: note = derived and/or modified CDS sequence (opt3) from SEOV(ShuangyangRn470)__GU592925.1__GP
  source 1..3402: mol_type = other RNA
atgtggagcctgctctttcttgccgctctggtgggccaggggtttgcattgaagaacgtcttcgacatgagaatccaatgcccccactccgttaattttggagagacctctgtgtcaggttacacagaattacctccactgagtctacaggagagcgaacagctcgtaccggagtcctcttgtaacatggataatcatcagtcgctgtcaactattaacaaacttacgaaggtgatatggaggaaaaaggccaatcaagaaagcgcgaaccagaatagtttcgaggtcgtggagtccgaagtttcttttaaaggcctgtgcatgttgaagcaccggatggtggaggaaagctatcgcaaccgacgttccgtcatctgttacgacctcgcttgcaattcaaccttctgtaagcccacagtgtatatgattgtacctatccatgcctgcaacatgatgaaaagttgtctgattgggctgggaccatacagaatccaggttgtgtatgagaggacttactgcaccacaggcatactcaccgagggtaagtgttttgtccccgataaagcagtggtgagcgccttaaagcgggggatgtatgctatcgcatctattgaaactatctgcttctttattcaccagaaaggaaatacatacaagatcgtcaccgccataacgtccgctatgggctcaaagtgtaacaatactgacaccaaagttcaaggctactatatttgcatcattgggggaaacagcgcccctgtgtacgcgccagccggtgaggatttccgcgcaatggaagtatttagtggcatcatcacatctccccatggggaggaccacgatctgcctggagaagagattgctacttatcagatatccggccagatcgaggccaagattccacacaccgtgagctcgaaaaatcttaagttgacagcattcgctggtatcccgtcttactcctcaaccagtatactggccgcgagcgaagacgggagatttattttctcccccggactattccctaacctcaaccagtctgtctgcaataacaatgccctgccacttatctggaggggcctgatcgatttgacgggctattacgaggcagtgcatccctgtaacgttttctgcgtgctcagcgggcctggagcttcatgtgaagccttcagtgagggtggcatttttaatatcacttccccaatgtgcctggtcagcaaacaaaaccggttccgcgctgccgaacagcagatttcttttgtgtgtcaacgagtagacatggatataatcgtttattgcaatgggcagaagaaaacaattttaaccaagactctggtgatcggacagtgtatctacacaattacctcactcttcagtcttctgcccggcgtcgcacacagcatagccatcgagttgtgcgtgccgggttttcatgggtgggctacggcggcactactgattaccttctgttttggctgggtcctcatccctgcctgcacactggctattcttctggtgttgaagttctttgccaacatcctccacacttccaatcaggagaacagattcaaagcaatactgaggaagatcaaagaagagtttgaaaagaccaaaggatctatggtttgtgagatttgcaagtacgaatgcgagacattaaaggagctgaaagcccacaatctatcgtgtgtgcaaggcgaatgcccctattgtttcactcattgcgagccaaccgaaacagctatccaggcccactacaaggtatgtcaggcaacccatcggttccgtgaggacctcaaaaagactgtcacgcctcagaacattgggcccggatgctatcgcacactgaatctttttagatacaaatccaggtgttatatcttgaccatgtggactctgctcctgatagtggagagcattctttgggcggcttcagccgcagaaatcccactggttcccttgtggaccgataacgcccacggtgtgggcagtgtccctatgcatacagacctcgagctggacttctctttaccaagctcctcaaagtacacctataagcggcacctgactaatccggtgaacgatcaacagagcgtatctctacacattgaaatcgagtcccaggggataggagctgacgtgcatcacctcggccattggtacgatgcccgactgaaccttaaaacaagttttcactgctacggtgcatgtacgaagtatcagtacccctggcacaccgctaaatgccatttcgaaaaggactatgagtacgagaatagctgggcctgtaaccctccagattgccccggggttggcactggatgcacagcgtgtggcttgtatctggaccaactcaaacctgtcgggaccgcctttaagatcatttctgtgcgctactccagaaaggtgtgcgtccagttcggagaagagtatctgtgtaaaacaatcgatatgaatgactgctttgttactaggcacgctaagatttgtatcataggtaccgtgtcaaaattcagtcagggcgatacgttactgtttcttgggccaatggaaggaggcggtattatcttcaagcattggtgcaccagcacatgtcactttggggaccccggcgatgtgatgggaccgaaagacaagcctttcatctgcccagagtttcccggccagttccggaaaacttgtaacttcgcaaccacacctgtatgcgaatacgacgggaatattatctcgggatacaagaaggtcttggccactattgattcctttcaatctttcaacaccagcaatatacattttacggacgagcgcatcgagtggagagatcccgacggcatgctcagggatcacattaacatcgtgatttcaaaagacatcgatttcgaaaatctggctgagaacccatgtaaggttggtctacaggccgcaaatatagaaggggcgtggggaagtggcgtgggttttacactgacctgccaggtctccctcactgagtgccctacattcctgacctctatcaaagcctgtgacatggctatttgctatggcgccgaaagcgtgactctttcccgtgggcaaaacaccgttaagatcacaggaaaaggcgggcactcaggaagcagttttaagtgttgccatggcaaggagtgttcttccacgggtttgcaggcaagcgctccccacctggataaagtgaatgggatttcggagttagaaaacgagaaggtatacgacgatggagccccagaatgcggcgtcacctgttggttcaaaaagtcaggtgagtgggtgatgggcatcataaatgggaactgggtggtcctcattgttctgtgcgtgcttctgttgttttctctcatcctgctaagtatcctgtgtccggtacggaaacataagaagtcctga

SEQ ID NO: 10220 - RNA, 3402 nt, synthetic construct
  misc_feature 1..3402: note = derived and/or modified CDS sequence (opt3) from SEOV(WuhanMm13)__JQ665886.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcatcgagagtgaagtgtccttcaaaggcttgtgcatgctcaagcaccggatggttgaggaatcttatcgcaaccgacgtagcgtgatttgttacgacctggcctgcaattccaccttttgtaagcccacagtctatatgatcgtgcctattcatgcatgcaacatgatgaaatcatgtctgatcgggctcggaccatacagaatacaggtagtttatgagaggacttactgcaccacaggcatcttaaccgagggtaagtgtttcgtgcccgataaagccgtcgtgagtgctctgaagcgggggatgtatgcagtggccagcattgaaactatctgctttttcattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggattttcgcgctatggaagtattcagcggcatcatcacaagtccccatggggaggaccacgatcttcctggagaagagattgccacttatcagatatctggccagatcgaggcaaagattccacacaccgtgtccagcaaaaatttgaagctgacagcttttgccggtatcccgtcgtactcttccacctcaatactagcggccagtgaagacgggagattcatttttagccccggactcttccctaacctgaaccagtccgtctgcgataataacgcacttccactgatctggaggggcttgatcgacctcacgggctattacgaggctgtgcatccctgtaatgttttctgcgtgctgtctgggcctggagccagctgtgaagccttttcagagggtggcattttcaacatcacttcaccaatgtgcttagtctccaaacaaaatcggtttcgcgccgcagaacagcagattagcttcgtgtgtcaacgagtagatatggacataatcgtttattgcaacgggcagaagaaaacaattctgaccaagactctcgtgatcggacagtgtatctacacaattacctctctgttttcacttttgcccggcgtcgcccacagtatagctatcgagctatgcgtgccgggtttccatgggtgggcgacggcagccctgctcaccacattttgtttcggctgggtcctgattcctgcttgcactcttgccatcctgttggtgctcaagtttttcgcaaatattctgcacaccagcaaccaggagaatagatttaaagccatcttaaggaagataaaagaagagttcgaaaagacaaaaggatccatggtttgtgagatctgcaagtacgaatgcgagactctgaaggagctaaaagctcacaacctctcttgtgtgcaaggcgaatgcccctattgttttacccattgcgagccaacagaaaccgccattcaggcacactacaaggtatgtcaggcgactcatcggttccgtgaggatctgaaaaagacggtcacacctcagaatatcgggcccggatgctatcgcacccttaacttgttcagatacaaatcgaggtgttatattctgactatgtggaccatcctcctgataattgagagcatcctttgggctgcctccgcagccgaaattccactggtgcccttgtggacagacaatgctcacggtgttggctcagtgcctatgcataccgacctcgagctggattttagtttaccatctagctccaagtacacttataagcggcacctgacaaacccggtcaatgaccaacagtcagtgagcctacacatcgaaatagagtctcaggggatcggagccgatgtacatcacctcggccattggtacgacgcacgactgaaccttaaaacgtccttccactgctacggtgcttgtaccaagtatcagtacccctggcacactgccaaatgccattttgaaaaggattatgagtacgagaacagttgggcgtgtaatcctccagactgccccggggtgggcacaggatgcaccgcctgtggcttgtatctggatcaactcaaacctgttgggacagctttcaagattatcagcgtccgctactctagaaaggtgtgcgtgcagtttggagaagagtatctgtgtaaaactattgacatgaacgattgcttcgtcaccaggcacgcaaagatctgtataattggtacggtttccaaattttcacagggcgacaccttactgttccttgggccaatggaaggaggcggtatcatctttaagcattggtgcacaagtacttgtcacttcggggatcccggcgacgtgatgggaccgaaagacaagccttttatttgcccagagttccccggccagtttcggaaaaagtgtaatttcgccaccacacctgtgtgcgaatacgatgggaacatcattagcggatacaagaaagtattggctactatagactcgttccaatcctttaatacctctaacatccatttcacggatgagcgcattgagtggagagaccccgatggcatgctcagggaccacatcaatattgtcatcagcaaggatatagactttgaaaacctggccgagaatccatgtaaagtgggtctacaggcagcgaacatcgaaggggcctggggatcaggcgttggtttcacactgacctgccaggtgagtctcactgagtgccctacatttctgacctccattaaggcttgtgatatggccatctgctatggcgcagaatctgtcactcttagccgtgggcaaaataccgtgaaaattacaggaaagggcgggcactccggaagtagcttcaagtgttgccatggcaaagagtgtagttctacgggtttgcaggcttccgctccccacctggacaaggttaacgggatcagcgagttagaaaatgagaaagtgtacgatgacggagcaccagaatgcggcataacctgttggtttaagaaatcgggtgagtgggtaatgggcattatcaacgggaattgggtcgtgctcatcgccctgtgcgtgcttctgttgttctcactcattctgctatctatactgtgtccggtccggaagcataagaaaagttga

SEQ ID NO: 10221 - RNA, 3402 nt, synthetic construct
  misc_feature 1..3402: note = derived and/or modified CDS sequence (opt3) from SEOV(WuhanMm24)__JQ665887.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcatggagagtgaagtgtccttcaaaggcttgtgcatgctcaagcaccggatggttgaggaatcttatcgcaaccgacgtagcgtgatctgttacgacctggcctgcaattccaccttttgtaagcccacagtctatatgattgtgcctatccatgcatgcaacatgatgaaatcatgtctgattgggctcggaccatacagaatccaggtagtttatgagaggacttactgcaccacaggcatattaaccgagggtaagtgtttcgtgcccgataaagccgtcgtgagtgctctgaagcgggggatgtatgcaatcgccagcattgaaactatctgctttttcattcaccagaaaggaaatacatacaagatcgtgaccgctataacgtctgccatgggctccaagtgtaacaatactgacaccaaagtccaaggctactatatttgcatcattgggggaaactcagcgcctgtttacgcaccagccggtgaggattttcgcgctatggaagtgttcagcggcatcatcacaagtccccatggggaggaccacgatcttcctggagaagagattgccacttatcagatatctggccagatcgaggcaaagattccacacaccgtatccagcaaaaatttgaagctgacagcttttgccggtatcccgtcgtactcttccacctcaatactagcggccagtgaagacgggagattcatttttagccccggactcttccctaacctgaaccagtccgtgtgcgataataacgcacttccactgatctggaggggcttgatcgacctcacgggctattacgaggctgtccatccctgtaatgtgttctgcgttctgtctgggcctggagccagctgtgaagccttttcagagggtggcattttcaacatcacttcaccaatgtgcttagtgtccaaacaaaatcggtttcgcgccgcagaacagcagattagcttcgtctgtcaacgagtggatatggacataatcgtatattgcaacgggcagaagaaaacaattctgaccaagactctcgttatcggacagtgtatctacacaattacctctctttttagtctgttgcccggcgtggcccacagtatagctatcgagctatgcgtcccgggtttccatgggtgggcgacggcagccctgctcattaccttttgtttcggctgggtgctgatccctgcttgcacacttgccattctgttggtcctcaagtttttcgcaaatatcctgcacactagcaaccaggagaatagatttaaagccatattaaggaagatcaaagaagagttcgaaaagaccaaaggatccatggtgtgtgagatttgcaagtacgaatgcgagacactgaaggagctaaaagctcacaacctctcttgtgttcaaggcgaatgcccctattgttttactcattgcgagccaaccgaaacagccatccaggcacactacaaggtgtgtcaggcgacccatcggttccgtgaggatctgaaaaagactgtaacgcctcagaatattgggcccggatgctatcgcacacttaacttgttcagatacaaatcgaggtgttatatcctgaccatgtggactctcctgcttataattgagagcatcctgtgggctgcctccgcagccgaaattccattggtccccctctggaccgacaatgctcacggtgtgggctcagttcctatgcatacagacctggagttagattttagtctgccatctagctcccggtacacctataagcgacacctaactaacccggtgaatgaccaacagtcagtcagcctccacatcgaaatagagtctcaggggatcggagccgatgtgcatcacctgggccattggtacgacgcacgccttaacttgaagacatccttccactgctacggtgcttgtacgaaatatcagtacccctggcacaccgccaagtgccattttgaaaaagattatgagtacgagaacagttgggcgtgtaatcctccagactgccccggggtaggcactggatgcacagcctgtggcctgtatctcgatcaactgaagcctgtggggaccgctttcaaaattatcagcgttagatactctaggaaggtctgcgtgcagtttggagaagagtatttatgtaagacaattgacatgaacgattgcttcgtgactcggcacgcaaaaatctgtataattggtaccgtctccaagttttcacagggcgacacgctgcttttcttggggccaatggaaggaggcggtatcatctttaaacattggtgcaccagtacatgtcacttcggggatcccggcgacgttatgggaccgaaggacaaaccttttatttgcccagagttccccggccagtttcgcaagaaatgtaatttcgccactagccctgtgtgcgaatacgatgggaacatcatttcgggatacaagaaggtgctcgctaccatagactccttccaatcttttaatacaagcaacatccatttcactgatgagagaattgagtggagggaccccgatggcatgctgcgtgaccacatcaatattgtaatctcaaaagatatagactttgaaaacctagccgagaatccatgtaaggtcggtctgcaggcagcgaacatcgaaggggcctggggaagtggcgtgggtttcaccctcacgtgccaggtttccctgacagagtgccctacctttcttacttctattaaggcttgtgatatggccatctgctatggcgcagaaagcgtgacattgtcccgggggcaaaataccgtcaaaattactggaaaaggcgggcactcaggaagcagtttcaagtgttgccatggcaaggagtgttctctgaccggtttacaggcttccgctccccacctcgacaaagtgaacgggatcagcgagctggaaaatgagaaggtttacgatgacggagcaccagaatgcggcataacatgttggtttaaaaagtcgggtgagtgggtgatgggcattatcaacgggaattgggtagtccttatcgccctgtgcgtgttgctcctgttctcactaattctgctctctatactgtgtccggtgcgaaaacataagaagagttga

SEQ ID NO: 10222 - RNA, 3402 nt, synthetic construct
  misc_feature 1..3402: note = derived and/or modified CDS sequence (opt3) from SEOV(WuhanRf02)__JQ665888.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcatcgagagtgaagtgtccttcaaaggcttgtgcatgctcaagcaccggatggttgaggaatcttatcgcaaccgacgtagcgtgatttgttacgacctggcctgcaattccaccttttgtaagcccacagtctatatgatcgtgcctattcatgcatgcaacatgatgaaatcatgtctgatcgggctcggaccatacagaatacaggtagtttatgagaggacttactgcaccacaggcatcttaaccgagggtaagtgtttcgtgcccgataaagccgtcgtgagtgctctgaagcgggggatgtatgcagtggccagcattgaaactatctgctttttcattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggattttcgcgctatggaagtattcagcggcatcatcacaagtccccatggggaggaccacgatcttcctggagaagagattgccacttatcagatatctggccagatcgaggcaaagattccacacaccgtgtccagcaaaaatttgaagctgacagcttttgccggtatcccgtcgtactcttccacctcaatactagcggccagtgaagacgggagattcatttttagccccggactcttccctaacctgaaccagtccgtctgcgataataacgcacttccactgatctggaggggcttgatcgacctcacgggctattacgaggctgtgcatccctgtaatgttttctgcgtgctgtctgggcctggagccagctgtgaggctttttcagaaggtggcattttcaacatcacaagtccaatgtgcttagtctccaaacaaaatcggtttcgcgccgcagaacagcgaattagcttcgtgtgtcagagagtagatatggacataatcgtttattgcaacgggcaaaagaaaactattctgaccaagactctcgtgatcggacagtgtatctacacaattacctctttgttttcactgttgcccggcgtcgcccacagtatagctatcgagctatgcgtgccgggtttccatgggtgggcgacggcagccctgctcaccacattttgtttcggctgggtcctgattcctgcttgcactcttgccatcctgttggtgctcaagtttttcgcaaatattctgcacaccagcaaccaggagaataggtttaaagccatcttacggaagataaaagaagagttcgaaaagacaaaaggatccgttgtgtgtgagatctgcaagtacgaatgcgagactctgaaggagctaaaagctcacaacctctcttgtgtacagggcgaatgcccctattgttttacccattgcgagccaacagaaaccgccattcaagcacactacaaggtctgtcaggcgactcatcgtttccgcgaggatctgaaaaagacggtgacacctcagaatatcgggcccggatgctatagaacccttaacttgttcaggtacaattcgcggccagacggtctgactatgtggaccctcctgcttattatcgagagcatactgtgggctgcctccgcagccgaaattcccttggttcctctctgggctgacaacgcccacggcgtggggtcagtcccaatgcatacagatctggagttagactttagtctgccgtctagctccaaatatacctacaagcgacacctaactaatcccgtgaacgatcagcaatcagtaagcctccacatcgaaattgagtctcagggaatcggcgcagacgtgcatcacctgggtcattggtatgatgctcgccttaacttgaagacatccttccactgttacggggcctgcacgaaataccagtatccttggcacaccgcgaagtgtcattttgaaaaagactacgagtatgagaatagttgggcctgcaacccacccgattgtcctggcgttggaactggctgcacagcttgcgggctgtacctcgaccagctgaagccagtcggaaccgcattcaaaataatcagcgtgagatattctaggaaggtgtgtgtccaatttggtgaagagtacttatgcaagacaattgatatgaatgactgtttcgttactcggcacgccaaaatctgcattatcggcaccgtgcccaagttttcccagggggatacgctgcttttcttgggaccgatggaaggcggtgggataatttttaaacattggtgtacctcaacatgccacttcggcgaccctggagacgtgatgggcccaaaggataaaccctttatccgccctgagttccccgggcagtttagaaagaaatgtaacttcgctactaccccagtatgcggatatgacggcaatatcattagtggttacaagaaggtcctcgccacaatcgatagcttccagtcgtttaacacttccaatattcatttcaccgacgaaaggatagagtggcgtgatcctgacgggatgctgcgggatcacatcaacattgtgatctctaaagacattgattttgagaatctagcagaaaacccctgtaaggttggactgcaagcggccaatatcgagggcgcttggggtagcggcgtggggttcacgctcacatgccaggtctcactgaccgaatgtccaacttttcttacaagtataaaagcctgcgacatggcaatctgctacggagctgagtccgtgaccttgtctcgaggccagaacactgttaagattaccgggaaaggaggccacagcggttcctcattcaagtgttgccatgggaaggaatgtagcagtacaggactgcaagcctctgcaccgcacttagataaagtgaatggcatctccgagctcgagaacgaaaaggtatatgacgatggtgcccctgagtgcggcattacgtgttggtttaaaaagagcggggaatgggtcatgggaatcataaatggcaactgggtggtgctgattgctctttgcgtcctgcttctcttctcgctgatcctactgtcaatcctctgtcccgttagaaaacataagaagtcttga

SEQ ID NO: 10223 - RNA, 3402 nt, synthetic construct
  misc_feature 1..3402: note = derived and/or modified CDS sequence (opt3) from SEOV(WuhanRf07)__JQ665889.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcatcgagagtgaagtgtccttcaaaggcttgtgcatgctcaagcaccggatggttgaggaatcttatcgcaaccgacgtagcgtgatttgttacgacctggcctgcaattccaccttttgtaagcccacagtctatatgatcgtgcctattcatgcatgcaacatgatgaaatcatgtctgatcgggctcggaccatacagaatacaggtagtttatgagaggacttactgcaccacaggcatcttaaccgagggtaagtgtttcgtgcccgataaagccgtcgtgagtgctctgaagcgggggatgtatgcagtggccagcattgaaactatctgctttttcattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggattttcgcgctatggaagtattcagcggcatcatcacaagtccccatggggaggaccacgatcttcctggagaagagattgccacttatcagatatctggccagatcgaggcaaagattccacacaccgtgtccagcaaaaatttgaagctgacagcttttgccggtatcccgtcgtactcttccacctcaatactagcggccagtgaagacgggagattcatttttagccccggactcttccctaacctgaaccagtccgtctgcgataataacgcacttccactgatctggaggggcttgatcgacctcacgggctattacgaggctgtgcatccctgtaatgttttctgcgtgctgtctgggcctggagccagctgtgaggctttttcagaaggtggcattttcaacatcacttcaccaatgtgcttagtctccaaacaaaatcggtttcgcgccgcagaacagcagattagcttcgtgtgtcaacgagtagatatggacataatcgtttattgcaacgggcagaagaaaacaattctgaccaagactctcgtgatcggacagtgtatctacacaattacctctctgttttcacttttgcccggcgtcgcccacagtatagctatcgagctatgcgtgccgggtttccatgggtgggcgacggcagccctgctcaccacattttgtttcggctgggtcctgattcctgcttgcactcttgccatcctgttggtgctcaagtttttcgcaaatattctgcacaccagcaaccaggagaatagatttaaagccatcttaaggaagataaaagaagagttcgaaaagacaaaaggatccatggtttgtgagatctgcaagtacgaatgcgagactctgaaggagctaaaagctcacaacctctcttgtgtgcaaggcgaatgcccctattgttttacccattgcgagccaacagaaaccgccattcaggcacactacaaggtatgtcaggcgactcatcggttccgtgaggatctgaaaaagacggtcacacctcagaatatcgggcccggatgctatcgcacccttaacttgttcagatacaaatcgaggccatatattctgactatgtggaccatcctcctgataattgagagcatcctttgggctgcctccgcagccgaaattcccctggtgcctttgtggacagacaatgctcacggtgttggctcagtgccaatgcataccgacctcgagctggattttagtttaccgtctagctccaagtacacttataagcggcacctgacaaaccccgtcaatgaccaacagtcagtgagcctacacatcgaaatagagtctcaggggatcggagccgatgtacatcacctcggccattggtacgacgcacgactgaaccttaaaacgtccttccactgttacggtgcttgcaccaagtatcagtacccttggcacactgccaaatgtcattttgaaaaggattatgagtacgagaacagttgggcgtgcaatccacccgactgtcctggggtgggcacaggatgcaccgcctgcggcttgtatctggatcaactcaaaccagttgggacagctttcaagattatcagcgtccgctactctagaaaggtgtgtgtgcagtttggagaagagtatctgtgcaaaactattgacatgaacgattgtttcgtcaccaggcacgcaaagatctgcataattggtacggtttccaaattttcacagggcgacaccttactgttccttgggcccatggaaggaggcggtatcatctttaagcattggtgtacaagtacttgccacttcggggatccgggcgacgtgatgggacctaaagacaagccatttatttgtcccgagttccctggccagtttcggaaaaagtgcaatttcgccaccacacccgtgtgtgaatacgatgggaacatcattagcggatacaagaaagtattggctactatagactcgttccaatcctttaatacctctaacatccatttcacggatgagcgcattgagtggagagacccagatggcatgctcagggaccacatcaatattgtcatcagcaaggatatagactttgaaaacctggccgagaatccttgcaaagtgggtctacaggcagcgaacatcgaaggggcctggggatcaggcgttggtttcacactgacctgtcaggtgagtctcactgagtgccccacatttctgacctccattaaggcttgcgatatggccatctgttatggcgcagaatctgtcactcttagccgtgggcaaaataccgtgaaaattacaggaaagggcgggcactccggaagtagcttcaagtgctgtcatggcaaagagtgcagttctacgggtttgcaggcttccgccccacacctggacaaggttaacgggatcagcgagttagaaaatgagaaagtgtacgatgacggagcaccggaatgtggcataacctgctggtttaagaaatcgggtgagtgggtaatgggcattatcaacgggaattgggtcgtgctcatcgccctgtgtgtgcttctgttgttctcactcattctgctatctatactgtgccctgtccggaagcataagaaaagttga

SEQ ID NO: 10224 - RNA, 3402 nt, synthetic construct
  misc_feature 1..3402: note = derived and/or modified CDS sequence (opt3) from SEOV(WuhanRf18)__JQ665893.1__GP
  source 1..3402: mol_type = other RNA
atgtggagcctgctccttctggccgctttggtgggccaagggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcatcgagagtgaagtgtccttcaaaggcttgtgcatgctcaagcaccggatggttgaggaatcttatcgcaaccgacgtagcgtgatttgttacgacctggcctgcaattccaccttttgtaagcccacagtctatatgatcgtgcctattcatgcatgcaacatgatgaaatcatgtctgatcgggctcggaccatacagaatacaggtagtttatgagaggacttactgcaccacaggcatcttaaccgagggtaagtgtttcgtgcccgataaagccgtcgtgagtgctctgaagcgggggatgtatgcagtggccagcattgaaactatctgctttttcattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggattttcgcgctatggaagtattcagcggcatcatcacaagtccccatggggaggaccacgatcttcctggagaagagattgccacttatcagatatctggccagatcgaggcaaagattccacacaccgtgtccagcaaaaatttgaagctgacagcttttgccggtatcccgtcgtactcttccacctcaatactagcggccagtgaagacgggagattcatttttagccccggactcttccctaacctgaaccagtccgtctgcgataataacgcacttccactgatctggaggggcttgatcgacctcacgggctattacgaggctgtgcatccctgtaatgttttctgcgtgctgtctgggcctggagccagctgtgaagccttttcagagggtggcattttcaacatcacttcaccaatgtgcttagtctccaaacaaaatcggtttcgcgccgcagaacagcgaattagcttcgtgtgtcagagagtagatatggacataatcgtttattgcaacgggcaaaagaaaacaattctgaccaagactctcgtgatcggacagtgtatctacacaattacctctctgttttcacttttgcccggcgtcgcccacagtatagctatcgagctatgcgtgccgggtttccatgggtgggcgacggcagccctgctcaccacattttgtttcggctgggtcctgattcctgcttgcactcttgccatcctgttggtgctcaagtttttcgcaaatattctgcacaccagcaaccaggagaataggtttaaagccatcttacggaagataaaagaagagttcgaaaagacaaaaggatccatggtttgtgagatctgcaagtacgaatgcgagactctgaaggagctaaaagctcacaacctctcttgtgtgcagggcgaatgcccctattgttttacccattgcgagccaacagaaaccgccattcaagcacactacaaggtatgtcaggcgactcatcgtttccgcgaggatctgaaaaagacggtcacacctcagaatatcgggcccggatgctatagaacccttaacttgttcaggtacaaatcgcggtgttatattctgactatgtggaccatcctcctgataattgagagcatcctttgggctgcctccgcagccgaaattccactggtgcccttgtggacagacaatgctcacggtgttggctcagtgcctatgcataccgacctcgagctggattttagtttaccatctagctccaagtacacttataagcgacacctgacaaacccggtcaatgaccagcaatcagtgagcctacacatcgaaatagagtctcaggggatcggagccgatgtacatcacctcggccattggtacgacgcacgcctgaaccttaaaacgtccttccactgctacggtgcttgtaccaagtatcagtacccctggcacactgccaaatgccattttgaaaaggattatgagtacgagaacagttgggcgtgtaatcctccagactgccccggggtgggcacaggatgcaccgcctgtggcttgtatctggatcagctcaaacctgttgggacagctttcaagattatcagcgtcagatactctaggaaggtgtgcgtgcaatttggagaagagtatctgtgtaaaactattgacatgaacgattgcttcgtcacccggcacgcaaagatctgtataattggtacggtttccaaattttcacagggcgacaccttactgttccttgggccaatggaaggaggcggtatcatctttaagcattggtgcacaagtacttgtcacttcggggatcccggcgacgtgatgggaccgaaagacaagccttttatttgcccagagttccccggccagtttcgcaaaaagtgtaatttcgccaccacacctgtgtgcgaatacgatgggaacatcattagcggatacaagaaagtattggctactatagactcgttccagtcctttaatacctctaacatccatttcacggatgagagaattgagtggagggaccccgatggcatgctccgtgaccacatcaatattgtcatcagcaaggatatagactttgaaaacctggccgagaatccatgtaaagtgggtctacaagcagcgaacatcgaaggggcctggggatcaggcgttggtttcacactgacctgccaggtgagtctcactgagtgccctacatttctgacctccattaaggcttgtgatatggccatctgctatggcgcagaatctgtcactcttagccgggggcagaataccgtgaaaattacaggaaagggcgggcactccggaagtagcttcaagtgttgccatggcaaagagtgtagttctacgggtttgcaggcttccgctccccacctggacaaggttaacgggatcagcgagttagaaaatgagaaagtgtacgatgacggagcaccagaatgcggcataacctgttggtttaagaaatcgggtgagtgggtaatgggcattatcaacgggaattgggtcgtgctcatcgccctgtgcgtgcttctgttgttctcactcattctgctatctatactgtgtccggtccgaaagcataagaaaagttga

SEQ ID NO: 10225 - RNA, 3402 nt, synthetic construct
  misc_feature 1..3402: note = derived and/or modified CDS sequence (opt3) from SEOV(WuhanRn10)__JQ665896.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcatcgagagtgaagtgtccttcaaaggcttgtgcatgctcaagcaccggatggttgaggaatcttatcgcaaccgacgtagcgtgatttgttacgacctggcctgcaattccaccttttgtaagcccacagtctatatgatcgtgcctattcatgcatgcaacatgatgaaatcatgtctgatcgggctcggaccatacagaatacaggtagtttatgagaggacttactgcaccacaggcatcttaaccgagggtaagtgtttcgtgcccgataaagccgtcgtgagtgctctgaagcgggggatgtatgcagtggccagcattgaaactatctgctttttcattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggattttcgcgctatggaagtattcagcggcatcatcacaagtccccatggggaggaccacgatcttcctggagaagagattgccacttatcagatatctggccagatcgaggcaaagattccacacaccgtgtccagcaaaaatttgaagctgacagcttttgccggtatcccgtcgtactcttccacctcaatactagcggccagtgaagacgggagattcatttttagccccggactcttccctaacctgaaccagtccgtctgcgataataacgcacttccactgatctggaggggcttgatcgacctcacgggctattacgaggctgtgcatccctgtaatgttttctgcgtgctgtctgggcctggagccagctgtgaagccttttcagagggtggcattttcaacatcacttcaccaatgtgcttagtctccaaacaaaatcggtttcgcgccgcagaacagcagattagcttcgtgtgtcaacgagtagatatggacataatcgtttattgcaacgggcagaagaaaacaattctgaccaagactctcgtgatcggacagtgtatctacacaattacctctctgttttcacttttgcccggcgtcgcccacagtatagctatcgagctatgcgtgccgggtttccatgggtgggcgacggcagccctgctcaccacattttgtttcggctgggtcctgattcctgcttgcactcttgccatcctgttggtgctcaagtttttcgcaaatattctgcacaccagcaaccaggagaatagatttaaagccatcttaaggaagataaaagaagagttcgaaaagaacaaaggatccgttgtgtgtgagatctgcaagtacgaatgcgagacactgaaggagctaaaagctcacaatctctcttgtgtacaaggcgaatgcccctattgttttactcattgcgagccaaccgaaacagccattcaggcacactacaaggtctgtcaggcgacccatcggttccgtgaggatctgaaaaagactgtgacgcctcagaacatcgggcccggatgctatcgcacacttaatttgttcagatacaaatcgaggtgttatattctgaccatgtggactatcctcctgataattgagagcatcctttgggctgcctccgcagccgaaattccactggttcccttgtggaccgacaacgctcacggtgtgggctcagtccctatgcatacagacctcgagctggattttagtttaccatctagctccaagtacacctataagcggcacctgactaatccggtgaacgaccaacagtcagtaagcctacacatcgaaatagagtctcaggggatcggagccgatgtgcatcacctcggccattggtacgacgcacgactgaaccttaaaacatccttccactgctacggtgcttgtacgaagtatcagtacccctggcacaccgccaaatgccattttgaaaaggattatgagtacgagaatagttgggcgtgtaaccctccagactgccccggggttggcactggatgcacagcctgtggcttgtatctggatcaactcaaacctgtcgggaccgctttcaagattatcagcgtgcgctactctagaaaggtgtgcgtccagtttggagaagagtatctgtgtaaaacaattgacatgaatgattgcttcgttactaggcacgcaaagatctgtataattggtaccgtgtccaaattttcacagggcgacacgttactgttccttgggccaatggaaggaggcggtatcatctttaagcattggtgcaccagtacatgtcacttcggggatcccggcgacgtgatgggaccgaaagacaagccttttatttgcccagagttccccggccagtttcggaaaaagtgtaacttcgccactacccctgtatgcgaatacgatgggaatatcattagcggatacaagaaagtcttggctacaatagactcgttccaatcctttaacacttctaatatccatttcaccgatgagcgcattgagtggagagaccccgatggcatgctcagggaccacatcaacattgtgatcagcaaggatatagactttgaaaatctggccgagaacccatgtaaagttggtctacaggcagcgaatatcgaaggggcctggggatcaggcgtgggtttcacgctgacatgccaggtcagtctcaccgagtgccctacttttctgacatccattaaggcttgtgatatggccatctgctatggcgcagaatctgtgacccttagccgtgggcaaaacactgttaaaattaccggaaagggcgggcactccggaagtagcttcaagtgttgccatggcaaagagtgtagttctacaggtttgcaggcttccgctccccacctggacaaggtgaatgggatcagcgagttagaaaacgagaaagtatacgatgacggagcaccagaatgcggcataacgtgttggtttaagaaatcgggtgagtgggtcatgggcattatcaatgggaactgggtggtgctcatcgccctgtgcgtccttctgttgttctcactcattctgctatctatactgtgtccggttcggaagcataagaaaagttga

SEQ ID NO: 10226 - RNA, 3402 nt, synthetic construct
  misc_feature 1..3402: note = derived and/or modified CDS sequence (opt3) from SEOV(WuhanRn25)__JQ665897.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcatcgagagtgaagtgtccttcaaaggcttgtgcatgctcaagcaccggatggttgaggaatcttatcgcaaccgacgtagcgtgatttgttacgacctggcctgcaattccaccttttgtaagcccacagtctatatgatcgtgcctattcatgcatgcaacatgatgaaatcatgtctgatcgggctcggaccatacagaatacaggtagtttatgagaggacttactgcaccacaggcatcttaaccgagggtaagtgtttcgtgcccgataaagccgtcgtgagtgctctgaagcgggggatgtatgcagtggccagcattgaaactatctgctttttcattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggattttcgcgctatggaagtattcagcggcatcatcacaagtccccatggggaggaccacgatcttcctggagaagagattgccacttatcagatatctggccagatcgaggcaaagattccacacaccgtgtccagcaaaaatttgaagctgacagcttttgccggtatcccgtcgtactcttccacctcaatactagcggccagtgaagacgggagattcatttttagccccggactcttccctaacctgaaccagtccgtctgcgataataacgcacttccactgatctggaggggcttgatcgacctcacgggctattacgaggctgtgcatccctgtaatgttttctgcgtgctgtctgggcctggagccagctgtgaagccttttcagagggtggcattttcaacatcacttcaccaatgtgcttagtctccaaacaaaatcggtttcgcgccgcagaacagcagattagcttcgtgtgtcaacgagtagatatggacataatcgtttattgcaacgggcagaagaaaacaattctgaccaagactctcgtgatcggacagtgtatctacacaattacctctctgttttcacttttgcccggcgtcgcccacagtatagctatcgagctatgcgtgccgggtttccatgggtgggcgacggcagccctgctcaccacattttgtttcggctgggtcctgattcctgcttgcactcttgccatcctgttggtgctcaagtttttcgcaaatattctgcacaccagcaaccaggagaatagatttaaagccatcttaaggaagataaaagaagagttcgaaaagaacaaaggatccatggtttgtgagatctgcaagtacgaatgcgagacactgaaggagctaaaagctcacaatctctcttgtgtgcaaggcgaatgcccctattgttttactcattgcgagccaaccgaaacagccattcaggcacactacaaggtatgtcaggcgacccatcggttccgtgaggatctgaaaaagactgtcacgcctcagaacatcgggcccggatgctatcgcacacttaatttgttcagatacaaatcgaggtgttatattctgaccatgtggactatcctcctgataattgagagcatcctttgggctgcctccgcagccgaaattccactggtgcccttgtggaccgacaacgctcacggtgttggctcagtgcctatgcatacagacctcgagctggattttagtttaccatctagctccaagtacacctataagcggcacctgactaatccggtcaacgaccaacagtcagtgagcctacacatcgaaatagagtctcaggggatcggagccgatgtacatcacctcggccattggtacgacgcacgactgaaccttaaaacatccttccactgctacggtgcttgtacgaagtatcagtacccctggcacaccgccaaatgccattttgaaaaggattatgagtacgagaatagttgggcgtgtaaccctccagactgccccggggtgggcactggatgcacagcctgtggcttgtatctggatcaactcaaacctgttgggaccgctttcaagattatcagcgtccgctactctagaaaggtgtgcgtgcagtttggagaagagtatctgtgtaaaacaattgacatgaatgattgcttcgtcactaggcacgcaaagatctgtataattggtaccgtttccaaattttcacagggcgacacgttactgttccttgggccaatggaaggaggcggtatcatctttaagcattggtgcaccagtacatgtcacttcggggatcccggcgacgtgatgggaccgaaagacaagccttttatttgcccagagttccccggccagtttcggaaaaagtgtaacttcgccactacccctgtgtgcgaatacgatgggaatatcattagcggatacaagaaagtattggctacaatagactcgttccaatcctttaacacttctaatatccatttcaccgatgagcgcattgagtggagagaccccgatggcatgctcagggaccacatcaacattgtcatcagcaaggatatagactttgaaaatctggccgagaacccatgtaaagtgggtctacaggcagcgaatatcgaaggggcctggggatcaggcgttggtttcacgctgacatgccaggtgagtctcaccgagtgccctacttttctgacatccattaaggcttgtgatatggccatctgctatggcgcagaatctgtcacccttagccgtgggcaaaacactgtgaaaattaccggaaagggcgggcactccggaagtagcttcaagtgttgccatggcaaagagtgtagttctacaggtttgcaggcttccgctccccacctggacaaggttaatgggatcagcgagttagaaaacgagaaagtgtacgatgacggagcaccagaatgcggcataacgtgttggtttaagaaatcgggtgagtgggtaatgggcattatcaatgggaactgggtcgtgctcatcgccctgtgcgtgcttctgttgttctcactcattctgctatctatactgtgtccggtccggaagcataagaaaagttga

SEQ ID NO: 10227 - RNA, 3402 nt, synthetic construct
  misc_feature 1..3402: note = derived and/or modified CDS sequence (opt3) from SEOV(XiaotangshanRn7)__GU592929.1__GP
  source 1..3402: mol_type = other RNA
atgtggagcctcctgttccttgccgctctggtgggccaggggtttgcattgaagaacgtcttcgacatgagaatccaatgcccccactccgttaattttggagagacctctgtgtcaggttacacagaattacctccactgagtctacaggaggccgaacagctcgtaccggagagctcctgtaacatggataatcatcagtctctgtcgactattaacaaacttacgaaggtgatatggaggcggaaagcgaatcaagaatcagctaaccagaatagcttcgaggtcgtggagagtgaagtttcctttaagggcctgtgcatgttgaaacaccgcatggtggaggaatcttatcgaaaccgtagaagcgtcatctgttacgacctcgcctgcaattccaccttctgtaagcccacagtgtatatgattgtacctatccatgcatgcaacatgatgaagtcatgtctgattgggctgggaccatacaggatccaggttgtgtatgagcggacttactgcaccacaggcatactcaccgagggtaaatgttttgtccccgataaggccgtggtgagtgctttaaaacgcgggatgtatgcaatcgccagcattgaaactatctgcttctttattcaccagaagggaaatacatacaaaatcgtcaccgctataacgtctgccatgggctccaagtgtaacaatactgacaccaaggttcaaggctactatatttgcatcattgggggaaactcagcgcctgtgtacgcaccagccggtgaggatttcagagctatggaagtatttagcggcatcatcacaagtccccatggggaggaccacgatctgcctggagaagagattgccacttatcagatatctggccagatcgaggcaaaaattccacacaccgtgtccagcaagaatcttaaattgacagctttcgccggtatcccgtcgtactcttccacctcaatactggcggccagtgaagacgggaggtttattttcagccccggactattccctaacctcaaccagtccgtctgcgataataacgcactgccacttatctggcggggcctgatcgacttgacgggctattacgaggctgtgcatccctgtaatgtgttttgcgttctctctgggcctggagccagctgtgaagccttctcagagggtggcatttttaacatcacttcaccaatgtgcctggtctccaagcaaaatcgcttccgagccgcagaacagcagattagctttgtgtgtcaaagagtagatatggacataatcgtttattgcaacgggcagaaaaagacaattttaaccaaaactctggtgatcggacagtgtatctacacaattacctctctcttctcacttctgcccggcgtcgcccacagtatagctatcgagttgtgcgtgccgggttttcatgggtgggcgacggcagccctactgattaccttctgttttggctgggtcctcatccctgcttgcacactggccattcttctggtgttgaagttctttgcaaatatcctccacactagcaaccaggagaataggttcaaggccatactgcggaaaatcaaggaagagtttgagaaaaccaagggatccatggtttgtgaaatttgcaaatacgaatgcgagacattaaaggagctgaaggctcacaacctatcttgtgtgcaaggcgaatgcccctattgtttcactcattgcgagccaaccgaaacagccatccaggcacactacaaagtatgtcaggcgacccatcgtttccgcgaggatctcaagaaaactgtcacgcctcagaatattgggcccggatgctatagaacactgaacctttttaggtacaagtcgcggtgttatatcttgaccatgtggactctgctcctgataattgagagcatcctttgggctgcctccgcagccgaaattccactggtgcccttgtggaccgacaatgctcacggtgttggctcagtgcctatgcatacagacctcgagctggatttcagtttaccatctagctccaaatacacctataagcgacacctgactaacccggtcaatgaccaacagtcagtgagcctacacatcgaaatagagtctcaggggatcggagccgatgtacatcacctcggccattggtacgacgcacgcctgaaccttaagacatcctttcactgctacggtgcttgtacgaaatatcagtacccctggcacaccgccaagtgccatttcgaaaaagattatgagtacgagaacagttgggcgtgtaatcctccagactgccccggggtgggcactggatgcacagcctgtggcttgtatctggatcaactcaagcctgttgggaccgcttttaaaattatcagcgtcagatactctaggaaggtgtgcgtgcagttcggagaagagtatctgtgtaagacaattgacatgaacgattgctttgtcactcggcacgcaaaaatctgtataattggtaccgtttccaagttctcacagggcgacacgttactgtttcttgggccaatggaaggaggcggtatcatcttcaaacattggtgcaccagtacatgtcactttggggatcccggcgacgtgatgggaccgaaggacaaacctttcatttgcccagagtttcccggccagttccgcaagaaatgtaatttcgccactacccctgtgtgcgaatacgatgggaacatcattagcggatacaagaaggtattggctacaatagactcgtttcaatccttcaatacttctaacatccattttaccgatgagagaattgagtggagggaccccgatggcatgctccgtgaccacatcaatattgtcatcagcaaagatatagacttcgaaaacctggccgagaatccatgtaaggtgggtctacaggcagcgaacatcgaaggggcctggggatcaggcgttggttttacgctgacatgccaggtgagtctcaccgagtgccctactttcctgacatccattaaggcttgtgatatggccatctgctatggcgcagaatctgtcacccttagccgggggcaaaatactgtgaaaattaccggaaaaggcgggcactccggaagtagctttaagtgttgccatggcaaggagtgtagttctacaggtttgcaggcttccgctccccacctggacaaagttaacgggatcagcgagttagaaaatgagaaggtgtacgatgacggagcaccagaatgcggcgtaacgtgttggttcaaaaagtcgggtgagtgggtcatgggcataattaacgggaattgggtggtgctcatcgtcctgtgcgttcttctgttgttttcactcatcctgctatctattctgtgtccggtgcgaaaacataagaagagttga

SEQ ID NO: 10228 - RNA, 3402 nt, synthetic construct
  misc_feature 1..3402: note = derived and/or modified CDS sequence (opt3) from SEOV(YongjiaRf45)__GU592926.1__GP
  source 1..3402: mol_type = other RNA
atgtggggcctgctccttctggccgctatggtggggcagggaagcgcattgaagaacgtcttcgacatgaaaatccaatgcccccactccgttaattttggtgagacctctgtgtcaggctacacagaattacctccactgccgctacaggaggccgaacagctcgtacccgagagtagctgtaacatggataatcatcagtccctgtctactattaacaagttgacgaaagtgatatggagaaagaaagcgaatcaagaatcggcttcacagaacagcttcgaggtcgtggagagtgaagtttcctttaaggggctgtgcatgttgaagcacaggatggtggaggaatcttatcggaatcgccgaagcgtcatctgttacgacctcgcctgcaacaccacattctgtaaacctactgtgtatatgattgtaccaatccatgcatgcaatatgatgaagtcctgtctgattggactgggcccctaccgtatccaggttatatatgagagaacctactgctcaacaggtatcctcaccgaggggaaatgttttgtgcacgataagactgtcgtgagtgccttaaaaaggggaatgtatgctattgcaagcatcgaaacagtgtgcttctttgtccatcagaagggcaacacctacaagattgttacggccatcacttctgctatgggctccaaatgtaataacaccgactcaaaggtgcaagggtactatatatgcattatcggaggtaatagcgcccctgtatacgcgccagcaggcgaggatttccgggccatggaagtgtttagtgggattatcacatctccccacggagaggaccacgatctgcctggcgaagaggtcgctacttatcagatctccggtcagattgaggccaaaataccacataccgtgagctcgaagaaccttaaattgacagcattcgctgggatcccgtcttactcctcaaccagtctgctagccgcgagcgaagacggacgctttattttctcccccggcctctttcctaatctgaaccagtctgtttgcgataacaatgcccttccactgatctggagaggcttgatagacctcacggggtattacgaggcagtgcacccctgtaacgtcttctgcgtgctgagcggacctggtgcttcatgtgaagccttcagtgagggcgggatttttaatatcacttccccaatgtgcttagtaagcaagcaaaacaggttccgggctgccgaacagcagatctcttttatttgtcaacgcgttgatatggacatcattgtgtattgcaatggacagaaaaagacaatactgaccaagactctcgtcatcggccagtgtatttacacaatcacctcacttttcagtctgttgcccggtgtggcacatagcatcgccattgagctatgcgtcccggggtttcacggctgggctacggcggcactgctcataaccttctgttttggatgggtgctgatccctgcctgcacacttgctgttctgttgttcctcaaatttttcgccaacattctgcacacttccaatcaggagaaccgatttaaggcaatcttaagaaaaattaaggaagagttcgaaaagaccaagggctctatggtgtgtgagatctgcaagtacgaatgcgagacactgaaagagctaaaggcccataatctctcgtgtgtacaaggggaatgcccctattgttttactcactgcgagccaaccgaaacagctatacaggcccattacaaagtctgtcaggcaacccacaggttccgggaggatctgaagaaaactgtgacgcctcagaacatcggacccggttgctatcgtacacttaatttgttccgctacaagagcagatgttatattctgaccatgtggatcctcctgcttgttattgagtccatcctgtgggcggcttcagccgcagaaataccattggtgcccctctggactgacaacgcccatggcgtcgggagtgtgcctatgcacaccgacctggagttagatttttctctgccaagctcctcaaagtacacatataaaaggcacctaaccaatccggtaaacgaccaacagagcgtgtctctccatattgaaatcgagtcccagggaattggcgctgatgttcaccatctgggtcactggtacgacgcccggcttaatttgaagaccagtttccactgctacggggcatgtacaaaatatcagtacccctggcatacggctaagtgctattttgaaaaagattacgagtatgagaacagctgggcctgtaaccctccagactgccccggcgtcggaatcggctgcaccgcgtgtgggctgtacctcgatcaactgaagcctgtgggaactgccttcaagataatctctgtgcgatattcccgcaaagtctgcgttcagtttggtgaagagtacttatgtaagacaattgacatgaatgattgcttcgtgaccagacacgctaaaatctgtattatcggcacagtgtcaaagtttagtcagggggacactctgcttttcttgggaccaatggaaggcggtgggataatttttaaacattggtgcaccagcacgtgtcacttcggcgatcccggagacgtaatgggcccgaaggacaaaccttttatctgcccagagttccccgggcagtttaggaagaagtgtaacttcgcaaccacacctgtctgcgaatacgatggaaatgtgttctcgggctatcggaaatttctcgccactatcgactccttccaatcttttaacaccagcaatgttcatttcacagatgagcgcattgagtggagagaccccgatggtatgctgagggaccacatcaacattgtgatatcaaaggatatcgactttgaaaatctagctgataacccatgtaaagtcgggctgcaggccgcaaatattgagggagcgtggggcagtggtgtgggcttcactctcacttgccaggtttccctgacggaatgccctacatttcttacctctatcaaggcctgtgacatggctatttgctacggggccgagagcgtgactttgtcccgtggacaaaacacagtaaaaatcaccggcaaagggggacactcaggcagcagtttcaagtgttgccatggtaaagaatgttcttccaatgggctgcaggcaagcgctccccacttagataaggtcaacggaatatcggagctcgagaatgaaaaagtgtatgacgatggcgccccagagtgcggtatcacttgttggtttaagaaatcaggcgaatgggtgatggggattatcaacggaaattggattgtcctgatcgttctttgcgtgctgcttctcttctctctgatactactgagtattctctgtccggtacggaagcataagaaatcctga

SEQ ID NO: 10229 - RNA, 3402 nt, synthetic construct
  misc_feature 1..3402: note = derived and/or modified CDS sequence (opt3) from SEOV(YongjiaRn14)__GU592927.1__GP
  source 1..3402: mol_type = other RNA
atgtggggcctgctccttctggccgctatggtggggcagggaagcgcattgaagaacgtcttcgacatgaaaatccaatgcccccactccgttaattttggtgagacctctgtgtcaggctacacagaattacctccactgccgctacaggaggccgaacagctcgtacccgagagtagctgtaacatggataatcatcagtccctgtctactattaacaagttgacgaaagtgatatggagaaagaaagcgaatcaagaatcggcttcacagaacagcttcgaggtcgtggagagtgaagtttcctttaaggggctgtgcatgttgaagcacaggatggtggaggaatcttatcggaatcgccgaagcgtcatctgttacgacctcgcctgcaacaccacattctgtaaacctactgtgtatatgattgtaccaatccatgcatgcaatatgatgaagtcctgtctgattggactgggcccctaccgtatccaggttatatatgagagaacctactgcacaaccggtatcctcactgaggggaaatgttttgtgcctgataaggccgtcgtgtcagctttaaaaaggggaatgtatgcaattgccagtatcgaaacagtgtgcttctttgtccaccagaagggcaacacctacaagattgttacggctatcactagcgccatgggctctaaatgtaataacaccgactccaaggtgcaagggtactatatatgcattatcggaggtaattcagcgccagtatacgcacccgccggcgaggatttccgggctatggaagtgtttagcgggattatcacaagtcctcatggagaggaccacgatctgccaggcgaagaggtcgccacttatcagatctctggtcagattgaggcaaaaataccgcacaccgtgtccagcaagaaccttaaattgacagctttcgccgggatcccctcgtactcttccacctcactgctagcggccagtgaagacggacgctttattttcagccctggcctctttccaaatctgaaccagtccgtttgcgataacaatgcacttcccctgatctggagaggcttgatagacctcacggggtattacgaggctgtgcatccttgtaacgtcttctgcgtgctgtctggaccaggtgccagctgtgaggctttctcagaaggcgggatttttaatatcacttcacccatgtgcttagtatccaagcaaaacaggttccgggccgcagaacagcagatcagctttatttgtcaacgcgttgatatggacatcattgtgtattgcaatggacagaaaaagacaatactgaccaagactctcgtcatcggccagtgtatttacacaatcacctctcttttctcactgttgccgggtgtggcccacagtatcgctattgagctatgcgtccctgggtttcatggctgggcgacggcagccctgctcataaccttctgttttggatgggtgctgatccccgcttgcacacttgccgttctgttgttcctcaaatttttcgcaaacattctgcacactagcaatcaggagaaccgatttaaggccatcttaagaaaaattaaggaagagttcgaaaagaccaagggctccatggtgtgtgagatctgcaagtacgaatgcgagacactgaaagagctaaaggctcacaatctctcttgtgtacaaggggaatgcccatattgttttactcattgcgagcctaccgaaacagccatacaggcacactacaaagtctgtcaggcgacccataggttccgggaggatctgaagaaaactgtgacgccccagaacatcggaccaggttgctatcgtacacttaatttgttccgctacaagtcgagatgttatattctgaccatgtggatcctcctgcttgttattgagagcatcctgtgggctgcctccgcagccgaaatacccttggtgcctctctggactgacaacgctcacggcgtcgggtcagtgccaatgcataccgacctggagttagattttagtctgccgtctagctccaagtacacatataaaaggcacctaaccaatcccgtaaacgaccaacagtcagtgagcctccacattgaaatcgagtctcagggaattggcgccgatgttcatcacctgggtcattggtacgacgcacggcttaatttgaagacttccttccactgctacggggcttgtacaaaatatcagtacccttggcacacggccaagtgccattttgaaaaagattatgagtacgagaacagttgggcgtgtaacccacccgactgccctggcgtcggaaccggctgcactgcctgtgggctgtatctcgatcaactgaagccagtgggaacagctttcaagatcataagcgtgcgatactctcgcaaagtctgcgttcagtttggtgaagagtatttatgtaagaccatcgacatgaatgattgcttcgtgacaagacacgcaaaaatttgtatcattggcactgtgtccaagttttcacagggggacaccctgcttttcttgggacccatggaaggcggtgggatcatatttaaacattggtgcacgagtacctgtcacttcggcgatccgggagacgtaatgggccctaaggacaaaccatttatttgccccgagttccctgggcagtttaggaagaagtgtaacttcgccacaactcccgtctgcgaatacgatggaaatgtgatcagcggctaccggaaagttctcgctaccatcgactcgttccaatcctttaacacatctaatgtgcatttcactgatgagcgcattgagtggagagacccagatggtatgctgagggaccacatcaacattgtcataagcaaggatatcgactttgaaaatctagccgagaacccttgtaaagtggggctgcaggcagcgaatattgaaggagcctggggctcaggtgttggcttcaccctcacgtgccaggtgagtctgacagagtgccccacctttcttacttccatcaaggcttgtgatatggccatttgctatggggcagaatctgtaacattgagccgtggacaaaacaccgtcaaaatcactggcaaagggggacactccggcagtagcttcaagtgttgccatggtaaagagtgtagttctaatgggctgcaggcttccgccccacacttagacaaggtgaacggaataagcgagctcgaaaatgagaaagtgtacgatgacggcgcaccggaatgcggtatcacctgttggtttaagaaatcgggcgagtgggtcatggggattatcaacggaaattggattgttctgatcgtgctttgcgtactgcttctcttctcactgatactactgtctattctctgtcctgtgcggaagcataagaaaagttga

SEQ ID NO: 10230 - RNA, 3402 nt, synthetic construct
  misc_feature 1..3402: note = derived and/or modified CDS sequence (opt3) from SEOV(ZT10)__DQ159911.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcgtggagagtgaagtttccttcaaaggcttgtgcatgctcaagcaccggatggtggaggaatcttatcgcaaccgacgtagcgtcatctgttacgacctggcctgcaattccaccttttgtaagcccacagtgtatatgattgtacctatccatgcatgcaacatgatgaaatcatgtctgattgggctcggaccatacagaatccaggttgtgtatgagaggacttactgcaccacaggcatattaaccgagggtaagtgtttcgtccccgataaagccgtggtgagtgctctgaagcgggggatgtatgcaatcgccagcattgaaactatctgctttttcattcaccagaaaggaaataagtacaagatcgtcacagctataacctctgccatgggctccaaatgtaacaatacggacactaaggttcaaggctactatatttgcatcattgggggaaactcagcgcctgtgtacgcaccagccggtgaggattttcgcgctatggaagtattcagcggcatcatcaccagtccccatggggaggaccacgatcttcctggagaagagattgccacatatcagatatctggccagatcgaggcaaaaattccacacactgtgtccagcaagaatttgaaactgaccgcttttgccggtatcccgtcgtactcttccacatcaatactagcggccagtgaagacgggagattcatttttagccccggactcttccctaacctgaaccagtccgtctgcgataataacgcacttccactgatctggaggggcttgatcgacctcaccggctattacgaggctgtgcatccctgtaatgttttctgcgtgctgtctgggcctggagccagctgtgaagccttttcagagggtggcattttcaacatcacgagtccaatgtgcttagtctccaagcaaattcggtttcgcgccgcagaacagcagatcagcttcatatgtcaacgagtggatatggacattatcgtatattgcaatgggcagaaaaagactatcctgacaaagaccctcgttattggacagtgtatatacactatcacatctctttttagtctgttgcccggcgtggcccacagtattgctatcgagctatgcgtcccgggtttccatgggtgggcgaccgcagccctgctcattacgttttgtttcggctgggtgctgatccctgcttgcacccttgccatactgttggtcctcaaatttttcgcaaacatcctgcacacaagcaatcaggagaacagatttaaggccattttaaggaaaatcaaggaagagttcgagaaaactaagggatccatggtgtgtgaaatttgcaagtacgaatgcgagaccctgaaagagctaaaggctcacaatctctcttgtgttcaaggcgaatgcccctattgttttacacattgcgagccaactgaaaccgccatccaggcacactacaaagtgtgtcaggcgacacatcggttccgtgaggatctgaagaaaaccgtaactcctcagaacatagggcccggatgctatcgcacgcttaatttgttcagatacaagtcgaggtgttatattctgacaatgtggaccctcctgcttatcattgagagcatcctgtgggctgcctccgcagccgaaataccattggtccccctctggactgacaacgctcacggtgtgggctcagttcctatgcataccgacctggagttagattttagtctgccatctagctccaagtacacatataaacggcacctaaccaatccggtgaacgaccaacagtcagtcagcctccacatcgaaattgagtctcaggggatcggagccgatgtgcatcacctgggccattgctacgacgcacgacttaatttgaagacttccttccactgttacggtgcttgcacaaaatatcagtacccctggcacacggccaagtgtcattttgaaaaagattatgagtacgagaacagttgggcgtgcaaccctccagactgccccggggtaggcaccggatgtactgcctgcggcctgtatctcgatcaactgaagcctgtggggacagctttcaagattatcagcgttcgctactctagaaaagtctgtgtgcagtttggagaagagtatttatgcaagaccatagacatgaatgattgtttcgtgacaaggcacgcaaaaatttgcatcatcggtactgtctccaagttttcacagggcgacaccctgcttttcttggggccaatggaaggaggcggtattatctttaaacattggtgtacgagtacctgccacttcggggatcccggcgacgttatgggaccgaaggacaaaccttttatttgtccagagttccccggccagtttcggaagaagtgcaacttcgccacaactcctgtgtgtgaatacgatgggaatataatcagcggatacaaaaaggtgctcgctaccattgactcgttccaatcctttaacacatctaatatccatttcactgatgagcgcattgagtggagagaccccgatggcatgctgagggaccacatcaacatagtaatcagcaaagatattgactttgaaaatctagccgagaacccatgcaaggtcggtctgcaggcagcgaatatcgaaggggcctggggactcggcgtgggtttcaccctgacgtgccaggtttcacttacagagtgtcctacctttttgacttcaattaaggcttgcgatatggccatctgttatggcgcagaatccgtgacactgtctcgtgggcaaaacaccgtcaaaataactggaaagggcgggcacagcggatcctcattcaaatgctgtcatggcaaggagtgcagcagtaccggtttacaggcttctgctccccacctcgacaaagtgaatgggatttccgagctggaaaacgagaaggtttacgatgacggagcaccagaatgtggcatcacatgctggtttaaaaagagcggtgagtgggtgatgggcatcattaatgggaactgggtagtccttatagtgctgtgtgtgttgctcctgttctcgctaatcctgctctcaattctgtgcccggtccggaagcataaaaagtcttga

SEQ ID NO: 10231 - RNA, 3402 nt, synthetic construct
  misc_feature 1..3402: note = derived and/or modified CDS sequence (opt3) from SEOV(ZT71)__EF117248.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcgtggagagtgaagtttccttcaaaggcttgtgcatgctcaagcaccggatggtggaggaatcttatcgcaaccgacgtagcgtcatctgttacgacctggcctgcaattccaccttttgtaagcccacagtgtatatgattgtacctatccatgcatgcaacatgatgaaatcatgtctgattgggctcggaccatacagaatccaggttgtgtatgagaggacttactgcaccacaggcatattagccgagggtaagtgtttcgtccccgataaagctgtggtgagtgcactgaagcgggggatgtatgccatcgctagcattgaaaccatctgctttttcattcaccagaaaggaaataagtacaagatcgtcactgccataacatctgcgatgggctccaaatgtaacaataccgacacgaaggttcaaggctactatatttgcatcattgggggaaactcagcacctgtgtacgccccagctggtgaggattttcgcgccatggaagtattcagcggcatcatcacttcaccccatggggaggaccacgatcttcctggagaagagattgcaacctatcagatatctggccagatcgaggctaaaattccacacacagtgtccagcaagaatttgaaactgactgcctttgcgggtatcccgtcgtactcttccacctcaatactagccgcaagtgaagacgggagattcatttttagccccggactcttccctaacctgaaccagtccgtctgcgataataacgcccttccactgatctggaggggcttgatcgacctcacaggctattacgaggctgtgcatccctgtaatgttttctgcgtgctgtctgggcctggagctagctgtgaagccttttcagagggtggcattttcaacatcaccagtccaatgtgcttagtctccaagcaaaatcggtttcgcgcagccgaacagcagattagcttcatatgtcaacgagtggatatggacatcattgtatattgcaacgggcagaaaaagacgatcctgactaagacactcgttatcggacagtgtatttacaccataacttctttgttttcactgttgcccggcgtggctcacagtatcgcgattgagctatgcgtcccgggtttccatgggtgggcaacagccgctctgctcatcaccttttgtttcggctgggtgctgattcctgcctgcacgcttgcaatcctgttggtcctcaaatttttcgccaatatactgcacaccagcaaccaggagaatagatttaaggctatcttaaggaaaattaaggaagagttcgaaaagacaaagggatccatggtgtgtgagatctgcaagtacgaatgcgagactctgaaagagctaaaggcccacaacctctcttgtgttcaaggcgaatgcccctattgttttacccattgcgagccaacagaaactgcaattcaggcgcactacaaagtgtgtcaggctacccatcggttccgtgaggatctgaagaaaacagtaacccctcagaatatcgggcccggatgctatcgcactcttaacttgttcagatacaagtcgaggtgttatatactgacgatgtggacactcctgcttattatcgagagcattctgtgggccgcatccgccgctgaaatcccattggtccccctctggaccgacaatgcccacggtgtgggctcagttcctatgcatactgacctggagttagattttagtctgccatctagctccaagtacacctataaacggcacctaacaaacccggtgaatgaccaacagtcagtcagcctccacatagaaatcgagtctcaggggattggagcagatgtgcatcacctgggccattggtacgacgctggtcttaacttgaagacctccttccactgctacggggcctgtactaaatatcagtacccctggcacacagcgaagtgccattttgaaaaagattatgagtacgagaacagttgggcctgtaatcctccagactgccccggcgtaggaacgggctgcaccgcttgtgggctgtatctcgatcaactgaagcctgtgggaactgcattcaagatcattagcgttcgatactctcgcaaagtctgcgtgcagtttggtgaagagtatttatgtaagacaatcgacatgaacgattgcttcgtgaccagacacgccaaaatatgtattatcggcacagtctccaagttttcacagggggacactctgcttttcttgggaccaatggaaggcggtgggatcatttttaaacattggtgcaccagtacgtgtcacttcggcgatcccggagacgttatgggcccgaaggacaaaccttttatctgcccagagttccccgggcagtttaggaagaagtgtaatttcgctaccacacctgtgtgcgaatacgatggaaacattataagcggctacaaaaaggtgctcgccactatcgactcgttccaatcctttaatacctctaacattcatttcacagatgagcggatcgagtggcgcgaccccgatggtatgctgagagaccacattaatatcgtaataagcaaagatatcgactttgaaactctagcagagaacccatgtaaggtcgggctgcaggcggccaatattgaaggagcttggggctcaggtgtgggcttcaccctcacgtgccaggttagtctgacagagtgccctacctttcttacttccatcaaagcctgtgatatggcaatttgctatggggctgaatctgtgacattgagcaggggacaaaacaccgtcaagatcactggcaaagggggacactccggcagtagcttcaaatgttgccatggtaaggagtgtagttctaccgggctgcaggcctccgcaccccacttagacaaagtgaatggaataagcgagctcgaaaacgagaaggtttacgatgacggcgccccagaatgcggtattacatgttggtttaaaaagtcgggcgagtgggtgatggggatcatcaatggaaactgggtagtcctgattgtgctttgcgtgctgcttctcttctcactgatactactgtctatcctctgtccggtccgtaagcataaaaagagttga

SEQ ID NO: 10232 - RNA, 3402 nt, synthetic construct
  misc_feature 1..3402: note = derived and/or modified CDS sequence (opt3) from SEOV(DN2)__KX289953.1__GP
  source 1..3402: mol_type = other RNA
atgtggagcctgctccttctggccgctttggcaggccaggggttcgccttaaagaacgtgtttgacatgagaatccaatgcccccactccgtcaatttcggagagacctctgtttcaggttacacagaactgcctccactaagtctccaggaggcggaacagctggtgccggagagctcctgtaacatggataatcatcagtctctttcgactattaacaaactgacgaaggtaatatggaggaaaaaggctaatcaagaatcagccagccagaacagttttgaggtggtcgagtccgaagtgtctttcaaaggcttgtgcatgctcaagcaccggatggttgaggaaagctatcgcaatcgacgttccgtgatctgttacgacctggcatgcaactcaaccttttgtaagcccacagtctatatgattgtgcctatccatgcctgcaatatgatgaaaagttgtctgattgggctcggaccatacagaatccaggtagtttatgagaggacttactgcaccacaggcatattaaccgagggtaagtgtttcgtgcccgataaagctgtcgtgagcgcactgaagcgggggatgtatgccatcgcttctattgaaactatctgctttttcattcaccagaaaggaaacacatacaagatcgtgaccgccataacgtccgcgatgggctcaaagtgtaataacactgacaccaaagtccaaggctactatatttgcatcattgggggaaatagcgcacctgtttacgccccagctggtgaggattttcgcgccatggaagtgttcagtggcatcatcacatctccccatggggaggaccacgatcttcctggagaagagattgcaacttatcagatatccggccagatcgaggctaagattccacacaccgtaagctcgaaaaacttgaagctgacagcctttgcgggtatcccgtcttactcctcaaccagtatactagccgcaagcgaagacgggagattcatttttagccccggactcttccctaatctgaaccagtctgtgtgcgataacaatgcccttccactgatctggaggggcttgatcgacctcacgggctattacgaggctgtccatccctgtaacgtgttctgcgttctgagcgggcctggagcttcatgtgaagcctttagtgagggtggcattttcaatatcacttccccaatgtgcttagtgagcaaacaaaaccggtttcgcgcagccgaacagcagatttctttcgtctgtcaacgaatagatatggacatcattgtgtattgcaatgggcagaagaaaacaatcctgaccaagactctcgtaatcggacagtgtatttacacaataacctcactttttagtctgttgcccggcgttgctcacagcatcgcgattgagctatgcgtgccgggtttccatgggtgggcaacggccgctctgctcatcaccttttgtttcggctgggtcctgattcctgcctgcacacttgcaatcctgttggtgctcaagtttttcgccaacatactgcacacttccaatcaggagaacagatttaaagctatcttaaggaagattaaagaagagttcgaaaagaccaaaggatctatggtctgtgagatctgcaagtacgaatgcgagacactgaaggagctaaaagcccacaatctctcgtgtgtgcaaggcgaatgcccctattgttttactcattgcgagccaaccgaaacagcaattcaggcgcactacaaggtttgtcaggctacccatcggttccgtgaggatctgaaaaagactgtgacgcctcagaacatcgggcccggatgctatcgcacacttaatttgttcagatacaaatccaggtgttatatactgaccatgtggactctcctgcttattatcgagtccattctgtgggccgcatcagccgctgaaatcccattgatacccctctggaccgacaacgcccacggtgtaggcagtgtccctatgcatacagacctggagttagatttttctctgccaagctcctcaaagtacacctataagcggcacctaactaatccggtgaacgaccaacagagcgtttctctccacatcgaaattgagtcccaggggatcggagcagatgtgcatcacctgggccattggtacgacgctcgacttaatttgaaaacaagtttccactgctacggtgcctgtacgaagtatcagtacccctggcacaccgcgaaatgccattttgaaaaggattatgagtacgagaacagctgggcctgtaaccctccagactgccccggggtcggcactggatgcacagcttgtggcctgtatctcgatcaactgcgccctgtggggaccgcattcaaaattatctctgtaagatactccaggaaggtgtgcgttcagtttggagaagagtatttatgtaagacaatagacatgaatgattgcttcgtcactcggcacgccaaaatttgtatcatcggtaccgtgtcaaagtttagtcagggcgacacgctgcttttcttggggccaatggaaggaggcggtattatctttaaacattggtgcaccagcacatgtcacttcggggatcccggcgacgtgatgggaccgaaggacaaaccttttatttgcccagagttccccggccagtttcgcaagaaatgtaacttcgctactacccctgtctgcgaatacgatgggaatacaatatcgggatacaagaaggttctcgccactatcgactccttccaatcttttaacaccagcaatattcatttcacggatgagagaatcgagtggagggaccccgatggcatgctgcgtgaccacattaacatcgtgatatcaaaagatatcgactttgaaaatctagcagagaacccatgtaaggtgggtctgcaggcggccaatattgaaggggcttggggaagtggcgtaggtttcacattgacctgccaggtctccctgactgagtgccctacatttcttacctctatcaaagcctgtgatatggcaatttgctatggcgctgaaagcgtgactttgtcccgggggcaaaacaccgttaagatcacaggaaaaggcgggcactcaggaagcagtttcaagtgttgccatggcaaggagtgttcttccacgggtctgcaggccagcgcaccccacttagacaaagtgaatgggatatcggagctcgaaaacgagaaggtctacgatgacggagccccagaatgcggcattacctgttggtttaaaaagtcaggtgagtgggtgatgggcatcatcaatgggaactgggttgtgctgattgtactttgcgtcctgctcctcttctctctgatactactgagtatcctctgtccggtgcgaaaacataagaagtcctga

SEQ ID NO: 10233 - RNA, 3402 nt, synthetic construct
  misc_feature 1..3402: note = derived and/or modified CDS sequence (opt3) from SEOV(IR162)__KX079475.1__GP
  source 1..3402: mol_type = other RNA
atgtggagcctgctccttctggccgctttggtgggcagagggttcaccttaaagaacgtctttgacatgaggatccaatgcccccactccgttaatttcggagagacatctgtgtcaggttacactgaactgcctccactaagtctccaagaggcagaacagctggtaccggagagctcctgtaacatggataatcatcagtctctttcgacgattaacaaactgaccaaggtgatatggcggaaaaaggccaatcaggaatcagcgaaccaaaatagctttgaggtcgtggagagtgaagtttccttcaaaggcttgtgcatgctcaagcaccgcatggtggaggaatcttatcgaaaccgtagaagcgtcatctgttacgacctggcttgcaattccacattttgtaagcccactgtgtatatgattgtacctatccatgcctgcaacatgatgaaatcatgtctgattgggctcggaccatacaggatccaggttgtgtatgagcggacctactgcacaaccggcatattaactgagggtaagtgtttcgtccccgataaagcagtggtgagtgccctgaagcgcgggatgtatgctatcgcaagcattgaaacaatctgctttttcattcaccagaaaggaaatacctacaagatcgtcacggccataacttctgctatgggctccaagtgtaacaataccgacacaaaagttcagggctactatatttgcatcattgggggaaactcagcccctgtgtacgcgccagccggtgaggattttagagccatggaagtattcagcggcatcatcacttcaccccatggggaggaccacgatcttcctggagaagagattgctacctatcaaatatctggccagatcgaggccaagattccacacacagtgtccagcaaaaatttgaagctgaccgcatttgctggtatcccgtcgtactcttccacgtcagtcctaatagccagtgaagacgggaggttcatttttagccccggactcttccctaacctgaaccagtccgtgtgcgataataacgcgcttccactgatctggcggggcttgatcgacctcactggctattacgaggccgttcatccctgtaatgtgttctgcgtcctgtctgggcctggagcaagctgtgaggctttttcagaaggtggcattttcaacatcacaagtccaatgtgcttagtgtccaaacagaatcgctttcgagccgctgaacaacagattagcttcgtatgtcagagagttgatatggacataatcgtgtattgcaacgggcaaaagaaaaccattctgactaagacactcgtcatcggacagtgtatctacaccattacgtctttgttttcactgttgcccggcgtggcccacagtatagcaatcgagctatgcgtcccgggtttccatgggtgggccaccgctgcgctgctcattacattttgtttcggctgggtgctgatccctgcatgcactcttgccattctgttggttctcaagtttttcgctaatatcctgcacaccagcaaccaggagaataggtttaaagccatattacggaagatcaaagaagagttcgaaaagacaaaaggatccatggtgtgtgagatttgcaagtacgaatgcgagactctgaaggagctaaaagcacacaacctctcttgtgtacagggcgaatgcccctattgttttacccattgcgagccaacagaaaccgccatccaagctcactacaaggtctgtcaggccactcatcgtttccgcgaggatctgaaaaagacggtgacacctcagaatattgggcccggatgctatagaacccttaacttgttcaggtacaaatcgcggtgttatatcctgactatgtggaccctcctgcttataattgagagcatcctgtgggcagcgtccgctacagaaattccattggttcccctctggaccgacaatgcccacggtgtgggctcagtccctatgcatactgacctggagttagattttagtctgccatctagctccaagtacacatataagcgacacctaacgaacccggtgaatgaccagcaatcagtaagcctccacatcgaaatagagtctcaggggatcggagcagatgtgcatcacctgggccattggtacgacgcccgccttaacttgaaaacctccttccactgctacggtgcttgtactaagtatcagtacccctggcacacagccaaatgccattttgaaaaggattatgagtacgagaacagttgggcatgtaatcctccagactgccccgggattggcaccggatgcacagcttgtggcctgtatctcgatcagctgaaacctgttgggactgccttcaagatcattagcgtcagatactctaggaaggtgtgcgtgcaatttggagaagagtatttatgtaaaaccatcgacatgaacgattgcttcgtcacgcggcacgcgaagatatgtattatcggtaccgtttccaaattttcacagggcgacacactgcttttcttggggccaatggaaggaggcggtatcatttttaagcattggtgcaccagtacttgtcacttcggggatcccggcgacgtgatgggaccgaaagacaagccttttatctgcccagagttccccggccagtttcgcaaaaagtgtaatttcgccacaactcctgtgtgcgaatacgatgggaacattataagcggatacaagaaagtactcgctaccatcgactcgttccagtcctttaatacgtctaacattcatttcacagatgagagaatcgagtggagggaccccgatggcatgctgcgtgaccacattaatatcgtcataagcaaggatatcgactttgaaaacctagcagagaatccatgtaaagtgggtctgcaagccgctaacattgaaggggcctggggatcaggcgttggtttcaccctcacttgccaggtgagtctgacagagtgccctacctttcttacttccatcaaggcatgtgatatggcgatttgctatggcgccgaatctgtcaccttgagccgggggcagaatacagtgaaaatcacgggaaagggcgggcactccggaagtagcttcaagtgttgccatggcaaagagtgtagttctaccggtctgcaggcttccgcaccccacttagacaaggttaacgggataagcgatctcgagaatgaaaaagtgtacgacgatggagcaccagagtgcggcattacttgttggtttaagaaatcgggtgaatgggtaatgggcatcatcaacgggaattgggtcgtgctgattgtgctttgcgtcctgcttctcttctcactgatactactgtctatcctctgtccggttcgaaagcataagaaaagttga

SEQ ID NO: 10234 - RNA, 3402 nt, synthetic construct
  misc_feature 1..3402: note = derived and/or modified CDS sequence (opt3) from SEOV(Gou3)__AF145977.2__GP
  source 1..3402: mol_type = other RNA
atgtggggcctgctccttctggccgctttggtggggcagggattagcactgaagaacgtcttcgacatgaaaatccaatgcccccacagcgttaattttggtgagacctccgtgtctggctacacagaactacctccactcccgctgcaggaggccgaacagcttgtacccgagtcaagttgtaacatggataatcatcagagcctgtccactattaacaagttgacgaaagtgatatggagaaagaaagcgaatcaagaatctgcttcgcagaactcattcgaggtcgtggagaatgaagttagctttaaggggctctgcatgctgaagcacaggatggtggaggaaagttatcggaaccgccgatccgtcatctgttacgacctggcctgcaataccacattctgtaaacctactgtgtatatgattgtaccaatccatgcatgcaacatgatgaagtcttgtctcattggattaggcccctaccgtatccaggttatatatgagagaacctactgcacaaccggtatcctgactgaggggaaatgttttgtgcctgataaggccgtcgtgagcgctcttaaaaggggaatgtatgcaattgcctccatcgaaacaatttgcttctttgtgcacaagaagggcaatacctacaaaatcgtctcagctataacgttggccatgggcagtaagtgtaacaatactgacagcaaagttcaggggtactatatttgcatcattggaggtaactctgcgccagtgtacgcacccgccggcgaggatttccgggctatggaagtattttccgggatcatcacctcacctcatggagaggaccacgatctgccaggcgaagagattgccacatatcaaataagcggtcagatcgaggcaaagattccgcacactgtgagttctaaaaatctaaagctcaccgctttcgccgggatcccctcctacagctcgacatctatactggcggcctccgaagacggacgctttattttctcacctggcctttttccaaacctgaaccagagtgtctgcgataataacgcattgcccctcatctggagaggcctgatcgacttaaccgggtattacgaggctattcatccttgtaatgtgttctgcgttctgagcggaccaggtgcctcctgtgaggctttctctgaaggcgggatctttaacattacgagccccatgtgcctcgtgtcaaaacagaataggttccgggccgcagaacaacagataagttttatctgtcagcgcgtcgatatggacattgtggtatattgcaacggacaaaagaagactatccttacaaaaaccctggttatcggccagtgtatttacactataacatccttgttcagcctactgccgggtgtggcccactctatcgctattgagctctgcgtccctgggtttcatggctgggcgaccgcagccctgcttgtgacgttctgttttggatgggtcctgatccccgcttgcaccttggccgtgctcctgttcttaaagtttttcgcaaatattctgcacacatcaaaccaggagaatcgatttaaagccatcctaagaaagataaaagaagagttcgaaaagactaagggcagtatggtttgtgagatctgcaaatacgaatgcgagaccctcaaggagctgaaagctcacaaccttagctgtgtgcagggggaatgcccatattgttttacacattgcgagcctactgaaaccgccattcaagcacactacaaggtatgtcaggcgacacataggttccgggaggatttgaaaaagaccgtcactccccagaatatcggaccaggttgctatcgtacgctgaacctcttccgctacaagtccagatgttatattctgacaatgtggatccttctgttggtgatagagtctattctctgggctgcctcggcagccgaaatccccctggttcctttatggaccgacaatgctcacggcgtggggagcgtcccaatgcatactgacctggagctagatttttccctcccgtcaagttctaaatacacctataagaggcacctgacaaaccccgtgaatgaccagcaaagcgtatcccttcacattgaaatcgagtcacagggaataggcgccgatgtgcatcacttgggtcattggtacgacgcacggctgaacctcaaaaccagcttccactgctacggggcttgtactaagtatcagtacccttggcacacagccaaatgccattttgaaaaggattatgagtacgagaactcttgggcgtgtaatccacccgactgccctggcgttggagccggctgcacggcttgtgggctgtatttagatcagctgaagccagtcggaaccgcattcaaaatcatttccgtgcgatacagtcgcaaggtgtgcgtccaatttggtgaagagtatctttgtaaaactatcgacatgaacgattgcttcgttacaagacacgccaagatttgtatcataggcaccgtgagcaaattttctcagggggacacactcttgttcctgggacccatggaaggcggtgggattatctttaagcattggtgcacttccacctgtcacttcggcgatccgggagacgtgatgggccctaaagacaagccatttatctgccccgagttccctgggcagtttaggaagaaatgtaatttcgctacgacccccgtatgcgaatacgatggaaacgtcatttcaggctaccggaaggtgctagccacaatcgacagtttccagagctttaatacttcgaacgttcatttcaccgatgagcgcattgagtggaaagacccagatggtatgctgagagaccacataaatatcgtgatttccaaggatatcgactttgaaaacctcgcagagaatccttgtaaagtcgggctgcaagcggccaacattgaaggagcttggggctctggtgtgggcttcacacttacttgccaggttagcttgaccgagtgccccacgtttctgacatcaatcgaagcctgtgatatggcaatatgctatggggctgagagtgtgaccttatccaggggacagaatactatcaagattacaggcaaagggggacactctggcagctccttcaagtgttgccatggtaaggagtgttcagccaacgggctccaagcaagcgccccacacctggacaaagtaaatggaatcagtgaacttgagaacgaaaaggtctacgatgacggcgctccggagtgcggtattacctgttggtttaaaaagtctggcgagtgggtgatggggatcataaatggaaactgggtggtcctgattgttttgtgcgtgctcctgctattctccctgatcctcctgagcatcctttgtcctgtacgtaagcataaaaagtcgtga

SEQ ID NO: 10235 - RNA, 3402 nt, synthetic construct
  misc_feature 1..3402: note = derived and/or modified CDS sequence (opt3) from SEOV(HB55)__AF035832.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtggtctggaggaaaaaggcgaatcaagaatcagctaaccagaatagctttgaggtggttgagagtgaagtgtccttcaaaggcttgtgcatgctcaagcaccggatggtcgaggaatcttatcgcaaccgacgtagcgtgatatgttacgacctggcctgcaattccaccttttgtaagcccacagtatatatgatcgttcctattcatgcatgcaacatgatgaaatcatgtctgatcgggctcggaccatacaggattcaggtggtctatgagagaacttactgcaccacaggcatcttaaccgagggtaagtgtttcgtgcccgataaagccgtggtcggggctctgaagcggggaatgtatgcaatagccagtatcgaaactatttgctttttcatccaccagaaaggcaataagtacaagattgttacagctatcaccagcgccatgggctctaaatgtaacaatacggacactaaggtgcaagggtactatatatgcattatcggaggtaactccgcgcctgtatacgcaccagccggcgaggattttcgcgctatggaagtgttctcagggattatcaccagcccccatggagaggaccacgatcttcctggcgaagagatcgccacatatcagattagtggtcagatagaggcaaaaatcccacacactgtctcttccaagaatttgaaactgattgcttttgccgggatcccgagctactcgtctacctccatactagcggcctcagaagacggaagattcatttttagtcccggcctcttccctaacctgaaccagagcgtgtgcgataataacgcacttccactgatctggaggggcttgatcgacctcacagggtattacgaggctgttcatccctgtaatgtgttctgcgtcctgtccggacctggtgcctcttgtgaggcttttagcgaaggcgggattttcaacatcacctcaccaatgtgcttagtgagtaagcaaaatcggtttcgcgccgcagaacagcagatttccttcatatgtcaacgagtagatatggacatcattgtttattgcaacggacagaaaaagacgatcctgactaagacactcgtgatcggccagtgtatttacaccataactagcctcttttctctgttgcccggtgtcgcccactcaatcgctattgagctatgcgtgccggggttccatggctgggcgacagcagccctgctcatcaccttttgtttcggatgggtcctgattcctgcttgcacgcttgccatcctgttggtgctcaaatttttcgcaaatatactgcacaccagtaaccaggagaatagatttaaggccatcttaaggaaaattaaggaagagttcgagaaaacaaagggcagcatggtttgtgaaatctgcaagtacgaatgcgagactctgaaagagctaaaggctcacaacctctcctgtgtgcaaggggaatgcccctattgttttacccattgcgagccaacagaaactgccattcaggcacactacaaagtatgtcaggcgacccatcggttccgtgaggatctgaagaaaacagtcacccctcagaatatcggacccggttgctatcgcactcttaacttgttcagatacaagtctaggtgttatatactgacgatgtggacactcctgcttattatcgagtcgattctgtgggctgccagcgcagccgaaatcccattggtgcccctctggaccgacaatgctcacggcgttgggtccgtgcctatgcatactgacctggagttagatttttcactgccaagttctagcaagtacacctataaacggcacctaacaaacccggtcaatgaccaacagtccgtgtcactccacatagaaatcgagagccagggaattggcgccgatgtacatcacctgggtcattggtacgacgcacgacttaacttgaagacctctttccactgctacggggcttgtactaaatatcagtacccctggcacacagccaagtgccattttgaaaaagattatgagtacgagaactcctgggcgtgtaatcctccagactgccccggcgtgggaacgggctgcaccgcctgtgggctgtatctcgatcaactgaagcctgttggaactgctttcaagatcattagtgtccgctacagcagaaaagcatgcgtgcagtttggtgaagagtatttatgtaagacaatcgacatgaacgattgcttcgtgaccggccacgccaaaatatgtattatcgggacagtctctaagttttcccagggagacactctgcttttcttgggcccaatggaaggtgggggcatcatttttaaacattggtgcacctcaacgtgtcacttcggagatcccggcgacgttatggggccgaaggacaaaccttttatctgcccagagttccccggacagtttaggaagaagtgtaatttcgctaccacacctatttgcgaatacgatggcaacataatcagtggttacaaaaaggtgctcgccactattgacagcttccaatcgtttaatacctccaacatccatttcacagatgagcggattgagtggcgcgaccccgatgggatgctgagagaccacatcaatatagtgatctctaaagatattgactttgaaaacctagcagagaatccatgtaaggtaggactgcaggcggccaacatcgaaggcgcttggggtagcggcgtcgggttcactcttacctgccaggtgtcactgacggagtgccctacatttcttaccagtattaaagcctgtgatatggcaatctgctatggagctgaatccgttactttgtctaggggccaaaatacagtgcgtataaccgggaagggaggccacagcggttcctcattcaagtgttgccatgggaaagagtgtagcagtactggactgcaggcctctgcaccccacttagacaaggtcaacggcatttccgagctcgaaaatgagaaagtgtacgatgacggtgccccagaatgcggcgttacctgttggtttaagaaaagcggggagtgggtgatgggaatcatcaacggcaattgggtagtcctgattgtgctttgcgtgctgctcttgttctcgctgatactactgtcaatcctctgtccggtccggaagcataagaaatcttga

SEQ ID NO: 10236 - RNA, 3402 nt, synthetic construct
  misc_feature 1..3402: note = derived and/or modified CDS sequence (opt3) from SEOV(L99)__AF035833.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtggtctggaggaaaaaggcgaatcaagaattggctaaccaaaattcatttgaggtggttgagagcgaagtgagtttcaaaggcctctgcatgctgaagcaccggatggtcgaggaatcctatcgcaaccgacgttctgtgatatgttacgacctggcctgcaatagcaccttttgtaagcccacagtatatatgatcgttcctattcatgcatgcaacatgatgaaatcctgtctcatcgggttaggaccatacaggattcaggtggtctatgagagaacttactgcaccacaggcatcctgaccgagggtaagtgtttcgtgcccgataaagccgtggtctcagctcttaagcgggggatgtatgcaatagccagtatcgaaactatttgctttttcatccaccagaaaggaaatacatacaagattgttaccgctatcacgagcgccatgggctctaagtgtaacaatactgacaccaaagtgcaaggctactatatatgcattatcgggggaaactccgcgcctgtatacgcaccagccggtgaggattttcgcgctatggaagtgttctcaggcattatcacaagcccccatggggaggaccacgatttgcctggagaagagatcgccacttatcagattagtggccagatagaggcaaagatcccacacaccgtctcttccaaaaatctgaagctaattgcttttgccggtatcccgagctactcgtctacatccatactcgcggcctcagaagacgggagattcatttttagtcccggactgttccctaaccttaaccagagcgtgtgcgataataacgcactgccattgatctggaggggcctcatcgacctgaccggctattacgaggctgttcatccctgtaatgtgttctgcgtcttatccgggcctggagcctcttgtgaagcctttagcgagggtggcattttcaacatcacgtcaccaatgtgcctggtgagtaaacaaaatcggtttcgcgccgcagaacagcagatttccttcatatgtcaacgagtagatatggacatcattgtttattgcaacgggcagaagaaaactatcctcacaaagacccttgtgatcggacagtgtatttacactataacaagcctgttttctttgctacccggcgtcgcccactcaatcgctattgagctgtgcgtgccgggtttccatgggtgggcgaccgcagccctcctgatcacgttttgtttcggctgggtccttattcctgcttgcaccctggccatcttgctcgtgctgaagtttttcgcaaatatattacacacaagtaaccaggagaatagatttaaagccatcctgaggaagattaaagaagagttcgaaaagactaaaggaagcatggtttgtgagatctgcaagtacgaatgcgagaccctaaaggagctcaaagctcacaacctgtcctgtgtgcaaggcgaatgcccctattgttttacacattgcgagccaactgaaaccgccattcaggcacactacaaggtatgtcaggcgacacatcggttccgtgaggatcttaaaaagaccgtcactcctaaaaatatcgggcccggatgctatcgcacgttgaacctgttcagatacaagtctaggtgttatatactcacaatgtggaccctgcttctgattatcgagtcgattttgtgggctgccagcgcagccgaaatcccactcgtgcccctgtggactgacaatgctcacggtgttggctccgtgcctatgcataccgacttagagctggatttttcactaccaagttctagcaagtacacatataaacggcacctcaccaacccggtcaatgaccagcaatccgtgtcactgcacatagaaatcgagagccaggggattggagccgatgtacatcaccttggccattggtacgacgcacgattgaacctgaagacttctttccactgctacggtgcttgtacaaaatatcagtacccctggcacacggccaagtgccattttgaaaaagattatgagtacgagaactcctgggcgtgtaatcctccagactgccccggggtgggcaccggatgcactgcctgtggcctctatctggatcagttaaagcctgttgggacagctttcaagatcattagtgtccgctacagcagaaaagtgtgcgtgcaatttggagaagagtatctgtgtaagaccatcgacatgaacgattgcttcgtcacaaggcacgcaaaaatatgtattatcggtactgtttctaagttttcccagggcgacacccttttgttcctcgggccaatggaaggaggcggtatcatttttaaacattggtgcacgtcaacctgtcacttcggggatcccggcgacgtgatgggaccgaaggacaaaccttttagttgcccagagttccccggccagtttcggaagaagtgtaatttcgccacaactcctatctgcgaatacgatgggaacattataagcggatacaaaaaggtgctggctaccatcgactcgttccagtcctttaatacatctaacattcatttcactgatgagcgcatcgagtggagagaccccgatggcatgctaagggaccacattaatatcgtaataagcaaagatatcgactttgaaaacctggccgagaatccatgtaaggtcggtctccaagcagcgaacattgaaggggcctggggatcaggcgtgggtttcaccctgacgtgccaggttagtcttacagagtgccctacctttttgacttccatcaaggcttgtgatatggccatttgctatggcgcagaatctgtgacactgagccgtgggcagaataccgtccggatcactggaaaaggcgggcactccggaagctcattcaagtgttgccatggcaaagagtgtagttctaccggtttacaggcttccgctccccacctcgacaaggtgaacgggataagcgagctggaaaatgagaaagtttacgatgacggagcaccagaatgcggcgtgacatgttggtttaagaaatcgggtgagtgggtaatgggcattatcaacgggaattgggtcgtgcttatcgtgctgtgcgtcttgctcctgttctcactaattctgctctctatactgtgtccggttcgaaagcataagaaaagttga

SEQ ID NO: 10237 - RNA, 3402 nt, synthetic construct
  misc_feature 1..3402: note = derived and/or modified CDS sequence (opt3) from SEOV(Z37)__AF187081.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcgtggagagtgaagtttccttcaaaggcttgtgcatgctcaagcaccggatggtggaggaatcttatcgcaaccgacgtagcgtcatctgttacgacctggcctgcaattccaccttttgtaagcccacagtgtatatgattgtacctatccatgcatgcaacatgatgaaatcatgtctgattgggctcggaccatacagaatccaggttgtgtatgagaggacttactgcaccacaggcatattaaccgagggtaagtgtttcgtccccgataaagccgtggtgagtgctctgaagcgggggatgtatgcaatcgccagcattgaaactatctgctttttcattcaccagaaaggaaataagtacaagatcgtcacagctataacctctgccatgggctccaaatgtaacaatacggacactaaggttcaaggctactatatttgcatcattgggggaaactcagcgcctgtgtacgcaccagccggtgaggattttcgcgctatggaagtattcagcggcatcatcaccagtccccatggggaggaccacgatcttcctggagaagagattgccacatatcagatatctggccagatcgaggcaaaaattccacacactgtgtccagcaagaatttgaaactgaccgcttttgccggtatcccgtcgtactcttccacatcaatactagcggccagtgaagacgggagattcatttttagccccggactcttccctaacctgaaccagtccgtctgcgataataacgcacttccactgatctggaggggcttgatcgacctcaccggctattacgaggctgtgcatccctgtaatgttttctgcgtgctgtctgggcctggagccagctgtgaggctttttcagaaggtggcattttcaacatcacgagtccaatgtgcttagtctccaagcaaattcggtttcgcgccgcagaacagcagatatcattcatctgtcaacgagtggatatggacattatcgtatattgcaatgggcagaaaaagactatcctgacaaagaccctcgttattggacagtgtatatacactatcacatctttgttttcactgttgcccggcgtggcccacagtattgctatcgagctatgcgtcccgggtttccatgggtgggcgaccgcagccctgctcattacgttttgtttcggctgggtgctgatccctgcttgcacccttgccatactgttggtcctcaaatttttcgcaaacatcctgcacacaagcaatcaggagaacagatttaaggccattttaaggaaaatcaaggaagagttcgagaaaactaagggatccatggtgtgtgaaatttgcaagtacgaatgcgagaccctgaaagagctaaaggctcacaatctctcttgtgttcaaggcgaatgcccctattgttttacacattgcgagccaactgaaaccgccatccaggcacactacaaagtgtgtcaggcgacacatcggttccgtgaggatctgaagaaaaccgtaactcctcagaacatagggcccggatgctatcgcacgcttaatttgttcagatacaagtcgaggtgttatattctgacaatgtggaccctcctgcttatcattgagagcatcctgtgggctgcctccgcagccgaaataccattggtccccctctggactgacaacgctcacggtgtgggctcagttcctatgcataccgacctggagttagattttagtctgccatctagctccaagtacacatataaacggcacctaaccaatccggtgaacgaccaacagtcagtcagcctccacatcgaaattgagtctcaggggatcggagccgatgtgcatcacctgggccattggtacgacgcacgacttaatttgaagacttccttccactgctacggtgcttgtacaaaatatcagtacccctggcacacggccaagtgccattttgaaaaagattatgagtacgagaacagttgggcgtgtaaccctccagactgccccggggtaggcaccggatgcactgcctgtggcctgtatctcgatcaactgaagcctgtggggacagctttcaagattatcagcgttcgctactctagaaaagtctgcgtgcagtttggagaagagtatttatgtaagaccatagacatgaatgattgcttcgtgacaaggcacgcaaaaatttgtatcatcggtactgtctccaagttttcacagggcgacaccctgcttttcttggggccaatggaaggaggcggtattatctttaaacattggtgcacgagtacctgtcacttcggggatcccggcgacgttatgggaccgaaggacaaaccttttatttgcccagagttccccggccagtttcggaagaagtgtaacttcgccacaactcctgtgtgcgaatacgatgggaatataatcagcggatacaaaaaggtgctcgctaccattgactcgttccaatcctttaacacatctaatatccatttcactgatgagcgcattgagtggagagaccccgatggcatgctgagggaccacatcaacatagtaatcagcaaagatattgactttgaaaatctagccgagaacccatgtaaggtcggtctgcaggcagcgaatatcgaaggggcctggggatcaggcgtgggtttcaccctcacgtgccaggttagtctgacagagtgccctacctttcttacttccattaaggcttgtgatatggccatctgctatggcgcagaatctgtgacattgagccgtgggcaaaacaccgtcaaaataactggaaagggcgggcactccggaagcagcttcaaatgttgccatggcaaggagtgtagttctaccggtctgcaggcttccacaccccacttagacaaagtgaatgggattagcgagctcgaaaacgagaaggtttacgatgacggagccccagaatgcggcatcacgtgttggtttaaaaagtcgggtgagtgggtgatgggcatcattaatgggaactgggtagtcctgatagtgctttgcgtgctgcttctcttctcactgatcctactgtctattctctgtccggtccggaagcataaaaagagttga

SEQ ID NO: 10238 - RNA, 3402 nt, synthetic construct
  misc_feature 1..3402: note = derived and/or modified CDS sequence (opt3) from SEOV(Z37)__AF190119.1__GP
  source 1..3402: mol_type = other RNA
atgtggagcctgctccttctggccgctttggtgggccaggggttcgcattaaagaacgtctttgacatgagaatccaatgcccccactccgttaatttcggagagacctctgtgtcaggttacacagaactgcctccactaagtctccaggaggccgaacagctggtaccggagagctcctgtaacatggataatcatcagtctctttcgactattaacaaactgacgaaggtgatatggaggaaaaaggcgaatcaagaatcagctaaccagaatagctttgaggtcgtggagagtgaagtttccttcaaaggcttgtgcatgctcaagcaccggatggtggaggaatcttatcgcaaccgacgtagcgtcatctgttacgacctggcctgcaattccaccttttgtaagcccacagtgtatatgattgtacctatccatgcatgcaacatgatgaaatcatgtctgattgggctcggaccatacagaatccaggttgtgtatgagaggacttactgcaccacaggcatattaaccgagggtaagtgtttcgtccccgataaagccgtggtgagtgctctgaagcgggggatgtatgcaatcgccagcattgaaactatctgctttttcattcaccagaaaggaaatacatacaagatcgtcaccgctataacgtctgccatgggctccaagtgtaacaatactgacaccaaagttcaaggctactatatttgcatcattgggggaaactcagcgcctgtgtacgcaccagccggtgaggattttcgcgctatggaagtattcagcggcatcatcacaagtccccatggggaggaccacgatcttcctggagaagagattgccacttatcagatatctggccagatcgaggcaaagattccacacaccgtgtccagcaaaaatttgaagctgacagcttttgccggtatcccgtcgtactcttccacctcaatactagcggccagtgaagacgggagattcatttttagccccggactcttccctaacctgaaccagtccgtctgcgataataacgcacttccactgatctggaggggcttgatcgacctcacgggctattacgaggctgtgcatccctgtaatgttttctgcgtgctgtctgggcctggagccagctgtgaggctttttcagaaggtggcattttcaacatcacttcaccaatgtgcttagtctccaaacaaaatcggtttcgcgccgcagaacagcagattagcttcatatgtcaacgagtggatatggacatcattgtatattgcaacgggcagaagaaaacaatcctgaccaagactctcgttatcggacagtgtatttacacaataacctctctttttagtctgttgcccggcgtggcccacagtatcgctattgagctatgcgtcccgggtttccatgggtgggcgacggcagccctgctcatcaccttttgtttcggctgggtgctgattcctgcttgcacacttgccatcctgttggtcctcaagtttttcgcaaatatactgcacactagcaaccaggagaatagatttaaagccatcttaaggaagattaaagaagagttcgaaaagaccaaaggatccatggtgtgtgagatctgcaagtacgaatgcgagacactgaaggagctaaaagctcacaacctctcttgtgttcaaggcgaatgcccctattgttttactcattgcgagccaaccgaaacagccattcaggcacactacaaggtgtgtcaggcgacccatcggttccgtgaggatctgaaaaagactgtaacgcctcagaatatcgggcccggatgctatcgcacacttaacttgttcagatacaaatcgaggtgttatatactgaccatgtggactctcctgcttattatcgagagcattctgtgggctgcctccgcagccgaaatcccattggtccccctctggaccgacaatgctcacggtgtgggctcagttcctatgcatacagacctggagttagattttagtctgccatctagctccaagtacacctataagcggcacctaactaacccggtgaatgaccaacagtcagtcagcctccacatagaaatcgagtctcaggggattggagccgatgtgcatcacctgggccattggtacgacgcacgacttaacttgaaaacatccttccactgctacggtgcttgtacgaagtatcagtacccctggcacaccgccaaatgccattttgaaaaggattatgagtacgagaacagttgggcgtgtaatcctccagactgccccggggtaggcactggatgcacagcctgtggcctgtatctcgatcaactgaaacctgtggggaccgctttcaagatcattagcgttcgctactctagaaaggtctgcgtgcagtttggagaagagtatttatgtaaaacaatcgacatgaacgattgcttcgtgactaggcacgcaaagatatgtattatcggtaccgtctccaaattttcacagggcgacacgctgcttttcttggggccaatggaaggaggcggtatcatttttaagcattggtgcaccagtacatgtcacttcggggatcccggcgacgttatgggaccgaaagacaagccttttatctgcccagagttcgccggccagtttcggaaaaagtgtaatttcgctactacccccgtgtgcgaatacgatgggaacattataagcggatacaagaaagtgctcgagacaatcgactcgttccaatcctttaatacttctaacattcatttcaccgatgagcgcatcgaatggagagaccctgatggcatgctgagggaccacattaatatcgtaataagcaaggatatcgactttgagaacatggccgaaaatccctgtaaagtcggtctacaggcagcgaacattgagggggcctggggatcaggcgtgggtttcacgctgacatgccaggttagtctcaccgaatgcccaacttccctgacatctatcaaggcttgtgatatggccatttgctatggcgcagagagcgtgaccctttcccgtgggcaaaatactgtcaaaatcaccggaaagggcgggcactcaggaagcagttttaagcggtgtcatggcaaagagtgttcttccacaggtttgcaggctagcgcccctcacctggacaaggtgaacgggatatcggaattagagaatgaaaaagtttacgatgacggagcacccgagtgcggcattacgtgctggttcaagaaatcaggtgagtgggtgatgggcatcatcaacgggaattgggtagtcctcattgtgctgtgtgtgcttctgttgttttctctcatactgctaagtatcctgtgcccagtccgaaagcataagaaatcctga

SEQ ID NO: 10239 - RNA, 3402 nt, synthetic construct
  misc_feature 1..3402: note = derived and/or modified CDS sequence (opt3) from SEOV__M34882.1__GP
  source 1..3402: mol_type = other RNA
atgtggagcctgctccttctggccgctttggtgggccaggggttcgcattaaagaacgtctttgacatgagaatccaactgccccactccgttaatttcggagagacctctgtgtcaggttacacagaatttcctccactaagtctccaggaggccgaacagctggtaccggagagctcctgcaacatggataatcatcagtctctttcgactattaacaaactgacgaaggtgatatggaggaaaaaggcgaatcaagaatcagctaaccagaatagcttcgaggtcgtggagagtgaagtttcctttaaaggcttgtgtatgctcaagcaccggatggtggaggaatcttatcgcaaccgacgtagcgtcatctgctacgacctggcctgtaattccaccttctgcaagcccacagtgtatatgattgtacctatccatgcatgtaacatgatgaaatcatgcctgattgggctcggaccatacagaatccaggttgtgtatgagaggacttactgtaccacaggcatattaaccgagggtaagtgctttgtccccgataaagccgtggtgagtgctctgaagcgggggatgtatgcaatcgccagcattgaaactatctgtttctttattcaccagaaaggaaatacatacaagatcgtcaccgctataacgtctgccatgggctccaagtgcaacaatactgacaccaaagttcaaggctactatatttgtatcattgggggaaactcagcgcctgtgtacgcaccagccggtgaggatttccgcgctatggaagtatttagcggcatcatcacaagtccccatggggaggaccacgatcttcctggagaagagattgccacttatcagatatctggccagatcgaggcaaagattccacacaccgtgtccagcaaaaatttgaagctgacagctttcgccggtatcccgtcgtactcttccacctcaatactagcggccagtgaagacgggagatttattttcagccccggactcttccctaacctgaaccagtccgtctgcgataataacgcacttccactgatctggaggggcttgatcgacctcacgggctattacgaggctgtgcatccctgcaatgtgttttgtgttctgtctgggcctggagccagctgcgaggctttctcagagggtggcatttttaacatcacttcaccaatgtgtttagtctccaaacaaaatcggttccgcgccgcagaacagcagattagctttgtgtgccaacgagtagatatggacataatcgtttattgtaacgggcagaagaaaacaattctgaccaagactctcgtgatcggacagtgcatctacacaattacctctcttttctcactgttgcccggcgtcgcccacagtatagctatcgagctatgtgtgccgggttttcatgggtgggcgacggcagccctgctcattaccttctgctttggctgggtcctgatccctgcttgtacacttgccattctgttggtgctcaagttctttgcaaatatcctgcacactagcaaccaggagaatagattcaaagccatattaaggaagatcaaagaagagtttgaaaagaccaaaggatccatggtttgcgagatttgtaagtacgaatgcgagacactgaaggagctaaaagctcacaacctctcttgcgtgcaaggcgaatgtccctattgcttcactcattgtgagccaaccgaaacagccatccaggcacactacaaggtatgccaggcgacccatcggttccgtgaggatctgaaaaagactgtcacgcctcagaatattgggcccggatgttatcgcacacttaacttgtttagatacaaatcgaggtgctatatcctgaccatgtggactctcctgcttataattgagagcatcctgtgggctgcctccgcagccgaaattccattggtgcccctctggaccgacaatgctcacggtgttggctcagtgcctatgcatacagacctggagttagatttcagtctgccatctagctccaagtacacctataagcggcacctaactaacccggtcaatgaccaacagtcagtgagcctccacatcgaaatagagtctcaggggatcggagccgcagtacatcacctgggccattggtacgatgctcgacttaacttgaaaacatcctttcactgttacggtgcctgcacgaagtatcagtacccctggcacaccgcgaaatgtcatttcgaaaaggactatgagtacgagaacagttgggcctgcaatcctccagattgtcccggggtgggcactggatgcacagcttgcggcctgtatctcgaccaactgaaacctgttgggaccgcatttaagattatcagcgtccgctactctagaaaggtgtgtgtgcagttcggagaagaacacttatgcaaaacaattgatatgaacgactgttttgtcactaggcatgccaagatctgcataattggtaccgtttccaaattctcacagggcgatacgctgttgtttcttgggccaatggaaggaggcggtatcatcttcaagcactggtgtaccagtacatgccattttggggaccccggcgatgtgatgggaccgaaagacaagcctttcatttgtccagagtttcccggccagttccggaaaaagtgcaatttcgctactacccctgtgtgtgaatatgacgggaacatcattagcggatacaagaaagtactcgccacaatagattcgtttcaatccttcaatacttctaacatccactttaccgacgagcgcattgagtggagagatcccgacggcatgctgagggatcacatcaatattgtcatcagcaaggacatagatttcgaaaacctagcagagaatccatgcaaagtgggtctgcaggcggccaacatcgaaggggcttggggatcaggcgttggttttacgctcacatgtaaggtgagtctgaccgagtgccctactttccttacatccattaaagcctgcgacatggcaatctgttacggcgctgaatctgtcaccttgagccgtgggcagaatactgtgaagattaccggaaagggcgggcattccggaagtagctttaaatgctgtcacggcaaggagtgcagttctacaggtctgcaagcctccgcaccccatttagataaagttaacgggatcagcgagctcgaaaatgagaaggtgtatgacgatggagccccagaatgtggcataacgtgctggttcaaaaagtcgggtgagtgggtaatgggcattatcaacgggaattgggtcgtgctgatcgtgctttgtgtcctgttgctcttttcactgattctactgtctatactctgcccggttcggaagcacaaaaagagttga

SEQ ID NO: 10240 - RNA, 3423 nt, synthetic construct
  misc_feature 1..3423: note = derived and/or modified CDS sequence (opt3) from SNV(NM H10)__NC_005215.1__GP
  source 1..3423: mol_type = other RNA
atggtgggctgggtctgcatcttcctggttgtgctcaccacagccactgctgggcttacgagaaacctgtacgagttgaagattgaatgtccccacaccgtaggattaggtcagggctatgtgacagggagcgtcgagataactcctatcctgctaacccaagtggcagacctcaaaattgaatcctcttgcaattttgatctgcatgttccagccacaaccactcagaagtacaaccaggtggactggaccaaaaagtcaagtacaacggagagcactaatgcgggagctaccacattcgaagccaaaactaaggagatcaaccttaagggcacctgtaatattccgcccacaacctttgaggcagcctataaatccaggaagacggtcatctgctacgatctggcttgtaaccagactcactgcttgcctacagtgcatctcatagcaccagtacaaacctgtatgtctgttcggtcgtgcatgatcggtctgctgtcaagccgcattcaggtgatctatgagaaaacttactgtgtcacagggcagctcattgagggattatgcttcatccccacccacacgatagccctgacccagcctggccatacatatgacactatgacccttccagtgacatgctttttggtggctaagaaactgggcactcaactaaagctcgccgtcgaactggagaaacttattaccggggttagttgtacagaaaattccttccagggatactacatctgctttattggtaaacactctgaacccctgttcgtgcctaccatggaggattatcgaagcgcggaattgtttactcgtatggtactcaacccaagaggcgaggaccacgatccggaccagaatgggcagggactgatgaggatcgcaggccccgtgacggccaaggtcccttccacagaaaccactgagaccatgcaaggtatcgctttcgccggggcaccaatgtactcaagttttagcacattagtgcggaaagctgatcccgagtatgttttctctcctggaattatagccgaatccaaccattcagtgtgtgacaagaaaaccgtcccactgacttggacaggctttctcgcggtgagcggcgagatcgaaaagattacggggtgcaccgtattctgtactcttgccggacccggtgcaagttgcgaggcttactctgaaacaggcatcttcaatatatccagcccgacctgtctggttaacaaagtgcagaagtttcgcgggtcggagcagagaattaatttcatgtgccaaagggtcgatcaggacgtggtcgtgtattgtaacggacagaagaaagttatcttgacaaagactctagtgatcggccagtgcatttacacctttacgtctctgttctccctcatccctggtgtagcccactcactggctgtcgagctttgtgtgcccgggctgcatggctgggccaccacagcattgctcattactttttgcttcggatggctgttaataccagccgttaccctgatcattctaaaaatcctccggctgcttacatttagttgtagccactattccactgaatctaagttcaaagtgatcttggagcgcgtcaaggtggaataccaaaagaccatgggcagcatggtatgcgatatttgccaccatgagtgtgaaacggctaaagagctggagacacacaagaaatcatgccctgaagggcagtgtccctactgcatgaccataactgagagtacagaatccgcgctccaggcacattttgccatctgtaagctgaccaatcgattccaggagaaccttaaaaagagcctgaagagaccagaggtgaggaaaggatgctatcggactttgggtgtttttcgttacaagtctcgctgttatgtcggcctcgtgtgggggattctgttaaccacagaactgatcatttgggctgcctcagcagacacgcccctaatggagagtggatggagcgacaccgcccacggcgtgggtatcatacctatgaaaactgatctcgaactggacttcgctcttgcctcctcttcgagctactcctatagaaggaagttggtcaacccagcaaatcaagaggaaacactgccgtttcatttccagctcgataaacaggttgtgcacgcggagatccagaacctggggcactggatggacggcaccttcaatattaagacagcttttcattgctacggagagtgtaagaaatatgcctacccctggcaaactgcaaagtgcttctttgaaaaagattaccagtatgagacctcatggggctgtaaccctccagactgccccggggtgggaacgggttgcacagcctgtggcgtatacttagataagctgcggagtgtcgggaaggcttataagatcgtgtctcttaaatacacccgaaaggtttgcattcagttgggaactgaacagacctgtaagcacatcgacgtgaatgattgcctcgtcacacctagcgtgaaagtttgtatgataggcactatttccaagctgcaaccaggtgacaccctactgttcctcgggcccctggagcagggcggaatcattcttaaacagtggtgcacaacgtcatgtgtgtttggcgatccgggggacatcatgagcaccacttctggaatgcgctgccctgaacatacaggctccttcagaaagatatgtggttttgccaccactccaacatgcgagtatcaagggaacaccgtaagtggattccagaggatgatggcaacgcgggacagctttcagtctttcaatgtcactgagccccacatcacctccaaccgcttggaatggattgatcctgactcaagtatcaaagatcacattaatatggtgctgaacagagacgtgagctttcaggatttatcggacaatccctgtaaggtcgatctccatacacaatccatcgacggcgcttggggttctggcgttgggttcaccctggtgtgcactgtaggacttacagagtgcgccaactttataaccagcattaaggcgtgtgattcagccatgtgctacggcgctacagtgactaatctgttgagggggagtaacaccgtcaaagtggttggaaagggcggtcactccgggtctctcttcaaatgttgccatgacacggattgtacagaagagggactggcagccagcccacctcacctagaccgtgtgaccggctataatcagatcgattccgacaaggtctacgacgatggtgctcccccatgcactatcaaatgttggttcaccaagtcaggcgaatggctgctcgggattctgaacggaaactgggtggttgtggccgtccttatcgtaattttgatactgagcatcttactctttagtttcttttgcccggtgcggtctcgaaagaataaagcaaactga

SEQ ID NO: 10241 - RNA, 3423 nt, synthetic construct
  misc_feature 1..3423: note = derived and/or modified CDS sequence (opt3) from SNV(1)__JQ690283.1__GP
  source 1..3423: mol_type = other RNA
atggtgggctgggtctgcatcttcctggttgtgctcaccacagccactgctgggcttacgagaaacctgtacgagttgaagattgaatgtccccacaccgtaggattaggtcagggctatgtgacagggagcgtcgagactacccctatactgctaacacaagtggcagacctcaaaatcgaatcctcttgcaattttgatctgcatgttccagccaccactacacagaagtacaaccaggtggactggaccaaaaagtcaagtacgactgagagcaccaatgcgggagctgccacattcgaagcaaaaactaaggaggtcaaccttaagggcacctgtaatattccgcccacaacctttgaggccgcttataaatccaggaagacggtgatctgctacgatctggcatgtaaccagactcactgcttgcctacagtacatctcattgccccagttcaaacctgtatgtctgtgcggtcgtgcatgatcggtctgctgtcaagccgcatacaggtcatctatgagaaaacttactgtgtgacagggcagctcattgagggattatgcttcatccccacccacacgattgctctgacccagcctggccatacatatgacactatgacccttccagtgacatgttttctagtcgccaagaaactgggcactcaactaaagctcgcggttgaactggagaaacttatcaccggggtgagttgcacagaaaattccttccagggatactacatatgctttattggtaagcactctgaacccctgttcgtacctaccatggaggattatcgaagcgcagaattgtttactcgtatggtgctcaacccaagaggcgaggaccacgatccggaccagaatgggcagggactgatgaggatcgccggccccgtcacggctaaggtgccttccacagaaaccactgagaccatgcaaggtattgccttcgcaggggctccaatgtactcaagttttagcacattagttcggaaagccgatcccgagtatgtgttctctcctggaatcatcgcggaatccaaccattcagtctgtgacaagaaaaccgtgccactgacttggacaggctttctcgccgtaagcggcgagattgaacgcataacggggtgcaccgttttctgtactcttgcaggacccggtgctagttgcgaggcctactctgaaacaggcatcttcaatatttccagcccgacctgtctggtgaacaaggtccagaaatttagagggtcggagcagaggatcaatttcatgtgccaacgggtggatcaggacgtcgtggtttattgtaacggacagaagaaggtgatattgacaaaaactctagtaattggccagtgcatctacacctttacgtctctgttctccctcatccctggtgtcgctcactcactggccgtggagctttgtgttcccgggctgcatggctgggcaaccacagccttgctcattactttttgcttcggatggctgttaatcccaaccgtgacactgattatactaaaggtcctccgcctgcttacttttagttgtagccactattccaccgaatctaaattcaaggtgatcttggagcgagtaaaagtggaataccaaaagacgatgggcagcatggtttgcgatatttgccaccatgagtgtgaaacagctaaggagctggagacccacaaaaagtcatgccctgaagggcagtgtccctactgcatgactatcacagagagtaccgaatccgcgctccaggcacattttagcatctgtaaactgactaatagattccaggagaaccttaagaaatctctgaagaggccagaggtccggaagggatgctatcgtaccttgggtgtgtttcgctacaaatcaagatgttatgtgggcctcgtctgggggattctgttaacaacggaactgataatctgggccgctagtgccgacacccccttgatggagagcggatggtccgacactgcacacggcgttggtattatccctatgaagacagatctcgaactggacttcgcccttgcttcttcgagctcctactcatataggcggaaattggtgaacccagccaatcaagaggaaaccctgccgtttcatttccagctcgataaacaggtggtacacgcagagattcagaacctggggcactggatggacggcacattcaatatcaagactgcgtttcattgctacggagagtgtaagaagtatgcttacccctggcaaaccgccaaatgcttctttgaaaaggattaccagtatgagacgagttggggctgtaaccctccagactgccccggggtcggaacaggttgcaccgcatgtggcgtgtacttagataaactgcgatctgttgggaaggcctataaaatagtgagccttaagtacactcgcaaagtctgcatccagttgggaaccgaacagacatgtaagcacattgacgtgaatgattgcctcgttactccttccgtgaaggtatgtatgatcggcaccatttcaaaactgcaaccaggtgacacactactgttcctcgggcccctggagcagggcggaatcatacttaagcagtggtgcacgaccagctgtgtctttggcgatccgggggacattatgtctactacatccggaatgagatgccctgaacataccggcagtttcaggaaaatctgtggttttgctactacaccaacctgcgagtatcaagggaacacggtgagcggattccagcggatgatggccactcgcgactcttttcagtccttcaatgtgaccgagccccacattacatcaaacagattggaatggatcgatcctgacagtagcataaaggatcacatcaatatggtcctgaacagggacgtttcgtttcaggatttatccgacaatccctgtaaagtggatctccatacccaatctattgacggcgcatggggtagcggcgtagggttcactctggtgtgcacagtcggacttaccgagtgcgctaactttatcacatcaattaaggcctgtgatagtgcgatgtgctacggcgccactgtgaccaatctgttgcgtgggtccaacacggttaaggtggtcggaaaaggcggtcactctgggagcctcttcaagtgttgccatgacacagattgtaccgaagagggactggctgcatccccacctcacctagaccgggtgactggctataatcagatcgattcagacaaagtttacgacgatggtgctcccccatgcaccataaagtgttggttcacaaaaagcggcgaatggctgctcgggattctgaacggaaactgggtggtcgtagccgtgcttatcgttatcttgattctgagtatcttactcttttctttcttttgcccggtgcgaaatagaaagaacaaggccaattga

SEQ ID NO: 10242 - RNA, 3423 nt, synthetic construct
  misc_feature 1..3423: note = derived and/or modified CDS sequence (opt3) from SNV(1)__JQ690279.1__GP
  source 1..3423: mol_type = other RNA
atggtgggctgggtctgcatcttcctggttgtgctcaccacagccactgctgggcttacgagaaacctgtacgagttgaagattgaatgtccccacaccgtaggattaggtcagggctatgtgacagggagcgtcgagactacccctatactgctaacacaagtggcagacctcaaaatcgaatcctcttgcaattttgatctgcatgttccagccaccactacacagaagtacaaccaggtggactggaccaaaaagtcaagtacgactgagagcaccaatgcgggagctaacacattcgaagccaaaactaaggagattaatcttaagggcacctgtaacatcccgcccacaacctttgaggcagcctataaatccaggaagacggtcatttgctacgatctggcttgtaatcagactcactgcttgcctacagtgcatctcatcgcaccagtacaaacctgtatgtctgttcggtcgtgcatgataggtctgctgtcaagccgcatccaggtgatttatgaaaagacttactgtgtcacagggcagctcatcgagggattatgcttcattcccacccacacgatcgccctgacccagcctggccatacatatgacactatgacccttccagtgacatgctttttggtggctaagaaactgggcactcaactaaagctcgccgtcgaactggagaagctgataaccggggttagttgtacagagaactccttccagggatactacatttgctttatcggtaaacactctgaacccctgttcgtgcctaccatggaggattatcgaagcgcggaattgtttactcgtatggtactcaatccaagaggcgaggaccacgatccggaccagaacgggcagggactgatgaggattgcaggccccgtgacggccaaggtcccttccacagaaaccactgagaccatgcaaggtatcgctttcgccggggcaccaatgtactcaagttttagcacattagtgcggaaagctgatcccgagtatgttttctctcctggaatcattgccgaatccaatcattcagtgtgtgacaagaaaaccgtcccactgacttggacaggctttctcgcggtgagcggcgagatagaacgcatcacggggtgcaccgtattctgtactcttgccggacccggtgcaagttgcgaggcttactctgaaacaggcattttcaacatctccagcccgacctgtctggttaataaggtgcagaaatttagagggtcggagcagaggataaacttcatgtgccaacgggtcgatcaggacgtggtcgtgtattgtaatggacagaagaaggttattttgacaaaaactctagtgatcggccagtgcatctacacctttacgtctctgttctccctcattcctggtgtagcccactcactggctgtcgagctttgtgtgcccgggctgcatggctgggccaccacagcattgctcatcactttttgcttcggatggctgttaattccaaccgttacactgctaatactcaagatcctgcgccttttgacttttagttgtagccactattccaccgaatctaaattcaaggtgattctggagcgagtcaaagtggaataccaaaagacgatgggcagcatggtatgcgatatctgccaccatgagtgtgaaacagccaaggagctcgagacccacaaaaagtcatgccctgaagggcagtgtccctactgcatgactatcacagagagtaccgaatccgctctgcaggcgcattttagcatttgtaaacttactaacagattccaggagaacctgaagaaatctttgaagaggccagaggtgaagaaaggatgctatcggaccctcggtgtttttcgttacaagtcacgctgttatgtcggcctggtgtgggggatattactgacaacggaactaatcatttgggcagccagtgctgacactcccctcatggagagcggatggtccgacactgcccacggcgtgggtatcattcctatgaaatctgatctggaacttgacttcgcattggcctcgagctcctcatacagttatagaaggaagctggtcaatccagctaaccaagaggaaacactcccgtttcatttccagctggataaacaggttgtgcacgccgagatccagaatttagggcactggatggacggcaccttcaacataaagacagcatttcattgctacggagagtgtaagaaatatgcgtacccctggcaaactgctaagtgcttctttgaaaaagattaccagtatgagacctcttggggctgtaatcctccagactgccccggggtgggaacgggttgcacagcctgtggcgtatacctggataaacttcggagcgtcgggaaagcatataagatcgtgtccttgaaatacacccgaaaggtttgcattcagctcggaactgaacagacctgtaagcacatcgacgtgaacgattgcctggtcacaccttcagtgaaagtttgtatgattggcactatcagcaagctacaaccaggtgacacccttctcttcctggggccccttgagcagggcggaataattttgaaacagtggtgcacaacgtcttgtgtgtttggcgatccgggggacatcatgtccaccaccagtggaatgcgctgccctgaacatacaggcagcttcagaaagatttgtggttttgccaccactccaacatgcgagtatcaagggaataccgtatctggattccagaggatgatggctacgcgggactcctttcagtcattcaacgtcactgagccccacatcaccagtaatcgcctggaatggatagatcctgacagctcgatcaaagatcacattaacatgatcttaaatagagacgtgtcctttcaggatctctctgacaacccctgtaaggtggatctgcatacacaaagcattgacggcgcctggggttcaggcgtcgggttcacccttgtttgcactgtgggactgacagagtgcgcaaattttatcaccagtataaaggcttgtgattccgccatgtgctacggcgcgacagtaactaacttgctcagggggtctaataccgtgaaagtcgtgggaaagggcggtcacagcgggtccctgttcaaatgttgccatgacacggattgtacagaagagggactagccgcttcaccacctcacctggaccgtgttaccggctataaccagattgatagcgacaaggtgtacgacgatggtgcacccccatgcactatcaaatgttggttcaccaagagtggcgaatggctcctggggatccttaacggaaattgggtcgtggttgccgtgttgattgtcatcctgattttatctatactcctgttttccttcttttgcccggtacggagccgaaagaacaaagctaattga

SEQ ID NO: 10243 - RNA, 3423 nt, synthetic construct
  misc_feature 1..3423: note = derived and/or modified CDS sequence (opt3) from SNV(2)__JQ690284.1__GP
  source 1..3423: mol_type = other RNA
atggtgggctgggtctgcatcttcctggttgtgctcaccacagccactgctgggcttacgagaaacctgtacgagttgaagattgaatgtccccacaccgtaggattaggtcagggctatgtgacagggagcgtcgagactacccctatactgctaacacaagtggcagacctcaaaatcgaatcctcttgcaattttgatctgcatgttccagccaccactacacagaagtacaaccaggtggactggaccaaaaagggatcaacgactgagagtaccaatgcgggcgctaacacattcgaagccaaaactaaggaggtcaatcttaagggtacctgtaacattccgcccacaacctttgaggcagcctataaaagcaggaagacggtgatctgctacgatctggcttgtaatcagactcactgcttgcctacagtacatctcattgcaccagttcaaacctgtatgtccgtgcggtcttgcatgatcgggctgctgtcgtcacgcatacaggtcatctatgaaaagacttactgtgtgacaggacagctcattgagggcttatgcttcatccccacccacacgattgccctgacccagcctggccatacatatgacactatgacccttccagtgacatgttttcttgtcgctaagaaactggggactcaactaaagctcgccgttgaactggagaagttgatcaccggagtgagctgcacagagaacagtttccagggttactacatatgctttattggcaaacactccgaacccctgttcgtacctaccatggaggattatcgatctgcggaagtgtttactcgtatggtcttgaatccaagaggggaggaccacgatccggaccagaacggacagggcctcatgaggatcgcaggtcccgtgacggccaaggttcctagcacagaaaccactgagaccatgcaagggattgctttcgccggagcaccaatgtactcctcatttagtacactggtgcggaaagctgatcccgagtatgtcttcagccctggcatcatcgccgaatctaatcattccgtgtgtgacaagaaaaccgtaccattaacttggacaggctttctggcggtttcaggggagattgaacgcataacgggatgcaccgtgttctgtactctcgccggtcccggcgcaagctgcgaggcttacagtgaaacagggatcttcaacatttcttccccgacctgtcttgtcaataaggtgcagaaatttagaggaagcgagcagaggatcaacttcatgtgccaacgggtcgatcaggacgtggttgtgtattgtaatggccagaagaaggtaatactgacaaaaactttggtcattggtcagtgcatctacacctttacgtcgctattctctctgatccctggggtggcccactccctcgctgttgagctgtgtgtgcccggccttcatggatgggccaccacagcactgttgattactttttgcttcggctggctcctgatcccaaccgtcacattaattatactgaagatcctacgcctcctgactttttcatgtagtcactatagcaccgaatccaaattcaaggtgattcttgagcgagtaaaagtggaataccaaaagacgatggggtctatggtttgcgatatctgccaccatgagtgtgaaacagccaaggagttggagacccacaaaaagagctgccctgaaggacagtgtccctactgcatgactatcacagagtcaaccgaaagtgctctgcaggcgcatttttccatttgtaaactcactaacagattccaggagaacctgaagaaaagccttaagaggccagaggtcaagaaaggttgctatcggaccctgggcgtgtttcgttacaagtctcgctgttatgtggggttggtctggggaatactcctgacaacggaattaatcatttgggcagcctcagctgacactcccctgatggagagtggctggagcgacaccgcccacggtgttgggatcattcctatgaaaacagatctagaactcgacttcgcactggcctcctcttcgagctactcctatagaaggaaacttgtgaatccagctaaccaagaggaaaccttgccgtttcatttccagctggataaacaggtggtacacgccgagatccagaatctcggccactggatggacggaacattcaacataaagactgcatttcattgctacggcgagtgtaagaaatatgcgtacccctggcaaaccgctaagtgcttctttgaaaaagattaccagtatgagacgtcatgggggtgtaatcctccagactgccccggagtcggtacaggctgcaccgcctgtggggtgtacctggataagttacggagtgttggaaaagcatataagatcgtgtctctgaaatacactcgaaaggtctgcattcagcttggcaccgaacagacatgtaagcacatcgacgtgaacgattgcttggttactcctagcgtgaaagtatgtatgattggtaccatctccaagctccaaccaggggacacactgctattcctgggccccctcgagcagggaggcataattctgaaacagtggtgcacgacctcatgtgtctttggggatccgggagacatcatgagcactacatctggcatgcgctgccctgaacataccggttccttcagaaagatttgtgggtttgccactacaccaacctgcgagtatcaaggaaatacggtgagtggcttccagaggatgatggctactcgggacagctttcagtctttcaacgtgaccgagccccacatcacatccaatcgccttgaatggatagatcctgactcaagtatcaaagatcacattaacatggtcttgaatagagacgttagctttcaggatctgtcggacaacccctgtaaggtggatttacatacccaatccatcgacggtgcctggggctctggggtaggattcactctcgtgtgcacagtcggcctgaccgagtgcgcaaattttattacaagcatcaaggcttgtgattcagccatgtgctacggggcgactgtgaccaaccttctgaggggaagtaatacggttaaagtggtcggcaagggtgggcactccggatctttgttcaaatgttgccatgacacagattgtaccgaagagggcctcgccgctagcccacctcacctggaccgtgtgactggttataaccagatagattccgacaaggtttacgacgatggcgcacccccatgcaccattaaatgttggttcacaaagtcaggggaatggctactgggaatcctcaacggcaattgggtggtcgtagccgtgctgatcgttattcttatcttgagcattctgttatttagtttcttttgcccggtgcggtctcgaaagaacaaagctaattga

SEQ ID NO: 10244 - RNA, 3423 nt, synthetic construct
  misc_feature 1..3423: note = derived and/or modified CDS sequence (opt3) from SNV(2)__JQ690280.1__GP
  source 1..3423: mol_type = other RNA
atggtgggctgggtctgcatcttcctggttgtgctcaccacagccactgctgggcttacgagaaacctgtacgagttgaagattgaatgtccccacaccgtaggattaggtcagggctatgtgacagggagcgtcgagactacccctatactgctaacacaagtggcagacctcaaaatcgaatcctcttgcaattttgatctgcatgttccagccaccactacacagaagtacaaccaggtggactggaccaaaaagtcaagtacgactgagagcaccaatgcgggagctaacacattcgaagccaaaactaaggaggtcaatcttaagggcacctgtaacattccgcccacaacctttgaggcagcctataaatccaggaagacggtgatctgctacgatctggcttgtaatcagactcactgcttgcctacagtacatctcattgcaccagttcaaacctgtatgtctgtgcggtcgtgcatgatcggtctgctgtcaagccgcatacaggtcatctatgaaaagacttactgtgtgacagggcagctcattgagggattatgcttcatccccacccacacgattgccctgacccagcctggccatacatatgacactatgacccttccagtgacatgttttctagtcgctaagaaactgggcactcaactaaagctcgccgttgaactggagaaacttatcaccggggtgagttgcacagagaactccttccagggatactacatatgctttattggtaaacactctgaacccctgttcgtacctaccatggaggattatcgaagcgcggaattgtttactcgtatggtgctcaatccaagaggcgaggaccacgatccggaccagaacgggcagggactgatgaggatcgcaggccccgtcacggccaaggtgccttccacagaaaccactgagaccatgcaaggtattgctttcgccggggcaccaatgtactcaagttttagcacattagttcggaaagctgatcccgagtatgtgttctctcctggaatcatcgccgaatccaatcattcagtctgtgacaagaaaaccgtgccactgacttggacaggctttctcgcggtaagcggcgagattgaacgcataacggggtgcaccgttttctgtactcttgccggacccggtgcaagttgcgaggcttactctgaaacaggcatcttcaacatttccagcccgacctgtctggtgaataaggtccagaaatttagagggtcggagcagaggatcaacttcatgtgccaacgggtggatcaggacgtcgtggtttattgtaatggacagaagaaggtgatattgacaaaaactctagtaattggccagtgcatctacacctttacgtctctgttctccctcatccctggtgtcgcccactcactggctgtggagctttgtgttcccgggctgcatggctgggccaccacagcattgctcattactttttgcttcggatggctgttaatcccaaccgtgacactgattatactaaagatcctccgcctgcttacttttagttgtagccactattccaccgaatctaaattcaaggtcattttggagcgagtgaaagtagaataccaaaagacgatgggcagcatggtgtgcgatatctgccaccatgagtgtgaaacagccaaggagctggagacccacaaaaagtcatgccctgaagggcagtgtccctactgcatgactatcacagagagtaccgaatccgctctccaggcgcattttagcatttgtaaactgactaacagattccaggagaaccttaagaaatctctgaagaggccagaggttaagaaaggatgctatcggaccttgggtgtctttcgttacaagtcacgctgttatgtgggcctcgtgtgggggatactgttaacaacggaactgatcatttgggcagccagtgctgacacccccttgatggagagcggatggtccgacactgcccacggcgtcggtatcattcctatgaaaacagatctcgaactggacttcgcacttgcctcttcgagctcctactcatatagaaggaagttggttaatccagctaaccaagaggaaaccctgccgtttcatttccagctcgataaacaggtggtgcacgccgagatccagaatctggggcactggatggacggcacattcaacataaagactgcatttcattgctacggagagtgtaagaaatatgcgtacccctggcaaaccgctaagtgcttctttgaaaaagattaccagtatgagacgagttggggctgtaatcctccagactgccccggggtaggaacaggttgcaccgcctgtggcgtctacttagataagctgcggtctgtggggaaagcatataagatcgttagccttaaatacactcgaaaggtgtgcattcagttgggaaccgaacagacatgtaagcacatcgacgtcaacgattgcctcgtgactccttccgttaaagtgtgtatgattggcaccatctcaaagctgcaaccaggtgacacactactgttcctcgggcccctggagcagggcggaataattcttaaacagtggtgcacgaccagctgtgtatttggcgatccgggggacatcatgtctactacatccggaatgcgctgccctgaacataccggcagtttcagaaagatttgtggttttgccactacaccaacctgcgagtatcaagggaatacggtcagcggattccagaggatgatggctactcgggactcttttcagtccttcaacgtgaccgagccccacatcacatcaaatcgcttggaatggatagatcctgacagtagcatcaaagatcacattaacatggtgctgaatagagacgtctcgtttcaggatttatccgacaacccctgtaaggttgatctccatacccaatctatcgacggcgcctggggtagcggcgtggggttcactctggtatgcacagtgggacttaccgagtgcgcaaattttattacatcaatcaaggcttgtgatagtgccatgtgctacggcgcgactgtcaccaacctgttgagggggtccaatacggtgaaagttgtgggaaagggcggtcactctgggagcctcttcaaatgttgccatgacacagattgtaccgaagagggactggccgcttccccacctcacctagaccgtgtcactggctataaccagatagattcagacaaggtgtacgacgatggtgcacccccatgcaccattaaatgttggttcacaaagagcggcgaatggctgctcgggatcctgaacggaaattgggttgtggtcgccgtacttatcgtgattttgatcctgagtattttactcttttctttcttttgcccggttcggtcccgaaagaacaaagctaattga

SEQ ID NO: 10245 - RNA, 3423 nt, synthetic construct
  misc_feature 1..3423: note = derived and/or modified CDS sequence (opt3) from SNV(CC107/POR)__KT885045.1__GP
  source 1..3423: mol_type = other RNA
atggtgggctgggtctgcatcttcctggttgtgctcaccacagccactgctgggcttacgagaaacctgtacgagttgaagattgaatgtccccacaccgtaggattaggtcagggctatgtgacagggagcgtcgagactacccctatactgctaacacaagtggcagacctcaaaatcgaatcctcttgcaattttgatctgcatgttccagccaccactacacagaagtacaaccaggtggactggaccaaaaagtcaagtacgactgagagcaccaatgcgggagctacaactttcgaagccaaaaccaaggaggtcaaccttaagggcacatgtaatattccgcccaccacgtttgaggcagcctataaatccaggaagactgtgatctgctacgatctggcttgtaaccagacacactgcttgcctaccgtacatctcattgcaccagttcaaacttgtatgtctgtgcggtcgtgcatgatcggtctgctgtcaagccgcatacaggtcatctatgagaaaacatactgtgtgaccgggcagctcattgagggattatgcttcatccccacgcacaccattgccctgacacagcctggccatacttatgacaccatgacacttccagtgacttgttttcttgtcgctaagaaactgggcacccaactaaagctcgccgttgaactggagaagttgatcacaggggtgagttgcaccgaaaattccttccagggatactacatatgctttattggtaaacactctgaacccctgttcgtacctactatggaggattatcgaagcgcggaattgtttacgcgtatggtgctcaacccaagaggcgaggaccacgatccggaccagaatgggcagggactgatgaggatcgcaggccccgtcacagccaaggtgccttccaccgaaactaccgagacaatgcaaggtattgctttcgccggggcaccaatgtactcaagttttagcaccttagttcggaaagctgatcccgagtatgtgttctctcctggaatcatcgccgaatccaaccattcagtctgtgacaagaaaactgtgccactgacatggacgggctttctcgcggtaagcggcgagattgaacgcataaccgggtgcactgttttctgtacacttgccggacccggtgcaagttgcgaggcttactctgaaaccggcatcttcaatatttccagcccgacatgtctggtgaacaaggtccagaaatttagagggtcggagcagaggatcaatttcatgtgccaacgggtggatcaggacgtcgtggtttattgtaacggacagaagaaggtgatattgactaaaaccctagtaattggccagtgcatctacacgtttacctctctgttctccctcatccctggtgtcgcccactcactggctgtggagctttgtgttcccgggctgcatggctgggccacaactgcattgctcattaccttttgcttcggatggctgttaatcccaacagtgactctgattatactaaagatcctccgcctgcttacctttagttgtagccactattccacggaatctaaattcaaggtcattttggagcgagtgaaagtagaataccaaaagacaatgggcagcatggtgtgcgatatctgccaccatgagtgtgaaaccgccaaggagctggagactcacaaaaagtcatgccctgaagggcagtgtccctactgcatgacaatcaccgagagtactgaatccgctctccaggcgcattttagcatttgtaaactgaccaatagattccaggagaaccttaagaaatctctgaagaggccagaggttcggaagggatgctatcgtacattgggtgtctttcgctacaaatcaagatgttatgtgggcctcgtgtgggggatactgttaacgaccgaactgatcatttgggcagccagtgctgacactcccctaatggagagcggatggtccgacacagcccacggcgtcggtatcgttcctatgaagaccgatctcgaactggacttcgcacttgcctcttcgagctcctactcatataggcggaaattggtgaacccagctaatcaagaggaaacactgccgtttcatttccagctcgataaacaggtggtacacgccgagattcagaacctggggcactggatggacggcactttcaatatcaagaccgcatttcattgctacggagagtgtaagaagtatgcgtacccctggcaaacggctaaatgcttctttgaaaaggattaccagtatgagacaagttggggctgtaaccctccagactgccccggggtcggaaccggttgcactgcctgtggcgtgtacttagataaactgcgatctgttgggaaggcatataaaatagtgagccttaagtacacccgcaaagtctgcatccagttgggaacagaacagacttgtaagcacattgacgtgaatgattgcctcgttaccccttccgtgaaggtatgtatgatcggcacaatttcaaaactgcaaccaggtgacacgctactgttcctcgggcccctggagcagggcggaatcatacttaagcagtggtgcaccactagctgtgtctttggcgatccgggggacattatgtctacaacctccggaatgagatgccctgaacatactggcagtttcaggaaaatctgtggttttgccacaaccccaacgtgcgagtatcaagggaacactgtgagcggattccagcggatgatggctacccgcgactcttttcagtccttcaatgtgacagagccccacattacctcaaacagattggaatggatcgatcctgacagtagcataaaggatcacatcaatatggtcctgaacagggacgtttcgtttcaggatttatccgacaatccctgtaaagtggatctccatactcaatctattgacggcgcctggggtagcggcgtagggttcacactggtgtgcaccgtcggacttacagagtgcgcaaactttatcacttcaattaaggcttgtgatagtgccatgtgctacggcgcgaccgtgacgaatctgttgcgtgggtccaacacagttaaggtggtcggaaaaggcggtcactctgggagcctcttcaagtgttgccatgacaccgattgtactgaagagggactggccgcttccccacctcacctagaccgggtgaccggctataatcagatcgattcagacaaagtttacgacgatggtgcacccccatgcacaataaagtgttggttcactaaaagcggcgaatggctgctcgggattctgaacggaaactgggtggtcgtagccgtgcttatcgttatcttgattctgagtatcttactcttttctttcttttgcccggtgcgaaatagaaagaacaaggctaattga

SEQ ID NO: 10246 - RNA, 3423 nt, synthetic construct
  misc_feature 1..3423: note = derived and/or modified CDS sequence (opt3) from HPS(Convict Creek 107)__L33474.1__GP
  source 1..3423: mol_type = other RNA
atggtgggctgggtctgcatcttcctggttgtgctcaccacagccactgctgggcttacgagaaacctgtacgagttgaagattgaatgtccccacaccgtaggattaggtcagggctatgtgacagggagcgtcgagactacccctatactgctaacacaagtggcagacctcaaaatcgaatcctcttgcaattttgatctgcatgttccagccaccactacacagaagtacaaccaggtggactggaccaaaaagtcaagtacgactgagagcaccaatgcgggagctacaactttcgaagccaaaaccaaggaggtcaaccttaagggcacatgtaatattccgcccaccacgtttgaggcagcctataaatccaggaagactgtgatctgctacgatctggcttgtaaccagacacactgcttgcctaccgtacatctcattgcaccagttcaaacttgtatgtctgtgcggtcgtgcatgatcggtctgctgtcaagccgcatacaggtcatctatgagaaaacatactgtgtgaccgggcagctcattgagggattatgcttcatccccacgcacaccattgccctgacacagcctggccatacttatgacaccatgacacttccagtgacttgttttcttgtcgctaagaaactgggcacccaactaaagctcgccgttgaactggagaagttgatcacaggggtgagttgcaccgaaaattccttccagggatactacatatgctttattggtaaacactctgaacccctgttcgtacctactatggaggattatcgaagcgcggaattgtttacgcgtatggtgctcaacccaagaggcgaggaccacgatccggaccagaatgggcagggactgatgaggatcgcaggccccgtcacagccaaggtgccttccaccgaaactaccgagacaatgcaaggtattgctttcgccggggcaccaatgtactcaagttttagcaccttagttcggaaagctgatcccgagtatgtgttctctcctggaatcatcgccgaatccaaccattcagtctgtgacaagaaaactgtgccactgacatggacgggctttctcgcggtaagcggcgagattgaacgcataaccgggtgcactgttttctgtacacttgccggacccggtgcaagttgcgaggcttactctgaaaccggcatcttcaatatttccagcccgacatgtctggtgaacaaggtccagaaatttagagggtcggagcagaggatcaatttcatgtgccaacgggtggatcaggacgtcgtggtttattgtaacggacagaagaaggtgatattgactaaaaccctagtaattggccagtgcatctacacgtttacctctctgttctccctcatccctggtgtcgcccactcactggctgtggagctttgtgttcccgggctgcatggctgggccacaactgcattgctcattaccttttgcttcggatggctgttaatcccaacagtgactctgattatactaaagatcctccgcctgcttacctttagttgtagccactattccacggaatctaaattcaaggtcattttggagcgagtgaaagtagaataccaaaagacaatgggcagcatggtgtgcgatatctgccaccatgagtgtgaaaccgccaaggagctggagactcacaaaaagtcatgccctgaagggcagtgtccctactgcatgacaatcaccgagagtactgaatccgctctccaggcgcattttagcatttgtaaactgaccaatagattccaggagatacttaagaaatctctgaagaggccagaggttcggaagggatgctatcgtacattgggtgtctttcgctacaaatcaagatgttatgtgggcctcgtgtgggggatcctgttaacgaccgaactgattatctgggcagccagtgctgacactcccctaatggagagcggatggtccgacacagcccacggcgtcggtattgttcctatgaagaccgatctcgaactggacttcgcacttgcctcttcgagctcctactcatataggcggaaattggtgaacccagctaaccaagaggaaacactgccgtttcatttccagctcgataaacaggtggtacacgccgagatccagaatctggggcactggatggacggcactttcaacataaagaccgcatttcattgctacggagagtgtaagaagtatgcgtacccctggcaaacggctaaatgcttctttgaaaaggattaccagtatgagacaagttggggctgtaatcctccagactgccccggggtcggaaccggttgcactgcctgtggcgtgtacttagataaactgcgatctgttgggaaggcatataaaatcgtgagccttaagtacacccgcaaagtctgcattcagttgggaacagaacagacttgtaagcacatcgacgtgaacgattgcctcgttaccccttccgtgaaggtatgtatgattggcacaatctcaaaactgcaaccaggtgacacgctactgttcctcgggcccctggagcagggcggaataattcttaagcagtggtgcaccactagctgtgtctttggcgatccgggggacatcatgtctacaacctccggaatgagatgccctgaacatactggcagtttcaggaaaatttgtggttttgccacaaccccaacgtgcgagtatcaagggaatactgtgagcggattccagcggatgatggctacccgcgactcttttcagtccttcaacgtgacagagccccacatcacctcaaatagattggaatggatagatcctgacagtagcatcaaggatcacattaacatggtcctgaatagggacgtttcgtttcaggatttatccgacaacccctgtaaagtggatctccatactcaatctatcgacggcgcctggggtagcggcgtagggttcacactggtgtgcaccgtcggacttacagagtgcgcaaattttattacttcaatcaaggcttgtgatagtgccatgtgctacggcgcgaccgtgacgaacctgttgcgtgggtccaatacagttaaggtggtcggaaaaggcggtcactctgggagcctcttcaagtgttgccatgacaccgattgtactgaagagggactggccgcttccccacctcacctagaccgggtgaccggctataaccagatagattcagacaaagtttacgacgatggtgcacccccatgcacaattaagtgttggttcactcgaagcggcgaatggctgctcgggatcctgaatggaaactgggtggtcgtagccgtgcttatcgttattttgatcctgagtattttactcttttctttcttttgcccggtgagaaacaggaaaaataaggctaactga

SEQ ID NO: 10247 - RNA, 3423 nt, synthetic construct
  misc_feature 1..3423: note = derived and/or modified CDS sequence (opt3) from HPS(Convict Creek 74)__L33684.1__GP
  source 1..3423: mol_type = other RNA
atggtgggctgggtctgcatcttcctggttgtgctcaccacagccactgctgggcttacgagaaacctgtacgagttgaagattgaatgtccccacaccgtaggattaggtcagggctatgtgacagggtctgtcgagactacccctatactgctaacacaagtggcagacctcaaaatcgaatcctcttgcaattttgatctgcatgttccagccaccactacacagaagtacaaccaggtggactggaccaaaaagtcaagtacgactgagagcaccaatgcgggagctacaactttcgaagccaaaaccaaggaggtcaaccttaagggcacatgtaatattccgcccaccacgtttgaggcagccttcaaatccaggaagactgtgatctgctatgatctggcttgtaaccagacacactgcttgcctaccgtacatctcattgcaccagttcaaacttgtatgtctgtgcggtcgtgcatgatcggtctgctgtcaagccgcatacaggtcatctacgagaaaacatattgtgtgaccgggcagctcattgagggattatgctttatccccacgcacaccattgccctgacacagcctggccatacttacgacaccatgacacttccagtgacttgtttcttggtcgctaagaaactgggcacccaactaaagctcgccgttgaactggagaaacttatcacaggggtgagttgcaccgaaaattcctttcagggatattacatatgcttcattggtaagcactctgaacccctgtttgtacctactatggaggattaccgaagcgcggaattgttcacgcgtatggtgctcaacccaagaggcgaggaccacgatccggaccagaatgggcagggactgatgaggatcgcaggccccgtcacagccaaggtgccttccaccgaaactaccgagacaatgcaaggtattgcttttgccggggcaccaatgtattcaagtttcagcaccttagttcggaaagctgatcccgagtacgtgttttctcctggaatcatcgccgaatccaaccattcagtctgtgacaagaaaactgtgccactgacatggacgggcttcctcgcggtaagcggcgagattgaacgcataaccgggtgcactgttttctgtacacttgccggacccggtgcaagttgcgaggcttattctgaaaccggcatctttaatatttccagcccgacatgtctggtgaacaaggtccagaaattcagagggtcggagcagaggatcaattttatgtgccaacgggtggatcaggacgtcgtggtttactgtaacggacagaagaaggtgatattgactaaaaccctagtaattggccagtgcatctatacgttcacctctctgttttccctcatccctggtgtcgcccactcactggctgtggagctttgtgttcccgggctgcatggctgggccacaactgcattgctcattaccttctgctttggatggctgttaatcccaacagtgactctgattatactaaagatcctccgcctgcttaccttcagttgtagccactactccacggaatctaaatttaaggtcattttggagcgagtgaaagtagaatatcaaaagacaatgggcagcatggtgtgcgatatctgccaccatgagtgtgaaaccgccaaggagctggagactcacaaaaagtcatgccctgaagggcagtgtccctactgcatgacaatcaccgagagtactgaatccgctctccaggcgcatttcagcatttgtaaactgaccaatagatttcaggagatacttaagaaatctctgaagaggccagaggttcggaagggatgctaccgtacattgggtgtcttccgctataaatcaagatgttacgtgggcctcgtgtgggggatcctgttaacgaccgaactgattatctgggcagccagtgctgacactcccctaatggagagcggatggtccgacacagcccacggcgtcggtattgttcctatgaagaccgatctcgaactggactttgcacttgcctcttcgagctcctattcatacaggcggaaattggtgaacccagctaaccaagaggaaacactgccgttccatttccagctcgataaacaggtggtacacgccgagatccagaatctggggcactggatggacggcacttttaacataaagaccgcattccattgctatggagagtgtaagaagtacgcgtatccctggcaaacggctaaatgctttttcgaaaaggattaccagtacgagacaagttggggctgtaatcctccagactgccccggggtcggaaccggttgcactgcctgtggcgtgtatttagataaactgcgatctgttgggaaggcatacaaaatcgtgagccttaagtatacccgcaaagtctgcattcagttgggaacagaacagacttgtaagcacatcgacgtgaacgattgcctcgttaccccttccgtgaaggtatgtatgattggcacaatctcaaaactgcaaccaggtgacacgctactgtttctcgggcccctggagcagggcggaataattcttaagcagtggtgcaccactagctgtgtcttcggcgatccgggggacatcatgtctacaacctccggaatgagatgccctgaacatactggcagttttaggaaaatttgtggtttcgccacaaccccaacgtgcgagtaccaagggaatactgtgagcggatttcagcggatgatggctacccgcgactctttccagtcctttaacgtgacagagccccacatcacctcaaatagattggaatggatagatcctgacagtagcatcaaggatcacattaacatggtcctgaatagggacgtttcgttccaggatttatccgacaacccctgtaaagtggatctccatactcaatctatcgacggcgcctggggtagcggcgtagggtttacactggtgtgcaccgtcggacttacagagtgcgcaaatttcattacttcaatcaaggcttgtgatagtgccatgtgctatggcgcgaccgtgacgaacctgttgcgtgggtccaatacagttaaggtggtcggaaaaggcggtcactctgggagcctcttcaagtgttgccatgacaccgattgtactgaagagggactggccgcttccccacctcacctagaccgggtgaccggctacaaccagatagattcagacaaagtttatgacgatggtgcacccccatgcacaattaagtgttggtttactaaaagcggcgaatggctgctcgggatcctgaatggaaactgggtggtcgtagccgtgcttatcgttattttgatcctgagtattttactcttcagctttttctgcccggtgcgaaacagaaagaataaggctaactga

SEQ ID NO: 10248 - RNA, 3423 nt, synthetic construct
  misc_feature 1..3423: note = derived and/or modified CDS sequence (opt3) from BRV(Indiana)__AF030551.1__GP
  source 1..3423: mol_type = other RNA
atggtgggctgggtctgcatcttcctggttgtgctcaccacagccactgctgggcttacgagaaacctgtacgagttgaagattgaatgtccccacaccgtaggattaggtcagggctatgtgacagggagcgtcgagactacccctgtgccactgggacaagttacagacctaaaaatagaatcctcttgcaattttgatctccatgtgccgtcaaccactatccagaagtacaaccaggtcgagtgggctaaaaagacaagtaccacggaaagcactaatgccggcgcgtccaccttcgaggctaaaacaaaggaggtgaacctgaagggtacttgtaatattcccgtaaccacatttgaagccgcatataaatctaggaagaccgttatctgctacgaccttgcctgtaaccagacgcactgcctgcctactgtgcatttgattgctccagtccaaacatgtatgtcggtgcggtcatgcatgatcgggctcctgagcagtcgcatacacgtgatctatgagaaaacctactgtgtcactggacaggttgtggaaggcctgtgcttcattcccacacataccatcgcactcacgcagcctggccacacctatgatacaatgactttaccaattacctgttttctggtagccaagaaacttgggacacagttgaagatcgctgtggagctggagaagctaataactgcctccggatgcaccgaaaattctttccaaggttactacatttgctttctcggcaaacacagcgagcccctgtatgtccctacaatggacgattaccgatccgcggaacttttcacccgtatggtgctgaacccaaagggggaggaccatgatccggaccaggatggacagggcttgatgagaatcactggtcccattacggcaaaagttccttcaacagaaaccactgagaccatgcagggggtggcctttgctggaacaccaatgtatagtagcttctctaccctcctgaggaaggccgaccccgagtacgtcttttcccctggcatcatcccagaatcaaatcacagcgtgtgtgataaaaagactatgcccattacatggacgggcttcttagcagtaagtggggagatagaaaagatcaccggatgcactgttttctgtacactggctggtccgggcgcctcttgcgaggcgtattccgaaaccgggattttcaacatcagctcgcctacatgtctcgtgaataaggtccaaaagttccggggatctgagcagcgcgtgaactttatgtgccagagagtcgaccaagatgtggttgtgtactgtaatggccagaaaaaggtaatacttactaaaaccctggtcattggtcagtgcatctatacgttcacctccttgttttcactactgcccggggtggcccatagtctcgcagttgagctgtgtgtgccaggccttcacggatgggctacaactgccctgttgatcaccttctgctttggctggctcctgattcctagcgtcacattaatcattctgaggatactacggctcctgactttctcctgttctcactacagcaccgaatcaaagtttaaaatccttttggagaaggtgaaggtagaataccagaaaacgatggggagtatggtgtgcgacatttgccatcacgagtgtgaaacagctaaggagctggacacccatcgcaaatcctgccccgagggacaatgtccatattgcatgactatgacagaaagcaccgagtctgccctccaggcacacttctcagtttgtaagctgactaaccgatttcaggaaaatcttaaaaagagtctgaagcatcccgaggtcaaacagggttgctacagaaccttgggcgtgttcaggtataagagccggtgttacgtggggctcgtctggggaatcctgttaacagccgagctgatcatttgggctgcgtccgcagaaacgcctctaatggagtctggctggtcggataccgcccacggtgttgggatagtgccaatgaaaactgacctcgaactggattttgctcttgccagctcctcaagttattcttaccgtcgcaagttggtgaacccggcaaacagcgaggaaacactgcccttccacctccaactggagaaacaggtagtccatgccgagatccacaatttaggccattggatggacggaacctttaacattaagacagctttccactgctatggcgaatgtaagaaatacgcctacccttggcagactgcaaagtgcttctttgagaaagattatcagtacgaaacctcctgggggtgtaatccacccgactgccctggagtgggtacgggctggacagcgtgcggggtttatctggataaacttagatcagtgggaaaagcatacaagatcgtcagcttgaaatataccaggaaggtgtgtattcaactcggcactgagcagacctgcaagcacatcgacgttaacgattgtctggtgacaccatctgtaaaagtctgcatgataggtactgtgtccaagctacagcccggggacaccctgctctttctgggcccgcttgaacagggaggcatcattttgaaacaatggtgtacaacgagttgcgtgtttggggatcctggagacatcatgagcaccacttctggcatgaagtgtccagagcatacaggttccttccggaaaatttgcgggtttgccaccactcccacatgtgagtaccagggaaataccgtctcaggcttcaagcgaatgatggcaacgcgcgacagttttcagagcttcaacgttactgaacctcacatcacctcgaatagactggagtggatagatcccgactcctctattaaggatcatatcaacgtggtattaaatagggacgtgagctttcaagatctctcagacaacccatgcaaagtcgatctgcacacacagagtattgacggtgcctggggctccggggtgggattcacccttgtttgtactgtgggcctgacagaatgcgctaattttatcacctctataaaggcctgcgatttggcaatgtgttatggggctacagtcactaacctcctgcggggaagcaataccgtgaaagttgtgggcaagggtgggcattccggatcactattcaaatgctgtcacgacacggattgcacagacgagggcctggccgcgagccctccccacctcgatcgcgtcaccggttttaaccagatcgacagtgacaaggtatacgatgacggcgccccaccgtgttctgtgaagtgctggttcactaaatccggggaatggctgcttagaattttgaatggaaactggatggttgtggctgtcctgatcgtgattttaatcctcagcatactgcttttctcgtttttctgtcctattaggtcacgtaagtctaaacccaactga

SEQ ID NO: 10249 - RNA, 3423 nt, synthetic construct
  misc_feature 1..3423: note = derived and/or modified CDS sequence (opt3) from BRV(Oklahoma)__AF030552.1__GP
  source 1..3423: mol_type = other RNA
atggtgggctgggtctgcatcttcctggttgtgctcaccacaagcactgccgggcttacgagaaacctgtacgagttgaagattgaatgtccccacaccgtaggattaggtcagggctatgtgacagggtccgtcgagataactcctgtgccactgggacaagttaccgacctaaaaatcgaatcttcatgcaattttgatctccatgtgccgagtacaaccattcagaagtacactcaggtcgagtgggctaaaaagagctccacaaccgaatctacgaacgcagccgcgactaccttcgaggctaaaacaaaggaggtgtcgctgaagggcacttgtaatatccccgtaaccacatttgaagccgcatataaatcaaggaagaccgttatttgctacgaccttgcctgtaaccagacgcactgcctgcctactgtgcatttgatcgctccagtccaaacatgtatgagcgtgcggagttgcatggtgggtctcctgtcctctcgcatacaggtcatctatgagaaaacctactgtgttactgggcagctggtggaaggactctgcttcattcccacacacaccatcgcattaacgcagcctggccatacctatgatacaatgactctgccaattacctgttttcttgtagccaagaaattgggcacacaactgaagatcgctgtggagctagagaagctcataactgccagcgggtgcaccgaaaattccttccagggatactacatttgctttctgggtaaacactcagagcccatgtatgtccctacaatggacgattaccgaagtgcggaacttttcacccgtatggtgctgaacccaaagggcgaggaccacgatccggaccagaatgggcagggattgatgagaatcgcaggccccattactgccaaagttcctagcacggaaacaaccgagactatgcaaggtatcgcttttgccggggcaccaatgtattctaccttcgctacactcgtgaggaaggccgatcccgagtacgtcttttcccctggaatcattccagaatcaaaccatagcgtgtgtgacaaaaagaccatgcccataacttggacaggcttcctggcgttaagtggcgagatcgaacggattacggggtgcaccgtattttgtactctggccggaccgggtgcatcttgcgaggcttattccgaaacaggcatcttcaatataagctcgcctacctgtctcgttaacaaagtgcagaagttccgcgggtctgagcagagaattaattttatgtgccaaagggtcgatcaggacgtggtcgtgtactgtaacggacagaagaaagttatccttacaaagactctggtgatcggccagtgcatttataccttcacgtccttgttttcactactgcccggtgtagcccacagtctcgctgtcgagctgtgtgtgccagggcttcatggctgggccaccacagcactgttgatcactttctgctttggatggctcctgattcctgccataaccttaatcgttctgaaaattctacggctcctgacattcagctgttcccactactctaaggaaagccgctttaaaatccttttggagaaggtgaaggtcgaataccagaaaactatgggctcaatggtgtgcgatatctgccaccatgactgtgagaccgctaaggaactggacacgcacaaaaagagttgccccgaggggcaatgtccatattgcatgacaatgaccgagtccactgaaagcgcgctccaggcacatttctctgtatgtaaactgacaaatcgatttcaggagaaccttaagaagtcactgaaacaccccgaagtgaagcaaggatgctacagaaccttgggtgttttcaggtataaaagtcggtgttacgtcggcctcgtgtgggggctgttactgactaccgagctaattatatgggccgctagcgccgagacacctctcatggaatccggatggtctgatacggcacatggcgtgggtatcgtcccaatgcgtaccgacctggagcttgattttgccttggcttcgagctcctcatatagttaccgcagaaagctggttaatccggccaacactgaagagacactccccttccatctgcagttagaaaaacaggtggtgcacgcagagattcagaacctggggcactggatggacggcacctttaatatcaagacagcgttccactgctatggagagtgtaagaaatacgcttacccttggcaaactgccaagtgcttctttgaaaaagattatcagtacgagacctcttggggctgtaacccacccgactgccctggggtaggaacgggttgcacagcatgtggcgtctatcttgataagttgaggagcgtggggaaagcctacaagattgtttccctcaaatatacccggaaggtgtgcatccagctgggaactgaacagacctgtaagcatatagacgtcaatgattgcctagtgtcaccaagcgttaaagtgtgtatgatcggcacagtatctaagctgcaacccggtgacactctcctgttccttgggccgttggagcagggcggaattatcctgaaacagtggtgcaccacatcctgtgtctttggcgatcctggggacattatgagtacgaccagcggaatgcgatgcccagaacacactggctctttccgcaagatctgtggttttgctacaacccccacttgcgagtaccaagggaacacaatatccggattcaaaagaatgatggccaccagggactcatttcagagtttcaatgtgacggagcctcacattactagcaaccggttagaatggatcgatcccgactcgtccattaaggatcatatcaatgtggtcctcaaccgcgacgtttcttttcaggatctgagcgacaatccatataaggtggatcttcacacccagtcaatagacggcgcatggggtagtggcgtagggttcacactggtgtgtatcgtcggattgaccgagtgcgctaactttattacttccatcaaagcctgcgatatggcgatgtgttacggcgccacagtgaccaatctcctgagagggtctaacacagttaaggtggtcggaaaaggcggtcatagcgggtccctattcaagtgctgtcacgacactgattgcaccgaagagggactggctgcatcacctccccatctcgacagggtgacgggctacaatcaaattgatagcgacaaagtttgtgacgatggtgccccactgtgcagtgtgaagtgttggtttacaaagtctggcgaatggcttttggggatcctgaacggaaattggatggtcgtagctgtgttagttgtgatactcattctgtccatccttctgttcagcttcttttgcccgatccgttcgaaaaagtcaaaacctaactga

SEQ ID NO: 10250 - RNA, 3399 nt, synthetic construct
  misc_feature 1..3399: note = derived and/or modified CDS sequence (opt3) from THAIV(Thai749)__L08756.1__GP
  source 1..3399: mol_type = other RNA
atgtggggcctgctcgtgattgccgtccttgttgggcccggattcgctattaagaacgtgtacgacatgaaaatagagtgccctcacagcgtaaattttggtgaaacctccgtgacaggccaggtcgagctgccagcattgccgatcactgaagccgagcaattagtgcccgaatcttcatgtaacatggataatcatcagagtctggcgacgattaacaccctaacaaaggttagctggagaaagaaggctgaccaggtgtccgcctctcaaaattcgttcgaggtcatcgaggcagaaacttcatttaaagggctctgcatgctgaagcacaggatgattgaggagagcttcaagaaccggcgcagtgtgatctgttatgatctttcctgcaataccacattttgtaaacctaccgtatacatggttgtgccagtccatgcctgcaacatgatgaagtcttgtctggtgggattgggcccctatcgagtgcaggtcgtttacgagcgtacttattgcacagtgggtatactcaccgaggggaaatgtttcatccctgacaagacgattctgagctccatcaaaagaggaatgtttgtagtgacttcagtccaggtgctgtgcttctttattgttcagaagggccacagttacaagatcatggatgaagtgaaaaagagcatgatgaataaatgtaacgacaccgagaataaggtccagggctattacatatgcattctcgggggaaactctgctccagtgtacgtaccctccttagatgacttcaggtcaatggaaatctttagcaatatgctgcggagtcctttcggtgaggatcatgaccttccaggcgaagagttttctacatatcaaattgcagggccgactgaggccaaagttccccacaccgcttccagcaagaacttggccctgatcgcgtactcgggaaatccttcttattcctcactaagtctcatcacaagctcccaggatggccgctacgtgttctctccaggtctgttccccaaccttaaccagacccagtgcgagaaaaatgcactgcctatggtctggagagggatgattgacttgagcggatattacgaagccatacacccatgtaacatcttttgcgtgctctcaggccccggcgctagttgtgaagccttctccgaagggggaatttttaatatcacgagcccgacttgcctggtctctaagcaaaacaggttccgggcagctgaacagcagataaattttgtgtgtcaacgcgttgatatggacattgtggtatattgcaacggtcagaagaaaacaatcttaaccaagactctgatcattggccagtgtatctacacaattacctcactcttcagtcttctgcctggggtcgcccatagcatagcgatcgagttgtgcgtgcccggatttcacggctgggccacggcagctctactgattaccttctgttttggttggatcctcatcccaacaattactctggccgttcttgtggtcctgaaattcatagctaatatcttgcataccaactcccaggagaatcgatttaagctcattctgaaaaaggtgaaggaagagttcgagaaaacaaaggggtctatggtatgcgaagtgtgtaaatacgaatgcgagacttcgaaggagttaaaagcccacaacctgagctgccctcaatccaagtgtccctattgctttacccactgtgaaccaacagaggcaaccttcaaggcccattacaaagtttgccaggctactcacagattcagggaagacctaaagaaaacggtcacaccccagaccgtgggccctggatgttatcggactctcaatctgtttcgttacaagtcacgctgctatatccttaccatgtggttgttcctgctcagtattgagtctatcatgtgggcggcaagcgccgctgagataccactggtgccgctttggacagataacgcccatggcatcgggtccgtccccatgcacaccgacctggaattggatttttcactcccttctagctccaaatacacttataagagaaagctgacaaatccagttaacacggagcagggagtgcaattacatattgaaatcgaggaacagggtattggcgcagacgtgcaccacctggggcattggttcgatgccaggctaaatctcaaaaccagttttcactgttacggagcttgcagcaagtaccagtatccctggcatactgccaaatgtcacttcgagaaggactacgagtatgaaaactcttgggcatgcaaccctgcggattgtccaggcgtaggtacagggtgcaccgcttgcggcctgtaccttgaccagatgaaacccatcggaacagcctataagttggtcgcaatacggtactcccgaaaagcctgtgtgcaatttggcgaggaacacctgtgcaagactattgatatgaatgactgtttcgttacccgccatgtgaagatctgcattatcgggacggtctcaaaatttatacagggagataccctcctgttcttaggtccgctggagggcgggggacttatctttaagcactggtgtacaagtacttgccagttcggcgaccctggtgacattatgagcccaaaagataagccctttttgtgtcctgagttccccgggcagttcaggaaaaagtgcaactttgctaccacaccagtgtgtgaatatgacggcaatcaaatctcgggatacaagaaaatgaaggccactattgattccttccagtcttttaacaccagctcaatccatttcacggacgagagactcatggaagatcctgacggcatgctgcgggatcacataaatattgttgtgacaaaagacatcgattttgagaacctagcagaaaatctgtgcgggatcggactccaggtaagtgctattaagggcgcctggggttccggggtcggattcaccctgacttgtcaagtgtctcttacagagtgccccacctttttgactagcatcaaagcgtgcgacatggccatttgttacggcgctgaatccgtgaccctggtccgcggtcagaacacagttaagatatcaggcaaagggggacatagcggcagttctttcaaatgctgtcacggggtggattgctccagcaatggattacaggcaaacccaccgcacctcgacagagtagccggcgtgtcggagctgacgaatgagaaggtctatgatgacggtgctcctcagtgtgggatcgcctgctggtttattaaatcaggagaatgggtgaagggcatcttctctggtaactggattgttcttatcgtgctgtgtgtcttgctcctgataagtctaatcctgctcggcatcttttgccccgtgaggaaacataagaagtcctga

SEQ ID NO: 10251 - RNA, 3426 nt, synthetic construct
  misc_feature 1..3426: note = derived and/or modified CDS sequence (opt3) from TULV(Moravia/5302v/95)__NC_005228.1__GP
  source 1..3426: mol_type = other RNA
atgttctgcctgtgtctcagccttctgggcttgttactgtgctggcccgccgctaccagaaacctactcgagctgaaggtggaatgtcctcacacaatcgggcttggacagggtattgtcataggctccgcagagctgccaccggttcccttggccaaagtggaatctctcaagctggagtcaagttgcaattttgacctgcatactagcacggcggctcaacaggccttcaccaaatggtcctgggaaaagaaagcagatacagccgagaacgctaaggcagcctctactacctttcagtcgtcaagcaaggaggtacagctcagggggttatgtgtgatccctacactggtccttgaaaccgctagtcggactcgcaaaacagtgacctgcttcgacttgtcctgtaatcaaacggtttgccagccaactgtgtacctgatggcccccattcagacctgtgtcacaactaagtcttgcctactcggactgggcgatcagcgaatccaagtggtatatgagaaaacctactgtgttagcggtcagcttattgaagggaactgctttaatcctctgcacacaatcgcgatatcccagccaacccatacgtatgacatcatgactttggcagtgcactgcttctttatttcaaagaaaggaggcacagatgacaccctcaagatcgagaagcagttcgagactctggtcgagaaaacaggctgtaccgaaaacgccttaaaggggtactatgcttgcattctgggaacgagtagcgaagtggtgtacgtccccgccatggatgactatcgttcttccgagatcctctcaagaatgaccacagcacctcatggtgaagatcacgacatagatccaaatgctattagcagtcttaggatcgttggccaactgactgggaaagccccgtctaccgagtccagcgacacagtgcagggaattgcgtttgccggcactcccttgtacacctcgacatctatcctagtacggaaggaggatcctatctacctgtggtccccaggtattatacccgaagggaaccactcacagtgtgacaaaaagaccctccctctgacttggacgggattcatcacacttccaggcgagattgaaaagaccactcaatgcaccgtgttttgtacactgagtggccccggggcagactgcgaggcttatagcgataccggaatcttcaatatatcctctccgacttgtttggtcaaccgcgtgcagagatttaggggtgccgaacagcaggttaaattcgtgtgccaacgggtcgacctcgatattacagtgtactgtaatggcgtaaagaaagttatcctgacgaagaccttagtgatcgggcagtgcatttatactttcacaagcatcttttcactgatgcctggagtcgctcatagtctagccgtggagctctgtgtccccggcctgcacggttgggcaaccatttcccttttgataacattctgctttgggtggctggccatcccactcctgagcatgattatcatccgcttccttctgatttttacttacttgtgctctaaatattcaaccgacagtaagttcaaactcataatcgagaaggtgaagcaggaataccagaaaacgatgggcagcatggtttgtgaggtgtgccaacagggatgtgaaaccgctaaggagctggaatcccataaaaagtcttgccctcacggccagtgtccctattgcttaaacccaacagaggcgactgagtcggcactgcaggcccactttaaagtatgtaagctaaccacacgattccaagaaaatctcaagaaaagcctgtccacttacgagcccaagagagggctttacaggaccttgtcaatgtttcggtataaaagtaagtgctacgtcggactggtgtggtgtattctcctgacgatggaattaatcgtttgggctgcctctgcagagacaattaacctggagcctggttggaccgatactgcccatggcagcgggatcataccacttaaaacagacttggaactcgatttctccctgccgtcaagcgctacctatacttaccgtcgcgagctacagaatcccgccaacgaacaggagaagatcccttttcacttccagatggaaagacaagtgattcatgcagagatccagcacctgggacattggatggacggcacctttaacctcaagacagcgttccactgctatggttcttgtattaaatacgcttatccatggcagacggccaagtgcttcctggagaaagattttgaatttgagaccgggtggggctgcaatccccctgactgtccaggagtcggcactgggtgcacagcatgtggagtgtaccttgataagttgaggtccgtaggtaaagtgtacaagatcctgagtttaaaatatacccggaaggtttgcatacaactcggcacagaacagacttgtaagaccattgacagcaacgactgcctggtcacgacatctgtgaaagtgtgtatgatcgggaccatttccaagtttcagcccggagatactcttctgttcttgggcccgctcgaggaaggtgggatgatctttaaacagtggtgcaccacaacttgtcaattcggcgaccctggagatataatgtcaaccccactgggcatgaagtgccccgagcacgccgggagttttcgcaaaaagtgtagcttcgctacactaccttcgtgccagtacgacggaaatacggtctccggctatcagcgaatgatcgccaccaaggattcttttcagagcttcaacattactgagccccatatcacaaccaattcactggaatgggttgacccagatagttccctcaaagaccacgtgaacctgattgtgaatagagatctttcttttcaagacttggcagagaacccttgccaggtagatctgagcgtctcctcaatcgacggtgcttgggggagcggagtgggcttcaatttagtttgtagtgtgtctctcactgaatgcgcctcctttctgacaagcataaaggcgtgtgattcggccatgtgctacggttcatctaccgctaaccttgtcaggggccagaatacggtgcatgttgtggggaaaggaggccacagtgggtccaagttcatgtgttgccacgacaaaaagtgtagcgcaactggactggtagccgctgcaccccatctagaccgggtcaccggctataaccagattgatacaaataaggtgttcgacgatggtgccccacaatgcggggtgcactgttggtttaaaaagtctggagagtggctcctgggcatcttgagcggtaactggatggtcgttgcggtgctgatcgccttattcattttctccctcctgcttttctcactgtgctgtccgcgcagacagaattacaaaaagaacaaatga

SEQ ID NO: 10252 - RNA, 5055 nt, synthetic construct
  misc_feature 1..5055: note = derived and/or modified CDS sequence (opt3) from CCHFV(10200)__U39455.2__GP
  source 1..5055: mol_type = other RNA
atgcacatcagcctgatgtacgccattctctgccttcagctgtgtggcttgggggagacccatggatcccacaacgaaacaagacataataagactgacacgatgaccacacacggtgataacccctcttcagagcctccagtgagtactgctttaagcataaccctggacccgtccacagtcacccccactactcctgcatctggcctagaagggtcgggagaggtttatacctcaccacccatcacgactggcagcctccctctgagtgaaaccacaccagagcttcccgtgactaccggtacagataccctgtccgccggggacgtagatccttctacgcagactgcgggaggcacaagcgctccaaccgtgaggacttccttgcccaattcacccagtacacctagcaccccacaggacacgcatcaccccgtccggaacctcctgtctgtgacctcccctggcccagatgagacatcaactcccagcgggaccggaaaagaaagttctgccacatccagcccgcaccctgtttcgaatcgcccgccaactcctcccgcaaccgcccagggtccaacagagaacgactctcataatgctaccgaacaccccgagtccctgactcagtcagcaacgcctggcctcatgacaagtccaacccaaattgtgcatccgcagagcgccactcccatcaccgtccaggatacacacccttccccaaccaaccgatctaagcgtaatttaaaaatggagattatcctgactcttagccaggggttgaagaaatactatggaaagatactgagactactccaactgacacttgaagaggacacggaaggcctgttggagtggtgcaagaggaacctcggtctggattgtgacgataccttctttcagaaacggatcgaagagttctttattactggggagggacacttcaatgaagtgttacagtttcgcacacccggcaccctgtcaacaactgagagtacccctgctggcctcccaacggccgaacccttcaagtcctactttgcgaaagggttccttagcatcgactctggatattactcagcaaagtgctatagtggtaccagcaactccggcctgcagttgattaatatcacaagacattctactaggatagtagacaccccggggcctaaaattacaaacctaaagactatcaattgtattaacctgaaggcctcgatctttaaagagcaccgggaagttgagatcaacgtgctcctgccacaagtcgctgtgaatcttagcaactgccatgtggtcattaagtcccacgtttgtgattactcactggacatagatggagccgtgcgcttgccccatatctaccacgagggcgtattcattcctggtacctataaaatcgtgatagacaagaaaaataagctcaacgatcgatgcacgctgtttacagactgtgtcattaaagggagagaagtgaggaagggccagagtgttttacggcagtacaagaccgagatccgtatcggaaaagcatctactggcttccgcagactgctaagcgaggaaccctccgatgactgcgtgtcaaggacacaactcctgcggaccgaaactgctgagattcacggggataattatggaggtccaggcgacaagatcaccatttgtaacgggagcacaatagtcgatcagcgacttggatctgagttgggctgctacacgatcaatcgcgtgagatcctttaaactgtgcgaaaacagtgccaccggtaagaattgtgagattgacagcgtacctgttaaatgcaggcaggggtattgtctccggatcactcaggaaggccgcggacatgtgaagctgtctagaggctccgaggtcgtgcttgacgcgtgcgatacatcatgtgagatcatgattcccaaggggaccggagacatactggtcgattgcagtggtggccaacagcacttcttgaaagacaacctcatcgatctggggtgtccaaagattccgttactgggaaaaatggccatctacatttgcaggatgagcaatcatcctaagacaactatggcattcctattttggttctcgtttggctatgtgatcacctgtatactctgcaaagctatcttctacctgcttattatcgttggtacgttggggcgtcggctgaagcagtaccgagaactcaagccccagacatgtaccatttgcgagactaccccagtgaacgccatcgacgctgaaatgcacgatctgaattgctcctataacatatgtccctactgcgcctctagattaacaagcgacggcctggcaaggcacgtaattcaatgtcctaaacgcaaggagaaagtcgaagagactgagctttatttgaatctcgaacggatcccatgggtggttagaaagctgctacaggtgtcagagagtaccggagtcgccctgaaaaggtcctcttggctcattgtgctgcttgtattgtttacagtgagcctgtcccccgttcagtcagctcctatcggccaggggaagacgatagaagcgtaccgcgcacgagagggatataccagcatctgcttattcgtcctcggcagtattctgtttatcgtgtcttgtcttatgaagggtctggtggattccgtcgggaacagcttctttccgggattgtcgatttgcaaaacttgttcaatctctagtataaacggcttcgaaattgagtcccataagtgctactgtagcctcttttgctgtccatattgccggcactgctctacagacaaagagatccataagctgcacctaagcatctgtaaaaagcgtaaaaccggttccaatgttatgctggccgtgtgcaagctcatgtgtttcagagctactatggaagtgtcaaacagggccctgtttattcgcagtatcattaatacaaccttcgtactttgcatattgatcctggcagtctgtgtggttagcacgtctgccgtggagatggaaaacttacccgctggcacttgggagcgggaagaggatctcaccaatttctgccatcaagagtgtcaggtcacagaaaccgagtgcctgtgtccttacgaagcccttgtgctgagaaagccactatttctcgactccactgcaaaagggatgaagaacctgctcaattcaacaagtctggagaccagcttatccattgaggcgccctggggagctatcaacgttcagtctacatacaaacctactgtgtcgaccgccaatattgcactcagctggtcatccgtagaacacaggggcaacaagatcctggtcagtgggcgatctgagagcataatgaaacttgaggaacgcacgggaatctcctgggatctgggcgtggaagacgcctcagagtctaagttgctcacagtgagcgtcatggacctgagtcagatgtattccccggttttcgagtacctaagcggtgatcggcaagtggaagagtggcccaaggctacctgcactggggactgtccagaaagatgcggatgcacctcttcaacatgtctgcacaaagagtggcctcattccaggaattggcgttgcaaccccacttggtgttggggcgtaggtaccggctgcacgtgttgcgggcttgatgtgaaggacctctttacagattatatgttcgtcaaatggaaggtggaatacattaaaaccgaggccatcgtttgtgtggagctgacaagtcaggaacgccagtgcagcttgattgaggcaggaacacggtttaatctgggcccagtcaccatcactttatcggaacctagaaacatacaacagaagttgcccccagagattatcacactgcacccgaggatcgaagaggggttctttgaccttatgcatgtgcagaaggttctgtctgcttccaccgtgtgtaaattgcagagctgcacgcacggagtccctggcgatctccaagtatatcatattggtaatctgctaaagggggacaaagtgaacggacacctgatacacaagatcgagccccatttcaacacttcatggatgagttgggatggctgtgaccttgattactattgcaatatgggtgactggccatcttgcacctacacaggcgttacccagcacaaccatgcctcctttgtgaatctcctgaacattgaaacagattacactaaaaatttccactttcacagcaagcgagtcaccgcgcatggggacacgccccagttggacttaaaggcccggcctacatatggagctggcgagatcactgtgctggtagaagtggcagatatggagctccacaccaaaaagattgagatctcagggctgaaattcgccagtcttgcttgtacaggatgctacgcctgtagctcctctataagctgcaaggtccgcatccatgttgacgaaccagatgagctgaccgtgcacgtgaaatccgacgatcccgacgtcgtggcagcgtcatctagtttgatggccagaaagctagaatttggcactgattcgaccttcaaggctttcagcgccatgcctaaaacatccctgtgtttttatattgttgagagggaacattgcaagtcttgttcagaggaggacacgaaaaagtgcgtaaacactaaactcgaacagccgcaaagcatcctgattgagcacaagggtaccatcatagggaaacaaaattccacatgtaccgcaaaggctagttgctggcttgaatctgtcaagagcttcttttacggactgaaaaacatgttatcaggcattttcggcaatgtgtttatggggatcttcctctttttggccccattcatcctgctcattctgtttttcatgtttggatggcggatccttttctgtttcaagtgctgccgaagaactcgcggtctgtttaaatataggcacttgaaggatgacgaggaaacaggctaccgtcggataattgagaaactaaacaataagaaggggaaaaacaagctgctcgatggagagagattagcagacggcaggatcgccgaactgttctccaccaaaacgcatattggttga

SEQ ID NO: 10253 - RNA, 5055 nt, synthetic construct
  misc_feature 1..5055: note = derived and/or modified CDS sequence (opt3) from CCHFV(IbAr10200)__AF467768.2__GP
  source 1..5055: mol_type = other RNA
atgcacatcagcctgatgtacgccattctctgccttcagctgtgtggcttgggggagacccatggatcccacaacgaaacaagacataataagactgacacgatgaccacacccggtgataacccttcttcagagccaccggtgagtactgctttaagcataaccctggacccctccacagtcacccctactacaccagcatctggcctagaagggtcgggagaggtttatacctcaccccctatcacgactggcagcctcccactgagtgaaaccacacccgagcttcctgtgactaccggtacagataccctgtccgccggggacgtagatccatctacgcagactgcgggaggcacaagcgctccgaccgtgaggacttccttgcccaattcacctagtacaccaagcacaccccaggacacgcaccatcctgtccggaacctcctgtctgtgacctccccaggccccgatgagacatcaactccgagcgggaccggaaaagaaagttctgccacatccagccctcaccccgtttcgaatcgcccacctactcccccagcaaccgcccagggtcccacagagaacgactctcacaatgctaccgaacatcctgagtccctgactcagtcagcaacgccaggcctcatgacaagtccgacccaaattgtgcacccccagagcgccactcctatcaccgtccaggatacacatccatcccccaccaaccgatctaagcgtaatttaaaaatggagattatcctgactcttagccaggggttgaagaaatactatggaaagatactgagactactccaactgacacttgaagaggacacggaaggcctgttggagtggtgcaagaggaacctcggtctggattgtgacgataccttctttcagaaacggatcgaagagttctttattactggggagggacacttcaatgaagtgttacagtttcgcacacctggcaccctgtcaacaactgagagtaccccagctggcctccccacggccgaaccgttcaagtcctactttgcgaaagggttccttagcatcgactctggatattactcagcaaagtgctatagtggtaccagcaactccggcctgcagttgattaatatcacaagacactctactaggatagtagacacccctgggccaaaaattacaaacctaaagactatcaattgtattaacctgaaggcctcgatctttaaagagcatcgggaagttgagatcaacgtgctcctgccccaagtcgctgtgaatcttagcaactgccacgtggtcattaagtcccatgtttgtgattactcactggacatagatggagccgtgcgcttgcctcacatctaccatgagggcgtattcattcccggtacctataaaatcgtgatagacaagaaaaataagctcaacgatcgatgcacgctgtttacagactgtgtcattaaagggagagaagtgaggaagggccagagtgttttacggcagtacaagaccgagatccgtatcggaaaagcatctactggcagccgcagactgctatccgaggaaccatcagatgactgcattagcaggacacaactcctgcggaccgaaactgctgagatccacggggataattatggaggtcctggcgacaagattaccatatgtaacgggtctacaatcgtggatcagcgacttggatccgagttgggctgctacacgattaatcgcgtcagaagtttcaaactgtgcgaaaacagcgccaccggtaagaattgtgagatcgactctgtgcccgtaaaatgcaggcaggggtattgtctccggatcactcaggaaggccgcggacacgttaagctgtccagaggctcagaggtggtccttgacgcgtgcgatacaagttgtgagattatgataccaaaggggaccggagacatcctggtggattgcagcggtggccaacagcattttcttaaagacaacctcattgatctggggtgtccgaagatccctttactgggaaaaatggccatttacatctgcaggatgtcgaatcaccccaagacaactatggcattcctattctggttttccttcggctatgtcataacctgtatcctctgcaaagctatcttttacctgcttattattgtgggtacgttggggaagcgtctgaagcagtaccgggaactcaaaccacagacatgtaccatctgcgagactacccccgttaacgccatagacgctgaaatgcatgatctgaattgctcttataacatttgtccttactgcgccagccgattaacatcagacggcctggcaagacacgtgatccaatgtccaaagaggaaagagaaggtagaagagactgagctttatttgaatctcgaacgcattccctgggtcgtgcggaaactgctacaggttagtgagtccaccggagtggccctgaagagatctagctggctcatcgtcctgcttgtgttgttcacagtatccctgtcacctgtgcagagcgctccgataggccaggggaagacgatcgaagcgtacagggcacgcgagggatataccagtatttgcttatttgttctcggctctatcctgttcattgtctcctgtcttatgaaaggtctggtggatagcgtggggaactcgtttttcccaggattgtcaatctgcaagacttgttctataagttccattaacggctttgaaatcgagagccacaaatgctactgttctctcttctgctgtccctattgccgacattgcagcacagacaaggagatccacaaactgcatctatccatttgtaagaaacggaagaagggttcaaatgtcatgctggccgtttgcaaactcatgtgttttcgtgctaccatggaagtgagtaacagagccctgttcatcaggagcattataaatactacatttgtgctttgcatcttgattctggcagtatgtgtcgtgtctacctccgccgttgagatggaaaacttacctgctggcacgtgggagcgcgaagaggatctcactaatttctgccaccaagagtgtcaggtgaccgaaacagagtgcctgtgtccatacgaagcccttgtcctgcggaagcccctattcctcgactcaaccgcaaaagggatgaagaacctgttgaatagtactagcctggagacatccttatctatcgaggcgccttggggagctattaacgtgcagtcgacctacaaaccgacagttagcactgccaatatcgcactctcatggtccagtgtggaacatagaggcaacaagatactggtatctgggaggagcgagtccatcatgaaacttgaggaacgaaccggaatttcatgggatctgggcgtcgaagacgcctctgagagcaaattgctcacggtgagtgtgatggacctgtcccagatgtatagccccgtctttgagtacctatctggtgatcgccaagttggggaatggccaaaggctacatgcaccggagactgtcctgagcggtgcggctgcacttcatccacctgtctgcacaaagaatggccccacagtagaaattggaggtgcaacccaacatggtgttggggtgtgggcactgggtgcacctgttgcggacttgatgtaaaggacctcttcacggattatatgtttgtgaaatggaaggtcgagtacatcaagacagaagccattgtgtgtgttgagctgaccagccaggagcgtcagtgctcgttgatcgaagcaggcactcgcttcaatctggggcctgtgacaataaccttatctgagccccggaacattcaacagaaactcccaccggaaatcatcactctgcatcctagaattgaggaaggatttttcgaccttatgcacgtccagaaggtgctgtccgctagcacagtttgtaaattgcagtcatgcacccatggcgtgcccggtgatctccaagtctatcacatagggaatctgctaaagggagacaaagtaaacggccatctgatccacaagattgagccacactttaacacgagttggatgtcttgggatggttgtgaccttgattactattgcaatatgggcgactggccctcctgcacttacaccggggtgacacagcataaccacgccagcttcgttaatctcctgaacatcgagaccgattacacaaagaattttcatttccactcaaaaagggtgactgcgcacggagacacccctcagttggacttaaaggcccgaccaacgtatggcgctggggaaattacagtcctggtggaggtagcagatatggaactccatactaaaaagatcgagataagtggactgaaatttgccagccttgcttgtaccggctgctacgcctgttcctctggtatcagctgcaaggtgcggattcacgtcgacgagcccgatgaactgacagttcatgtgaaatccgacgatcctgacgtggtcgcagcgtcatctagtttgatggcccgcaagctagagttcgggaccgattcgacttttaaggctttcagcgccatgccgaaaacctccctgtgtttctatatcgtggaaagagagcactgcaagtcttgttcagaagaggacaccaaaaagtgcgttaacacgaaactcgagcagccacaaagcattctgatcgaacataagggaactataattggcaagcaaaattccacctgtacagcaaaagctagttgctggcttgagtctgtaaagagctttttctacggcttaaagaacatgctgtcagggatctttggaaatgtgttcatgggtatctttctcttcttggccccctttattctgctcatcctgttctttatgttcggctggaggatattgttttgtttcaagtgctgccggcgaaccagagggctgttcaaatatcgccacttgaaggatgacgaagagactggatacaggcgtattatcgaaaagctaaacaataaaaagggcaaaaacaagctgctcgatggtgagcggttagcagacagaaggattgccgagctgttttccacaaaaacccacatcgggtga

SEQ ID NO: 10254 - RNA, 5067 nt, synthetic construct
  misc_feature 1..5067: note = derived and/or modified CDS sequence (opt3) from CCHFV(Turkey-Kelkit06)__GQ337054.1__GP
  source 1..5067: mol_type = other RNA
atgcccaccaacatcatgcacacacctctggtgtgcttcattctctaccttcagctgttgtgtttaggcggggcccatggacaactgaatgctactgagcacaacggtacgaataacaccacagcaccaggcgccagccagtccccgaagccccctatgtctactaccccaccccatgcgcctgaatcaagtacaataaaaccaaccactcccatcagcgaggctgaagggtccggagagacaacctctcctccaaatacgactcagggcctatcgtcaccggaaaccacaagcgagagacccgccactaccagtatttccacatctagcaccgactccacgaaccctactacacagatgaccgataatactccaacacccaccgtctcaacgagtccttcttcttccccatcaacccccagcacaccgcaaggtatccaccatcctgcaaggagtctcctgtctgtttccagccccaagactgtgaccacaccaactcctacctcgcccggggagatgtcttccgaaacatcaagtcagcacagcgccatgtcccggattccaactccccacactgctacgcgcgtatctacagagatcaccaaccatcgaactcctcgtcagagcgaatcaagtgcacagcaaaccacaccatccccgatgaccagccccgcccagtctatacttctgatgtcagctgcccctactgcggtgcaggacatccacccaagtcccacaaatagaagcaaaaggaacttggagacggagattatcctcaccctgtcccagggactgaagaaatattacggcaagattctcaagttactgcatcttactttggaacaagatacagagggcctgctagaatggtgcaaagggaatctcggatctaactgtgacgatgactttttccagaagcggatcgaggaatttttcatgaccggtgagtgctattttaatgaggtcctgcagttcaaaacactttcgactctgagccctaccgaaccatcccacgcacgcttgcccacggccgagccgtttaagtcatacttcgctaaaggctttctcagtatagattctgggtatttcagcgccaagtgttaccctagatcctcagcaagcggactgcaattaattaacgtgacccagcacccagctaggatcgccgaaacacccggccctaagactacctctctgaaaacaattaattgcatcaacctccgggcgtccgtttttaaggagcatcgcgaagtggagatcaacgtccttctgccccagattgccgtgaatttgagtaactgtcacgtagttataaatagccatgtgtgcgactattctctagatactgacggtccagtccgactgcctagaatctaccacgaggggaccttcattcccggaacgtacaaaatcgtgatagataagaaaaacaagctcaatgacaggtgtacactggtgaccaactgcgtcattaaaggccgggaagttcgtaagggccagtccgtgcttcgccaatataagactgagatcaaaatcgggaaggcatcaacaggatttagaaaactgttgagtgaggaaccaggtgatgactgtattagcaggacccagctcctgcggactgaaaccgctgagatccatgacgataattacggcgggccgggagacaagattacaatatgcaacggctcgacgatcgtagatcagcgattaggttccgagctggggtgctataccattaatcgcgtgaaatctttcaagctatgtaagaacagcgccactggcaaaacatgcgaagtcgactcaacccctgtgaagtgtagacagggattctgcctcaaaatcacacaagagggcagggggcacgttaagctgagtcggggatccgaagtggtccttgatgcttgtgactctagctgcgaggtgatgatccccaaaggtactggcgatattttggtagactgttccgggggacagcagcactttctgaaggataatctcatagacctgggctgcccacatatcccccttctgggtcgcatggccatttacatctgtagaatgtcaaaccaccctaggaccacgatggcattcttgttttggttcagctttgggtatgttattacatgcatcttctgtaaggccctcttttacagtctgataatcattggcaccttagggaaaaagatcaaacagtatcgtgagctgaagccacaaacttgcaccatttgcgaaacagctcccgtgaatgcgatcgatgcagagatgcatgacctaaactgttcttacaatatatgcccttactgtgcctcccggctcactagcgacggcctggctcgacacgtcacccagtgcccgaaaagaaaggaaaaggtggaggaaacagagctttatttgaacctggagaggattccatggatcgtccgcaaactcctgcaagtgtcggaatcaacgggggttgccttaaagcggtctagttggctgattgtgcttttggtactcctgaccgtctccctaagccccgtgcagtctgcacctgttggacacggtaaaactatcgagatataccagacaagagaaggcttcgccagcatctgtctgtttatgctcgggtccattctgttcatcgtgtcatgccttgtcaagggattggtggatagtgtaagcgagagctttttcccaggcctgtccgtgtgtaaaacctgctcaattggtagtgttaacgggtttgaaatcgagagccataagtgttattgctccttattctgttgcccctactgcaggcactgttctgctgaccgcgagatacatcagctccacctgtcgatttgcaaaaagcgaaagactggcagcaatgtcatgcttgccgtgtgtaaacggatgtgcttccgtgcaacaatcgaagcgtcaagaagggctctgttgatccgctccattatcaacaccacgtttgtgatttgtatactcactctgaccatctgcgtcgttagtacatctgccgtggagatggaaaatctacctgcaggaacctgggagcgggaagaggatctgactaacttctgtcatcaggagtgccaagtgacagaaaccgagtgtctctgcccgtatgaagccctggtacttagaaagcccttgtttctggacagcattgtcaaaggcatgaagaatttactcaactccacatcactggagacttctcttagcatcgaggctccatggggagccattaatgtgcagagtaccttcaaacctacggtttccacagcaaacatcgctctgagctggtcttcagtggtccacaggggaaataagatattggtgaccggccgatccgaaagtatcatgaagctcgaggaacgcactggtgttagctgggatctgggggtggaggacgcctcggaatctaaattgctgaccgtatccattatggatttaagccagatgtactcacccgtctttgagtatctcagtggagacagacaggtggaggaatggccaaaggcgacatgtactggcgattgccctgagcggtgcggttgtacctcttccacgtgcctgcacaaagaatggagccattcaaggaactggcgttgtaatcccacatggtgctggggcgtggggaccggatgtacttgctgtggcgtcgacgttaaggatcttttcacagaccacatgtttgtgaaatggaaggtagagtacatcaagaccgaagccattgtgtgcgtcgctctgaccagtcaagagcgccagtgtagcttgatcgaggcagggacacggttcaacctcggaccagtgaccataacgctgtccgaaccgagaaatattcagcagaaactacctcccgagatcatcactctgcatccaaagattgaagagggctttttcgatcttatgcacgttcaaaaagtgctctctgccagcaccgtctgcaagctgcagtcctgtacacatggtatacccggggacctacaggtgtaccacatcggaaacctgttaaaaggcgacagggttaatggtcacctcattcataagatcgaatcacactttaacacctcttggatgagttgggatggctgcgacctggattattactgcaacatgggggactggccttcgtgtacatatactggagtgacccagcataatcacgctgccttcgtcaaccttctgaatattgagacggattacacaaagacttttcacttccatagcaaacgagtaaccgcacacggcgacacaccacaattggatctcaaggcgcggcccacctatggggccggaggcatcactgtgctggttgaggtggctgacatggaactacataccaaaaaggtcgagatatccggtctgaaattcgcctctcttgcatgcacagggtgttacgcttgctcaagcggaatctcctgtaaggtgcgcattcacgtagatgaacctgacgagctcacggtgcatgtcaaaagttctgatccggacgttgtggccgcaagcacttcactgatggccagaaagttggagtttggcaccgattccacattcaaggcttttagtgcgatgccaaaaaccagcttatgcttctatatcgtggaaagggagtactgtaagtcttgctccgaagacgacactcagaaatgtgtcgatacacggctggagcagccccaatcaattctcatcgaacacaagggtaccataattggcaaacagaacgacacgtgcactgccaaggcaagctgttggctggagtcggtgaagtctttcttttacgggcttaaaaatatgctgggaagtgtttttggcaacttgttcatcgggatcctactgtttctcgctcctttcgtactgcttgtgttatttttcatgttcggatggaagattctgttttgcttcaaatgctgtcgaagaacacgcggcctctttaagtataggcacttgaaagatgacgaggaaaccggttaccgtcggatcatagagagactgaactccaagaaggggaaaaataggctcctggatggagaccgccttgccgatcgaaagattgccgaactgttcagcaccaaaactcatatcggctga

SEQ ID NO: 10255 - RNA, 5103 nt, synthetic construct
  misc_feature 1..5103: note = derived and/or modified CDS sequence (opt3) from CCHFV(UCCR4416)__KY484026.1__GP
  source 1..5103: mol_type = other RNA
atgttcctgcactttaagttcatgctccttaccaactttttcttttgccagctgttgtggggcgggggaggtgtggccagcggcgggagaacaaatacttcctctacgcaaaccacattaatctcaagtaacactctgaatagcaccatgtccgtcctagagtcttcgattggaacagctaccgaaactgttccctcaacaaccacgaacactcctgacacccaggtgacaactgatagcggcagtggtgagtcctctaccgacccacagacaaccagcaaagaagtaccgtccacgtcagtggcaactataaagacacaggagagtgaaacccatagggcccaaaatcccagcactacagcggggtctggagcttccaccccttcaaacacgaccagcaataaaccagatgtcaacagtctcacatctcccatcctggaggccaagtccagcccttcgccatctaaaacttccatgccccagaccgcacaccatctttcacggagtctgttgagcgccgctacaactgagaccaatcaggcagcctccgtgatgacaaccactcgcgaaacgacaaccatgtctagccctactaccgttaagaactcagtgacagctattccaacccagggcatcactacaagtaatacgtccaagcaaaccgacactattacactcgagatcagcccgaaaatacagaccacacagtctcagcaaactgccacccccgcgatcgcccctgcaacgaccgctattgccttcatctcaccaacaaaccgaagtaagcgtgaaagcaaagtccagattatcctgactttttcccagggcctgaagaaatactattctaagatactcaagttactgcaccttacccaagaggaggattcggaagggttgctggagtggtgtacaagagtgctagaacaggcatgcaatgacgattacttcaacgagaggattgaagagtttttcatcactggaaaaggttattttaatgacgtactccagttccggctgtacgatacccttagcacgacagagtccacccagaacacttcacccacagctaagccttttcgcagttattacgccaaaggctctctgaccttcgacagcgggtatttctccgcgaagtgttacccaagagcctcaaacagcggattgcaactcattaatgttactcagcattctgtgaaaatcgcaaacacccccggcccgaagatctccaatcctaaaacaattaactgcataaatctgaaggtcagtacggataaggaccacagcaaattagaaatcaacgtgctgctcccccaggtggctgtcaatctttctaactgtcacgttctgattgagtcccatgtgtgcgattactcattggacaccgacggtactatcaagctaccaaaaataacacacaatggggcctttattcctggaacctataagatcgtaatcgataaaaagaacaagctgaatgacaggtgtgctctcttcacaaactgcgtgattaaaggccgggaagtccgccgaggccagagtgccctgagacaatacaggactgagatccggattgggcagacctttacgggaagccgtcgccttctggcagaaggtggctcgaatgattgtgtgtccagaacacagttggttaagaccgaggtggccgagatacatgaagactcttatgggggacccggcgagaaaatcactatttgcaacggtagcaccatcgtcgatcagaggctcgggtcagaactgggctgttacacaatcaatcgggtgcgaacttataagttatgcgagaacagtgctaccgaaaaatcctgcgagattgactctgtaccagttaagtgtaagcaaggattctgcctgaaaataacacaggagggccgcgggcacgtgaagctaagcagaggaacggaaatcgtcctcgatgtgtgtgacacctcctgcgagctgatgattcccaaaggtactggcgatatccttgtcgactgttcagggggacagcagcactttttgcaagataacctgattgacctcggctgccctaatatcccactgcttggtaggacagcgatatacgtgtgtcggatgagcaaccatccgaagaccactatggcattcctgttttggttcagttttgggtatgttatcacatgcgtggtatgtaaagtcttgttctacctcctgattgtgatcggcaccttaggaaagcgcctgaagcagtacagagaactaaaaccccagacgtgcattgtttgtgagtctatccctgtgaatgccatagacgctgagatgcacgatctcaactgcaattataacatttgcccatactgtgcctccaggctgactagcgacggccttgtccgtcatgtgacccaatgccccaagcggaaagaaaaggtagaggaaacagagttgtatctgaatctcgaacgaatcccttggctggtgagaaaattactgcaggtttcggagtcaaccggggtcgcacttaagaggtcttgttggatgattactttgctcatcctgctaacagtgagtatgtccccagtgcagagcgcccccgtcggacacaaacgcgctgttgaggtgtaccagatgcgggaatcttataccggtatatgcctgtttgtgctcggcagcgtactgttcgccgtctcctggcttgtgaaggcattgatcgattcaattgggaacagctttttcccgggactgagtatctgtaagacatgctctattggctccatcaatggtttcgagatagaatcacataaatgttactgcagtttattttgttgcccttattgtagagcgtgcagctccgacaagattactcacaggatgcacctcaacgtttgcaaaaagcgcaaagtggggtctaatgtcatgctggctgtgtgtaagcgaatgtgcttcaaggccaccatcgaggcatcgaaccgggccacgtttatccgtaatattatcaacagcacattcgttatttgtatacttatcctggtgatttgcgtagtctcaacctccgctgtggatatggaaaatttgccagccggcatctgggagaaagaggaagacctcactaacttttgtcatcaagagtgccaggtgaccgaaacagagtgtctgtgcccctacgaagcactaatgctgagaaagcctctcttcctggataggattgctaaaggaatgaagagtcttttgaactctactagcctggagacctccttatcaatcgaggccccctggggcgcgataaatgtccagtctacgtttaaaccaacagttagcgccgctaacatcgcactcagttggtccagcgtggaacacaaggggaataagattctggtatctggacgctcagagtccatcatgaaacttgaggaacggaccggcattagttggtgtctgggtgtggaggacgccagcgaatcgaagactctaacagtctctgtgatggatctctcccagatgtacagccctgttttcgagtatctgtcaggggacagacaagtggaagagtggcccaaagctacctgcactggagattgtccagaaaggtgcggctgcacaagttctacctgtttgcataaggagtggccgcactcccgaaactggcgctgcaatcctacgtggtgttggggtgtcggcactgggtgcacctgttgcggactggacgtgaaagatttatttacagactacatgctcgttaagtggaaggtggagtatatcaaaaccgaagccataatttgtgtcgagctgacaagccaggaacggcagtgctcacttatcgaggcaggcactagattcaacctggggcccgtaaccatcacgttgagtgaaccaaggaatgtgcagcaacgtcttccccctgagattataacactgcacccaaagatcgaggaaggatttttcgacctaatgcatgttcagaaagtgatgagcgcgtccactgtctgtaagctgcagtcttgcacccacggcgtgcccggtgatcttcaagtataccatgtggggaacctcctgaaaggagacaaggtcaatggccacagcattcataaaatcgagtcccacttgaacacatcatggatgtcttgggatggttgtgacctggattatttttgcaatatgggcgactggcctagttgcacctacactggggttacccagcacaaccatgccgctttcattaatatgttaaacatcgaaacagattatacgaagactttccactttcattcgaagcgcgtgaccgcccacggagacacaccgcagctcgatctgaaagcacggccagcttacggcgccggggagataaccgtgcttgtcgaagtggcagacctggagttgcatactaagaaaatcgaggttagcggactcaagttcgcctccctgtcttgttcaggctgctacgcttgtagctccggtattagttgcaaagtaagaatccacgtgaatgaacccgatgagtttacagtccacgtgaagtctaacgaccctgatgttgtggcggccgggagctcactaatggcaaggaagattgaatccggagctgacagtaccttcaaagcctttagctctatgccaaagaactccctgtgtttctatatcgtcgagcgagactactgctcaagctgtacggatgacgatactcagaaatgcgtggacataaagctcgagcatccccaatcgattctcatcgaacacaaaggcacaatcattggtaagcagaatgatacctgtcctaccaagacttcttgctggctggagagtatcaaatcctttttctatggcttgaagaacatgttaagcgggatatttggaaatgtattcctgggcatgctcctgtttcttgccccgttcattctgttgatcctattctttttctttgggtggcggctgcttttctgtctgaaatgctgccgcagaacaaggaagctcttaaaatacaagcatctgcgggacgaagaggaatcaggatataagaaaattatcgagcgactcaacgataagaaaggcaagtccagattgtttgacggtgagcgcctggctgataggaaaatagcagaactcttctctaccaagacacacattgggtga

SEQ ID NO: 10256 - RNA, 5103 nt, synthetic construct
  misc_feature 1..5103: note = derived and/or modified CDS sequence (opt3) from CCHFV(ArD15786)__DQ211627.1__GP
  source 1..5103: mol_type = other RNA
atgttcctgcactttaagttcgtgctccttaccaactttttcttttgccagctgttgtggggcgggggaggtgtcacaagcggcgggggaactaatacgtcctctacccaagccatcttaatttcaagtaacacacccaatagcactatgtccgttctggagtcttcgaccggcacagctgcagaaaccgtgccttcaactacaataaacaccccagacacgcaggtaactaccgatagcggtagtggggagtcctctacagacccgcagactaccaatggagaagtgcccagcacatccatcgccaccattaaaacgcaggagtcagaaactagaaggacacaaaacctaagtaccactgcgggcagcggcgcttctacacctgggaataccacgtccaacaagccagatgtcaatctcctgacctcacccatcagcgaggccaaaagttctccttccccaagcaagacatcgactccccagaccgcacatcacctttctcggtccctgttgtcagccgctacaactgagaccagtcaggcagccagcgtgatgacaaccactcgcgaaacgacaaccatgtcctctcctactaccgttaaaaacagcgctacagccaccccaactcagggaattacaacgtcaaataccagtaagcaaactgacacaaccacactcgagatcccgcccaagatacagactacccagtcccagcaaacggcgacccctgcaatcacaccagccactaccgctattgccttcatcagccccacaaaccgatctaaacgtgaatcaaaggtgcagattatcctgacttttagtcagggtctgaaaaagtactatagcaaaatactcaagttactgcatcttacccaagaggaggattccgaaggcttgctggagtggtgtacgagagtcctagaacaggcatgcgacgatgactacttcaatgagaggattgaagagtttttcatcacagggaagggatattttaacgatgtgctccagttccggctgtacgacaccttttctactacagagtcgacccagaatactagccctaccgctaaaccattccgctcctattacgccaagggctcacttacattcgatagtggttatttttctgcgaaatgttaccccagagccagcaactccgggctgcaattgattaacgtaacgcagcactcagttaagatcgcaaataccccgggacctaaaatcagcaaccccaagactattaattgcataaacctcaaagtgtctacagacaaggatcattccaagctggaaatcaatgtcttactgccacaggtggctgtgaacctcagtaattgtcacgtccttattgagagccacgtttgcgactactctctgaacaccgacggcacaatcaaattgcctaagatagcccataatggcgctttcattcccgggacttataaaatcgtgatcgataagaaaaacaagctaaatgacaggtgtgccctgtttaccaactgcgtaattaagggacgggaagtgcgccgaggtcagtccgcactcagacaatacaggacggagatccggattggccagacattcaccgggtcacgtcgcctgcttgccgaaggaggcagtaatgattgtgtcagcagaactcagctggtgaaaaccgaggttacagagatacacgaagactcgtatggtgggccaggcgagaagatcactatttgcaacggatccaccatcgtggatcagaggttgggctctgaactcgggtgttacacaatcaatcgggtccgaacgtataaactgtgcgagaacagcgctaccgaaaagtcatgcgagattgacagtgtgcccgtaaaatgtaagcaaggattttgcttaaagataactcaggagggtcgcggccatgttaaactgtccagagggacagaaatcgtgctagatgtctgtgacacctcttgcgagctcatgattcctaagggaactggcgatatcctggtggactgtagcggtgggcagcagcacttccttcaagataacttgattgacctgggctgcccaaatatcccgctcctgggacagacagcgatatacgtctgtaggatgtccaaccaccccaaaaccacgatggcatttcttttctggttttcattcggctatgtgatcacttgcgttgtgtgtaaggtactgttttacttgctcattgtcatcgggaccctgggaaaacggttaaagcagtaccgcgaactgaagcctcaaacatgcattgtgtgtgagagcatcccagttaatgccatagacgctgagatgcatgatctaaactgcaattataacatttgcccctactgtgccagtagactcacctctgacggtctggtgaggcacgtcactcagtgccctaaacgtaaggaaaaagtggaggaaacagagctttatttgaatctggaacggatcccatggctcgtacgaaagctgttacaggtgtccgagagcaccggcgttgcactgaaaagatcgtgttggattatcacacttttgatactcctgactgtctcaatgtctcccgtgcagagtgccccggtggggcataagagggctgtcgaggtttaccaaatccgcgaatcctataccggaatttgcctattcgtgctgggcggtgtgctctttgccgtaagctggctggtcaaagcacttatcgattctattgggaacagcttcttccctggcttgtccatctgtaagacgtgctcaataggaagtattaatggctttgagatcgaaagccacaagtgttactgctctctgttatgttgcccatattgtcgggcgtgctcctcagacaaaatcacacatagaatgcacctcaacgtgtgcaagaaaaggaaggttgggagtaatgtgatgctggctgtctgtaaacgcatgtgcttcaaggccaccattgaggcaaacaatcgagccacttttatccggaacattataaatagcaccttcgtgatctgtattcttatcctggttatttgcgtggtatccacatctgctgtcgatatggaaaacttgcccgccggaatctgggagaaggaggaagacctcactaacttttgtcaccaggagtgccaggtgaccgaaacggagtgtctgtgcccttacgaagcactaatgctgcgtaaacccctctcgctggatagcatagctaagggcatgaaatcacttcttaattccacaagtctggagacctctttaagcatcgaggccccatggggtgcgattaacgtgcagtccactttcaagcctacaatctcagccgctaatattgcactctcttggagcagtgtcgaacataaagggaacaagatcctggtttccggaagaagcgagtctataatgaagttggaagagaggaccggcatttcatggtgtctgggtgtggaggacgcctccgaaagtaaaactctaacagtaagcgtgatggatctctcgcaaatgtactctcccgtctttgagtatctgtccggcgaccgccaggtggaagagtggccaaaggctacctgcacgggggattgtccggaacggtgcggatgcactagctcaacctgtttgcacaaagagtggcctcatagtagaaattggaggtgcaaccccacatggtgttggggcgttgggaccggatgcacatgttgcggcctggacgtgaaggatttattcactgactacatgctcgtcaaatggaaggtggagtatatcaagaccgaagccatcatttgtgttgagctgacgtctcaggaacgacagtgctcccttatagaggcaggtacacgctttaatctggggccagtgactatcaccttgagcgaaccccggaacgtccaacagagactccctccagagattatcacactgcaccccaaaattgaggaaggattctttgacctaatgcacgtacagaaggtgatgtcagcgagtaccgtttgtaaactgcaaagctgcactcatggcgtgcctggtgatcttcaggtctaccacgtgggcaatctcctgaagggggacaaagtaaacggacattccatccacaagatagagtctcatttgaataccagctggatgtcctgggatggctgtgacctggattatttctgcaacatgggggactggccgtcatgcacatacacgggagtgactcagcacaatagggccgcttttatcaacatgttaaatattgaaaccgattatacaaaaaccttccacttccattctaagcgtgtcactgcccacggcgacacaccacagctcgatctgaaggcacgccccacctacggtgctggggagatcacggttcttgtggaagtggccgacctggagttgcatactaaaaagattgaggtcagtggactcaaatttgcatcgctgacatgtagcggctgctacgcctgttcctctggtatctcatgcaaggtgcggatacacgttaacgaacctgatgagttcaccgtacatgtgaaaagcaacgacccagatgtcgtggctgcgggctccagtctaatggccagaaagattgaatctggggcagacagcacctttaaggctttctcatccatgcccaaaaatagtctgtgtttttatatcgttgagagggactactgcagctcttgtactgatgacgatacacaaaagtgcgtggacatcaaacttgagcaccctcagtccattctcatcgaacacaagggaaccataattggcaaacagaacgatacatgtccgactaagacgtcatgctggctggagagcatcaagtcgttcttttatgggttgaaaaatatgttatctggaattttcggcaacatctttctgggtatgctcctgttccttgccccctttgtcctgttgatactattcttctttttcgggtggcgactgctcttttgtctgaagtgctgccggcgcaccagaaaacttttaaagtacaaacatctgagggacgaagaggaaagtggatataagaagattatcgagcggctcaatgataaaaagggcaaatcccgattgttcgacggcgagagactggccgatcgcaagatcgctgaactctttagcacaaaaactcacgtggggtga

SEQ ID NO: 10257 - RNA, 5100 nt, synthetic construct
  misc_feature 1..5100: note = derived and/or modified CDS sequence (opt3) from CCHFV(UCCR4432)__KY484047.1__GP
  source 1..5100: mol_type = other RNA
atgttctgcctgagactcgtgcttctgatcaacttggccttatgtcagctgctagagggcaatgacggggtcaccagcgctgatgaaattaactccaatacaactcaaacgtctctcggactgcccaccatacttaactcaacaactcctgcaccaggtccgagtatcgacgccaccatggaggcggttcccggcacaaccaatagcgtgctggaaactcaggtaacaatggattccgggtctggagagttgtcgaccgaccctacgactaccagggaagctacaactccaattaccgccgcaacagtgtcagcccaggagaccaagacgcacatgactcagaaccccggcacaaccgtcgatcctgacactacaaccagcaatacgaccacaagtatcgagccaattactacaccccctacatccccaactccgcaagctacccccacaccttcttacagcgaaaccccaactctccccaacacgcatcacctgtcccggtcactgctcagtgcagtgggtacagaggccgggcagaccgctcctgccactccaaccgcggaagttgcattagcccccggaggcagctctacagctgagtccaataccatctcaataccggcccaggatactacaatcagcggcgtgagtaaacaggacaaccctacgaccactgggatttctcccgaggcacaaacaatgcagtcccagcaggctgtcgccccagtgaccacccctgcgactgccatcagcgcacccacctcgccaacgaatcgctctaagcgagaatccaaagtacaaattatcctgacctttccccagggacttaagaaatattactcaaagatattgaagttcctgcatctaacacaggaggaagatagtgagggtctcctggaatggtgcactcgtgttcttcaacaggtgtgtgacgatacctattttaacgagagaattaaagagttctttatcacaggcaaggggtacttcaatgacgtcctgcagtttaaattgcacgatactcctgctaccacggtgccagccctcgctgccagctccacagcaatgccgttcaggtcttattacgccaagggaagcctgaccttagactcaggctattttagtgctaaatgctacccccgggcgtccaacagcggtatgcagctgattaatgtgactcaacatcctatgaagatcgcaaacacaccagggcccaagatctctaacctcaaaaccattaattgtataaaccttaaggtctcaactgacaaagaacacagtgagctggaaatcaatgttttgattcctcaggtggccgtaaacctaagcaattgcttcgtgtccatcaagtctcacgtctgtgattactcgctggacaccgatggagctatacgcctcccaaaagtggcccataacggcgtttttatgcccggcacatataagattgtgatcgacaaaaagaataagctgaacgatagatgcgcacttatcacgaattgtgtcattaaagggagggaggtgcggaagggacagagcaccctgcgccagtacaaaactgaaatccgaattggtcaaacaatagccggctccagaaggttgctcgctgagggggtatcaaacgactgcgttagtcggacccagctgatcaagacagaggtggccgaaattcacgaggattcttatggaggcccgggtgagaaaatcactatctgtaatgggagcaccattgtcgaccagcgtttaggctccgaactgggatgctacacgataaaccgcgtgaagacatataagctatgcgaaaattcagcaaccgagaaaggctgtgagatcgatagcgtccctgtgaagtgcaaacaggggttctgtctcaaggttactcaagaaggaagaggtcatgtgaaactgtctaggggcaccgagattgtacttgacgtctgcgatacatcctgtgaattgatgatcccaaaggggactggagacattctggtggactgcagtggcggtcagcagcactttctccaggataacctgatcgaccttgggtgtcccaatgttcctctgttgggcaagatggcgatatacatctgccggatgagcaaccaccccaaaaccacaatggctttcctcttctggttttctttcggatatgtgattacgtgtatcgtctgcaaggtgctgttttacttactgattgtaatcggcaccctatccaaaaagctcaaacaataccgagagctgaagccacagacttgtatagtgtgcgagtcaacacctgttaacgccattgatgcagaaatgcatgagcttaattgcaactataatatctgtccctactgcgccagtcgcttgaccagcgacgggctggtcagacacgtgaaccagtgtccaaagaggaaagaaaaggtggaggaaactgagctctatctgaatttagagcggattccgtggctggtccgcagacttttgcaagtttcggaatccacaggaatggctctcaaaaggtcttgctggatgaccacgctgctaatcctgctcgtggtgagcctgtcacctgtacagagtgcccccgtcggtcagggcaaggcagtggaggtttaccgtgtgcgggaatcctatacttctatatgtcttttcgtcttggggagcgtgctgtttgctgtttcctggttaatcaaaggactcattgatggcatcggtaactcattctttccagggctgagcgtgtgcaagacctgtagtattggctctatcaatggattcgagatagaatcccataaatgctactgtagcctgttttgctgtccctattgccgagcctgctcgtcagacaagattacacacagaatgcatcttaacgtatgtaagaaaaggaaggcgggctctaatgtcatgttggccgtgtgcaaacgcatgtgtttcaaggctaccgtggaggcaagtaacactgccctcctgatccgggggatcattaattccacatttgtcatctgcgttctaattctggtgatatgtgtagtgagcacctctgctgtcgatatggagaacctccctgccggaatctgggaaagagaggaagacctgacaaatttctgccaccaggagtgtcaagtgactgaaaccgagtgcctttgtccatacgaggcattgattctgaggaaacccttatacctcgatagcatcgcgaagggcatgaagtccctgcttaactcaacgaatctggaaacaagtctaagcattgaggccccttggggtgctatcaacgttcagtctacctttaaaccgactgtgtccgccgcaaacatagctctctcatggagtagcgtcgaacaccgcgggaataagatcctggtgtccggacgatctgagtcgattatgaaattggaggaacggaccggcatcagctggtcactgggtgttgaggacgcctccgaaagtaagacattaactgtgtctgtcatggatctcagccagatgtattccccagtattcgagtacctgtcaggcgaccgtcaggtggaagagtggcccaaagcaacctgcacgggggattgtcaagagagatgcggatgcacatctagcacctgtcttcataaggaatggcctcacagtaggaactggcgctgcaatccaacttggtgttggggcgttgggacaggatgcacctgttgcggcctggacgtgcgggacttgttcactgattatatgatggtcaagtggaaagtggagtacgtaaagacagaagccattatgtgtgtggagctcacctcccaggaaagacagtgcagcctgatcgaggctggtacgaggtttaacctagggcccgtcactataaccctgtctgagcctcgaaatattcagcaacgccttccgtcagaaatcgttacactccatcccaaaatcgaggaaggattctttgacctgatgcacgtgcagaaggtgttgtccgcgagtaccgtctgtaaactgcagagctgcacacacggcgtgccaggtgatttacaagtttatcatgtaggcaacctcctgaagggggacaaggtgaatggacactcgattcataaaatagagtctcacttcaacacttcctggatgagctgggatggctgtgaccttgattacttttgcaatatgggggactggccttcatgcacctatacgggagtcacacagcataaccgggccgcattcatcaatatgctgaacattgaaactgattacaccaagacatttcacttccacagtaaaagagtgaccgctcatggcgacactccccagttggatctcaaggccaggccaacctacggtgccggggaggttacagtgctggtcgaggtggctgacctagaactgcacacgaaaaagatcgaggtatctggacttaaatttgcatccctcacttgtagcggctgctatgcctgttcaagtggtattagctgcaaggtccgtatccatgtgaatgaacctgatgagttcaccgttcacgtgaagtcctctgaccccgacgtcgtggcggctggcagctccctgatggcccgcaaaatagagtttggggcagattcaacattcaaggccttttctagtatgccgaaaaactcgttgtgtttctacatcgttgaacgggactattgcagctcctgtaccaatgatgacactcagaagtgcgtggatacaaaattagagcatccacaatctattctgatcgaacacaagggaaccattatcggcaagcagaacgacacgtgttcaactaaaacaagctgctggctcgagtccgtcaagagtttcttttacgggctgaaaaacatgcttggaggcatattcggtaatgtgtttctggggattttcttgtttctagctcctttcgcactgctcatctttttctttttctttggatggagactgcttttctgtttaaagtgctgcaggcgaacccggggcctgctcaaatataagcagttgaaggatgaagaggaggccggctacaaaaagatcattgaacgcctgaacgacaaaaaggggaaatctagactcttcgatggagagaggctggcggaccggaagatcgctgaactttttagcaccaagactcacataggttga

SEQ ID NO: 10258 - RNA, 5100 nt, synthetic construct
  misc_feature 1..5100: note = derived and/or modified CDS sequence (opt3) from CCHFV(Nakiwogo)__KX013484.1__GP
  source 1..5100: mol_type = other RNA
atgttctgcctgaagctcgtgcttctgatcaacttgaccttatgtcagctgctagagggcaatgacagagtcacaagcgccgatgggattaactccaatactacgcaaaccaacctcggaatatctacaatcctgaatagtactacccccgctcctggtccaagtacagacaccactatggaaacagttccgagcaccgcagattccatgcttgagactcaggtgactaccgactctggctcgggggaaccctcaacagagcctactaccacaggagaagccaccagcagtacgactgcggctacagtatccatgcaggagaccaaaaagcacatgactcagaacacaaggtctaccgccgatccagacacgaccacacccaatagcactacctccgtggagcctacaactattccacccacctcacctatcccacaagcaacaccgacccccggccatggtaaagcccctactctgccaaacacgcaccatttgagtcggagcctcctgtctgctgtctccacagaagcagggcagaccactcccgccacctcaacaaccgaggctgccagcgcgcctagttcttccagcactgcagaaaataacacagtgtcgcagccagcccaggatacgaccacttctggagtttccgagcaatacaatcccacaaccacaggcatttcaccgaaggctcagactatgcagggccagcaagccatcgtgcctgtcaccacgcccgtgaccacaacttttaccccaacaaaccctactaatcgcagtaaacgagagagcaaggtacagataatcctgaccttcccccaggggctcaagaaatattactccaagattttaaaactgcttcacttgacgcaagaagaggactctgaaggactgctagagtggtgcacacgtgttctccaacaggtgtgtgatgacacctattttaacgaaagaatcgaggagttctttattactggtaagggctacttcaatgatgtcctgcagtttaaacttcatgacacaccaaccactaccgtgagcgcactggctgcctcaagtacagcgatgcccttcaggtcctattacgccaaggggagcttgacgctcgattctggatatttttcagcaaagtgctaccctcgggctagtaacagcggcatgcagctgatcaacgtgacccagcacccaatgaaaatagccaatactccgggtcccaagacatccaacttaaaaaccatgaattgtattaacctgaaggtctctacagacaaagaacactcggagctcgaaatcaatgttcttattcctcaggtggctgtaaacctgagcaattgcttggtgtccatcaagtcacatgtctgtgactacagtctagatactgacggggccatccgcctgccaaaagtggcatataacggagttttcatgcccggcacctacaagattgtgatagataagaaaaatagactcaacgacaggtgcgccctgatcacgaattgtgtcattaagggccgggaggtgcgcaaagggcagtctacacttcgacaatataagaccgaaatcagaataggacagactctgatgggtagcaggcggttgctcgctgagggcgtatccaacgattgcgtttcacgtacccagctgattaaaacagaggtggcggaaatccacgaggacagctacgggggacctggcgaaaagatcactatttgtaatggttctaccatcgtcgatcagcgcttagggtccgagctgggctgctatacaattaacagagtgaagacgtacaaactatgcgaaaatagtgcaaccgagaagggatgtgagatagacagcgtcccagtgaaatgcaagcaaggcttttgtctcaaagttactcaggaagggaggggacatgtgaagctgtctcggggtacagagatcgtacttgatgtctgcgacacctcctgtgaattgatgattcccaagggcactggggatatcctggtggactgctcaggaggccagcagcacttcctccaagacaacctgatcgatcttggttgtccgaacgttcctctgttggggaaaatggccatttatatatgccgaatgagtaatcacccaaagacaaccatggcttttctcttctggttcagctttggctacgtgatcacgtgtgtcgtgtgcaaagtactgttctacttactgattgtgatcggaactctaggcaagaaactcaagcagtatcgcgagctgaagccccagacctgtattgtttgcgagtcgatccctgtcaacgtgatagacgccgaaatgcatgagcttaattgcaactacaatatctgtccctattgcgcatccagattgacatctgatgggctggtgaggcacgtcacccaatgtccaaaacggaaggaaaaagttgaggaaactgagctctacctgaacttagagcgcattccttggctggtgagaaggcttctccaggtgagcgaatcaacaggaatggccttgaagcgtagttgctggatgaccacactgctaatcctgctcgtagtctccctgtctcccgtgcagagcgctccagttggtcaggagaaagccattgaagtgtatcaagtccgggagtcctacacttcaatgtgtctttttgtgttgggcagcgttctgttcgcagtgagttggttagtaaaggggctcatcgacggaataggcaattcctttttcccgggtctgtctgtctgcaaaacctgtagcattgggtcgatcaacggctttgaaattgagtcacataagtgctattgttctcttttctgctgtccttactgccgagcgtgcagttccgataagatcacgcacagaatgcatctgaatatatgtaaaaggcgcaaggtgggaagcaacgtgatgttggctgtctgcaaacggatgtgttttaaggccacagttgaggcatctaatagcgccctcctgatcagatccattatcaactcaaccttcgtgatttgcgtactaatcctggtgatatgtgtcgtgagtactagcgctgttgacatggaaaatctccccgccggcatttgggagagggaagaggatctgaccaacttttgccaccaggaatgtcaggtgacagagactgagtgcctttgtccatacgaagcattgatcctgcgcaaacccttatatctcgactctatcgctaaggggatgaagtccctgcttaattcaaccaacctggagacgagtctaagcattgaagccccttggggagcgatcaacgtccagtccacattcaaaccaaccgtgtctgccgctaatattgcactctcgtggagctcagttgagcaccgaggcaacaagatactggtgtccggtcggagtgagtctatcatgaaattggaggaacgtactgggattagctggtccctgggagtcgaagatgcctcagagtctaagacattaaccgtaagcgtgatggacctcagtcaaatgtactcccccgtttttgaatatctgagcggcgatagacaggtggaggagtggcctaaagctacttgcacaggtgactgtccggaaaggtgcggctgcacctcttcaacgtgtcttcataaggagtggccacactcccgcaattggcggtgcaaccccacttggtgttggggtgtcggaaccggctgcacatgttgcgggctggatgtgagagacttgttcaccgactacatgatggtaaagtggaaagtggaatatgtcaagacagaggccatcatgtgtgttgaactcacttcacaggagaggcagtgcagcctgattgaggcaggaacccgattcaatctaggccctgtgacgatcacactgtcggaaccacgcaacgtgcaacagcggcttccctctgagatagtcactctccatcctaaaatcgaagaggggtttttcgatctgatgcacgtgcagaaggttttgttttgtaaacactccctgcaagcgaccagctgcacacatggggtaccgggagacttacaggtgtaccacgtcggcaatctcctgaagggtgataaggtgaacggccattcaattcacaaaatcgaaagtcatttcaatacctcttggatgtcctgggacgggtgtgatcttgactatttttgcaacatgggagattggcccagctgcacttacaccggcgttacacagcacaatagagccgctttcgtgaacatgctgaatattgagacggactacactaagacctttcacttccattcaaaaagggtcacagcccacggggataccccacagttggacctcaaggcacgtcctacttatggagctggcgaggtgacagtactggtcgaagtggccgatctagagctgcataccaaaaagatcgaagttagtggtcttaaatttgcaagcctcacgtgttccgggtgctacgcctgttctagcggaatatcctgcaaggtgcgcattcacgtcaacgagcccgacgagttcactgtgcatgttaagtcaaatgatccagacgtggtcgctgcgggctctagtctgatggcccggaaaatcgaattgggtgcagactcgacatttaaggctttcagctccatgcctaaaaactctttatgtttttatatcgtggagagagattactgctcaagctgtaccgacgatgacacccaaaagtgcgtaaacactaaactggaacacccccagtccattctcatagagcacaagggcacaatcattgggaagcagaatgatacctgtccaacaaaaacgagttgctggctggaatctgttaagagcttcttctatggacttaaaaacatgctgggcgggatctttggaaatgtgttcttgggcatttttctattcctggccccgtttgccctcctgatccttttctttttctttggttggaggttactgttctgtctcaagtgctgccgacggacgcgcgggttgctgaaatacaagcagctcaaggacgaggaggaagctggatataaaaagataatcgagagactgaacgataaaaagggcaaatcaaggctttttgacggcgaacggctggcagatcgaaagattgccgagttgttctccaccaagacacatatcgggtga

SEQ ID NO: 10259 - RNA, 5100 nt, synthetic construct
  misc_feature 1..5100: note = derived and/or modified CDS sequence (opt3) from CCHFV(UG3010)__AY900143.1__GP
  source 1..5100: mol_type = other RNA
atgttctgcctgagactcgtgcttctgatcaacttggccttatgtcagctgctagagggcaatgacggggtcaccagcgctgatgaaattaactccaatacaactcaaacgtctctcggactgcccaccatacttaactcaacaactcctgcaccaggtccgagtatcgacgccaccatggaggcggttcccggcacaaccaatagcgtgctggaaactcaggtaacaatggattccgggtctggagagttgtcgaccgaccctacgactaccagggaagctacaactccaattaccgccgcaacagtgtcagcccaggagaccaagacgcacatgactcagaaccccggcacaaccgtcgatcctgacactacaaccagcaatacgaccacaagtatcgagccaattactacaccccctacatccccaactccgcaagctacccccacaccttcttacagcgaaaccccaactctccccaacacgcatcacctgtcccggtcactgctcagtgcagtgggtacagaggccgggcagaccgctcctgccactccaaccgcggaagttgcattagcccccggaggcagctctacagctgagtccaataccatctcaataccggcccaggatactacaatcagcggcgtgagtaaacaggacaaccctacgaccactgggatttctcccgaggcacaaacaatgcagtcccagcaggctgtcgccccagtgaccacccctgcgactgccatcagcgcacccacctcgccaacgaatcgctctaagcgagaatccaaagtacaaattatcctgacctttccccagggacttaagaaatattactcaaagatattgaagttcctgcatctaacacaggaggaagatagtgagggtctcctggaatggtgcactcgtgttcttcaacaggtgtgtgacgatacctattttaacgagagaattaaagagttctttatcacaggcaaggggtacttcaatgacgtcctgcagtttaaattgcacgatactcctgctaccacggtgccagccctcgctgccagctccacagcaattccgttcaggtcttattacgccaagggaagcctgaccttagactcaggctattttagtgctaaatgctacccccgggcgtccaacagcggtatgcagctgatcaatgtgactcaacatcctatgaagatcgcaaacacaccagggcccaagatttctaacctcaaaaccataaattgtatcaaccttaaggtctcaactgacaaagaacacagtgagctggaaattaatgttttgatccctcaggtggccgtaaacctaagcaattgcttcgtgtccataaagtctcacgtctgtgattactcgctggacaccgatggagctattcgcctcccaaaagtggcccataacggcgtttttatgcccggcacatataagatcgtgatcgacaaaaagaataagctgaacgatagatgcgcacttattacgaattgtgtcatcaaagggagggaggtgcggaagggacagagcaccctgcgccagtacaaaactgaaattcgaataggtcaaacaatcgccggctccagaaggttgctcgctgagggggtatcaaacgactgcgttagtcggacccagctgattaagacagaggtggccgaaatccacgaggattcttatggaggcccgggtgagaaaatcactatttgtaatgggagcaccatagtcgaccagcgtttaggctccgaactgggatgctacacgatcaaccgcgtgaagacatataagctatgcgaaaattcagcaaccgagaaaggctgtgagattgatagcgtccctgtgaagtgcaaacaggggttctgtctcaaggttactcaagaaggaagaggtcatgtgaaactgtctaggggcaccgagatcgtacttgacgtctgcgatacatcctgtgaattgatgattccaaaggggactggagacatcctggtggactgcagtggcggtcagcagcactttctccaggataacctgatagaccttgggtgtcccaatgttcctctgttgggcaagatggcgatctacatttgccggatgagcaaccaccccaaaaccacaatggctttcctcttctggttttctttcggatatgtgatcacgtgtattgtctgcaaggtgctgttttacttactgatcgtaataggcaccctatccaaaaagctcaaacaataccgagagctgaagccacagacttgtattgtgtgcgagtcaacacctgttaacgccatcgatgcagaaatgcatgagcttaattgcaactataatatttgtccctactgcgccagtcgcttgaccagcgacgggctggtcagacacgtgaaccagtgtccaaagaggaaagaaaaggtggaggaaactgagctctatctgaatttagagcggatcccgtggctggtccgcagacttttgcaagtttcggaatccacaggaatggctctcaaaaggtcttgctggatgaccacgctgctaatactgctcgtggtgagcctgtcacctgtacagagtgcccccgtcggtcagggcaaggcagtggaggtttaccgtgtgcgggaatcctatacttctatctgtcttttcgtcttggggagcgtgctgtttgctgtttcctggttaattaaaggactcatcgatggcattggtaactcattctttccagggctgagcgtgtgcaagacctgtagtatcggctctataaatggattcgagattgaatcccataaatgctactgtagcctgttttgctgtccctattgccgagcctgctcgtcagacaagatcacacacagaatgcatcttaacgtatgtaagaaaaggaaggcgggctctaatgtcatgttggccgtgtgcaaacgcatgtgtttcaaggctaccgtggaggcaagtaacactgccctcctgatccgggggattatcaattccacatttgtcatttgcgttctaatactggtgatctgtgtagtgagcacctctgctgtcgatatggagaacctccctgccggaatttgggaaagagaggaagacctgacaaatttctgccaccaggagtgtcaagtgactgaaaccgagtgcctttgtccatacgaggcattgatcctgaggaaacccttatacctcgatagcattgcgaagggcatgaagtccctgcttaactcaacgaatctggaaacaagtctaagcatcgaggccccttggggtgctataaacgttcagtctacctttaaaccgactgtgtccgccgcaaacatcgctctctcatggagtagcgtcgaacaccgcgggaataagattctggtgtccggacgatctgagtcgatcatgaaattggaggaacggaccggcattagctggtcactgggtgttgaggacgcctccgaaagtaagacattaactgtgtctgtcatggatctcagccagatgtattccccagtattcgagtacctgtcaggcgaccgtcaggtggaagagtggcccaaagcaacctgcacgggggattgtcaagagagatgcggatgcacatctagcacctgtcttcataaggaatggcctcacagtaggaactggcgctgcaatccaacttggtgttggggcgttgggacaggatgcacctgttgcggcctggacgtgcgggacttgttcactgattatatgatggtcaagtggaaagtggagtacgtaaagacagaagccatcatgtgtgtggagctcacctcccaggaaagacagtgcagcctgatagaggctggtacgaggtttaacctagggcccgtcactattaccctgtctgagcctcgaaatatccagcaacgccttccgtcagaaatcgttacactccatcccaaaattgaggaaggattctttgacctgatgcacgtgcagaaggtgttgtccgcgagtaccgtctgtaaactgcagagctgcacacacggcgtgccaggtgatttacaagtttatcatgtaggcaacctcctgaagggggacaaggtgaatggacactcgatacataaaatcgagtctcacttcaacacttcctggatgagctgggatggctgtgaccttgattacttttgcaatatgggggactggccttcatgcacctatacgggagtcacacagcataaccgggccgcattcattaatatgctgaacatcgaaactgattacaccaagacatttcacttccacagtaaaagagtgaccgctcatggcgacactccccagttggatctcaaggccaggccaacctacggtgccggggaggttacagtgctggtcgaggtggctgacctagaactgcacacgaaaaagattgaggtatctggacttaaatttgcatccctcacttgtagcggctgctatgcctgttcaagtggtatcagctgcaaggtccgtatacatgtgaatgaacctgatgagttcaccgttcacgtgaagtcctctgaccccgacgtcgtggcggctggcagctccctgatggcccgcaaaatcgagtttggggcagattcaacattcaaggccttttctagtatgccgaaaaactcgttgtgtttctacattgttgaacgggactattgcagctcctgtaccaatgatgacactcagaagtgcgtggatacaaaattagagcatccacaatctatcctgattgaacacaagggaaccatcataggcaagcagaacgacacgtgttcaactaaaacaagctgctggctcgagtccgtcaagagtttcttttacgggctgaaaaacatgcttggaggcattttcggtaatgtgtttctggggatcttcttgtttctagctcctttcgcactgctcatctttttctttttctttggatggagactgcttttctgtttaaagtgctgcaggcgaacccggggcctgctcaaatataagcagttgaaggatgaagaggaggccggctacaaaaagattatcgaacgcctgaacgacaaaaaggggaaatctagactcttcgatggagagaggctggcggaccggaagatagctgaactttttagcaccaagactcacattggttga

SEQ ID NO: 10260 - RNA, 5100 nt, synthetic construct
  misc_feature 1..5100: note = derived and/or modified CDS sequence (opt3) from CCHFV(Semunya)__DQ094832.1__GP
  source 1..5100: mol_type = other RNA
atgttctgcctgaagctcgtgcttctgatcaacttggccttatgtcagctgctagagggcaatgacagagtcaccagcgctgatgggattaactccaatacaactcaaacgaacctcggaatatctaccatccttaattcaacaactcccgcacctggtccaagtaccgacacaaccatggaaactgttccgagcacagccgattccatgcttgagacccaggtgacgactgactctggctcgggggaaccctcaaccgagcctacaactaccggagaagcgacaagcagtaccacggctgccactgtatccatgcaggagacaaaaacccacatgactcagaacacaaggtctaccgcagatccagacacgaccacacccaatactaccacaagcgtggagcctactaccattccacccacatcccctatcctgcaagccaccccaactccgggccatggtaaggctcccacgttgcctaacacacaccatctctcacggagtctgctgagcgcagtctctaccgaagccgggcagactaccccagctacatccaccactgaggccgcgtcagcacccagcagttcttccacagccgaaaataacacgatgtttcagcctgctcaggataccactacaagcggagtgtcggagcaatacaatccaaccacaactggcatttctcccaaagcccagaccatgcaggcacagcaagctatcgttccggtgacgacccctgtcacaactaccttcacacccataaacccaactaatcgctccaagcgagagtcaaaagtgcagatcattctcacctttcctcagggcttaaagaagtattacagtaaaatcctgaaacttttgcacctgacgcaagaagaggacagcgaagggctactcgagtggtgcacacgtgtactgcagcaggtttgtgatgacacctatttcaacgaaagaattgaggagtttttcatcactggaaaaggttactttaatgatgtgcttcagttcaagctgcatgacacacccaccactaccgtcccagccttggcggcctcctctacagcaatgccctttaggagctattacgctaaaggctcactcacgctggatagtgggtatttctccgccaagtgctaccctcgggctagcaactctggaatgcaattaataaacgtgacccagcacccaatgaagattgccaatactccgggccccaaaacatcaaacctgaagaccatgaattgtatcaacctcaaagtgagtacagacaaggaacacagcgagcttgaaattaatgtcctgatccctcaggttgcagtgaacttgtccaattgcctagtatctatcaaatcgcatgtgtgtgactacagcctggatactgacggtgccattcgcctcccaaaggtcgcttataacggggtgtttatgcccggaacctacaaaatagttatcgataagaagaatagactgaacgacaggtgcgcgcttattacgaattgtgtgatcaaaggccgggaggtccgcaagggccagtccacactgcgacaatataaaaccgaaataagaattgggcagactttgatgggatcaaggcggctcctggcagagggtgtgagtaacgattgcgtatctcgtacccagttaatcaagacagaggttgccgaaatccacgaggacagctacggcgggcctggagaaaagattactatctgtaatggctccaccattgtggatcagcgcctgggttcagagctagggtgctatacaataaacagagtcaagacgtacaagctctgcgaaaatagcgctaccgagaaaggctgtgagatcgactctgtgccagtcaagtgcaaacaaggattctgtctgaaggtgactcaggaaggcagggggcatgttaaactttcccggggaacagagattgtgttggatgtatgcgacaccagttgtgaactgatgatccccaagggtactggcgatatcctcgtcgactgcagcgggggacagcagcactttctgcaagacaaccttattgatctgggctgtccgaacgtgcctttgctcggtaagatggccatatatatctgccgaatgtctaatcacccaaaaacaaccatggcattcctgttctggttttccttcgggtacgttattacgtgtgtggtctgcaaggtgttattttacctgctaatcgtaattggcactctcgggaaaaagctgaaacagtatcgcgagcttaagccccagacctgtatcgtgtgcgagtcaatacctgttaacgccatcgacgctgaaatgcatgagttgaattgcaactacaatatttgtccctattgcgccagtagactgacaagcgatggcctcgtcaggcacgtgacccaatgtccaaagcggaaagaaaaggtggaggaaactgagctgtacttaaacctggagcgcatcccttggcttgtcagaaggttgctccaggtttcggaatccacagggatggcactgaaacgttcttgctggatgaccacactactgattctcctggtggtgagcctttcacccgtacagagtgcgccagtcggacaggagaaggctatcgaagtgtatcaagttcgggagtcctacacttctatatgtttgttcgtgctgggtagcgtcttatttgccgtgtcctggctcgttaaaggcctgattgacgggatcggaaattcattctttccgggccttagcgtgtgcaagacctgtagtattggttctatcaacgggttcgaaatagagtcccataaatgctattgtagcctgttttgctgtccttactgccgagcatgctcgtcagataagatcacgcacagaatgcatttgaatatttgtaagaggcgcaaagtaggctctaacgtcatgctcgccgtgtgcaagcggatgtgtttcaaagctacagtggaggccagtaattccgcactgctaatcagaagcattatcaactctacctttgtcatatgcgttctgattctcgtgatctgtgtagtgagcacttccgctgtcgacatggaaaatctgcccgccggaatctgggagagggaagaggatcttaccaacttctgccaccaggaatgtcaggtgacagagactgagtgcttgtgtccatacgaagcgctgattttacgcaagcccctctttctggactcaatcgccaaaggcaagaagagtcttctgaatagcaccaacctagagacgtctctctccattgaagctccttggggagcaataaacgttcagtcaacattcaaaccaaccgtgagtgccgctaatatcgccctgagctggtcctctgtcgagcaccgaggaaacaagattttggtgtcgggccggagcgagtcaatcatgaaactggaggaacgtactggtatttcctggagtttaggggttgaagatgcatctgagagcaagacactcaccgtgtccgtcatggacctgtcacaaatgtattctcccgtattcgaataccttagcggagatagacaggtggaggagtggcctaaagcgacttgcacaggcgactgtccggaaaggtgcggttgcaccagttccacgtgtctgcataaggagtggccacacagccgcaattggcggtgcaaccccacttggtgttggggcgttgggaccggatgcacatgttgcggcttggatgtgagagacctctttaccgactatatgatggtcaagtggaaagtggaatacgtaaagacagaggccatcatgtgtgtggaactgacttctcaggagaggcagtgctcactaatagaggctgggacccgattcaatctgggacctgtcacgatcacactttccgaaccacgcaacgttcaacagcggctccccagtgagattgtgactctgcatcctaaaatcgaagagggctttttcgatttgatgcacgtgcagaaggtcctgttttgtaaatatagcttacaagccacctcgtgcacacacggtgtgccgggggacctccaggtttaccatgtaggaaatctgcttaagggcgataaggtgaacggtcactctattcataaaatcgaatcccacttcaataccagctggatgtcatgggacggctgtgatctggactatttttgcaacatgggggattggcccagttgcacttacaccggagtcacacagcataatagagcagctttcgtgaacatgttgaatatagagacggactacactaagacctttcacttccactctaaaagggttacagcccatggcgataccccacagctcgacctgaaggcacgtcctacttatggggccggagaggtgacagtcctagtggaagtagctgatctggagcttcacaccaaaaagattgaagtctccggcctcaaatttgcgagcctgacgtgttcaggttgctacgcctgtagtagcgggatctcctgcaaggtgcgcatccatgttaacgagcccgacgagttcactgtgcacgtcaagtctaatgatccagacgtggttgcagctggaagctccttgatggcccggaaaattgaatttggcgccgactcaacattcaaggctttctctagtatgcctaaaaactcgttatgtttttatatagtggagagagattactgcagctcctgtaccgacgatgacacccaaaagtgcgtcaacatcaaactggaacatccccagtctattctcatcgagcacaagggtactattatcggcaagcagaatgatacatgtccaaccaaaacatcatgctggctggaaagcgtgaagtccttcttttatgggcttaaaaacatgctgggaggcatattcgggaatgtatttttgggaatcttcctatttctggcaccgttcgccctcctgattctgtttttctttttcggctggaggttactgttctgtctcaagtgctgccgacggactcgcggtttgctgaaatacaagcagctcaaggacgaggaggaagcggggtataaaaagatcattgagagactgaacgataaaaagggaaaaagtaggctttttgacggcgaacggctggctgatcgaaagatcgccaagttgttctctacgaaaacccacataggctga

SEQ ID NO: 10261 - RNA, 5094 nt, synthetic construct
  misc_feature 1..5094: note = derived and/or modified CDS sequence (opt3) from CCHFV(79121)__AB069673.1__GP
  source 1..5094: mol_type = other RNA
atgctgttccactttaagttcatgctccttatcaactttattctgtgccatttgttatggggcgggggaggtgtgaccggcggggtcgagacaaatagctcctctactcaggccatacaaacgccccctgttacctcaaacagtacaactccaggaccgagcaccgacacagctaccgaaactgcatcctctatgacaacctcgacgcccgatactcaggtgaccacagacaatggctcaggtgagcctagcactgatccactgaccacaaacgaagccactccccctctaagtgtaacgactgcgcagacaaccgagactaaaaagcacacaaccctcgacccatccacgtctaccaatcccgatgctacaactcctagcatcaccattctgtccgcctcaaacacaagtcttccaatcagctctgtgcatgcatccccgtcacccagcagttctgaggaacctactccacagaatgcccaccatctgtccaggagcttgctctcggctgtctctaccgagacagggcaaattgcatccgccgctaccgccgcgaaagaaatcactacgaagaactcaccccctacagcaggaaatgacaccatggtgaccagtgccccaaacggcaatataagaaacacccccgagcaggctaatccgacagcccctgaagcaagccccaaaatccagaccactcagaaccaacagacagttacgccagaggctacccctattactacaatcaccgccctgacagatctgactaatcggtccaagcgcgactctaaggtgcagaaaattctcaccttcagccagggcttaaagaaatactattcaaagatcctgaaacttttgcaactgacgcaggaggaagatagtgaggggctactcgaatggtgtacccgagtcctggagcaggcgtgcgacgatgactactttaacaagcgtatagaagagttctttattacaggaaagggttatttcaacgatgtgcttcaatttagactgcacgacgccttgtccaatactgagcccgcacagaccacaagcccaactgctgtacccttcaaatcttactatgccaagggctcactcacctttgacagtgggtacttcagcgctaggtgttatcctcgggcctccaactctggactgcagttaatcaatgttacgcagcacccagtgaaaattgcaaacacaccgggccccaagctgtcgaatctcaaaaccatcaactgcatcaatcttaaggtcagcactgataaagaacattccgagctggaagtgaacgtgttgctacctcaagtcgccgttaatctgtcaaactgtcacgtgagtattaagtctcatgtatgcgactacagcctcgatacagacggtgctataaagctgccacgcgtggcgcacaatggggtctttatccccggaacctacaaaattgtgatcgataagaaaaacaatcttaacgacagatgtactctgataaccaattgcgttattaagggcagggaggtgcggaaaggccagtccgcattgcgccagtataagacagaaatccgaatcgggcagacgttcaccggatcaagaaggctcctggccgagggtggcagctctgattgtatttcccggactcaattagtcaagacagaggtggctgaaatccacgaggacagttacgggggacctggcgaaaagattaccatatgcaacggtagcacaatcgtagatcaggggctgggctctgagctaggatgttatactattaaccgtgttcgctcctacaagctctgcgaaaattcagccagtggcaaaagctgcgagatcgactcgatcccagtgaagtgtaaacaggggttctgcctgaagattacccaggagggaagaggtcatgtcaaactttccaggggcacggaaatagtgttggatgtctgtgactctagctgcgagctgatgatccccaaagggacaggagacattctcgtggattgttcaggcggtcaacagcactttctgcagaacaatcttatcgacctggggtgcccgaacgttcctttgctcggcaagatggcaatttatgtgtgtcggatgagtaatcatccaaaaaccactatggccttcctgttttggttctcctttggatacgtaattacctgcatagcttgtcgagtcttattctatctgctaatcgccattggcacagtggggaagaaactcaagcagtaccgcgaactgaagccccaaacttgcatcgtttgtgagtctgtgcctgtcaacgcaattgatgcggagatgcacgaacttaattgcagctacaacatctgcccctattgtgcttccagattgtcaaccgacggactgataaggcatgtgacacagtgcccaaaacggcgcgagaaggtagaagagacggaactctttctgaatttagagagaatcccttggctggtgaggaaacttttgcaggttagcgagagtaccggtatggccctcaagcgttcttgttggatgatcactctgctaattctgctcctggtctccatcagccccgtgcaatcggcaccagtgggcaaagaacgggccatagagacataccaggctcgagaaacctatactgggatctgccttttcgtcttgggatcagttctgtttgccgtgtcttggttaacaaaggcactcattgatggcatcggtaacagtttctccccggggctgagcgtgtgtaaaacctgctctattggcagcatcaatggatttgagatagaatcccacaagtgttactgctcacttttctgttgcccttattgtagagcttgcagtagcgacaagaacacgcacaggatgcatctgaatgtatgcaaaaagcgcaaaatgggctctaacgtcatgttggccgtgtgtaagcggatgtgctttagagcgactattgaggcctccaataaagctctcctgatcaggtcaatcattaacagtaccttcgttatctgtattctaatactgacaatctgcgtggtcagcacctccgcagtggatatggagaacctccccgccgggatttgggaaaaggaggaagacctgactaatttctgtcaccaggagtgccaggttacagaaaccgagtgtctttgcccatacgaggctatggtgttgcgcaagcccctgtttttagattctacagccaaaggaatgaagtcgctcctgaacagcacttcacttgaaacctccctgagtatcgaggcaccttggggcgcgattaatgtacaatctacgttcaaaccaacagtcagcgccgctaacatcgccctatcctggtcatctgtggaacatcgaggtaataagatactcgtgagcgggcggagtgagtccatcatgaaactggaggaacgtaccggagtcagctggaacttgggcgttgaggacgcatctgaatcaaagactctgaccgtgtccgtaatggatttaagtcagatgtatagccccgtgtttgagtacctctcgggtgacagacaggtcgaagagtggcctaaggctacatgtactggcgattgcccggagaggtgtgggtgcacctcttccacgtgcctgcacaaagaatggccacacagccgcaattggcggtgtaaccccacatggtgctggggagtgggcaccgggtgtacttgctgtggacttgacgttaaggacttctttacagattacatgctggtgaaatggaaggtcgagtatattaaaaccgaagccatcgtgtgcgttgagttgacttcacaggaaagacaatgtagtctcattgaggcaggcacaaggttcaatctgggtcctgtgaccatcacgctatctgagccacgaaacgtccagcagcgcctgccccctgaaatagtaactcttcatccgaagattgaggaagggtttttcgacctcatgcacgtgcagaagatcctgtccgccagcaccgtttgcaaattgcaatcatgtacacatggagtgcccggcgattttcagatctaccacgtcggtaatctgttacggggcgacaaggtgaacgggcatagtattcacaaaatagagccacacttcaataccagctggatgtcctgggatggatgcgacctcgattatttttgtaacatgggcgactggccttcttgcacatacactggggtaacccagcataatagagctgcgttcatcaacatgctgaacattgaaacggattatacaaagacttttcacttccatagcaaaagggtgaccgcccacggagacacaccccaacttgatctgaaggcacgtccagcttacggcgccggtgaggtcaccgttttggtggaggtggccgacctcgaactgcatactaaaaatctagaggtctccgggctgaagatcgcttcacttacctgctctggatgttatgcatgcagttcgggcattagctgtaaggtgcgcatccacgttaacgaacctgatgagttcacagtacacgtgcggtcctctgaccccgacgtcgtggccgcgggttcaagcctcatggctagaaaaatagagtttggcgccgattccacgttcaaggcatttagttctatgccaaaagacagcctgtgcttctacatcgttgaaaaggattactgttcatcctgcactgacgatgacacccagaaatgtgtgaatacaaagttggatcatccgcagagtattttaatcgagcacaaggggaccattatcggaaaacagaacgacacttgcagcacaaagacctcttgttggctggaatccgtcaaaggctttttctatgggctcaagaatatgctgtcaggaatatttggcaacgtgttccttggtatttttctgttcttggccccttttgtactactgatcttcttctttttctttgggtggaggctcctgttctgccttaaatgttgccgacggacgcgcggattactgaagtacaagcatctcaaagatgaggaagaggctggctataagaaaatcattgagagattgaatggcaagaaaggaaagagccaactgtttgacggggaaaggctcgcagatcggaagatcgccgagctgttctcgactaaaatacacattggttga

SEQ ID NO: 10262 - RNA, 5094 nt, synthetic construct
  misc_feature 1..5094: note = derived and/or modified CDS sequence (opt3) from CCHFV(7001)__AB069670.1__GP
  source 1..5094: mol_type = other RNA
atgctgttccactttaagttcatgctccttatcaactttattctgtgccatttgttatggggcgggggaggtgtgaccggcggggtcgagacaaatagctcctctactcaggccatacaaacgccccctgttacctcaaacagtacaactccaggaccgagcaccgacacagctaccgaaactgcatcctctatgacaacctcgacgcccgatactcaggtgaccacagacaatggctcaggtgagcctagcactgatccactgaccacaaacgaagccactccccctctaagtgtaacgactgcgcagacaaccgagactaaaaagcacacaaccctcgacccatccacgtctaccaatcccgatgctacaactcctagcatcaccattctgtccgcctcaaacacaagtcttccaatcagctctgtgcatgcatccccgtcacccagcagttctgaggaacctactccacagaatgcccaccatctgtccaggagcttgctctcggctgtctctaccgagacagggcaaattgcatccgccgctaccgccgcgaaagaaatcactacgaagaactcaccccctacagcaggaaatgacaccatggtgaccagtgccccaaacggcaatataagaaacacccccgagcaggctaatccgacagcccctgaagcaagccccaaaatccagaccactcagaaccaacagacagttacgccagaggctacccctattactacaatcaccgccctgacagatctgactaatcggtccaagcgcgactctaaggtgcagattatcctcaccttcagccagggcttaaagaagtactattcaaaaatactgaaacttttgcaactgacgcaggaggaagatagtgaggggctactcgaatggtgtacccgagtcctggagcaggcgtgcgacgatgactactttaacaaacgtattgaagagttctttatcacaggaaagggttatttcaacgatgtgcttcaatttagactgcacgacgccttgtccaatactgagcccgcacagaccacaagcccaactgctgtacccttcaagtcttactatgccaaaggctcactcacctttgacagtgggtacttcagcgctaggtgttatcctcgggcctccaactctggactgcagttaattaatgttacgcagcacccagtgaagatcgcaaacacaccgggccccaaactgtcgaatctcaagaccatcaactgcattaatcttaaagtcagcactgataaggaacattccgagctggaagtgaacgtgttgctacctcaagtcgccgttaatctgtcaaactgtcacgtgagtataaaatctcatgtatgcgactacagcctcgatacagacggtgctatcaagctgccacgcgtggcgcacaatggggtctttattcccggaacctacaagatcgtgatagataaaaagaacaatcttaacgacagatgtactctgattaccaattgcgttatcaaaggcagggaggtgcggaagggccagtccgcattgcgccagtataaaacagaaatccgaattgggcagacgttcaccggatcaagaaggctcctggccgagggtggcagctctgattgtatctcccggactcaattagtcaagacagaggtggctgaaattcacgaggacagttacgggggacctggcgaaaagataaccatctgcaacggtagcacaattgtagatcagcgtctggggtctgagctaggctgttatactatcaaccgcgttagatcctacaaactctgcgaaaattcagccagtggaaagagctgcgagatcgactcgattccagtgaaatgtaagcagggcttctgcctgaaaataacccaggaggggaggggacatgtcaaactttcccggggtacggaaatcgtgttggatgtctgtgactctagctgcgagctgatgattcccaagggcacaggggacatcctcgtggattgttcaggaggccaacagcactttctgcagaacaatcttattgacctgggttgcccgaacgttcctttgctcgggaagatggcaatctatgtgtgtcgaatgagtaatcatccaaagaccactatggccttcctgttttggttctcctttggctacgtaataacctgcatcgcttgtcgcgtcttattctatctgctaattgccatcggaacagtgggcaaaaagctcaaacagtacagagaactgaagccccaaacttgcattgtttgtgagtctgtgcctgtcaacgcaatcgatgcggagatgcacgaacttaattgcagctacaacatatgcccctattgtgcttccaggttgtcaaccgacgggctgattcggcatgtgacacagtgcccaaagcgcagagagaaagtagaagagacggaactctttctgaatttagagaggatcccttggctggtgcgtaaacttttgcaggttagcgagagtaccggaatggccctcaagcggtcttgttggatgattactctgctaatcctgctcctggtctccataagccccgtgcaatcggcaccagtgggtaaggaacgagccatcgagacataccaggctagagaaacctatactggcatttgccttttcgtcttggggtcagttctgtttgccgtgtcttggttaacaaaagcactcatcgatggaattggcaacagtttctttccgggtctgtccgtgtgtaagacctgcagcatcgggtctataaatggcttcgagattgaaagccacaaatgttactgctccctgttttgttgcccttattgtagggcttgctcaagtgacaagaacacgcaccgcatgcatctgaatgtatgcaagaaacggaagatgggaagcaacgtcatgttggccgtgtgtaaaagaatgtgcttcagggcgactatcgaggcctctaataaggctctcctgatccgctccattatcaactcaaccttcgttatttgtatactaatcctgacaatttgcgtggtcagtaccagcgcagtggatatggagaacctccccgccggcatctgggaaaaagaggaagacctgactaatttttgtcaccaggagtgccaggttacagaaaccgagtgtctttgcccatacgaggctatggtgttgcgaaagcccctgttcttagataacattgccaaggggatgaaatccctccttaattctacatcgcttgaaactagcctgtcaatcgaggcaccttggggagcgataaacgtacaatccacctttaagccaacggtcagtgccgctaatatcgccctatcttggagctccgtggaacatcggggcaacaaaattctcgtgtcaggtcgttctgagagcatcatgaagctggaggaaagaacaggggtcagttggaatttgggagttgaggacgcatccgaaagcaaaaccctgactgtgtctgtaatggatttatcacagatgtattcccccgtgttcgagtacctcagtggcgacaggcaggtcgaagagtggcctaaggctacctgtacaggtgattgcccggagcgctgtggctgcactagctcgacctgcctgcacaaggaatggccacactctcggaactggagatgtaatcccacgtggtgctggggagtggggacaggctgtacctgctgtgggcttgacgttaaagactttttcactgattacatgctggtgaagtggaaagtcgagtatattaagacagaagccatcgtgtgcgttgagttgacctcccaggaaaggcaatgtagcctcatagaggcaggaactcgatttaacctgggccctgtgacaattaccctatcagagccacgcaatgtccagcagcggctgccccctgaaatcgtaacgcttcatccgaaaatcgaggaaggtttctttgacctcatgcacgtgcagaagattctgagtgcctctactgtttgcaagttgcaatcctgtacccatggggtgcccggagatttccaggtctaccacgtgggcaacctgttaagaggtgacaaagtaaatggccatagcatacacaagatcgagccacactttaacacatcatggatgagttgggatgggtgcgacctcgattatttctgtaatatgggagactggcctagctgcacctacacaggcgtgactcagcataacagggctgcgtttattaacatgctgaatatcgaaaccgattatacgaaaacattccacttccattccaagcgtgtcactgcccacggggacacaccccaacttgatctgaaagcacgcccagcttacggagccggcgaggttaccgtgttggtggaggtcgccgacctcgaactgcataccaagaaactagaggtgtctggtctgaagattgctagccttacttgctccgggtgttatgcatgctcatctggaatcagttgtaaggttcggatacacgtaaacgaacctgatgagtttaccgtgcacgtcagatcgagcgaccccgacgtggttgccgcgggctcctctctcatggctaggaaaatcgagttcggtgccgattcaacatttaaggcattcagctccatgccaaaagacagtctgtgcttttacattgtggaaaaggattactgttctagctgcacggacgatgacactcagaaatgtgtcaataccaagttggatcatccgcagtcaatcttaattgagcacaagggcacaatcatagggaaacagaacgatacctgctccactaagacaagttgttggctggaaagcgtgaaaggattcttttatggcctcaagaatatgctgtctgggattttcggaaacgtatttcttggcatcttcctgtttttggcccctttcgtcctactgatcttctttttctttttcggttggcgactcctgttttgccttaaatgttgccggcgcaccagagggttactgaagtacaagcatctcaaagacgaggaagaggctggatataagaaaattatcgagaggttgaatggcaagaaaggcaagtcccaactgttcgacggggaacggctcgcagatcgaaagatagccgagctgttttcaacgaaaattcacatcggatga

SEQ ID NO: 10263 - RNA, 5094 nt, synthetic construct
  misc_feature 1..5094: note = derived and/or modified CDS sequence (opt3) from CCHFV(YL16070)__KY354081.1__GP
  source 1..5094: mol_type = other RNA
atgctgttccactttaagttcatgctccttatcaactttattctgtgccatttgttatggggcggggtgggagtcaccggtggcgttgagacaaatagctcctctactcaggccatacccacgcctccagtgacctcaaacagtacaactccggggcccagcaccgacacagctaccgaaactgcatcctctatgacaacctcgacgcctgatactcaagtaaccacagacaatggatcaggcgagccaagcactgatcccctgaccacaaacgaagccacccctccactaagtgtgacgactgcgcagacaaaagagaccaagaaacacactacactcgaccccaatacctccgctaaccctgatgccacgaccccatctatcacaattctgagcgcatccaatacttcacttccgaccagtagcgtccatgcctctccctccccttcaagcagtgaggaaccaacaccccagaacgctcaccatctgtctagatccttgctcagcgcagtgtcgactgagaccggtcagacagcctctgctaccactgccacgaaggaaatcacaaccaaaaattcccctccaactgcggggaacgacaccatggttacatcagcacccaatggaaacaccaggaatactccggagcaagccaaccctacagctcccgaagccagtctgaagattcagacgacccagaatcagcaaactgtgacaccagaggcaacccctatcacaactgtcaccgctctgacggatctcaccaaccggagcaagcgcgactccaaagtgcagataatcttaacattctctcagggcctgaagaaatactatagcaagattcttaaattgctgcagctaactcaagaggaagattcagagggcctcctggaatggtgtacccgagtacttgagcaggcctgcgacgatgactactttaacaagcgtatcgaagagttctttattacagggaagggatatttcaatgatgttctgcagtttagattgcacgacgcgctcagtaacactgagcccgcccaaaccacgtccccaacagcagtgcccttcaaaagctactatgctaagggttctctgacctttgactcaggctacttcagtgccaggtgttatcctcgggctagcaattccgggttacagctgatcaacgtcactcagcacccagtgaaaatagccaatacaccgggacccaagctctctaaccttaaaaccattaattgcatcaacctgaaggtgtcgactgataaagaacatagcgagttggaagtcaatgttctactgcctcaggtggcagtaaacctctccaattgtcacgtgtcaattaagagtcatgtctgcgactactctctggataccgacggcgccatcaaacttccacgcgtggctcacaacggtgtttttatccccgggacatacaaaattgtgatagataagaaaaataacctgaatgacagatgtacgttgaccactaactgcgtcatcaagggaagggaggtgcggaaaggccaaagcgcgctccgccagtataagacagaaattcgaatcggccagaccgtaacagggtccagaaggctgttagcagagggaggttcaagcgattgtatatctcggactcagctggttaagaccgaggtggccgaaattcacgaggactcctacggcgggcctggagaaaagatcacgatctgcaacggcagtacaattgtcgatcaacgtctaggtagcgagctcgggtgttataccatcaatcgcgtgaagtcttacaaactgtgcgaaaactccgcttcaggcaagagttgcgagattgacagcataccagtcaaatgtaagcagggattctgccttaagatcactcaggagggcagagggcatgtgaaattgtcgaggggaaccgaaattgttctggatgtgtgtgactcctcttgcgagctcatgatccccaagggtacaggcgacatcctggtagattgtagcgggggacagcaacacttccttcagaataacctgattgacttgggctgcccgaatgtccctctcctgggtaaaatggccatatatgtgtgtcggatgtcaaaccatccaaagactaccatggcatttttattctggtttagtttcgggtacgttatcacatgcattgtgtgtcgagtcctgttttatctactcatcgccattggcacggtggggaaaaagctgaagcagtaccgcgaacttaaaccccagacctgcatcgtatgtgagtccgtgcctgttaatgctatagatgccgagatgcacgaattgaactgctcttacaatatctgcccctattgtgcaagcagactgtccactgacggcctcattaggcatgtcacacaatgcccaaagcggcgcgagaaagtggaagagaccgaactgttcttaaacctggagagaatcccttggcttgtgaggaagttgctccaggtctcagagagcactgggatggcgctgaaacgtagttgttggatgattacactactgatcctcctgcttgtttctatgtcccccgtgcagagcgctccagtgggaaaggaacgggccatagagacctaccaagcacgagaagcctatacgggtatttgcttgtttgtactgggctcggtcttattcgctgtgtcatggctcactaaagccctgatcgatgggattggaaatagctttttcccgggccttagtgtttgtaagacctgctccatcggtagcataaacgggtttgagatcgaatctcacaagtgttactgcagcctgttctgttgcccttattgtagagcatgctcctcagacaaaaatacacacaggatgcatttgaacgtgtgcaagaaacgcaagatgggcagtaatgtcatgctcgctgtgtgtaaacggatgtgctttagagccaccattgaggcgagcaacaaggccctgctaatcaggtctattatcaactccactttcgttatatgtattctgatcctcacaatctgcgtggtatcaaccagtgctgtcgatatggagaatctgcccgcaggaatttgggaaaaggaggaagaccttacaaacttctgtcaccaggagtgccaggtgactgaaaccgagtgtttgtgcccatacgaggccatggtgctgcgcaaacccttatttctcgatagcatcgctaagggcatgaaatccctgcttaattctacgtcgctggaaacaagcctatcaattgaggccccttggggagcaataaacgtccagtccaccttcaagccaactgttagtgcggccaatatcgctctctcttggagctccgtggaacatcgaggaaacaaaattctggtatcaggccggtctgagagcatcatgaagttggaggaacgtaccggtgtgagttggaatctgggggtcgaggacgcctccgaaagcaagacattaactgtgtctgttatggatctctcacaaatgtattcccccgtgtttgagtacctgagtggagacagacaggtcgaagagtggcctaaagcaacctgtacgggcgattgcccggagaggtgtggttgcacaagctcgacctgccttcacaaggaatggccacactctcgcaactggcggtgtaatcccacttggtgctggggcgtggggacaggatgtacctgctgtggcctggacgttaaagacttctttactgattacatgttggtgaagtggaaagtcgagtatattaagacagaagctatcgtatgcgtggagctcacctcccaggaaagacagtgtagcctgatagaggccgggacgaggttcaacctaggacctgttactatcaccctgtcagagccacgaaatgtgcaacagcgccttccccctgaaattgtcacactccatccgaagatcgaggaaggctttttcgacctgatgcacgtgcagaaaattttgagtgcatctaccgtatgcaagctgcagtcctgtacacatggtgtgcccggggattttcaagtctaccacgttggaaacttactccggggcgacaaagtgaatggtcatagcatccacaagatagagccacacttcaacacttcatggatgagttgggatggctgcgacctggattatttttgtaatatgggggactggcctagctgcacctacacgggagtgacacagcataacagagccgctttcattaacatgcttaatatcgaaactgattataccaaaacatttcacttccattccaagagggtcaccgcgcacggcgacactccccagctggatttgaaagcccgtccagcatacggggctggagaggtgaccgttctcgtagaggtggccgacctggaactacatacaaagaagctggaggtctctggccttaaaatcgccagcctcacgtgctccggttgttatgcttgctcatctgggattagttgtaaggtgcgcatacacgttaacgaacctgatgagttcactgtgcacgtccggtcgagcgaccccgacgtggtagcagccggatcctctctgatggcgagaaaaatcgagtttggcgctgattcaaccttcaaggcctttagctccatgccaaaagacagtttgtgcttctacattgtcgaaaaggattactgttctagctgcacagacgatgacacccaaaagtgtgtgaatactaaattagatcatccgcagtcaatcctgattgagcacaagggtacaatcataggcaaacagaacgacacttgctccacgaagaccagttgttggctcaaatcttttaaggggttcttttatggactgaagaatatgctttctggcatcttcgggaacgtttttctgggaattttgctattcctggcaccttttgtgctcctgatcttcttctttttctttggctggaggcttttattctgcctgaaatgttgcaagaaaacaaagggtctcttgaaatacaagcatctgaaggataaagaagaggccgggtataagaaaattatcgaacgactcaatggaaagaaaggcaagtcccagctgtttgacggcgagcggcttgctaaccgcaagatagcagagctgttctcaaccaaaattcacatcgggtga

SEQ ID NO: 10264 - RNA, 5094 nt, synthetic construct
  misc_feature 1..5094: note = derived and/or modified CDS sequence (opt3) from CCHFV(YL04057)__FJ562094.1__GP
  source 1..5094: mol_type = other RNA
atgctgttccactttaagttcatgctccttatcaactttattctgtgccatttgttatggggcgggggaggtgtgaccggcggggtcgagacaaatagctcctctactcaggccatacccacgcctccagttacctcaaacagtacaactccgggacccagcaccgacacagctaccgaaactgcatcctctatgacaacctcgacgcctgatactcaagtgaccacagacaatggctcaggtgagccaagcactgatccccctaccacaaacgaaaccacgccaccccctagtgccactacagcgcagaccactgagaccaaaaagcacaccacgctggacccaaatacctccacaaacccggatgctatcactccctctattaccatcctaagcgcctccaatacatcactccctattagtagcgtacatgcatctccatccccctcaagcagtgaggagcctactccacagaacgcccaccatctgtctagatcccttctgagcgctgtgtcgaccgagacagggcagatcgcatctgccaccactgctgccaaagaaataacgacaaagaactcacccccgaccgcgggaaatgacactatgatcacctccgcacctaatggcaacacaaggaatacccccgagcaagccaacccaactgctcctgaagccagtcccaaaattcagacaacgcagaatcagcaaaccgtcatcccagaggcaactcccattacaaccatcacagctttgactgatctcaccaaccggagcaagcgcgactccaaggtgcagataattctgacgttctctcagggcctgaaaaagtactatagcaaaatcctcaagttactgcagcttacccaagaggaagattcagaggggttgctggaatggtgtacacgagttctagagcaggcctgcgacgatgactactttaacaaacgtattgaagagttctttatcactggaaagggttatttcaatgatgtgctccagtttagactgcacgacgcgcttagtaacaccgagcctgcccaaacaacttccccaaccgcagtcccgttcaagagctactatgctaaaggctctctgacgtttgactcagggtacttcagtgccaggtgttatccccgggctagcaattccggattgcagctcatcaacgtgacacagcaccctgtaaagattgccaataccccaggccccaaactgtctaacttaaagactataaattgcatcaacctgaaagtttcgacagataaggaacatagcgagctcgaagtgaatgtccttctgcctcaggtggcagtgaacttgtccaattgtcacgtctcaattaaaagtcatgtttgcgactactctctagataccgacggtgccatcaagctgccacgcatagctcacaacggggtgtttattcccggaacttacaagatcgtaatcgataaaaagaataacctcaatgacagatgtaccctgacaacgaactgcgtgattaaaggcagggaggtccggaagggccaaagcgcgcttcgccagtataaaaccgaaatccgaattgggcagactttcacaggatccagaaggctgttggcagagggtggctcaagcgattgtatatctcggacccagctcgtgaagacagaggttgccgaaatccacgaggactcctacgggggaccgggcgaaaagattactatctgcaacggtagtaccatcgtggatcaacgtctggggcgcgagttaggctgttatacgattaatagagtcaggagctacaaactgtgcgaaaactctgcttccggaaagtcatgcgagatagacagtatccctgtgaaatgtaagcagggcttctgcctaaaaattacacaggaggggcggggacatgtaaagctcagccgaggtaccgaaatcgttctggatgtgtgtgactcgtcctgcgagcttatgattccaaagggcactggggacatcttggtcgattgttctggaggccagcaacactttctgcagaataacctcatagacctgggttgccccaatgtgcctcttctggggaaaatggccatctatgtctgtcgcatgagcaaccatcccaagaccacaatggcattcttgttttggttctcatttggctacgtgattacttgcatcgcctgtagagttctcttctatctgttaattgctatcggaaccgtgggcaaaaagctgaaacagtacagggaactaaagccacagacatgcatagtatgtgagagtgtccctgtgaatgccattgatgcagagatgcacgaactcaactgctcctacaatatctgcccctattgtgcgtctcggctgagcacggacgggcttattcgccatgttacccaatgcccaaagagaagggagaaagtggaagagactgaattgtttctgaacctcgagcgtatcccgtggctggtccggaagttattacaggtgtccgagtcaacaggaatggctcttaaacgaagctgttggatgataaccttgctcatcctgctactggtaagtatttctcctgtgcagtccgcccccgttggtaaggaaagagcaatcgagacttaccaagccagggaaacatataccggcatttgcctcttcgtcctggggagcgtgctttttgctgtgtcgtggttgacgaaagccctgatcgatggaataggcaattcattctttccaggtttatctgtctgtaagacttgcagtattgggtccatcaacggcttcgagatcgaaagccacaaatgttactgctctctcttttgttgcccctattgtcgcgcatgcagctccgacaagaatacccaccggatgcatctgaacgtttgcaagaaaagaaagatgggatcaaatgtgatgcttgctgtgtgtaaaaggatgtgcttccgcgccacaattgaggcgagtaacaaggccctgttgatccgaagcattataaactctaccttcgtaatctgtattctcatcctgactatttgcgtcgtgtccacatcagctgttgatatggagaatctacctgcaggcatctgggaaaaagaggaagacctgaccaacttttgtcaccaggagtgccaggtgacagaaactgagtgtctctgcccatacgaggccatggtcctgcggaagccccttttcttggatagtatagctaaggggaaaaagagcctgttaaattccacctctctcgaaacgtcgctgagcatcgaggccccttggggagcaattaacgtgcagtcaacatttaaaccgaccgtttccgcggccaatatcgctcttagttggtctagcgtggaacatcgtggcaacaagattctggtatccggtagatcagagtctatcatgaaactagaggaaaggactggggtcagctggaatctcggagtggaggacgccagtgaatccaagaccctgacagtgagcgtcatggatttgtctcaaatgtattcaccagttttcgagtacctgtccggcgaccgccaggtggaagagtggcccaaggcaacttgtaccggtgattgccctgagcggtgtggctgcacgagtagcacatgcttacacaaagaatggccacactcgagaaactggaggtgttctcccacctggtgctggggagtagggactggctgtacatgctgtgggctcgacgtgaaggactttttcaccgattacatgctggtcaaatggaaggtggagtatataaaaactgaagctattgtttgcgtggagcttacatcccaggaacgacagtgtagcctgatcgaggccggaacccgctttaatttgggccctgtcacgatcactctctcagagccgcggaacgtgcaacagagactgcccccagaaattgttaccctacatcctaagatagaggaaggtttctttgacctgatgcacgtgcagaagatccttagtgcatctacagtctgcaaactccagtcctgtacccatggggtacccggagatttccaagtgtaccacgttggcaatctgttgaggggtgacaaggtgaacggccatagcattcacaaaatcgagccacactttaatacatcatggatgagttgggatgggtgcgacctggattatttctgtaacatgggagactggcctagctgcacttacaccggcgtcacgcagcataatcgtgccgcttttattaacatgttaaacatcgaaacagattatactaagaccttccacttccattccaaacgcgtgacagcgcacggggacacaccccagctcgatctgaaggcccggccagcatacggagctggcgaggtaactgtgcttgtcgaggttgccgacctggaattgcataccaaaaagctcgaggtgtctggtctgaagatagccagcctaacatgctccgggtgttatgcttgctcatctggaatcagttgtaaagtgaggattcacgtcaatgaaccggatgagtttacggtgcacgttagatcgagcgaccctgacgtagtggcagccggctcctctctgatggcgcgaaagatcgagttcggtgctgattcaacttttaaagccttcagctccatgcccaaggacagtctttgcttttacattgtcgaaaaagattactgttctagctgcaccgacgatgacacacaaaagtgtgtgaacaccaagctcgatcatccacagtcaatcctgatagagcacaaaggcactattatcgggaagcagaatgacacatgctccaccaaaacgagttgttggttggaaagcgttaagggattcttttatggcctgaaaaacatgctgtctgggatcttcggaaatgtgtttctcggcattctgcttttcctggcaccctttgtcttgctaatcttcttctttttctttggttggcggctcctgttctgcctgaagtgttgccgcagaactagggggcttttaaagtacaaacatctgaaggatgaggaagaggccggatataaaaagataattgagcggctcaacggcaaaaagggcaagtcccagttgtttgacggggaacgactggctgatagaaaaatcgcagaactcttctcaacaaagattcacatcggatga

SEQ ID NO: 10265 - RNA, 5094 nt, synthetic construct
  misc_feature 1..5094: note = derived and/or modified CDS sequence (opt3) from CCHFV(79121M18)__GU477493.1__GP
  source 1..5094: mol_type = other RNA
atgctgttccactttaagttcatgctccttatcaactttattctgtgccatttgttatggggcgggggaggtgtgaccggcggggtcgagacaaatagctcctctactcaggccatacaaacgccccctgttacctcaaacagtacaactccaggaccgagcaccgacacagctaccgaaactgcatcctctatgacaacctcgacgcccgatactcaggtgaccacagacaatggctcaggtgagcctagcactgatccactgaccacaaacgaagccactccccctctaagtgtaacgactgcgcagacaaccgagactaaaaagcacacaaccctcgacccatccacgtctaccaatcccgatgctacaactcctagcatcaccattctgtccgcctcaaacacaagtcttccaatcagctctgtgcatgcatccccgtcacccagcagttctgaggaacctactccacagaatgcccaccatctgtccaggagcttgctctcggctgtctctaccgagacagggcaaattgcatccgccgctaccgccgcgaaagaaatcactacgaagaactcaccccctacagcaggaaatgacaccatggtgaccagtgccccaaacggcaatataagaaacacccccgagcaggctaatccgacagcccctgaagcaagccccaaaatccagaccactcagaaccaacagacagttacgccagaggctacccctattactacaatcaccgccctgacagatctgactaatcggtccaagcgcgactctaaggtgcagaaaattctcaccttcagccagggcttaaagaaatactattcaaagatcctgaaacttttgcaactgacgcaggaggaagatagtgaggggctactcgaatggtgtacccgagtcctggagcaggcgtgcgacgatgactactttaacaagcgtatagaagagttctttattacaggaaagggttatttcaacgatgtgcttcaatttagactgcacgacgccttgtccaatactgagcccgcacagaccacaagcccaactgctgtacccttcaaatcttactatgccaagggctcactcacctttgacagtgggtacttcagcgctaggtgttatcctcgggcctccaactctggactgcagttaatcaatgttacgcagcacccagtgaaaattgcaaacacaccgggccccaagctgtcgaatctcaaaaccatcaactgcatcaatcttaaggtcagcactgataaagaacattccgagctggaagtgaacgtgttgctacctcaagtcgccgttaatctgtcaaactgtcacgtgagtattaagtctcatgtatgcgactacagcctcgatacagacggtgctataaagctgccacgcgtggcgcacaatggggtctttatccccggaacctacaaaattgtgatcgataagaaaaacaatcttaacgacagatgtactctgataaccaattgcgttattaagggcagggaggtgcggaaaggccagtccgcattgcgccagtataagacagaaatccgaatcgggcagacgttcaccggatcaagaaggctcctggccgagggtggcagctctgattgtatttcccggactcaattagtcaagacagaggtggctgaaatccacgaggacagttacgggggacctggcgaaaagattaccatatgcaacggtagcacaatcgtagatcaggggctgggctctgagctaggatgttatactattaaccgtgttcgctcctacaagctctgcgaaaattcagccagtggcaaaagctgcgagatcgactcgatcccagtgaagtgtaaacaggggttctgcctgaagattacccaggagggaagaggtcatgtcaaactttccaggggcacggaaatagtgttggatgtctgtgactctagctgcgagctgatgatccccaaagggacaggagacattctcgtggattgttcaggcggtcaacagcactttctgcagaacaatcttatcgacctggggtgcccgaacgttcctttgctcggcaagatggcaatttatgtgtgtcggatgagtaatcatccaaaaaccactatggccttcctgttttggttctcctttggatacgtaattacctgcatagcttgtcgagtcttattctatctgctaatcgccattggcacagtggggaagaaactcaagcagtaccgcgaactgaagccccaaacttgcatcgtttgtgagtctgtgcctgtcaacgcaattgatgcggagatgcacgaacttaattgcagctacaacatctgcccctattgtgcttccagattgtcaaccgacggactgataaggcatgtgacacagtgcccaaaacggcgcgagaaggtagaagagacggaactctttctgaatttagagagaatcccttggctggtgaggaaacttttgcaggttagcgagagtaccggtatggccctcaagcgttcttgttggatgatcactctgctaattctgctcctggtctccatcagccccgtgcaatcggcaccagtgggcaaagaacgggccatagagacataccaggctcgagaaacctatactgggatctgccttttcgtcttgggatcagttctgtttgccgtgtcttggttaacaaaggcactcattgatggcatcggtaacagtttctccccggggctgagcgtgtgtaaaacctgctctattggcagcatcaatggatttgagatagaatcccacaagtgttactgctcacttttctgttgcccttattgtagagcttgcagtagcgacaagaacacgcacaggatgcatctgaatgtatgcaaaaagcgcaaaatgggctctaacgtcatgttggccgtgtgtaagcggatgtgctttagagcgactattgaggcctccaataaagctctcctgatcaggtcaatcattaacagtaccttcgttatctgtattctaatactgacaatctgcgtggtcagcacctccgcagtggatatggagaacctccccgccgggatttgggaaaaggaggaagacctgactaatttctgtcaccaggagtgccaggttacagaaaccgagtgtctttgcccatacgaggctatggtgttgcgcaagcccctgtttttagattctacagccaaaggaatgaagtcgctcctgaacagcacttcacttgaaacctccctgagtatcgaggcaccttggggcgcgattaatgtacaatctacgttcaaaccaacagtcagcgccgctaacatcgccctatcctggtcatctgtggaacatcgaggtaataagatactcgtgagcgggcggagtgagtccatcatgaaactggaggaacgtaccggagtcagctggaacttgggcgttgaggacgcatctgaatcaaagactctgaccgtgtccgtaatggatttaagtcagatgtatagccccgtgtttgagtacctctcgggtgacagacaggtcgaagagtggcctaaggctacatgtactggcgattgcccggagaggtgtgggtgcacctcttccacgtgcctgcacaaagaatggccacacagccgcaattggcggtgtaaccccacatggtgctggggagtgggcaccgggtgtacttgctgtggacttgacgttaaggacttctttacagattacatgctggtgaaatggaaggtcgagtatattaaaaccgaagccatcgtgtgcgttgagttgacttcacaggaaagacaatgtagtctcattgaggcaggcacaaggttcaatctgggtcctgtgaccatcacgctatctgagccacgaaacgtccagcagcgcctgccccctgaaatagtaactcttcatccgaagattgaggaagggtttttcgacctcatgcacgtgcagaagatcctgtccgccagcaccgtttgcaaattgcaatcatgtacacatggagtgcccggcgattttcagatctaccacgtcggtaatctgttacggggcgacaaggtgaacgggcatagtattcacaaaatagagccacacttcaataccagctggatgtcctgggatggatgcgacctcgattatttttgtaacatgggcgactggccttcttgcacatacactggggtaacccagcataatagagctgcgttcatcaacatgctgaacattgaaacggattatacaaagacttttcacttccatagcaaaagggtgaccgcccacggagacacaccccaacttgatctgaaggcacgtccagcttacggcgccggtgaggtcaccgttttggtggaggtggccgacctcgaactgcatactaaaaagctagaggtctccgggctgaagatcgcttcacttacctgctctggatgttatgcatgcagttcgggcattagctgtaaagtgcgcatccacgttaatgaacctgatgagttcacagtacacgtgcggtcctctgaccccgacgtcgtggccgcgggttcaagcctcatggctagaaagatagagtttggcgccgattccacgttcaaagcatttagttctatgccaaaggacagcctgtgcttctacatcgttgaaaaagattactgttcatcctgcactgacgatgacacccagaagtgtgtgaacacaaagttggatcatccgcagagtattttaatcgagcacaaagggaccattatcggaaagcagaatgacacttgcagcacaaaaacctcttgttggctggaatccgtcaagggctttttctatgggctcaaaaacatgctgtcaggaatatttggcaatgtgttccttggtatttttctgttcttggccccttttgtactactgatcttcttctttttctttgggtggaggctcctgttctgccttaagtgttgccgacggacgcgcggattactgaagtacaaacatctcaaggatgaggaagaggctggctataaaaagatcattgagagattgaacggcaaaaagggaaagagccaactgtttgacggggaaaggctcgcagatcggaaaatcgccgagctgttctcgactaagatacacattggttga

SEQ ID NO: 10266 - RNA, 5088 nt, synthetic construct
  misc_feature 1..5088: note = derived and/or modified CDS sequence (opt3) from CCHFV(ArD39554)__DQ211628.1__GP
  source 1..5088: mol_type = other RNA
atgctgtgccacatcaagcatattctccttttctgtataatcctgtaccaccagcaatggaacaccggcgccagcaatacaactatttcccccacgaccaacaaatctcatacagacatctcacaccagcctaccagtattactgctgcaagctccccagggtctccggccacaaccgcgccccctgagagatcggtgactccatcacatacacccaccacgagcgtcagtgaagctggatccggtgagcctccagccgcaactcccgcctctgctaccgcacagagccctgaaccagcctccgctgcccagccgtcacccacaatccctaagccaactacccccgatcctacaagtgaggcgttgagcaccccagcaacgtctaggccccaagaaccgtccactcacccttcaccccggagcagtccatctaaacctgttgagacacagtccacccgccacactgcccgagagttactgagcgtgacaggcaccgaagctgagcagctaataacgcagaccatccatacaactaaggaagccaccaaagcaacatcgccccaaccaactgcttctaatcccgaccctaccctcgccacaacctcccgttcaattaacagtatcaatccaaaggggccggagagcactagagcgacgccccagtccacatctcctaccccagagagctcaactattcagacccagatcctgcccataattacaacccctggaactcttgaagccatcattcacccaacaaacaggagtaagcggaatctgggcacggagatcatcttgaccctcccccaaggtctgaaaaagtattactccaaagtactgaagctcatgcatttaactcgcgaagaggatagcgaagggctgcttgagtggtgcacaagaattttgggacagacctgtgacgatgactattttcagaaaaggataacagagttctttatcactggcgtgggctacttcaacgaagtcctgctatttaaggagaccacggatgcaccgaccctcgctcctacacacaagggggccccacccactgaacctttcaaatcttattacgctaagggatttattaccatggactcaggttatttcagtgccaaatgctacagccgggcatccaattctggcctgcaacttatcaacgtgacaatgcactcgagcaagatgcccataactccagggcctaaatactccaatctgaagaacattaattgtatcaacttgaaagtttcaaccgataaggagcataatgaagtggagatcaacgtcctcctgccccaggtggccgtaaacttaagttcttgccacgttctggtgcgcagccatgtctgtgactattccctcgatgctgacggaatgattaagctgccacagatcacgcacgagggcacatttattccgggtacctacaaaataatcattgataagaaaaataagcagaacgaccgatgcactctgatcacaaattgtgtgatcaaagggagagaagtgaggaagggacaatcagcgttgcggcagtataagaccgagattcgtgtcggccaggcaagctctggcactcgcagactactgtccgaaagtaacaataacgactgcgttagcaggacccagctcataaaaacagagaatgccgaaatccatggggatgactacggaggtcctggcgagaagattacgatctgtaacgggtctaccattgtggagcaacggctgggatccgaacttggctgctatactatcaatcgaataaaatcattcaagctgtgcgagaacagtgctagcggtaaagggtgtgaaatcgattcgacacccgtaaagtgcaagcagggcttttgtttgaaaattacccaggagggacgcggccacgtgaagctctccagagggtctgagatcattctggacgtctgcgatagctcatgtgaaatgatgatcccaaaaggaagtggtgacatattagtggattgctccggcgggcagcaacacttcctgcaggacaatctagttgatctcggatgtcccaacgtgcctctgcttggcaagatggccatttacatctgcaggatgtctaatcatccaaaaacaactatggcatttttgttctggttcagctttggttatgtcattacctgtatcttctgcaaggtgatattttacgtactgatcattatcgggacgctcggcaagcggattaaacagtaccgcgagctgaagccccagacatgtaccatctgcgaagccactcctgttaacgctatagacgccgagatgcacgatcttaattgctcctataacatttgtccgtactgcgcatcaagactgaccagcgaaggattggtgaggcatgtcacacaatgtccaaaacgtaaggagaaaatcgaggaaactgagctctatctgaacttagaacggatcccctggttcgtgcgaaagctgctacaggtcagtgagtctaccggcgtggcgctcaaaagatccagctggctggttacacttttggtgctgctcacggtatcgctgtcacctgtccagtctgctccaattgggcaagaaaggaccgtggttacttaccaggtgcgcgagagttatacaggaatgtgcttatttatcctgggttccgtccttttcgccattagctggttgaccaagggcctcgtggactctgtagggaatatatttttccccggactgagcgtgtgtaagacttgctccatcggctcaattaacggttttgagatcgaaagtcacaaatgttactgcagcctattctgttgcccttattgtcggtactgctctgcagacagaggggcccaccagtcccatctgtcagtttgcaagaaaaggaagacaggcagtaatgtcatgctcgctgtgtgtaaacgcatgtgctttcgagccaccctgaaggtgagctccgaggcacttattatccggtctataatcaacacgactttcgtcgtttgtattttgatcctggtggtgtgcgtagtctcgaccagcgctgtggaaatggagaatttaccggccggaacatgggaaaaggaggaggatctcaccaacttttgtcaccaggaatgccaagttactgagacagaatgtctgtgcccctacgaggcgttcgtgcttcgtaaaccactgttcttggactcaaccgccaagtccatgaaaagtctccttaattctacaagcctagagacttccctgtcaattgaagctccttggggcgcaatcaacgtccagtctacctttaagcccacggccagcacagctaatatagccctcagttggtccagcgtggagcatagagggaacaaaattctggttaccggaaggtctgaatcaatcatgaaacttgaggaacgcactggcatctcctggaatttgggtgtggaggatgcaagtgagagcaagaccctgacagtatcggtcatggacttatctcagatgtattccactgtgttcgaatacctcagcggggatagacaggtggaggaatggccaaaggcgacctgtacgggagactgccctgagcggtgtggctgcacatcaagtacctgcctgcacaaggcctggccccattctaggaactggcgatgtaatccaacttggtgctggggtgtcggcacagggtgtacctgctgtggacttgatgttaaaaacctgtttactgactatatgctaattaagtggaaagtggaatttataaagacagaggctatcgtatgcgtggagctcacctcccaagaacgccagtgtagcctgattgaggccggcacgcggtttaatttggggccggtcactatcaccctgtcagaacctagaaacattcagcagaagttacccccagagctcgtgacactgcaccccagggttgaagagggattctttgatcttatgcacgtgcaaaaagtcctgagtgcaagcaccgtgtgcaagttgcagtcctgtacacatggcgttcctggtgacctccaggtgtaccacgtcgggaacctgctaaaaggagataagatcaatggcaactctttccataaaatagagccaaatctgaacactagctggatgtcctgggacggttgcgatcttgactattactgtaatatgggcgactggccctcatgcacctatacgggggtaacacaacacaaccatgctgcctttgtgaatctcctgaacatcgaaactgattacaccaagaatttccactttcactctaaacgtgttacagcacatggagagacccctcagttggacctgaaggcccgcccgaagtacggcgctggggaagtgactgtcttagtggaggtagcggatatggagctccacaccaaaaagattgaaatcagtggactgaaattcgcctcgcttacatgcacgggctgttatgcatgcagctccggtatttcttgtaaggtgcggctgcatgtcgacgagccagatgaattgactgttcacgtgaaatcagacgatcccgacgtggtcgctgccagctccagtctcatggccagaaagatcgagtttgggaccgattctacattcaaggctttcagctcaatgcctaaagacaagctgtgcttttacatagtggaaagggattattgttccagttgcagcaaagaggacacccagaagtgtgttaacgcaaaactagagcagccccaatctattctgatcgaacacaagggaactatcattggcaagcagaatgatacatgcaccgtaaaagcctcctgttggcttgagtcagtcaagagcttcttttacggtctcaaaaacatgctgggcgggatcttcggaaatgtgatattgggcattatcatgtttttagcgccattcgctctgctcctgcttttcttcctgtttgggtggcgaattttgttctgcctacggtgttgccgcagaacgaggggactgtttaagtataaacatatcaaggacgacgaagagtcgggctacaagcggataattgaacgactcaacaataaaaagggtaaaaacaagctgttcgatggggagagacttgccgacaaaaagatcgcagagttattctctactaagacacacatcggatga

SEQ ID NO: 10267 - RNA, 5088 nt, synthetic construct
  misc_feature 1..5088: note = derived and/or modified CDS sequence (opt3) from CCHFV(AP92)__DQ211625.1__GP
  source 1..5088: mol_type = other RNA
atgcccgaccacttcatcctgctccttctgatgtacaccgtgtttcatcagcaccctcaagatgtcagcgccaacgttcatttggtgaatccatccaactctacaactggcgcttcaacggcattcaatccggtacacaacgccaccacagacgggcagaagcagagtactagcaccacaaccatggcgagaccctccactgtgacacagattaccacggctcaagccatggaggtcgatggatctggtgaatcgactaccttacctgcagtgacaccaactcccgccgagaccacaacccatgctaatcagaaatcagcaagcacgatgggcactctgacaaccagtctagaagacactgccctcatgacactgaccgggaggtccatacttacgtctcagagccagaccggatcctttgatcggacatcaaagcctcaaactccacgcagtaccaaccagcccctgcgaaaattgctcagcgctgtttctacagaggccgcgcctcagacttccccaaccgcagtgacagccgaccagaccgaagctagcactagcccgcaagtcacgacagataccagtccctctactcctacccaggtgacatccagcgccggctcgtcttcctcaaataccagtaaccacagcaagactacaccacagctgacgtcctctggtagcgaggcacaacagacccagcccactacaatgcctaataccacagctctggtaactccaaccgcccacatctcacccacgaaccgtagtaaaagaaattccgaggttgaaattatcctcaccttaccgcaggggctgaagaagtattacagcaaaattcttaagttgctgcatctaacactcgaggaagactctgagggactgcttgagtggtgcactaggaccctgaaacaagcgtgtgatgacggctatttccaggaacggatcaaggagtttttcttgacaggcgaagggtactttaacgaggtgctcctgttccgctcacctagtcagttaggaactaccggtagccccctggcctccccacctacggcagaaccctttaaatctttctatgctaagggctttctcataatggattcggggtacttcagcgccaagtgctatccaaaggcttccaattcaggacttcagctgatcaacattacacaacacagtatcaaggtcgtgaatacccccggccctaaatactctaacttgaagactgtgaactgtattaatctaaaagtcagcacagacaaggatcattccgagctggaggttaacgtgctcctgccacaggtagccgtgaatatctcaaactgccacgtccttataaaaagccacgtgtgtgactactctctggacaccgatggtatgattagattgccgcaggttactcatgaagggacctttatccccggaacatataagattgtgatcgacaagaaaaataagctcaacgataggtgcacgatgaccactaattgtgtcatcaaaggcaaggaggtgcggaaaggccagtccacactgcgccaataccgaaccgaaattagagtagggcagatgagtagcggaacaaggcggttactgtctgagggtggcgacgggggatgcatatcccgtactcagctaatcaagaccgaaacggcagaggttcacggcgatgactatggtgggcctggcgagaagattacaatctgtaacggatcaaccatagtggatcagcgcctcggcagtgaactggggtgctacactattaatagaatcaaatcattcaaactttgtgagaactcggcccaaggtaaaaattgcgaaatcgactccgctccagtccagtgcaggcagggatattgtttgaagatttctcaagagggccgggggcatgtgaaactgagccgaggatcagaaatcgtcctcgatgtgtgcgacaccagttgtgagattatgatacccaagggcacaggtgatatcctggttgactgctccgggggccagcagcacttccttcagtctaacctggtggacttgggatgtcctaatattccactcctgggcaagatggcgatctacatctgccgcatgagcaaccatcccaaaactaccatggcatttttattctggttttccttcgggtatgtaattacatgtatactgtgcaagacgctattttacatcctcattatcattggaaccctgggtaaaaagctcaaacaatacagagagttgaagccgcagacttgtacaatctgcgaatcagtccctgtgaatgccatagatgctgagatgcacgacctgaactgtagctataacatctgcccatactgcgccagtaggctcacctctgaaggcctgactcggcacgttaatcagtgtcccaagcgcaaagagaaggtggaggaaacagagttatatctgaaccttgaaaggattccttggatcgtcagaaaattgctccaggtgtccgagagcaccggggtagcactgaagcgttcgtcatggatgattgtgctactgatcctcctgatagtttctatgagtcccgtccaatccgccccaattagccaggaacggacggtggctctttaccagtctcgagaggattatatgggaatctgcttggtgattatgggcagcgtcctgttagccgtttccctcctggtgagaggtcttatcgactcaataagtagcactttctttcctgggctgtctgtgtgtaggacctgccatatcggctccattaatggattcgagatcgaatcacacaaatgttactgcggcttgctctgttgcccctattgtcgcgcatgcagtacagatcaggacgcgcatcaatttcacctgagcgtatgtaagaaacggaaggctgggtccaacgtcatgctagccgtgtgcaagagaatgtgcttcaaagcaattatcgaggcctctaataaggttctgtttataaggaacgtgattaataccactttcgtcgtgtgtatcctcgttatggtggcttgcatcgcctcgagcgcagctgtagaaatggagaacctgccagccggaacatgggaacgcgaggaggaacttaccaatttttgtcaccaggagtgccaggtcacagaaactgagtgtttgtgcccgtacgaatcattcattctgcgaaaacctttattcctcgattccatcgcgaagggcgtgaaaaacctgcttaatagtacctctctggagacgagcctatccattgaggccccctggggtgctataaacgcacaatcaacatacaagccaaccgcctctagcgctaatatcgccctcacttggagttccgtggaacatcgggggaacaagattctggtcagcggacgttctgagtcaatcatgaaattggaagagagaaccggcatttcctggaatctgggtgttgaggacgcaagtgaaagcaggacattaactatctcggtgatggatctctctcagatgtattcccccgtatttgagtacctgagcggcgaccgccaggtggaagagtggcctaaggcgacctgtacggggaactgcccagaacggtgtggatgcacatcaagtacctgtctttataaagagtggccccactctagaaactggaggtgcaatcctacttggtgctggggcgtcgggacaggatgtacctgctgtggcctggatgtgaaggagttgttcactgaccatatgctcgttaaatggaaggtggaatacataaagacagaggccatcgtctgcgtggaactgacctcccaggagcgacaatgtagcctaattgaagctggtacgcgcttttcactggggccggttactatcacccttagtgagccacggaacattcagcagaaacttccccctgagctgatcacattgcacccaaagatagaagatggatatttcgacctgatgcatgtgcagaaagtcatgagcgcctccaccgtatgcaagttacaatcttgtacacacggcgtgcccggtgacctccagatttaccacgttggcaatctgcttaaaggggatagagtgaacggacatctgatccacaaggtcgagcctcatttgaatactagctggatgtcctgggacggctgcgatctcgactatttttgtaacatgggggattggccgtcatgcacctacacgggagtgacacagcacaatcatgcagctttcgccaacctgctaaatatcgaaactgactacaccaagacatttcacttccactctaaaagggtaaccgcacatggcgatactccccagctggaccttaaggcccgtccacgctatggtgctggggagattaccgtgctcgtcgaagttgcggatatggagctgcacacgaaaaaggtggaggtgacaggattgaaatttgccagtttaacttgttcgggctgctacgcatgcagctccggtatatcttgtaaggtccggatccatgtggacgaacctgatgagctgaccgttcacgtaaaatcaagcgaccccgatattgtggctgcctccagttctctcatggccagaaagatcgagttcggcgtcgacagcacatttaaggctttctcatccatgccaaaagacagtctgtgcttttatattgtggaaagggattactgtaacagctgcaagaatgaggaaacccaacgatgtgttaacgcaaaacttgagcagcctcagtctatcctgatagaacacactgggacaatcattggaaagcagaatgatacctgcggctcccggacgtcatgttggttggacagcttcaaatcgttcttttatgggctaaagtctatgctgagtggaatcttcggcaacgtgtttctcggtattttcctgtttcttgcccccttcgcgttactgctctttttctttttctttgggtggcgcatcttgttctgcttcaagtgttgcagaaggactcggggactgtttaaataccgacatataaaggacgatgaggaagtcggctataaaaagattatcgagagactcaataacaaaaagggcaagcaccgcctgcttgacggggagaggctggctgatcgtaaaatcgccgaattgttctccacaaagacccatattggatga

SEQ ID NO: 10268 - RNA, 5085 nt, synthetic construct
  misc_feature 1..5085: note = derived and/or modified CDS sequence (opt3) from CCHFV(UCCR4413)__KY484038.1__GP
  source 1..5085: mol_type = other RNA
atgctgagatacatcctctatgcccttctggctagcgcaattttgcaccagcatttatacaaggtgggcgccgacacccaaaaacccacagtcaggactaacacgacccacaagatatcccctacagcgactgctaatcggaccacatatgagcaggccaccccatctactacaccgaaatcaagtaccaagcccacgactcatatcgcaaccgcccacctggctgagagcgatgggtccggagagacaactctactcctgcctaccacagcatctcagtacaccacggaaggtcagacttcgcttgagccaacagccgaagagaccggctcaaacactattcccagcgacacaaccagtacgtcccctatcaccgaaaattctgaaagcacagatactcaaatgaacgtttccgactcaagtagctctccactggctacccagggggcccgctcccccgcgcgaaatttgctctcagtgcctagcgtagagccaggacagcagacaactccgaaacaacccaccacaaagggcaccgtgactcctacgacaccacagcccaccaccagttctcctactccagcacccacatccgccaccctgagcactaactcgtcttccatttcaacaccggtccagacgagtagccctctgcagcccatggctccatcccatgaaacccaacacgccctctatactacatctaccgagagcacattacgtactctgtcagcagagagaatccaccctaccaataggagtcggcgcaactccgaagtggagataatccttacgttgccccagggtctgaagaaatactatagcagactactcaagctgcttcatctgaccatggaagaggatacagaagggttgcaggagtggtgcgttagggtgctcggacaaacttgtgacgattcttacttccacaaacggctggctgagtttttcattaccggcacaggctttttcaatgaagtcttactgtttcgctcaccaagtactcccaccacgatcaagcctagcccaacagggtccccgaccgtggagcccttccgatcttactatgccaaaggatcgctcactattgacagcggttacttttccgcgaagtgctatcctagaacatcaaacagtggccttcagctgatcaatttgacccagcattctgtagaaatagccaacactccagggcccaagcacagctccctaaaaaccattaattgtatcaacattaaggcatcaacagataaagagcacaatgaagttgagatcaacgtgctgctccctcaggtcgctatcaacctgagcaattgccatgtgtctattaggtcccacgtgtgtgactacagtcttgatacggacggaaagatacggctgccacaaatcagccatgagggcaccttcattcccggtacttataaaatcataattgataagaaaaacaagttgaatgaccgttgctctctcatcacatcctgtgtcatcaaggggcgcgaactgagaaaaggacagtcaaccttaaggcagtacaagacagagattaaaatcggccagaccagtagcggctcgcggcgactgctatccgaatctagcgcctcagggtgcattagtcgcactcaaatgataaagtccgagacggctgaaatccacgacgatatttatggaggtccgggcgagaaactcacaatctgtaacgggaccactgttgtggaccagagactgggatctgagcttggctgctacaccatcaataggattaagacatacaagttgtgtgaaaacagcgtaaaagagaagacttgcgaaatagattccgtgcctgtcaaatgccggcagggtctgtgtctcaagatcacccaggaggggcgcggccatgtgaaactgtcaagaggaagcgagattgttcttgacatctgcgatagttcttgtgaactgatgattccaaagggcacaggggacatcttggtggattgctccggaggtcaacagcactttctccaggacaatctggtcgatttaggctgtcccaacatacctctgctagggaaggtggccatctatatttgcaggatgagcaatcaccccaaaacgaccatggcattcctcttttggttctcgtttggatacgtaatcacttgtattctgtgcaagatccttttctatttgctgataattacaggcaccctcggtaaaaagctgaaacagtaccgtgagttaaagccacaaacttgtacaatctgcgaatcaacccctgttaacgccattgacgctgagatgcatgatctgaattgttcttataacatctgcccctactgcgcgagtcggcttacgtccgacgggttgatacgacacgtgaatctctgtccaaagagaaaagaaaaggtcgaggagactgaactgtatctaaacctggagaggatcccgtggttcgtgcgcaaactcctgcaggtcagcgaatctaccggcgtggcacttaagcggagctcctggttgctgattttagttatcctcctgacagtgtcaatgagtcctgtacagagcgcccccattaatcaacagagagctgtcgaggcctaccaggcaagggaaggatacaccggcatctgcctttttatactggggtctgtgttgttcatgacttcctggctcacaaaaggactgattgactcaatcggtgatagctttttcccaggcctatttgtttgtaagacctgcagcatcgggtccattaacggattcgagatcgagtctcatcgctgttattgctcgctgctctgttgcccctactgtcgaacatgcagcgccgacaaagattcacaccagctgcacctttccatttgtaagaagaaaaaggctggcagtaacgtgatgttggccgtctgcaaacggatgtgctttaaggcaactatagaagcgtctaatcgtgtgctgttaatcagaagcattatcaacaccacgttcattatctgtatgctcatactggtagtgtgcgttatctccacatcagctgtcgagatggaagaccttcctgccggtacctgggagagggaagaggatctgactaatttttgtcatcaagagtgccaggtgaccgaaacagagtgtctatgcccatatgaagcattcgtgctccgcaaacccctgtttttgtctagcattgtcaaggggaagaaaaacctgttaaatagtgcctccctcgagactagcctgtctatcgaggctccttggggcgccattaacgcacagtcaaccttcaagccgacgatctccacagctaatatagcccttagttggagctcggttgaacaccggggaaacaaagtgctggtgtctggcagatccgagagcattatgaagttggaagagaggaccgggatctcatggaatctcggagtagaagacgcgagtgagtctcgaatgctgactgtctccgtgatggatctaagccagatgtacctgccagtttttgagtatctttcaggcgaccgccaagtggaagagtggcccaaagccacatgtaccggtgattgccctgaacggtgtgggtgcacaagtagcacttgtctccataaggagtggccacactccagaaactggaggtgcaatcccacctggtgctggggagtcggcacgggttgtacttgctgtggcctggacgtgaaggatttgttcaccgactacatgttcgttaaatggaaggtggaatatatcaaaacagaggctattgtatgcgtcgagctgacctctcaggaacgtcagtgtagcttaatagaggcagggacacgctttaacctcggacctgtgactatcaccctgtccgaaccgcggaatattcagcaaaagctgccctcagagatcgtgacgctgcatccaaaaattgaagagggcttctttgatttgatgcacgtccagaaggttctctctgccagtacagtgtgcaagctgcagtcgtgtactcacggggtagctggagacctacaagtgtaccatgtcggcaacctgcttaaaggtgacaagatcaatgggcacagcatacataaaatcgagcctcacctcaacacctcctggatgtcttgggatggatgcgacctggattactattgtaacatgggcgactggccctcatgcacatacaccggtgtgactcagcataatcacgccgcattcgttaacttgttaaatattgaaaccgattatacaaagagctttcacttccattccaaaagagtgacggcgcacggcgacactccacagctggatctcaaggccaggcctatgtacggggctggagagatcaccgtcctggtggaagttgccgacatggagcttcatagtaaaaacattgagatctctggcctgaagtttgcaagtttgacatgttcagggtgctatgcttgctccagtggaataagctgtaaggtgcgaatccacgtcgatgaacccgacgagctagccgtacacgtgaaatctgatgacctggatgttgtggcagcctcctcaagcctcatggctcggaagattgagttcggcaccgactcgacttttaaagcgttctctagtatgccaaaggagtccctgtgcttttacatcgtcgaacgcgacttctgtaaaagctgcgccgcagaggatacacagaagtgtgtgaaggctaaacttgagcaaccgcagtcaattttaatcgaacataagggtaccataattgggaaacagaatgacacgtgctccactaagacatcttgttggctggagagctttaaaagtttcttctatggactcaagaacatgttgtccggcgtatttggtagcgccatcatgggcattcttctcttcctggccccttttatccttctgatattgttctttttctttgggtggaggattctattctgcctgagatgttgccggcgaaccagaggactctttaagtacaaacacatcaaggatgacgaagaggctggctacaaaaagatcattgaaaaattaaataacaagaaagggggaacctctaagctgcttgatggcgagcgcctggcagacaggaagatcgccgaactcttctcaactaaagcgcatattggttga

SEQ ID NO: 10269 - RNA, 5076 nt, synthetic construct
  misc_feature 1..5076: note = derived and/or modified CDS sequence (opt3) from CCHFV(SCT ex Afghanistan)__KC344856.1__GP
  source 1..5076: mol_type = other RNA
atgcaccatgcctaccagatcatgtataccctgctcgtgtgcgctattctttgtccccaaccttggagcctggagggcacacacgtcccattgaacgggactaagcataatggaacgggtataaccgcagccccgggcgggtcccagggacccacatctcctgcgtcaactgctgttagtttaaccccagaccccttcacaaccgaacctactgccagcgcagtggagctggaatcctctggcgagggtcacacatcgctatcagtaaccacgcaggggctcactagcccagaaaccacacccggactgcctactgtgaccgatacaggcgtcagttccacctctatctttggcattgggatcagagtggccggagacacgccaactagcacaacccatactggtcttccgtcctcacccagtatgcctagcacagctcagggcccacaccacgcagttagggggctgttgtctgtgtcctcaacccggcccggagaggccagcacgattaccgtccctggcgaggctggtacagaagccaacagttcttccagcgcgatctcgaaaaagccagcaccctctccgactgccgaggctataaccgaagccaataactcctcaaatcctcgccaacccgagctcagtacacagccagcaatccctgggctggtgactagctccgctcagcccattctgctccagtctgccaccagcacagcggcccaagatatctacccatcacccaccaaccgaagtaaacgtaatttagagatggaaattatcctgactctttcccagggattgaagaaatattacggcaagatactgagaatcctagacctcacgctggaggaagatacagagggccttctggaatggtgcaagaggaacttggggctcacctgtaatgacaacttctttcaggagcggattgaggagttctttctgactggagagggtcatttcaatgaagtattacagtttaaaacccctagcacactgtctccaaccgagccgactcacacacgcacgcccaccgttaagcctttcaaatcatattttgcaagaggcttcctcagtattgatagcgggtacttttccgctaagtgctattctaaaacttcgaacagcggacttcaactgatcaatatcacacagcatccagccaggattgctgacacccccggccctaagataacaaacttgaaggccatcaattgtattaacctaaaagcatccgtgttcaaggaacaccgggagatcgagataaacgtcctgctcccacaggtggccgtgaatctgtcaaactgccacgtccttattaaaagtcatgtttgtgattactctctggacatcgatggtgctgtgcgcttgccccacgtacatcacaaggggacttttatcccgggcacctacaaaattgtgatcgacaagcgaaataaacaaaacgatagatgcacgctcgtcaccaattgtgtgattaagggaaaggaaataaggaaaggccagagcgcgctgcggcagtatcgtacagagatccgcattgggaaggcatccgccggatcaagaaggttactgagcgaagagtctggtgacgactgcatctcccggactcagctactccgaaccgaaacagctgaggttcataacgataattacggcgggcctggagacaaaatcactatttgtaacggcagtaccatagtggatcaacgcctgggtagcgagcttgggtgctatacgatcaatagagtcaagtctttcaaattgtgcgaaaactccgccacaggcaagtcatgtaagattgacagtaccccagtgaaatgcaggcagggattctgtctgaagatcactcaggagggccgggggcacgtaaaactcagccgcggatcggaagttgtgctggatgcatgcgactcctcttgtgagattatgatccccaagggtacaggcgatatacttgtcgactgcagcgggggacagcaacactttctgaaagataatttgatcgacctcggctgtcctaacattcccctgttaggtaagatggccatctacatttgcagaatgtcaaatcatccaaagaccactatggctttcctgttttggttcagttttgggtatgtgatcacctgtatattctgcaaagtcatcttttacctactcattgtggttggcacactgggaaagaaattcaagcagtatagggagcttaaacctcagacgtgtaccatttgcgaaactacacccaccaacgccatcgatgcagagatgcacgacttgaattgctcctacaacatatgtccatactgcgcgtctcgtctgacaagcgacggcctcgctcggcatgtgactcagtgtccgaagcgaaaggaaaaagtagaggaaaccgagctgtatttaaacctggagagaatcccttggattgtcaggaaacttttgcaagtgtccgaatcaacgggggttgccctcaaacgcagcagttggctgatcgtgctactggtcctcctgacagtgtctctttcccccgtacagagcgcaccaattggacacggcaagaccatcgagacttaccagacccgggaaggttatatatcggtgtgcttgtttgttcttgggggaattttattcgtcgtgtcatgtctcatcaaaggcctggtggattctgtcggtaatagctttttccccggcctttccatctgcaagacatgtagcattgggtctgttaacggatttgagatcgaaagccacaaatgctactgttccctgttgtgctgtccttattgcagacattgctcaactgacagggagattcaccagctccatctgagtatatgtaagaagcgccgaaccggcgggaatgtgatgctagccgtgtgcaaacggatgtgtttccgtgctacaatggaggtaagcaacaaggtcctgttcatcagaaatattatcaacacgacctttgtgatttgcatcctcatactggccgtttgtgtggtctctacttccgcagtggaaatggagtcacttccagctggaacatgggaaagggaggaagatttgaccaatttctgccaccaagagtgtcaggttactgagacagaatgcctgtgtccctacgaggccttagtgctccgcaaacctctgtttcttaacagtatcgtaaagggcatgaaaaatctgctaaacagcaccaatctcgaaacgtccctgtctattgaggcgccgtggggtgccatcaacgtccagtcgactttcaagccaaccgtgagcacagctaatattgcattgtcatggtccagtgtggagcatcgggggaacaagatcctggtctctggaagaagcgaatccataatgaaattagaggaaaggaccggcatttcatgggacctcggtgttgaggatgcctctgaaagcaagagtctgactgtgtccgtaatggaccttagccaaatgtattctcccgtgtttgagtacctgtcaggcgatcgacaggtcgaggaatggcctaaagctacatgcaccggggactgtccagagcgctgcggatgcacatccagtacttgtttgcacaaggaatggccccacagccggaattggagatgcaaccctacctggtgttggggcgtggggacgggatgcacatgttgcggcctcgatgttaaagacctgttcaccgattacatgtttgtgaagtggaaggtcgagtatatcaaaactgaagccatcgtgtgtgttgagctaacctcgcaggagaggcagtgctctctgattgaagcaggtacacgtttcaaccttgggccggtgactataaccctctccgagccccgcaatatccaacagaagctgccacctgaaattatcacgttgcatccccggattgaggaaggatttttcgacctgatgcacgtccagaaagtattaagcgcgtcaacagtgtgtaagctccagagttgcacccatggcgttccaggtgatctgcaagtgtaccacatcggcaaccttctgaaaggggacaagttgaatggacatatgatacacaagatcgagcctcactttaacacttcttggatgtcctgggacggctgtgatctcgactattactgcaatatgggggattggcccagctgcacatataccggagtcactcagcataaccacgccgctttcgtgaatctgctaaacattgagacagactacaccaaaaattttcatttccactcaaagagagtaacggcccacggcgatactccacagctggaccttaaagcaaggccgacctatggtgctggggaaatcacagtgctcgtcgaggttgccgatatggaactgcataccaagaaaattgacatcagtggattgaagttcgcaagtttaacatgtgccggctgctacgcttgttcctctggcataagctgcaaagtgcggattcacgtggatgagcctgacgagctgactgtccatgtgaagtccgaagatcccgacatcgttgcggcctcaacctctctcatcgcacgaaagctggagcttgggacggatagtacatttaaggctttctcggccatgccaaagactagcctgtgtttttacattgtagaacgcgagtattgcaaatcctgttctaaggaagacacccagaaatgcgtgaacacaaagttggagcacccccaaggaatcctaatagagcataagggtaccattatcggcaaacagaatgacacttgtaccgccaaggctgggtgctggctggaatcagtcaagagcttcttttacggactcaaaaacatgctgtccggcattttcggtaatgtgtttatcgggatattcctgtttttagcacctttcgttctgctcattttgtttttcatgttcggatggagactgctcttttgtttcaaatgctgcaggcggacacgaggcctgtttaagtatagacaccttaaggaggatgaagagagtggctaccgcaggatcatcgaacgtctgaacaataaaaaggggaaaaacaagttgctagacggagagcggctggccgatagaaggattgcggaactcttctctacgaaaactcacatcggttga

SEQ ID NO: 10270 - RNA, 5070 nt, synthetic construct
  misc_feature 1..5070: note = derived and/or modified CDS sequence (opt3) from CCHFV(SPU 431/85)__KJ682812.1__GP
  source 1..5070: mol_type = other RNA
atgcccgtgaacatcatgtacacccctctggtctgcgccgttatttgtctccagctttggaatctgggcgggacattggtgagcactaacagaacgcaacacaatgagaccggaacagtagctactccagaaggtaccttaaggccgcggctgcccgtgtccacagcactacctaccaagtctgaccgcccatcagtcggccccgccgcgagtagctccgggctcgagggatctggcgaacctaacacttcgccatcaataacaaccaaaggtctgacgccccctgagactaccccagcccttccgacagccactgataccgacgcaagcagtacaggggtggttgatgtgtccacccagatgacgaaggacatccccatgtctactgcctatacaaatcctccaagcaccccctccgctccttcaactccacagggaacacatcacaccgcacgaggcctgttgagtgtcgccagcacgaaatctgaagaggtgtccatgtcaaccagccccgctaagacaagtactgagacctcttccccgcctcccgccacaagcgaaactccaaccccttcgcccacaacccaggtaccaactggcaacaataaccccaatacgtctcgtcaacctacaccatccgcgcagccggcaatgtcaaaccccgccaccagtcctgctcagccaaatctcagccagtccgctccccctactgcagatcaaggggttcatccatctcccaccaacagaagcaaaaggaatctggagattgaaatcattctgacactctcacagggattacggaagtactatggtaagatcctgaaacttttggacctgaccctagaggaggatactgaaggcctcctggagtggtgcaagcgcaaccttgggctgacatgtgacgataatttctttcagaaaagaatagaagagttctttttgacgggagaaggctacttcaacgaggtgctccagtttaaggtcccgagtaccctgtccagcactgagcctacacacaccaggccacccacagtggaacctttcaaatcttattttgctaagggtttcttatcaatgaacagtgggtactttagcgccaagtgctatccccggacttccaattctggactgcaactcatcaacgtgaccaaacattcggcgaagattgccgacacgccaggccctaaaatcaccaatcttaagacaattaactgtatcaatctgcgcgcaagcgtcttcaaagagcaccgagaagttgagataaacgtgttgctaccccaggtagctgtgaatctgtccaactgccacgcccagattaagtcacatgtctgtgattacagtctcgctactgacggcatggtgagactgccacacatccatcacgaagggacctttattccgggaacatacaaaatcgttatcgataagaagaataaacaaaacgacaggtgcactcttgtgaccaattgtgtcattaagggtcgggaggtgcgtaaaggccagtctgccctgcgccagtataagacggagataagaatcgggaaagcaagctccggatcaaggcggttgctcagcgaagagtctgacggcgattgcatttcccgaacacagctgttacgcaccgaaactacagagatccacagtgacaactacggtgggcctggcgataagataaccatttgtaatggaagcactatcgtagaccaaagactgggctctgaactagggtgctataccatcaacagggttaagtccttcaaactctgcgaaaattcagccacaggaaagagttgtgagattgatagcacgcccgtgaaatgccggcagggtttttgtctgaagatcacccaggaaggccgcgggcatgtcaaactttcgagaggatccgagattgtgttggacgcttgcgattctaactgtgaaataatgatcccaaagggcactggtgacattctggtcgattgcagcgggggccagcaacacttcctcaaggacaacctgatcgatcttggatgtcccaatatccctctgttgggcaaaatggcgatttacatatgcaggatgtcaaaccatccaaagacaaccatggcattcctcttttggttcagttttgggtatgtgatcacatgtattctgtgcaaagttatcttctacttactgattgtggccggaactgtaggtaagaaatttaagcagtatcgtgagctacggccccagacctgtacgatctgcgagacaatacctgtcaatgctatcgacgccgaaatgcacgacctcaactgctcctacaatatttgtccgtactgcgcatctcgactgaccagcgatggccttgccagacatgtgatgcagtgtccaaagaggaaagagaaggttgaagagactgaattgtatctgaacctcgagcgcatcccctgggtggtccggaaactgttacaagtgtccgagtcaaccggggtagctctgaagagaagcagttggcttacagtgttgctcgttctgctaattgtctctctgtcccctgtgcagagcgccccaatcggacacggcaaaactatagaaacctaccaggcaagggagggttatacatcgttctgcctctttattctggggtcaatccttttcgtggtctcttgtttggttaagggcctgattgacagtgtgggaaattcctttttccccggcttaagcatctgcaaaacgtgttctatagggagcatcaacggatttgaaattgagtcccacaagtgctactgttcactcttctgctgtccttattgccgccattgcccggcggatcgagaaatccacaagctgcatcttagtatttgtaaaaagcggaaaaccggcagcaatgtgatgctggctgtatgcaagcgtatgtgttttagagccactatcgaggtctctaacagggcattgctcatacgcaatattatcaacacaaccttcgtggtttgcatcctgactctagccgtgtgtgtcgtgtccacatcagctgttgagatggaaagtctgcccgccggtacctgggagaaagaagaggacctcacgaatttctgccaccaggaatgtcaagtgactgagaccgagtgcctgtgtccatacgaagcacttgtattgcggaagcctctgtttttagatagcattgtcaaggggaggaaaaacctccttaattccacatctcttgagacctcgctgagcatcgaagctccctggggagccattaacgtgcagtcaactttcaagccaacagtgtccgcggccaacatagctctaagttggtctagcgtcgagcacagaggcaataaaatcctcgtttccggtcgatcagagtctattatgaagctggaggagcgcaccggcatcagctgggacttgggggtggaagatgcaagtgagtccaaactgttaacagtaagcgtgatggacctctctcagatgtattcacctgtctttgaatacctgtccggagatcggcaagtggaggagtggcccaaggccacttgcaccggcgactgtccagaaagatgcgggtgcacgagtagcacatgtcttcataaggagtggccgcactcgaggaactggcgttgcaatcctacctggtgttggggagttggcactggttgcacctgttgcgggctggatgtgaaagacttgttcacagattacatgtttgtcaagtggaaagtggaatatattaagactgaggctatcgtttgtgtggaactcacctctcaggagcgccagtgctccctgatagaggccggaacgcggttcaacctaggccccgtcacaatcaccctgagcgaaccaagaaatattcagcaaaaacttccccctgagatcattactctccatccaaggatcgaagagggctttttcgacctgatgcacgtacagcgagtgttgtcagcaagtacagtttgtaagctgcagtcttgcacccatggtgtgcccggggacttacaggtctaccacataggaaacctcctgaagggcgataaagtgaatgggcaccttattcataagatcgaacctcactttaacacttcctggatgagctgggacggatgtgatctggactattactgcaatatgggcgattggccgtcatgcacatataccggtgtaacgcaacataaccacgcggccttcgtgaatttgctcaacatcgagactgactacaccaaaaattttcatttccacagtaagcgggtcacagctcacggggataccccacagctggacctaaaagcccgccccacatatggagcaggcgaggttactgtgctggtggaagtcgctgatatggagcttcataccaagaaaattgaaataagcggtctcaagtttgcctccctgacgtgtacaggctgctacgcatgttctagcgggatctcctgcaaggtgaaaattcacgttgacgagcctgatgagttgactgtacatgtgaagtcagaagaccccgatatcgtcgccgctggatctagtttaatggcgagaaaactggagttcggcgccgactcgaccttcaaggcatttagcgctatgccaaaaacatccctctgtttctacattgtggaaagggagtattgcaagtcttgttcacgggaagacacccgaaagtgcgttaacactaaactggatagacctcagagcatccttatagagcacaaggggaccatcattggaaaacagaataacacatgtacggccaaggcctcctgctggctggagagtgtgaaatctttcttttacggcttgaagaacatgctaagcggtatctttgggaatgtcttcattggaatctttctgttcatagctccctttgtgctcctgattcttttctttatgttcggctggcgcatcttattctgttttaagtgctgcaggcgtactcggggcctgttcaaatatagacacctcaaggacgatgaagagaccgggtacaggaaaatcattgaacgcttgaacaataagaaaggaaagaacaagctgctcgacggtgagcgactggcagatagaaaaatcgccgaactgttttcaacaaagtcccatataggctga

SEQ ID NO: 10271 - RNA, 5070 nt, synthetic construct
  misc_feature 1..5070: note = derived and/or modified CDS sequence (opt3) from CCHFV(SPU 556/87)__KJ682811.1__GP
  source 1..5070: mol_type = other RNA
atgaccgtgaacacagtctgcactcccctggtttgtgccgtgttctgcctccagctttggaatctgggcgggacgttggtacctaccaacagaacacaacacaataagactggaaccatggctacaccagagggtaccttaggcccgaggctgcccgtgagcactgcactacctacaaaatccgaccggccatctgtcgggcccgccgcgccttcaagtggactcgaaggcagcggtgagccaaacacctccccctctatcacgactaaggggctggctctgcctgaaaccacaccagccccgcccactgcaaccgatacagacgcctcgtcaaccggagtggttaatgtgagcacgcagatgactaaagatattcctatgagtacagcttacaccaacccaccctccactccttctgcaccaagcacaccccagggcacccatcacacggcccgcggcctgttgtccgtcgcttcaaccaagagtgaggaagtgagcatgtctacatccccggggaaaacttcaaccgagacaagcagtcctcccccagccacttctgagacccctgcgccctccccaacaacccaggcacccactggaaataacaatcctaacacgagccgacaaccaacaccgtcggcccagcccgctatgtctaatcctaccacttccccagcccagcccaacctcctgcagaatgcacctccaaccgctgaccaaggtgtacatcccggcccgacaaaccgttcaaagagaaatctggaaatggagataatcctcaccttaagtcaggggctgaggaagtattacggaaaaattcttaagtttttggatctgactctagaagaggacacagagggcctcctggaatggtgtaaacggaaccttggtctgacgtgcgatgacaacttctttcagaagcgcatcgaggagttctttttgaccggggaaggatatttcaatgaagttctccagtttaaagtgcctagcactctgtcctctacagagccaacccacacaggcagccccactgtcgagcctttcaagtcatactttgccaagggcttcttaagtatgaactccgggtattttagcgcgaaatgttaccccagaacctctaattcaggactgcaactcattaacgtgacgaagcatagtgccaaaatcgcagataccccaggtcctaagataacaaatcttaaaactatcaactgcattaatctgagggctagcgtgttcaaggaacaccgggaggtcgaaatcaacgttttgctaccccaggtggccgtaaatctgtccaactgtcacgctcagattaaatctcatgtgtgcgactattcgctcgccaccgatggcatggtccgcctgccacgaatccaccatgaggggacatttataccgggaacttacaagattgtgatcgacaagaaaaataagcaaaacgatagatgtacccttgttacgaattgcgtgattaaaggcagggaagtccggaagggtcagagcgcactgcgtcagtacaaaacagagatccgcatcgggaaggcctcctcaggcagtagaaggttgctctctgaggaaagcgacggagactgtatttcccggacccagctgttacgaactgagacagctgaaatacactcagataactatggcgggcctggagacaagatcaccatttgcaatggtagcactatcgtggatcaacgcctgggctctgagctagggtgctacaccataaacagagtaaaatccttcaagctctgtgaaaacagtgcgacaggaaaaagctgcgagattgactctacgcccgttaagtgtaggcagggcttctgcctgaaaatcacccaggagggtcgggggcacgtgaaactttcccgcggctcagaaatcgtcttggatgcatgtgacagtagctgcgagattatgatcccaaagggaactggcgatattctggtggactgtagcgggggacagcaacattttctcaaagataatctgatagaccttggttgccccaacatccctctgttgggcagaatggccatttatatctgtaggatgtccaatcacccaaagacaaccatggctttcctcttttggttctcttttgggtacgtcatcacatgcattctgtgtaaagtgatattctatttactgatcgttgccggaactgtgggcaagaaatttaagcagtaccgtgaactacggccccagacctgcacgatttgcgagacaacccctgtaaacgcaatcgatgccgagatgcatgacctcaattgtagctataacatttgcccgtactgtgcttcacgactgaccagtgacggtcttgccagacacgtcatgcagtgcccaaagaggaaagaaaagatcgaggaaactgagttgtacctgaatctcgaacgcataccctgggtggttcggaaactgttacaagtgtccgagtctacaggggtcgcactgaagagaagctcctggcttactgtgttgctcgtactgctaatcgtgtcactgagccctgttcagagtgcgccaattggccatggaaaaaccatcgagacatatcaggctagggaaggctacacgtctttctgtctctttattctggggtccatccttttcatagtcagctgcttggtgaagggactgattgattcggtgggcaactcatttttccccggtttatctatctgtaaaacctgcagtattgggtccgtcaatggatttgagatcgaaagccacaagtgttattgctctctcttctgttgcccttactgccgccactgtagcgccgaccgagagatacataagctgcacctttccatctgcaaaaagcggaaaactggctcaaacgttatgagtgcagtgtgtaagcgtatgtgcttcagagccacaattgaagtgagcaatagggctctgttgatccgctctattatcaacaccacttttgccgtatgtatactcacactggcagtctgcgtggtttccacctcagctgtggagatggagagtctaccggccggtacgtgggaacgggaggaagatctgactaatttctgtcatcaggagtgccaagtcaccgaaacagagtgtctctgcccctatgaggcgctggtgcttagaaaaccattgtttctggacagcattgttaagggcaagaaaaacttactcaattccacctctctggaaacttcgcttagcatcgaggccccttggggagctatcaacgtgcagtcaacattcaagcccaccgtatccgcagccaacattgctctgagttggtctagcgtcgaacacagggggaataaaatcctagtgtccggccgatcagagtctattatgaagctcgaggaacgcacagggataagctgggatctgggagtggaggacgccagtgaatccaaattgctgactgtcagcgttatggatttatctcagatgtactcaccagtgtttgagtatctctccggcgaccggcaagtagaagagtggcctaaggcaacctgtacgggtgattgccccgagagatgcgggtgtacaagttcgacctgcctgcacaaggaatggccacattcgaggaactggcgttgtaatccgacttggtgctggggagtgggcaccggttgtacatgctgtggccttgacgtcaaagatctgttcactgactacatgtttgtgaagtggaaagttgagtacatcaagaccgaagcgattgtgtgcgtcgagttgacgtctcaggaacgccagtgttccctcatcgaggccgggacacggttcaacctgggacctgtgaccattactctaagcgagcccagaaatatccagcaaaaactgccacccgaaataatcacacttcaccctaggattgaggaaggctttttcgatctcatgcatgttcagaaggtgctgtcagctagtaccgtctgcaagttgcagtcttgtactcacggggtaccaggagaccttcaggtgtatcatatcggcaacttactcaaaggtgacaaggttaatgggcacctgattcacaaaatcgagccccattttaacacatcctggatgagctgggatggatgcgaccttgattactattgcaatatgggcgactggccttcatgtacctacacgggtgtgactcaacacaaccatgccgcattcgtcaatctgttgaacatagaaaccgattatacaaagaattttcacttccatagtaaacgagtgaccgctcacggcgacacaccgcagctcgatctgaaggcccggccaacttacggggcaggagaggtaaccgtgctagtcgaggttgccgacatggaactgcacacgaaaaagattgagatcagcggccttaagttcgcttccctctcttgcacagggtgttatgcgtgcagctccggaatctcatgtaaagtgcgcattcatgtggatgaacccgacgagctgactgtccacgtgaagtctgaggatcctgacatagttgccgcaggcagttcgttgatggctagaaaattagaatttggtgccgatagcaccttcaaggccttttccgctatgcccaaaacatctctgtgcttctacatcgtagagagggaatactgtaagtcatgcagccgggaggacacccagaagtgtgtgaacactaaactcgaacgaccacagtccattctgatcgagcataaggggaccattatcggaaaacaaaatgacacatgcacggcaaaggccagttgttggcttgagtctgtcaagagctttttctatggcctgaagtcaatgttgtccggcatatttgggaacgtgttcatcggaatttttctattcatcgcgccttttgttctgctcattctgttcttcatgtttggttggagaatccttttctgctttaagtgctgtcgcaggactcgtggcttattcaaataccggcacctgaaggatgacgaagagaccgggtatagaaaaataattgaaaggctcaacaataagaaaggaaagaacaagttgctggatggcgagcgcctcgctgaccgaaaaatcgccgaactgtttagtacaaagagccacatcggttga

SEQ ID NO: 10272 - RNA, 5070 nt, synthetic construct
  misc_feature 1..5070: note = derived and/or modified CDS sequence (opt3) from CCHFV(SPU 18/88)__KJ682810.1__GP
  source 1..5070: mol_type = other RNA
atgcccttcaacatcatgtacacccctctgctctgcgccattctttgtctgcagttgtggagcttagagggcatatatgggctgtccaataagacacaacacaacgacacttctacgatcaaagtgccagaagagtcacagaagaccagtctaccggctaatacagcaagccccattacttccgatccttcttcggccacctcaacagcgctcgctagcggaccagaaggtagtggcgacacctccacttctcccagcgtcacaacccaggggcctacgctgcttgagactaccccagaaccccatacaactatcgatattgacgagtcctcaaccgccatcgcagatataagtacacagaccgttaaagacatccctacgccaactacacacaccagcctgccgtctactccctccgcccctacaattccacaagaggctcatcacaccgcaagaggattgctctcagtgacgagcaccaagcccggcgaaacaagtactcctacctctccaggtgaggcctccacagaagctagctcgccccagccgactatctctgagacccctagcccaccccctacaacccaggcccccactgagattaacaatccaaacacgtcaaggcagcccatgcctagtacacaaccagcggcaccgaatagcgtaactccccctgtgcagccaaccttttcccagtctgatgtcagcaccgtggcccaggacatccatccctcacctacaaaccggagtaaacgcaatctggaaatggagataattctgaccctctcccaagggttaaagaagtactatggaaaagttctgaaacttttggatctgactctagaagaggacacagaaggcctcctggagtggtgcaaacgaaaccttggcctgacgtgtgatgacaatttctttcagaagcgtatcgaggagttctttttgaccggggagggacacttcaacgaagtgctccagtttaaaactccaagcacactgtctcccaccgagccggctagagtcgaatcacctacagtggagccattcaagagttactttgccaagggtttcttaagcatggattccggctatttttctgcaaaatgctaccccaagtcgagcaattccgggctgcaactcattaacgtaactcagcactcaatcaggatcaccgacacgcctggacccaaaattaccagtcttaagacaataaattgtatcaacctgaaggctttggttttcaaggagcatcgggaaattgagatcaacgtgctactgccacaggtcgccgtgaatctctctaactgccacgtgctgataaaaagccatgcgtgtgactattcccttgatattgacggccctgtccgcctgcccagaatccaccacgaaggtacttttatcccagggacctacaagattgttatcgataagaaaaataagcagaacgacaggtgcacattggtgactaattgtgtaattaaaggacgggagatacgcaagggccaatcagtgctccgacagtacagaaccgaaatcaaaattggcaaggccagctctgggtccaggcggctgttaagtgaggagagcaacgatgactgcctgtctcgtacgcagctactccgcacagaaaatgcagagatccattccgataactatggaggtccgggcgacaagatcaccatttgtaatgggtcaactatagtcgatcagagactgggaagtgaacttggctgctacacaatcaacagggtgaaatccttcaagttgtgcgaaaattcggctaccggtaaatcctgtgagattgactctactcctgttcggtgccgacaagggttctgtctgaagatcacccaggaaggccgcggacacgtgaaactcagcagaggctcagaggtcgtgctggatgcctgcgacagttcctgtgaaattatgatccccaaggggacaggagacatacttgtagattgctctggtggccagcagcattttctgaaggacaacttggttgatctcgggtgtccaaatatccccctgttaggaaaaatggctatttatatctgcaggatgagcaaccaccctaagacgaccatgggcttcctgttttggttctcctttggttacgtgattacttgtatcctatgcaaagtcatattctatctcctgattgtggtcgggacacttggcaagaaatttaagcaataccgggagttgaagccacagacctgtacaatctgcgaaactaatcccgtgaacgccattgacgcagagatgcatgatctgaactgctcatataatatctgtccttactgcgccagccgcctcaccagtgacggactggctagacacgttatgcagtgtccgaaaaggaaggagaaaatagaagagacggaattatacctgaaccttgagcgtatcccatgggtggtacggaagttgctccaggtctctgaatccacaggcgtggcgctgaaacgaagctcgtggctagttattctgctcgtgctgcttaccgtctcattgtctcccgtgcaaagtgcacctatctcccacggggagactgtagaggtgtatcagaccagagaaggatacacaagcatttgcctgttcgttttaggttctatcctctttctggtcagctgtcttatgaagggcctggtggattccgtgggaaattcattcagtccagggttgagcatatgcaaaacttgttctattggctccatcaacggttttgagatcgaatcacataagtgctattgtagtctcttctgctgtccctactgcaggcactgcagcgccgacattgagatccataagctgcacctatccatttgtaaaaagcgcaaaaccgggtctaatgtcatgctggctgtttgcaagcggatgtgttttagagccacagtggaagtgtcgaacaaagcactcctgataaggaatatcattaacacgaccttcgtagtctgcatccttattttggccgtgtgtgttgtgagcacttcagctgtcgagatggagaatctgcctgccggcacatgggaaaaggaggaagatttaaccaacttctgccaccaggagtgtcaagtgactgagacagaatgcctctgtccgtatgaggcactggttcttcgcaagcccctgtttctagactccatcgtgaaaggaaagaaaaatctcctgaacagtacctctttggaaacgagcctgtccatagaggcgccatggggcgctatcaatgtacagtcaactttcaagcctaccgtctctgccgcaaacattgccttaagctggagttccgtggaacatcgagggaataaaatcctcgtgagcggacggtctgagtcaattatgaagctggaggaacgtacaggcatctcctgggatcttggtgtcgaggacgctagtgaaagcaagctgttgaccgtttcggtgatggatctctctcagatgtactcccccgtatttgagtatctgagcggggacagacaggtggaagagtggccaaaagccacttgcacaggagactgtcctgagaggtgcggctgcacctcaagtacatgtctacacaaggaatggccccattctcgcaactggcggtgcaacccaacttggtgttggggtgtcggcaccgggtgcacgtgttgcggactggatgtgaaagaccttttcacagattacatgtttgttaagtggaaagtggactacataaagaccgaggcaattgtctgtgtggaactcacttcccaagagagacagtgcagcctgatcgaagctggcaccaggttcaatttggggccggttacaatcactctgtcagagcctcgaaacattcagcagaagttacccccagagatagtgaccctccacccccgcatcgaagagggatttttcgatctgatgcatattcaaaaagtccttagtgccagcacggtatgtaagctgcagtcctgcacacacggcgtgcctggtgacttgcagatctatcacattgggaatctcctgaaaggagataaggttaacggccatctaatccacaaaatagaaccacattttaatacctcttggatgagctgggacggttgtgatctggactactattgcaacatgggcgattggccctcctgctcatacactggggtgacacagcacaatcatgcggccttcgtcaacatgcttaatatcgagaccgactatactaagaactttcacttccactctaaacgggtgacagctcatggagatacccctcaactcgacctgaaggcaagaccgacgtacggcgccggggagattactgtattggtggaagtcgctgacatggagttacacaccaagaaaatcgaaattagtggactgaagtttgcctcgctcacatgtaccggctgctatgcatgtagctccggtatctcttgcaaagttaggatacatgtggatgagccagacgaactgacagtgcacgtcaagtcagaggatcccgacattgtggcggccagctccagtcttatggctcgtaaactggagttcgggactgattctaccttcaaggcctttagcgcaatgcctaagacgtcattgtgtttctacatcgttgaacgcgagtactgcaaatcctgtagtaaggaagacacacagaaatgcgtaaatactaagctagagcagccccaaagcatcctgattgaacacaaaggaaccatcataggcaagcagaacgatacatgtaccggtaaggctggctgctggctcgagtctattaaatcctttttctatgggctgaagaatatgctttcaggaatctttggcaacgtgttcattgggatctttttattcctggccccatttataatgctcattttgttctttatgttcggatggcggatcctgttctgttttaaatgctgcagaaggactcgaggcctcttcaagtaccggcatctgaaagacgatgaggaaatcggttatcgcaagattatcgagagacttaagaataaaaaggggaaaaacaagctgttggacggagaaaggctagcagatcggaaaattgccgagctgtttagcaccaagacacacataggctga

SEQ ID NO: 10273 - RNA, 5070 nt, synthetic construct
  misc_feature 1..5070: note = derived and/or modified CDS sequence (opt3) from CCHFV(SPU 497/88)__KJ682808.1__GP
  source 1..5070: mol_type = other RNA
atgcccttcaacatcatgtacacccctctgctctgcgccattctttgtctgcagttgtggagcttagagggcatatatgggctgtccaataagacacaacacaacgacacttctacgatcaaagtgccagaagagtcacagaagaccagtctaccggctaatattgcaagccccacaacttccgatcctccatctgccacctcgacagcgtcagctagcggacccgaaggtagtggcgacacctccacttctcctagcgtcacaacccaggggccaacgcccctcgagatcactcctgaaccacataccacaattgatatcgacaaatcctcaacttctatagccgatatcagcaccagaacagttaaggacattccgacccccacgactcacacatctctgccttccaccccatcagcacccactatccctcaggaggtgcatcacacagccaggggacttctgagcgtaaccagtacgaaaccagaggaagctagtaccttgacatcccccggcgaggcaagcactgaagcctcgtctccgcaacctaccatttccgagacaccctcaccacctcccactacccaggctccaacagagatcaacaatcccaacaccagtcggcagcctatgccaagcactcagccggccgcgcccaattccgtgacgcctccagtccaacccacattttctcagagcgatgtgtcaaccgcagcccaggacatacatcctagtccaactaaccgctccaagcgaaatctcgaaatggagattatcctgaccctgagccagggtctcaagaaatactatgggaaggttttaaaactgcttgatttgacactggaagaggacaccgaaggactactcgagtggtgcaagcgtaacctgggccttacttgtgatgacaatttctttcaaaagagaattgaggagttctttctgacaggcgaagggcacttcaacgaagtgttgcagtttaagacgccctctaccctctcaccgactgagcctgctagggtcgaaagtccaacagtggagcccttcaagagctactttgccaaaggattcctgtccatggattctggttatttttcggcaaagtgctaccctaaaagctccaattcaggcttacagctgatcaacgtaacccaacacctcatccggattacagacactcccgggccaaagataaccaatcttaaaacgatcaactgtattaacctgaaggctttggttttcaaagagcatcgcgaaatcgagataaatgtgctactgcctcaggtcgccgtgaacctcagtaattgccacgtgctgattaagtctcatgtctgtgactatagccttgatatcgacggacccgttagactgccaaggatccaccacgaaggcacctttattccgggtacatacaagatcgtgattgataaaaagactaaacagaacgaccggtgcaccttggtaacaaattgtgtgataaaggggcgcgagatccgaaaaggacagtccgtcctcagacaatacaggactgaaattaagatcggcaaggcgtcaagcggctctcggcgtctgttatccgaggagagtaacgatgactgcctgagccgcacccagctactcagaacggaaaatgccgagatccattctgataactatgggggacctggtgacaaaattacaatatgtaatggctccaccatcgtggatcagaggctggggtcagaacttggatgctacactattaaccgggttaagagtttcaaattgtgcgagaatagcgcaacaggcaagtcgtgtgagatcgactccacccccgtgcgatgccgccagggtttctgtctgaaaattactcaagaagggaagggccacgtcaagctctctagaggaagcgaggtggtactggatgcttgcgactcaagttgtgaaatcatgataccaaaaggcaccggggacatccttgttgattgctccggaggtcagcagcattttctgaaggacaacttggtggatctcggctgtcccaatattcctctgttagggaaaatggccatctatatttgcaggatgtctaaccacccaaagacaacgatggtcttcctgttttggttcagctttggatacgtgatcacctgtatactatgcaaagtcattttctatctcctgatcgtggttggcactcttggtaagaagtttaaacagtaccgggagttgaagccccaaacatgtaccatttgcgaaacaaatcctgtgaacgctatcgacgccgagatgcatgatctgaactgctcctataatatatgtccgtactgcgcatcacgcctcactagcgacgggctggccagacacgtaatgcagtgtccaaaaaggaaggagaaaatcgaagagaccgaattatacctgaaccttgagcgtattccctgggtcgtgcggaagttgctccaggttagtgaatctacgggcgtggctctgaaacgatccagctggctagtcatcctgctcgtgctgcttacagtatcgttgtcacctgtgcagtctgcgccaattagtcacggagagaccgttgaggtctatcaaactagagaaggctacacctccatctgcctgttcgtgttagggggaatactctttctggtgagctgtcttatgaagggtctggtcgattctgttggcaatagcttctttcccgggttgtccatttgcaagacatgttcaatcggaagtatcaacggcttcgagattgaaagccataaatgctattgttctctcttttgctgtccttactgcaggcactgctccgcagacatcgagattcataagctgcacctatcaatatgtaaaaagcgcaaaacttggagtaatgtgatgctggccgtgtgcaagcggatgtgtttcagagctaccgtagaagtcagcaacaaggccctcctgatcaggaatattatcaacacaacgttcgtggtttgcattcttatcttggcaatatgtgtggtctccacctctgccgtggagatggagaatctgccggctggtacttgggaaaaagaggaagatttaacaaacttttgccaccaggagtgtcaggttaccgagactgaatgcctctgtccctatgaggccctggtgcttcgcaagccactgttcctagactcgatcgtaaaagggatgcgaaatctcctgaacagcacatcattggaaacctccctgagtattgaggcaccttggggcgcgatcaatgtccaatctacgtttaagcccactgtgagcgctgccaacattgcattatcctggtcatctgtggaacatcggggaaataaaatcctcgtcagcggccgtagtgagtccataatgaagctggaggaaagaaccgggattagctgggatcttggagttgaggacgcctctgaatcaaagctgttgacagtgtccgtaatggatctcagtcagatgtacagcccagtgttcgagtatctgtcgggcgacaggcaggtcgaagagtggcctaaagctacctgcactggtgactgtcccgagcgctgcgggtgcacatcttccacctgtctacacaaggaatggccacatagccggaactggagatgcaacccgacatggtgttggggagtgggcactggttgcacctgttgcggcctggatgttaaagacctttttacggattacatgttcgtgaagtggaaagtcgactacatcaagacagaggccatcgtgtgtgttgaactcacctcacaggagaggcaatgcagtctgattgaagcagggactcgatttaatttgggacctgtgaccataacactgtctgagccccgcaacatccagcagaagttaccacccgagattgtcactctccaccctcggatcgaagagggcttctttgatctgatgcatattcagaaagtactttccgctagcaccgtgtgtaagctgcaatcatgcacgcacggggttccaggagacttgcagatctatcacataggcaatctcctgaaaggtgataaggtgaacgggcatctaatccacaaaattgaaccccatttcaatacaagttggatgagctgggacggatgtgatctggactactattgcaacatgggcgattggccttcctgctcttacaccggtgtcactcagcacaatcatgccgcgtttgtgaacatgcttaatatcgagacagactataccaagaacttccactttcacagcaaaagagtaactgcccatggcgatacaccgcagctcgacctgaaggctaggccaacctacggggcaggagagattacggtgttggtcgaagttgccgacatggagttacacactaagaaaatcgaaatatccggcctgaagttcgcttcactcacctgtacagggtgctatgcctgttctagtggaatttcgtgcaaagtgcgtatccatgtggatgagcccgacgaactgaccgtccacgttaagagcgaggatcctgacatcgtggcagcgtcctcttcacttatggcccgcaaactggagttcggcacagatagcacttttaaggctttctccgccatgcccaagaccagtttgtgtttttacattgtagaacgggagtactgcaaatcttgtagcaaggaagacacgcaaaaatgcgtgaatacaaagctagagcagccacagtcaatcctgatagaacacaaaggtactattatcgggaagcaaaacgatacctgtacagcaagagcttcctgctggctcgagagtattaagagcttcttttatggactgaaaaatatgctttctggcatcttcggtaacgtctttataggcattttcttatttttcgccccttttatcatgctgatcctcttcttcatgtttgggtggaggattttgttctgttttaagtgctgccgacggacccgcggactgttcaaatacagacatctcaaggacgatgaggaagtgggctataggaaaatcattgagcggctgaataacaagaaggggaaaaacaaacttctggacggagaacgattggcagatagaaaaatagccgagctattttccactaagacccacatcggctga

SEQ ID NO: 10274 - RNA, 5070 nt, synthetic construct
  misc_feature 1..5070: note = derived and/or modified CDS sequence (opt3) from CCHFV(SPU 130/89)__KJ682807.1__GP
  source 1..5070: mol_type = other RNA
atgcccttcaacatcatgtacacccctctgctctgcgccattctttgtctgcagttgtggagcttagagggcatatatgggctgtccaataagacacaacacaacgacaattctactacgaaagctccagaagagtcacataagaccagtctaccggcaaacacagccagccccatcacttccgatcctccatctaccacatcgaccacttcagcgagcggacccgaaggtagtggcgacacatccacctctcctccagtgacgactcaggggcccgctagccctgagaccacaccagaaccgcacactaccattgatatcgacaaatcctcaacagccattgcagatatcagtacccagacggtcaaggacatacccactcctacaacccatactagcctcccatctacactgtccgcccccaccatccctcaggaggctcaccatacggcaagaggacttctgtcagttaccaggcacaaaccaggcgaggccagcaagcccacaagtccgggtgaagctagtactgaggcctccagctcgcaacctaccatttctgaaacaccctccccacctcccactacccaggcgccaacagagatcaataaccccaatacctcacggcagcctatgccaagtactcagccggcagcccccagctccgtgacgcaccctgctcaaccaacaccctctcagagcgatgtacctaccgccgcacaggacattcatccatcacccactaaccgcagtaagcgaaatttggagatggaaatcatactcaccctgtcccaggggctgaaaaagtactatggaaaagtgctcaagttactggatcttacattggaggaagacaccgagggcctgctagaatggtgcaaacgtaacctcggcctgacttgtgatgacaactttttccaaaagagaattgaggagtttttccttacaggggaaggacactttaatgaggtcctgcagttcaagacgccgagcaccttgtctcctactgaaccagctagggtggagtcacccacagttgaaccttttaaaagttacttcgccaagggttttctcagcatggattccggctatttctctgcgaaatgctaccccaagtcgagcaattccgggctgcagttaatcaacgtgacccaacatctgattcggatcacagacactccaggacctaaaatcaccaatctcaagacgattaactgtataaaccttaaagccctggtctttaaggagcaccgcgagatcgaaattaatgtgttgctaccccaggtagcagttaacctgtcaaattgccacgtgctcatcaagagtcatgtctgtgactattctctggatatagacggcccagtgagacttccgagcattcaccatgagggtaccttcatccctgggacatacaaaatcgtgattgataagaaaaacaagcagaatgacaggtgcactctggtcaccaactgtgttatcaaaggacgggaaattcgcaagggccagtccgtgttgcgacaatacagaacagagataaagatcggcaaggcttcaagcgggtctaggcggctcctgtccgaggaacccaattatgattgcttaagtcgtactcagctgctacgcaccgagaacgccgaaattcacagcgacaattacggaggtccaggcgataagatcacgatctgtaacgggtctacaattgtagaccagagactcggatccgagctgggctgctataccataaatagggtgaaatcatttaaactttgcgaaaacagtgctactggtaaaagctgtgagatcgattcgacacccgtccggtgccgacaggggttctgtttgaagattacccaagagggccgcggacatgtgaagctgtccagaggctctgaagttgtgctcgacgcctgcgatagctcatgtgagatcatgattcctaaagggactggagacatcctggtcgactgcagtggtggccagcagcacttccttaaggataatctggtggacttggggtgtccaaacatacccctcctgggaaaaatggcaatctacatttgcaggatgtccaatcaccctaagaccacaatggcctttttattctggttttctttcggctatgtaatcacgtgtattctgtgcaaagttatcttttacctactcatagtggtcggtaccctggggaagaagttcaaacagtatcgggaacttaagccgcaaacttgtacaatttgcgagaccaacccagtgaacgctatcgatgcggaaatgcatgacttgaattgcagctacaacatttgtccctactgcgcatcccgcctgacatcagatggcctcgccagacacgtcatgcagtgtcctaaaaggaaggagaaaatcgaggaaactgagctgtatttaaatctggaacgtataccatgggtggttcggaaacttcttcaggtgagcgagagtaccggagtagctctcaaacgatcttcctggctggtcgtgctactggttctcctgacggtgagcctttcgcccgtccagtcagcccctatctctcatggcgaaacagtggaggtataccaaaccagagaggggtatacttctatttgcttgtttgtgctgggatccatcttattcctcgttagctgtctgatgaagggtcttgtcgactctgtgggcaacagctttttcccggggctgtccatttgcaagacctgttcaatcggaagtataaatggctttgaaattgagagccacaaatgctactgttctttgttctgctgtccctattgcaggcactgctccgcagatatcgaaatccataagctccacctgtcaatttgtaaaaagcgcaaaacaggtagtaacgtgatgctagccgtctgcaagcggatgtgttttagagctactgttgaggtgagcaataaggccctgctcatcaggaacattataaataccacattcgtggtatgcatcctgattcttgcagtctgtgtggtttccacgtctgcggtggaaatggagaacttgccagctgggacctgggagaaagaagaggacctgactaatttctgccatcaggaatgtcaggtcacagagaccgagtgcttatgtccttacgaagccctcgtgctgcgcaagcccctttcgctggatagcatcgttaaaggcatgaagaacctactcaattcaacttccctggagacaagtttgtctattgaagcaccatggggagccatcaacgtgcaaagcacctttaaacctacggtatccgctgccaatatagcactgtcatggtctagcgtcgagcaccgaggcaacaagatcttagtgagtgggcggtccgaaagcattatgaagctcgaggagcgtactggaatctcttgggacctgggcgtggaagatgcttcagagtccaaacttctgaccgtcagtgttatggacttgagccagatgtattcgcccgtgttcgaatacctctctggtgatagacaggtagaggaatggccaaaggccacatgcaccggggactgtccggagaggtgcggatgcacttccagcacatgtctgcataaagagtggcctcactcacgcaactggcggtgcaatcccacctggtgttggggcgtgggtacaggctgcacttgttgcgggctagacgtcaaggatctgtttaccgactacatgttcgtgaaatggaaggttgattatattaagacggaagcgatcgtgtgtgtcgagcttacaagtcaggaaagacaatgctctctcatagaggccggaaccaggtttaacctgggcccagtgactattaccttgtccgaaccccgaaatatccagcagaaactgcctccagagatcgttacattacacccccgcattgaggaagggttctttgacctcatgcatatacagaaggtgctgagcgcttcaactgtctgtaaacttcaaagttgcacccacggagtacctggcgatctgcagatctaccatattggtaacttgctcaagggggacaaagtgaatggacacctgatccataagattgagccgcacttcaacacgagctggatgtcctgggatggctgtgacctagattattactgcaatatgggtgactggccatcttgcagctatacaggcgttacccagcacaaccatgcagcctttgtgaatatgctgaacatcgaaactgattacacaaagaatttccactttcattccaagcgggtcaccgctcacggggacactccccagcttgatctcaaggccagacctacatatggagcaggcgagataaccgtgctggtagaggtggcggacatggaattgcacacgaaaaaggtcgagatctcagggttaaaattcgcctctctgacttgtaccggatgctacgcttgtagttcgggcattagctgcaaggttaggatccatgtggacgaacccgatgagctcacagtgcacgtcaaatccgaagacccagatattgtggccgcatcttcaagcctgatggctcgtaaacttgagtttggtaccgactccacattcaaggccttcagtgcaatgcctaagacttctctgtgtttttacatcgttgagcgcgaacattgcaagagctgttcaaaagaggatacccaacggtgcgtaaacacgaagttggaacagccccagtccatactaattgagcacaaagggacaatcatcggaaagcaaaatgacacttgtaccgccaaggctagttgctggctggaaagcattaaatctttcttttatggcctcaagaacatgctgtccggtatcttcggcaatgtgtttataggggtcttcttgtttttagcgccattcattatcctgattctctttttcatgtttggatggagaatcttgttctgtttcaaatgctgcaggcgaacacggggcctgctcaagtaccgccatctgaaagatgacgaggagatagggtatagaaagattatcgaaaggcttaacaacaagaaaggaaagaataaactgttggatggcgagcggctagccgaccgaaagatcgcagaactgttttcaaccaaaactcacattggttga

SEQ ID NO: 10275 - RNA, 5070 nt, synthetic construct
  misc_feature 1..5070: note = derived and/or modified CDS sequence (opt3) from CCHFV(SPU 383/87)__KJ682806.1__GP
  source 1..5070: mol_type = other RNA
atgcccttcaacatcatgtacacccctctgctctgcgccattctttgtctgcagttgtggagcttagagggcatatatgggctgtccaatagaacacaacacaacgacacttctacgatcaaggtgccagaagagtcacagaaaaccagtctaccggctaatacagcaagccccattacttccgatcctccatctaccacatcgaccgcctcagcgagcggacccgaaggtagtggcgacacttccacatctcctccagtcaccacgcaggggcccactcctccagagaccacaccggaaccccatactaccatcgatattgacaagagctccacagctatcgccgatatatcaacccagacggttaaagacatccctactccaacaacccacaccagtctccccagcacactgtctgcacctaccattccacaagaggcccatcacacggctaggggacttctgtccatcacctcaacaaagcccggcgaggcaagcactccgattagtcctggtgaagcctctaccgaggcttccagcccccagccaacaatctcggaaactccttctcccccacccaccgcccaggcgcctacagagataaactccccaaatacctcacggcagccgatgcccagtactcaacctgcagccccaaacagcgtgacgcatcccgctcagcctacaccatcccagtctgatgtacccaccgccgcacaggacattcacccgaatcctatcaaccgcagcaaacgaaatttggagatggaaattatcctcactctgtcacaagggctgaagaagtactatggaaaagtgctcaagttactggatcttaccttggaggaagacacagagggcctgctagaaagttgcaaacgtaacctcggcctgacctgtgatgacaactttttccagaagagaatcgaggagtttttccttactggggaaggacactttaatgaggtcctgcagttcaaaacaccatccacgttgagccccaccgaacctgctagggtggagtctcccactgttgaaccatttaagtcatacttcgccaagggttttctcagtatggatagcggctatttctccgcgaaatgctactctaagtcgagcaattccgggctgcaattaattaacgtgacacagcatctgatacggatcaccgacacacctggacccaaaattactaatctcaagaccatcaactgtataaaccttaaagccctggtctttaaggagcaccgcgagattgaaatcaatgtgttgctaccacaggtagcagttaacctgtcaaattgccatgtgctcatcaaaagtcacgtctgtgactattctctggatattgacggcccggtgagacttcctaggatccaccatgagggtacgttcattcccgggacctacaagatagtgatcgataagaacaataaacagaacgaccggtgcacactggtcactaattgtgttattaagggacgcgaaatccgaaaaggccaaagcgtgttgagacagtacaggaccgagatcaagattggcaaggcttcctcagggagccggcgtctcctgtctgaagagtccaacgatgactgcttaagtcgcacacagctgctaagaactgagaatgccgaaatacacagcgataactatggaggtccaggcgacaagatcaccatttgtaatgggtctacgatcgtagatcagaggctcggatccgagctgggctgctacacaattaaccgggtgaagtcatttaaactttgcgaaaatagtgctaccggtaagagctgtgagatcgactcgactcccgtccgatgccgccaagggttctgtttgaaaataacacaggagggcagaggacatgtgaagctgtccaggggctctgaagttgtgctcgatgcctgcgacagctcatgtgagatcatgattcctaaagggaccggagacatcctggtcgattgcagtggtggccagcagcacttccttaaggacaacctggtggatttggggtgtccaaatattcccctcctgggaaagatggcaatctatatatgccggatgtccaaccatcctaaaactaccatggcctttttattctggttttctttcggctacgtaattacatgtatcctgtgcaaggttatcttttatctactcgtggtcgtgggtacgctggggaaaaagttcaaacaataccgcgaacttaagccgcagacctgtactatttgcgagacaaacccagtcaatgctatagacgcggaaatgcacgatttgaactgcagctataatatctgtccctactgcgcatccagactgacctcagacggcctcgccaggcacgtgattcagtgtcctaagcgtaaagagaagatcgaggaaacagagctgtacttaaacctggaacggattccatgggttgtgcgaaaacttttgcaggtaagcgagagtactggagtcgctctcaagagatcttcctggctggtgatcctactggttctcctgaccgtgagcctttcgcccgtccaatcagcccctatatctcatggcgaaacggtggaggtatatcagacaagggaggggtacaccagtatttgcttgtttgtgctgggatccatcttattcctcgttagctgtctgatgaaaggtcttgtcgattctgtgggcaatagctttttcccggggctgtccatctgcaagacttgttcaattggaagtatcaacggctttgaaattgagagccacaaatgctattgttctttgttctgctgtccctactgccgccattgctccgcagacatagaaatccaccggctccacctgtcaatttgtaagaagagaaaaaccggtagtaatgtgatgctagccgtctgcaagaggatgtgttttcgcgctacagttgaggtgagcaacaaagccctgctcatccgaaatattatcaacactaccttcgtggtatgcatactgatccttgcagtctgtgtggtttccacatctgcggtggaaatggagaatttgccagctgggacgtgggagaaggaagaggatctgaccaacttctgccatcaggaatgtcaagtcactgagacagagtgcttatgtccttatgaagccctcgtgctgcggaaacccctttttctggactcgattgttaagggcatgaagaatctactcaacagcacctcactggagacttccttgagtatcgaagcaccatggggagccattaatgtgcagtctacattcaaacctaccgtaagcgctgccaacatcgcactgtcctggtcatctgtcgagcaccgtggcaacaagatattagtgagcgggagaagtgaatccattatgaaactcgaggagaggacgggaatcagctgggatctgggcgtggaagacgcttctgagtcaaaacttctgactgtctccgttatggatttgagtcagatgtacagccccgtgtttgaatatctctcgggtgaccgccaggtagaggaatggccaaaagcgacctgcacaggggactgtccggagcggtgcggatgcacctcttccacttgtctgcataaggagtggcctcacagcagaaattggaggtgcaaccccacatggtgttggggcgtgggtaccggctgcacatgttgcgggctagatgtcaaggacctgttcactgattacatgtttgtgaaatggaaggttgactacatcaaaaccgaagccattgtgtgtgtcgagcttacgtcacaagaacgacagtgcagtctcatagaggccggaacacgcttcaatctgggcccagtgaccatcactttgtctgaaccccggaacattcagcagaagctgcctccagagatcgttaccttacatcccagaattgaggaagggtttttcgatctcatgcacatccaaaaagtgctgtccgctagcacagtctgtaaacttcagtcatgcactcacggagtacctggcgacctgcagatatatcatatcggtaatttgctcaagggggataaagtgaacggacacctgattcataagatcgagccgcactttaataccagttggatgagctgggacggctgtgatctagactactattgcaacatgggtgattggccatcctgctcttacacgggcgttacacagcataatcacgcagccttcgtgaacatgctgaatattgaaaccgactatactaaaaactttcacttccatagcaagagggtcacagctcacggggatactccccaacttgacctcaaagcccgtcctacttacggagcaggcgagatcacagtgctggtagaggtggcggacatggaattgcataccaagaaaatagagatttccgggttaaagtttgcctcactgacgtgtactggatgctatgcttgttctagtggcatctcgtgcaaggtccgcatccacgttgatgaacccgacgagctcaccgtgcacgtgaaaagcgaagatccagacattgtcgccgcatcctcttcactgatggctcggaaacttgagttcggtacagatagcaccttcaaggccttttccgcaatgcctaagacaagtctgtgtttctacatcgtggagagagaatactgcaaatcttgtagcaaggaggacactcagaagtgcgttaataccaaattggaacagccccaatcaatactaattgagcataaggggacgatctttggaaaacagaacgatacatgtactgccaaggcttcctgctggctggaaagtgtaaagagcttcttttatggcctcaagaatatgctgtctggtattttcggcaacgtgtttatcggggtcttcttatttcttgcgccattcataatgctgattctctttttcatgttcggatggaggatcttgttttgtttcaagtgctgccgacggacccgcggcctgtttaaatacagacacctcaaggacgatgaggagatcgggtataggaaaattatcgaacggctgaacaataagaaaggaaagaacaaacttctggacggcgagcgattggccgatagaaagattgcagaactattctccacaaagacccatataggttga

SEQ ID NO: 10276 - RNA, 5070 nt, synthetic construct
  misc_feature 1..5070: note = derived and/or modified CDS sequence (opt3) from CCHFV(SPU 44/08)__KJ682805.1__GP
  source 1..5070: mol_type = other RNA
atgcccttcaacatcatgtacacccctctgctctgcgccattctttgtctgcagttgtggagcttagagggcatatatgggctgtccaataacacacaacacaatgacacttctacgatcaaggtgccagaagagtcacagaaaaccagtctaccggctaacacagcaagccccattacttccgatcctccacccaccacacctaccgcctctgcgtcgggaccagaaggttcaggcgacactagcacaagtccccctgtcaccacgcaggggccaactccgcccgagaccacacctgaaccacatactaccatcgatattgacaagtcctctacagctatcgccgatataagcacccagacggttaaaaatatccccactcctacagcacacacctccctcccatcaactctgagtgcccccacaatgccgcaagaggctcatcacaccgcaagaggacttctgagcgtgacgtctaccaagcctggcgaggcctccacacccacttcaccaggtgaagctagcaccgaggccagttctcctcagcccacaattagggaaactccaagtccccctccaaccacacagaccccgactgagatcaacaatcccaacacgagccggcagcctatgccatcgacacaacccgcggcaccttcttccgtaacccatccagcccagcccactccgtcacagagtgacgtgcctaccgctgcccaggatattcacccaagccccacaaatcgctccaaacgaaacttggagatggaaatcatactcaccctgtctcaagggctgaagaagtactatggaaaagtcctcaagttactggaccttactttggaggaagatacagagggcctgctagaatggtgcaaacgtaatctcggcctgacgtgtgacgataactttttccagaagagaattgaggagtttttccttaccggggaaggacactttaatgaggtgctgcagttcaaaactcctagcacattgtcacccaccgaaccagcaagggttgagagtcctacagtggaaccctttaagtcctacttcgctaagggttttctcctgatggacagcggctatttctctgccaaatgctacccaaagtcaagtaacagcgggttacaactgatcaatgtcactcagcatctcattcggatcaccgatacgccgggacctaaaatcaccaaccttaagacaattaactgtataaatctgaaagcgttggtgtttaaggagcaccgcgagatcgaaattaacgtactactgccccaggttgccgtgaatctctccaactgccatgtcctgatcaaatctcacgtgtgtgactattcgatagacattgatggcccagtgagacttcccaggatccaccatgagggtactttcatccctgggacctacaagattgtcatcgacaagaaaaataagcagaacgatcggtgcacactggttactaattgtgtgattaaaggacgcgaaatacgaaagggccaaagcgtattgagacagtacaggaccgagatcaaaattggcaaggcatcctcagggagtcggcgtctcctgtctgaagagagcaacgacgattgcttatcccgcacgcagctgctaagaacagagaatgctgaaatccactcagacaactatggaggtccaggcgataagatcaccatttgtaatgggagcactatagtggaccagaggctcggatctgagctgggctgctacacaatcaaccgggtcaaatcctttaagttgtgcgaaaatagtgccaccggtaaaagctgtgagattgattctactcccgtgcgatgccgccaagggttctgtttgaagatcacccaggagggcagaggacatgttaaactgtccaggggctcagaagtggtcctcgacgcttgcgatagtagctgtgagattatgatccctaaggggacaggagacatactggtggactgctcgggtggccagcagcacttccttaaggataacctggtagacttggggtgtccgaatatcccactcctgggaaaaatggccatttatatctgccggatgtccaaccatcccaagacgaccatggcatttttattctggttttctttcggctacgttattacttgtatcctgtgcaaagccatattttatctactcattgtggtcggtacactggggaagaaattcaagcaataccgcgaacttaagcctcagacctgtacaatctgcgagactaacccagtgaatgctattgatgcggaaatgcacgacttgaactgcagctataatatctgtccctactgcgcatcaagactgaccagtgatggcctcgccaggcacgtcatgcagtgtcctaaacgtaaggagaaaatagaggaaacggagctgtacttaaacctggaacggatcccgtgggtggttcgaaaacttcttcaggtgtccgagtctacaggagtagctctcaagagaagctcctggctggtcattctactggtgctcctgaccgtttcacttagccccgtgcaaagtgccccaatctctcatggcgaaactgtcgaggtgtatcagaccagggaggggtacacatccatttgcttgtttgtactgggaagcatcttattcctcgtgtcgtgtctgatgcgcggtcttgttgactcagtctctaattcctttttccctggcctgtccatatgcaagacttgtagcattgggtctatcaacggatttgaaatcgagagccacaaatgctattgttccttgttctgctgtccctactgccggcattgctcagcagatattgaaatccacaagctccacctgagtatttgtaagaaaagaaagaccggcagcaatgtgatgctagccgtgtgcaaaaggatgtgttttcgcgctacagtcgaggtttctaacaaggccctgctcatacgaaatatcattaacacgaccttcgtggtgtgcatcctgattcttgcagtatgtgtcgtgtccacttcagcggttgaaatggagaatttgccagctggtacatgggagaaagaagaggacctgaccaacttctgccatcaggaatgtcaagtgactgagacagagtgcttatgtccttatgaagccctcgtcctgcggaagcccctttttctggatagtatcgtgaaggggatgaaaaatctactcaacagcacctccctggagacgtctttgtcgatagaagcaccatggggcgccatcaatgttcagagcactttcaagccgaccgtgtcagctgccaacattgcactgtcctggagttctgtagagcaccgtggaaacaaaatcttagtcagcggcagatccgaatcaattatgaagctcgaggagaggacagggatctcttgggacctgggagtggaagatgctagcgagagtaaacttctgaccgtgtccgtcatggacttgagccagatgtactctcctgtttttgaatatctctcaggcgatcgccaggtggaggaatggcccaaggccacttgcacaggtgactgtccagagcggtgcgggtgcacctccagtacatgtctgcataaggagtggccccacagcagaaattggaggtgcaaccctacttggtgttggggagtaggcaccggttgcacgtgttgcggcctagacgtgaaagatctgttcacagactacatgtttgtcaagtggaaagtggattacataaagaccgaagcgattgtttgtgtggagcttacttcgcaagaacgacagtgctctctcatcgaggccgggacccgcttcaatctgggaccagtcacaatcactttgtccgaaccccggaacattcagcagaaactgcctccggagatagtgaccttacatccaagaatcgaggaaggctttttcgacctcatgcacattcaaaaggttctgagcgcttcaacggtgtgtaaacttcagagttgcacacacggggtccccggagatctgcagatctatcatattggcaatttgctcaagggtgacaaggtaaacgggcacctgatccataaaatagagcctcactttaatacctcttggatgtcctgggatggatgtgacctagattactattgcaacatgggcgactggcccagctgctcatacactggtgtgacacagcataatcacgcagccttcgttaacatgctgaatatcgaaaccgattatactaagaactttcacttccatagtaaaagggtgacagctcacggcgacaccccacaacttgatctcaaggcccgtcctacgtacggggcaggagagattactgtcctggtggaggtagcggacatggaattgcataccaaaaagatcgagattagcggcttaaagtttgcctccctgacatgtaccgggtgctatgcttgttctagcggaatctcctgcaaagtgcgcatacacgtcgacgaacccgatgagctcacagttcacgtgaagtcagaagacccagatattgtggccgcatctagttcgctgatggctcggaaacttgagttcggcactgacagcaccttcaaggccttttccgcaatgcctaaaacgtctctgtgtttctacatcgtcgagagagaatactgcaagtcatgtagcaaggaggatacacagaaatgcgtgaatactaagttggaacagccgcaatccatcctaattgagcataaaggtaccatcatagggaagcagaacgacacatgtaccgccaaagctagttgctggctggaatctattaagagctttttctatggactcaagaatatgctgtcaggcatctttggtaacgttttcattggcatctttcttttcttagcgccctttataatgctgattctcttctttatgttcgggtggaggatcttgttctgttttaaatgctgccgacggactcgcggactgttcaagtacagacacctcaaagatgacgaggagatcggctataggaagattatcgaacggctgaacaataaaaaggggaagaacaaacttctggatggagagcgattggccgacagaaagattgcagaactattttccaccaaaacacatataggctga

SEQ ID NO: 10277 - RNA, 5070 nt, synthetic construct
  misc_feature 1..5070: note = derived and/or modified CDS sequence (opt3) from CCHFV(Matin)__AF467769.2__GP
  source 1..5070: mol_type = other RNA
atgagcttcaacatcatgtacaccctgctcctttgcgccattctgtgttcccagttgtggtcttcagagggcatacacgggttaagtaatgaaacacaacatggaaacgctagcactatcaaggcacccgaggtgtcccagggtctgggcctacctgtctctacggccccaccgattacctcggacccaccttcaatcacaagcgcggctagtgtttccgggccagaaggatctggcgatactaatacctcaccccctgtgacaacccagggtctcactctgccagagacaacccttgaactgttgacgactaccaacacaggggcctcctcaactgtaattgtggacgtcagtacccagacagtgaaagatacccccgttagcacggcacacacttctcctccaggaacaccgtccgcccccaccactcctcaaggcacacatcacaccgctagaggcctcctgtcagtgacgagcaccaagagtgaggaggcatctacacagactaatcccaaaaagacctccatggaaacaaacagccccgggcctgccacttcggagaccccatctccctccccgacaacccaggctcctactgaaaataacaatcccaacacgccaaggcagcctacacccccaacccaacccgccactccttcaccagtcaccagtccggcgctgctcgcaagctcccagggagacacatctaccgccgtgcaggatgtacatcccagccctactaatcggtcaaaacgcaacttagagatggagatcatactgacacttagtcagggtttgaagaagtattacggcaaaatcctgaagctactcgacctgacgcttgaagaggataccgaagggctgttggagtggtgcaaacgaaatctcggactggtttgtgacgattcctttttccaaaagcgtattgaagagtttttcttaactggcgagggtcactttaacgaagtgctgcagttcaaaacaccaagcaccctctctcccacagagcctgctagagccgggtcaccaactgtcgaaccctttaagagttatttcgcaaggggacttctgagcatggactccggctacttttctgctaagtgctatccgcgggcctcgaatagcggcttgcagctaatcaacattacccaacactccgcgcgcatcacggatacccctgggccaaaaataacaaacctgaagactattaattgtatcaacctcaaagcctcaaccttcaaggagcatagagaaattgagatcaatgtgctgcttccccaggtggcagtcaacctgagttcttgccacgttttgatcaaaagccatgtgtgtgactactccctcgatattgacggacctgtaaggctgccccggatacaccacgagggtacatttatcccaggcacttataagattgtgatcgacaaaaagaataagcagaacgatcgctgcaccatagtcacgaattgtgtgattaaagggcgagaaatcagaaagggacagtcagttttaaggcaatacaaaacagagatcaagattggcaaagctagctctggttcccggcgtctgctaagtgaagagagcggggacgattgcatctctcgcacccagctcctgagaactgaaacagccgagattcattccgactcatacggcggacctggcgataagataaccatctgtaacgggagtactgtggtcgaccagaggcttggaagcgagttgggttgctataccattaatcgggtgaagtcgttcaaactgtgcgaaaactccgctacaggcaagtcttgtgagatcgatagcacgcccgtaaaatgccgacaggggttttgtctcaagatcacccaagaaggacgcggccacgttaaactgtcaagaggtagtgaggtggtccttgacgcctgcgattcctcttgtgagattatgataccaaaggggactggcgacatcctggtggattgcagcggaggccagcagcatttcttgaaggacaatctcattgacctggggtgtccgaacatccctttactgggaaaaatggcaatttacatctgcaggatgtccaatcaccccaagacaaccatggtcttcctattttggttctcatttggttatgtgataacatgtatcctctgcaaagttattttctacctgcttatcgtggtaggcactttggggaagaaatttaagcagtatcgggaactgaagccacaaacctgtacgatttgcgagacaacccccgtcaacgccatcgatgctgaaatgcatgacctcaattgcagctacaacatatgtccttattgcgcgagtcgcctgacttctgatggattagcaagacacgtgatgcagtgtccaaaaaggaaggagaaaattgaagagaccgagctgtaccttaacttggaacgtatcccctgggttgtgcggaagctcctgcaggtctccgagagcacaggcgtggccctaaaacgatcgtcatggctggtagtgctcctggttcttttgactgtctctctgagtcctgtgcagtccgctccgattggtcacgggaagaccgtggaaacataccaaatcagagagggctatacgagcgtctgcttattcgttctcggatctatactgtttatcgtgagctgtcttatgaaaggcctggtggactccgatgggaatagcttctttccaggattgagtatttgcaagacctgtagcatcggctctattaacggtttcgaaatcgagtcccataagtgctactgttcactcttttgctgtccctattgcaggcactgcagtactgaccgcgagatacataaactgcacctaagcatttgtaagaaacggaagacagggtccaatgtaatgctggccgtctgcaaaagaatgtgtttcagggcaaccgtggaagtttctaacaaggccctcctgatccgctcgatcattaatactacatttgtggtctgcatccttattttggctgtgtgtgttgtgagcacctcagccgtagagatggaatccctgcctgcaggaacgtgggagcgagaagaggatttaataaacttctgccaccaggagtgtcaggtcactgaaaccgagtgcctctgtccatacgaagcgctggtgcttcggaagcccctgttcctagacagtatcattaaaggcatgaagaatctcctgaactctaccagcttggagacatccctgtcaatcgaggctccttggggtgccattaatgtgcaatctacttttaaaccgacaatgagcgcagccaacatcgctttaagttggtccagcgtcgaacatcgtggcaataagatactcgtttctgggagatcagagtccatcatgaaactggaagagaggaccggaattagttgggatcttggcgtggaagacgccagcgagtcgaagctgttgacagtatctgtgatggatctctcccagatgtatagccccgtcttcgagtacctgtcaggggaccgccaggtggaagagtggccaaaggcaacttgcaccggagattgtcctgaacggtgcggctgcacgagttctacatgtctacacaaagagtggccccattccagaaactggaggtgcaatccaacctggtgttggggtgttgggactggatgcacctgttgcggcctggacgtgaaggacctttttacagattatatgttcgtcaaatggaaggtggaatacatcaaaactgaggttattgtgtgtgtcgagctcaccagccaggaacgacaatgctcactgatcgaggctggtacgcgctttaacttgggccctgtaacaataaccctgagtgaaccccggaatattcagcagaagttaccaccggagatcgtgactctccaccctagaatcgaagaggggttctttgacctgatgcatgttcagaaggtgcttagcgcctccacagtctgtaaactgcaatcttgcacccacggagtgcccggcgatttgcaggtataccacattgggaacctcctgaagggagacaaagtgaacggccatctaatacacaagatcgagccacatttcaatactagctggatgtcctgggatggttgtgacctggattattactgcaacatgggggactggccctcatgctcttatacaggagtcacccagcacaatcatgcggcctttgttaacatgcttagtattgaaacggattacactaaaaatttccactttcactcgaagagggtgaccgctcatggcgacacacctcagctcgatctgaaagcacgtccaacctatggtgccggcgagatcacagtgttggtcgaagtggctgacatggagttacacactaagaagattgagatcagcgggctgaaattcgcctccctcacctgtacgggatgctacgcatgttcttcaggcataagctgcaaggttcgcatccatgtagatgaacccgacgagctgacagtgcacgtcaaatccgaagaccctgatattgtggcggccagttctagccttatggctcggaagctggagtttgggactgactcaaccttcaaagccttctccgcaatgccgaagacaagtttgtgtttttatatcgttgaaagagagtactgcaagagctgttctaaagaggatacccaaaagtgcgtgaacactaaactagaacagccacagtccattctgatcgagcacaagggaaccataattggcaaacaaaatgacacatgtacggctaaggcctcatgctggctcgaaagcgtcaagtcgttcttttacggtctgaaaaacatgctttctgggatcttcggaaatgtgtttatcggcattttcttatttctggcacccttcgccctcttgatcctgtttttcatgtttggctggaggatactcttctgtttcaagtgctgccgacggactcgcgggctgtttaaatatagacatcttaaggatgacgaggaaaccggatacaggaaaattatcgagcggctgaacaataagaagggtaaaaacaagttgctagatggcgagcgactggctgacagaaaaattgcggaactcttcagtacaaagacccacgtagggtga

SEQ ID NO: 10278 - RNA, 5070 nt, synthetic construct
  misc_feature 1..5070: note = derived and/or modified CDS sequence (opt3) from CCHFV(TADJ/HU8966)__AY179962.1__GP
  source 1..5070: mol_type = other RNA
atgcccgtgagcatcatgcacatgctgctcatgtgcgccgtcctttgtctgcagttgtacggcttagggggaaccctgagatccaacaatggtacagagcataacaagactaatgttctaacgacccctggcgacaaactctctccagaaccgcccgtgtcaacagctctgcctgtaactccagatagtagcaccgtgacacccaccactcctgcatccgggcttgagggatctggcgaagtctatacatcgccacccattaccacgaagggtctgtcacctagcgaggccaccagtgaaccaccggcgactacagggatgggaatatcctctgctagcggcgtggacttctccactcaagccgcaagggatacctcaacattgaccgttctcacgagtccccctaacagcccaaatactccccctacatctcaggacacccaccatccagtgcggtccctgctgtcagtcactagcccccgcccggaggagacaaccgcccctagtaaatctggcaaggaatcccccgctgcaaacagctcgcacccagtgacgtctcgaccttcctcacccctcatcaccgtacgtgggccaacagagaatagtagccataacactaccggacagttagaatccatgacacagtctactaccctggttcccatggccagccctacacaaaccgtgctttcacagagtgtcacttccattgctgtgcaggatgcccacccaagctctacgaatagatcaaaaaggaacttggagatggagatcattctgacactaccgcagggtctcaagaagtactatggcaaagtgctgcggcttctgcaattgaccctcgaagaggacactgaagggctgttagagtggtgcaagcgcaatctgggactcgattgtgacgatacctttttccagaaaagaatcgaagagtttttcataacaggcgagggtcactttaacgaagtccttcagttcaggacccccgggactctgagtacaacggagagcacccatgcgggatcccctactgcagaaccatttaagtcttacttcgccaaaggctttttgtcgatcgacagcggctatttctccgctaagtgctactcacggacaagtaattctgggctacgcctgattaacgttacccgacacagcacaagaatcgccgatactcccggacctaagattaccaatctcaaaacgatctcctgtataaacctgagggcatcaatttttaaggagcatcgggaagtggagatcaacgtacttctgccacaggtggctgtcaatttgagcaactgccacgtggccattaaatctcacgtttgtgactattccctcgatgtggacggtaccgtccgtctgccccatatccaccatggcgggacattcatcccgggaacttacaagattgtgatagacaaaaagaataaattaaacgatcgctgcaccctgtttacaaattgtgtaatcaagggcagagaggttaggaagggtcaaagtattctacggcagtacaaaactgaaatccgaatagggaaggcgagcaccggctctcgcagactcctgtccgaggaatcaggagacgattgcattagtaggacgcagcttttgcggacagagaccgccgaaatccacggcgacgattatgggggacctggtgacaaaatcactatttgtaacggcagcacaatcgtggatcaacgcctggggtcggagctcggatgctacaccattaatagagtcaagtccttcaaactgtgcgagaactctgcaactggcaagaattgtgaaatagacagcgtgccagtcaagtgcaggcagggttattgtcttaaaatcacccaggaggggcgtggccatgtgaagctgtcacggggaagtgaagttgtgttggatgcttgcgactcctcttgtgaggtaatgattcccaaaggcacaggggatatcagcgtcgactgctccggaggtcagcaacacttcctcaaggacaacctgatcgatttaggctgtcctaaaattcccctgctagggaagatggccatatacatctgccgaatgtcaaatcacccaaagacgaccatggcttttctcttctggtttagcttcggatatgtgattactagaatcctgtgtaaagccatcttttaccttttgattatagttggcacactgggtaagaggttcaaacagtatcgcgagctcaagcctcagacctgcacaatctgtgaaactacccccgcaaacgccattgacgctgagatgcatgatctgaattgcagttacaacatctgcccatactgtgcgtctcggttaacgtccgacgggctggcaagacacgtgacacagtgcccgaaaaggaaggaacgcgtcgaggaaaccgagctttatttgaatctcgagcggattccttggatcgtgcgaaagctgctacaagtaagcgaatcgactggcgtggccctgaaacgttcatcttggctcatagttctgcttgtcttgtttaccgtgagtctgtcccccgtgcagagcgctccaattggatacggcaacacaatcgagacttatcaggccagagaagagtacacctctatttgtttattcgtcctcgggagcatcctgtttatagtttcctgccttatgaagggactggtggattcaatcggcaacattttctttcccggtttgacaatctgtaaaacgtgcagtattgggagcatcaatggattcgaaatagagtctcataagtgttattgctccctcctgtgttgcccttactgtaggcactgctcagcagaccgcgagattcaccagctacatctgagtatctgcaaaaagcggaaaaccggcagcaacgtgatgctcgccgtatgtaagagaatgtgctttagggctactatggaagtctccaataaggccctgcttatccgatctattatcaacacaaccttcgtggtttgtattttgatactggcagtgtgcatcgtctcgactagcgcggtggagatggaatcattaccagctggtacatgggagcgcgaagaggatctcaccaatttctgtcaccaagagtgccaggttacggaaactgagtgtctgtgcccctatgaagcccttgtgctgcggagacctctatttctcgactccattgtaaaaggcatgaagaacccgctgaatagtacctctttggagacaagcctgtccatcgaggcaccatggggagccattaacgtccagtcaacctacaaacccactgtgtctacagctaatatcgccttaagctggagttccatagaacatagggggaacaatatcctcgtgagcggccgttctgagtcaattatgaagctggaggaacgcaccgggatctccggagatcttggcgtcgaagacgcaagtgagagcaaactgttgacagtttcggtgatggatctctctcagatgtactcccctgtattcgagtatctgagcggtgaccggcaagtggaagagtggccaaaggctacttgtaccggggattgccccgaaagatgtggatgcacgtcaagtacatgcctacacaaggagtggcctcattctaggaactggcgatgtaatccgacctggtgctggggcgtcggtactggctgtacctgctgtgggctggacgtgaaagacctttttattgattacatgttcgttaagtggaaagtggactatatcaagacagaagccatagtctgcgtggagctcacttcccaggagcggcagtgtagcctggttgaagcgggaacccgctttaacttgggccccgtgacgattacactgtcagagccaagaaatatccaacagaaattacctcccgaaatcattaccctccacccaaggatagaggaagggttctttgatctgatgcacgtccagaaggtacttagtgccagcactgtgtgcaagctgcagtcctgtacacatggagttcctggcgacttgcaagtgtaccacatcggtaacctcctgaaaggggataaggagaacggacatctaattcacaaaatcgagccccatttcaatacctcttggatgagctgggacggctgcgatctggactattactgtaacatgggtgattggccatcctgcacttatacaggcgtcacccagcacaatcacgcttcatttgtgaaccttctcaatattgaaacggactacactaagtctttccattttcacagtaaacgggtaaccgcacatggggatacaccgcagctggacttgaaggcccgacctacctacggagctggcgagatcacagtgttagtcgaagttgccgatatggagctgcacactaagaaaatagagatcaccgggctcaagttcgcatcgctgacgtgcacaggatgttatgcgtgcagctccggcatttcttgtaaagtgagaatccacgtggacgaacccgacgagcttactgtccatgtgaagtcagatgacccagatgttgtagccgctagctccagtctgatggcccgcaaattggaatttggtaccgactctacattcaaggcattcagcgctatgcccaaaacctcactatgcttttacattgtggagagggaatatcgtaagtcctgtagtaaggaggatactcagaaatgcgtcaacaccaagctggagcaacctcagagcatcctcatagaacacaaagggacaattatcggaaagcagaataacacgtgtactgccaaagcatcttgctggctggagtccgtgaagtcattcttttacggccttaagaatatgttaagcggcatcttcgggaacgtttttgtgggaattttcctgtttctcgccccattcatcttgctgatactctttttcatgtttggttggcggattctgtcgtgtttcaaatgctgtagaaggacccgcggccttctgaagcatcgacacttgaaagacgatgaagagacagggtatagacggatcattgaaaggctaaataacaagaaaggaaagaataagctgctcgacggcgagcgcttagctgatcgtagaatcgcggagctgttctctaccaaaactcatataggttga

SEQ ID NO: 10279 - RNA, 5070 nt, synthetic construct
  misc_feature 1..5070: note = derived and/or modified CDS sequence (opt3) from CCHFV(88166)__AB069675.1__GP
  source 1..5070: mol_type = other RNA
atgagcttctccgtgatgtacactcccctgctctgcgccgtcctttgtctgcagttgtggtctttagagggctcacacgggctgagtaacaagacacaacatagcaatacttccacgaccaaagctcctgaagtttctcaggagctaggactcccagtgtcgacagtatcaactatcaccagcgacccgcccagtattacatccgcagtgtctgtcagcggttccgaaggctcaggggataccaacacttctcctagcgtgacaacccagggaccaacgctgcccgagactacccttgaacctctgacaactaccgacacagatgcctcttccaccgttgtggtcgacgtgtcaacgcagactgtaaaggatacaccaataagcaccacttatacaagtttgccctctaccccttccgagccaacgaccccgcaaggcacacaccatactgcgagaggtctcctgagcgttacctcgacaaaacccgaggaagctagtactcaggccaatcctgggaagatctccatggagaccaactcaccaaggctggcaattagtgaaacacccagcttttcccctaccactcaggccccaacggaaaattctaaccccatcacaagcaaacagctcatgttatcagctcaaccggtgacccctaatcccatgaccagtccagtccagcctgcactgtcccagagcgacacctctacagccattcaggatatccacccctcaccaaccggacggagtaagcgcaaccttgagatggaaataatcttgactctgagccaaggcctaaagaaatactatggcaagattctcaaactgcttgacctgacattggaggaagatacggaggggctcctggaatggtgcaagcgaaatttaggactggtgtgtgacgataacttctttcagaaacgtatcgaggagttctttctcaccggtaagggccatttcaatgaagtgcttcagtttaagactccctccacactgtctcctaccgggccagctagaacaggatcgccgactgtcgagcccttcaaaagctactttgccaagggcttcttgtccatggactcaggttattttagtgcgaaatgctaccctagggcatctaacagcgggctacaactgattaatgttacccagcactccacgcggatcaccgatacaccaggacccaagataactaacctcaaaaccattaattgtatcaacctgaaggcctcagtgttcaaagaacaccgcgagattgaaatcaacgtacttctgcctcaggtggctgtcaatttgagctcttgccatgtgctcatcaagtcccacgtttgtgactatagtctggacattgatggcccagtgagattacccaggatacatcacgagggcacatttatcccggggacttacaagattgtcatcgacaaaaagaacaaacagaatgatcggtgcaccctggtgacgaactgtgtaataaagggacgcgagattcgaaaaggtcaaagcgttctaagacagtacaggacagaaatcaagatcggcaaggcctcttccgggtcacggcgtctcctgagtgaggaaagcggagacgattgcatttcgcgcacccagcttttgagaactgagacagcagaaatccactccgacaattatggcggtcctggggataaaattaccatatgtaacggctctactgtggtcgaccagaggctgggaagcgagctcggctgctacaccatcaatcgggtgaagtcattcaaactgtgcgagaacagtgctacagggaagtcctgtgaaattgattctacgccagtcaaatgccgacaaggattctgtcttaagatcacccaggagggtcgcggccatgtgaagctgagcagagggtccgaagttgtgttggacgcctgcgattcaagctgtgagatcatgattcccaaaggaactggcgacatactcgtagactgcagtggtgggcagcagcactttctgaaggataatttaatcgacctgggctgtcctaacattcccctactcggaaaaatggcgatctatatttgcaggatgtctaatcatccaaagacaaccatgggcttcctgttttggttctcctttgggtacgtcgtgacatgtatcctttgcaaagttatattctatttgctgatcgtggtcggaactctcggtaagaagtttaaacaataccgggagctgaagcctcagacctgtacgatttgcgaaacaacccccgtgaacgccatcgatgcagagatgcacgacttaaattgcagctataacatttgtccatactgcgcttcgcgcctgacttcagatggccttgccagacatgtaatgcagtgtccgaaaaggaaggagaaaatcgaggaaaccgagttgtacctcaatctggagcgtataccttgggtggttcggaagctactgcaggtctctgaaagtacaggggtggctctcaaacgatccagctggctggtggtccttttggttctgttaactgtgtctctcagccccgtgcaatccgccccaattggacacggcaagaccgtagagacatatcagacgagagaaggttacacctcaatctgcctgttcgtccttgggagtattctgtttatcgtgagctgtttgatgaagggcctcgttgactctgtgggaaactccttctttcccggcctgtcaatatgcaaaacttgtagtatcgggagcgtcaacggattcgagattgaatcccacaagtgctattgttctctattttgctgtccttactgcaggcattgctcggcagatcgcgagatccaccggctgcatctcagcatttgtaaaaagagaaaaacatggtcaaatgtgatgctggccgtttgcaagaggatgtgtttccgcgctaccgtggaggtatccaacaaggcgcttttgatccgaaatataattaacactacattcgtcctgtgcatcttaatcctcgcagtgtgtgtggtcagtacctctgccgttgaaatggagagcctgccagctggcacgtgggaacgggaggaagaccttactaatttttgccaccaggagtgtcaagtgaccgagacagaatgcctgtgtccctatgaggccctagtactccgtaaacctctgttctccgattcaattgtgaagggtatgaaaaacttgttaaattctaccagcctggaaacaagtctctccatcgaggcaccgtggggagccattaacgtccagagcacttttaagccaaccatgtctgctgccaatatagcactgtcatggtccagtgtggagcacagagggaacaaaatccttgttagcggcaggtcggaatctattatgaagctggaggaacgcacaggtatctcctggaatttgggcgtggaggacgcgagcgaatcaaagctcctgactgtcagtgtgatggatctatctcagatgtactcccccgttttcgagtatctgagcggggaccgacaggtggaggaatggcctaaagctacctgcacgggagattgtccagagagatgcggctgcacatcaagtacctgtcttcataaggaatggccccacagcaggaactggcgatgcaatcctacttggtgttggggagtcgggaccggctgcacatgttgcggtctcgacgtaaaagacctgtttactgattacatgttcattaagtggaaagtggagtacatcaagaccgaagccatagtttgtgtggagttgacgtcccaagagcgccagtgcacactgatcgaagcagggacccggtttaacttaggaccggtcactattacactctctgagcccagaaatatccagcagaagctgccacctgaaattgtgacccttcatcccaggatcgaggaaggcttctttgacctgatgcacgtacaaaaagtgttgagcgcctccactgtctgtaagctccagtcatgcacacatggtgttccaggcgatctacaggtgtatcacatagggaacctgctgaaaggagacaaggtgaacggccaccttattcataaaatcgagcctcacttcaatacctcttggatgagttgggatgggtgtgacctcgattactattgcaacatgggagactggccctcgtgcacgtacactggcgtcacccagcataatcacgctgcctttgtgaacatgctgaatatcgagacagattataccaagaacttccattttcacagcaaacgtgttacagcacacggtgacactccacaattggatttaaaggctcgcccgacctacggggccggagaaattacggtactggtggaggtcgcggacatggaactccatacaaagaaaatagagatctccggcctgaagttcgcctctcttacttgtaccggttgctatgcttgttcaagcggcatttcctgcaaagtgcggatccacgttgatgagcctgacgaactgacagtgcatgtcaagagtgaggaccccgatttggtggcagcctctagctcactaatggctagaaaactggagttcgggaccgactccacttttaaggccttcagtgcaatgccaaagaccagcctctgtttttacattgtagaaagggaatactgcaaatcttgttccaaggaggatacacagaaatgcgtcaatacgaagctggagcagccccaatcaatccttatagaacacaaaggaactatcattggcaagcagaacaatacctgtacagcgaaggccagctgctggttagagtcggtgaaatctttcttttatgggctgaagaacatgctcagtggaatcttcggcaatgtttttattggtgtgttcttgtttttcgctccttttatcctgctcatactgttcttcatgtttgggtggcggattcttttctgttttaaatgctgccggcgcaccagaggactgttcaagtacaggcacttgaaagacgatgaagagactggctatcggaagatcatcgaacgactaaacaataagaaaggcaagaacaaactgctcgacggggagagattagccgatcgcaagattgcagagctgttttccacaaaaacccatatcggatga

SEQ ID NO: 10280 - RNA, 5070 nt, synthetic construct
  misc_feature 1..5070: note = derived and/or modified CDS sequence (opt3) from CCHFV(8402)__AB069674.1__GP
  source 1..5070: mol_type = other RNA
atgagcttctccgtgatgtacactcccctgctctgcgccgtcctttgtctgcagttgtggtctttagagggctcacacgggctgagtaacaagacacaacatagcaatacttccacgaccaaagctcctgaagtttctcaggagctaggactcccagtgtcgacagtatcaactatcaccagcgacccgcccagtattacatccgcagtgtctgtcagcggttccgaaggctcaggggataccaacaccagtcctagcgtgacaacccagggaccaacgctgcccgagactacccttgaacctctgacaactaccgacacagatgcctcttccaccgttgtggtcgacgtgtcaacgcagactgtaaaggatacaccaataagcaccacttatacaagtttgccctctaccccttccgagccaacgaccccgcaaggcacacaccatactgcgagaggtctcctgagcgttacctcgacaaaacccgaggaagcctctactcaggccaatcctgggaagatctccatggagaccaacggaccaaggctggcaatttcagaaacacccagttttagccctaccactcaggccccaacggaaaattccaaccccatcacatctaaacagctcatgttaagcgctcaaccggtgacccctaatcccatgacttcaccagtccagcctgcactgagtcagtccgacaccagcacagccattcaggatgtgcacccctctccaaccggccggtcaaagcgcaaccttgagatggaaatcatattgactctgagtcaaggcctaaagaaatactatgggaagatcctcaaactgcttgacctgacattggaggaagatacggagggactcctggaatggtgcaagcgaaatttaggtctggtgtgtgacgataacttctttcagaaacgtattgaggagttctttctcaccggcaaggggcatttcaatgaagtccttcagtttaagactcccagcacactgtcccctaccggaccagctagaacaggctctccgactgttgagcccttcaaatcgtactttgccaagggtttcttgagcatggactccgggtatttttcagcgaaatgctaccctagggcaagtaactctggactacaactgatcaatgtgacccagcacagcacgcggattaccgatacaccaggccccaagatcactaacctcaaaaccataaattgtattaacctgaaggcctccgtattcaaagaacaccgcgagatcgaaattaacgtgcttctgcctcaggtcgctgtgaatttgtcaagctgccatgttctcatcaagtctcacgtgtgtgactattccctggacatcgatggcccagtcagattacccaggattcatcacgaggggacatttataccgggaacttacaagatcgtgattgacaaaaagaacaaacagaatgatcggtgcaccctggtaacgaactgtgttatcaagggtcgcgagatacgaaaaggccaaagtgtgctaagacagtacaggacagaaattaagatcgggaaggccagctctggatcccggcgtctcctgtcagaggaaagtggcgacgattgcatcagccgcacccagcttttgagaactgagacagcagaaattcacaatgacaactatggtgggcctggcgataaaatcaccatttgtaatggatcgactgtcgtggaccagaggctgggctccgagctcgggtgctacaccataaaccgggtcaagtctttcaaactgtgcgagaatagcgctacaggaaagtcatgtgaaatcgatagtacgccagtgaaatgccgacaaggtttctgtcttaagattacccaggagggccgcgggcatgttaagctgtccagaggatctgaagtggtattggacgcctgcgatagctcctgtgagatcatgatccccaaaggcactggtgacattctcgtcgactgctcagggggccagcagcactttctgaaggataacttaatagacctgggatgtcctaatatccccctactcggcaaaatggcgatttatatctgcaggatgagcaaccatccaaagacaaccatggccttcctgttttggttcagttttgggtacgtggttacatgtattctttgcaaagtgatcttctatttgctgatagtcgtgggaactctcggtaagaagtttaaacaataccgggagctgaagcctcagacctgtacgatctgcgaaacaacccccgtaaatgcaattgatgctgagatgcacgacttaaactgctcttataatatctgtccatactgcgcctcccgcctgactagcgatggccttgctagacatgtgatgcagtgtccgaaaaggaaggagaaaattgaggaaaccgagttgtacctcaacctggagcgtatcccttgggttgtccggaagctactacaggtgtcggaatcaacaggggtggccctcaaacgatctagttggctggtcgttcttttggtgctgttaactgtgtccctcagccccgtacaatctgcaccaataggacacggcaagaccgtcgagacatatcagacgagagaaggttacaccagcatttgcctgttcgtgcttgggtccatcctgtttattgtttcatgtttgatgaagggcctcgtggacagtgtcggaaacagcttctttcccggcctgtctatctgcaaaacttgttccatagggtcagtgaatggattcgagatcgaaagtcacaagtgctattgtagcctattttgctgtccttactgcaggcattgctccgccgatcgcgagattcaccggctgcatctctctatctgtaaaaagagaaaaacaggctcgaacgttatgctggctgtgtgcaagaggatgtgtttccgcgcgaccgtagaggtcagcaataaggcacttttgattcgaaacatcataaatactacattcgtgctgtgcattttaatcctcgccgtgtgtgtcgtttcaacctccgctgtggaaatggagagtctgccagccggtacgtgggaacgggaggaagaccttactaacttttgccaccaggagtgtcaagtaaccgagacagaatgcctgtgtccctatgaggcactggtgctccgtaaacctctgttctctgatagcatcgtcaaggggatgaaaaatttgctgaactccacctcattagaaacttctctcagcattgaggccccgtggggagctatcaatgtgcagagtacatttaagccaaccgtttccgccgcaaacattgcgctgagctggtcttcagtggagcacagaggcaataaaatacttgtctccggtaggagtgaaagcatcatgaagctggaggaacgcacaggcatttcgtgggacttgggggtggaggatgcttctgaatccaagctcctgactgttagcgtgatggacctatcacagatgtacagtcccgtcttcgagtatctgtctggagatcggcaggtagaggaatggcctaaagctacctgcacgggcgactgtccagagagatgcgggtgcacatccagcacctgtcttcataaggaatggccccactcaaggaactggcgatgcaatcctacttggtgttggggagtgggcaccggttgcacatgttgcgggctcgacgttaaagatctgtttactgactacatgttcatcaagtggaaagtggagtacattaagaccgaagcaatcgtctgtgtggagttgacgagtcaagagcgccagtgcacactgatagaagccggaacccggtttaacttaggcccggtaactatcacactcagcgagcccagaaatattcagcagaagctgccacctgaaatcgtgacccttcatcccaggattgaggaaggtttctttgatctgatgcacgtccaaaaagttttgtccgcttctactgtgtgtaagctccagagctgcacacatggcgtgccaggggacctgcaggtctatcacatcggaaacctactgaaaggcgataaggtgaacgggcaccttatacataaaattgagcctcacttcaatacctcctggatgtcatgggacggatgtgatctcgactactattgcaacatgggcgattggccctcttgcacgtacactggtgttacccagcataatcacgccgcatttgtaaacatgctgaatatcgagacagactataccaagaacttccattttcacagtaaacgtgtgacagctcacggggatactccacaattggacttaaaggcccgcccgacctacggagcgggcgaaatcacggtcctggtggaggttgccgatatggaactccatacaaagaaaattgagatatcgggtctgaagttcgctagccttacttgtaccggctgctatgcatgttcctctgggatctcatgcaaagtgcggattcacgtcgacgagcctgacgaactgacagtgcatgtaaagagcgaggatcccgacatcgtcgccgcttccagttctttgatggccagaaaactagagttcggaaccgatagcacttttaaggcattctcagcgatgccaaagacctccctgtgtttttacattgtggaaagggaatactgcaaaagttgtagcaaggaggacacacagaaatgcgttaatacgaagctcgagcagccccaatctatcctgatagaacacaaaggcactatcattgggaagcagtccaacacctgtacagccaaggcttcatgctggcttgagagcgtgaaatcgttcttttatggattaaagaatatgctgtctggcatcttcggtaacgtctttattggggtgttcctctttttcgccccttttatcttgctgatactcttcttcatgtttggatggcggattctgttctgttttaaatgctgccgacgcaccagaggccttttcaagtacaggcacctgaaagatgacgaagagactggctatcggaagatcatcgaacgattgaataacaagaaagggaagaataaactactggatggagagagactcgcagaccgcaagattgctgagttatttagtacaaaaacccatatcggttga

SEQ ID NO: 10281 - RNA, 5070 nt, synthetic construct
  misc_feature 1..5070: note = derived and/or modified CDS sequence (opt3) from CCHFV(7803)__AB069672.1__GP
  source 1..5070: mol_type = other RNA
atgcccgtgagcatcatgcacatttccctgatgtgcgccgtcctctgtcttcagctgtacggcttgggggagacccatggatcttcaaacgaaacagagcacaataagactaacgttgtgacgacccctggtgacagtcaaagcccagaaccgttagtatccacaactctgcccgtgaccctagattcttcgacagtcacccctactacaccagcttcagagcccgaaggcagcggggaggtgtataccagtcctccaataacgactgagggactctccccctctgaagcaaccagcgagctgcctgttacaactggcatcggtatttcctcagccagtgacgtggatagctctacccaggcggctggggacacatccaccccaacggtcagaacttcaccgcccaatagccctagtacaccacccacctctcaggatactcatcaccctatgaggaaccttctgtccgtgacaagcctaaaatcggaagagacctctgccccatccaagtcaggaaaagagagtcccgcagccagctccccgcatcctgtagcttctcggcccccaacgcaccctatcaccgcacagggccccacagaaaataacagccacaatactaccggccaactcgagtcagttacacagagtgccactctggggccaatggcttcccccacccagacagtgctgagccagaacgtcacctctattgccatccaagacactcatccttcaccaacgaatcgcagtaagcgaaacctcgaaatggagataatcttaacactgccgcagggacttaaaaagtactatggtaaggtgttgcgtctgctacagctcaccctggaagaggatactgagggccttctggaatggtgcaaaagaaatttggggctcgactgtgatgacaccttctttcagaagaggattgaggagttctttatcacaggagaaggccacttcaacgaagtgctgcaatttcggacccccggtactttaagcacaacggagtccacccatgcggagtctcctactgcagaaccattcaaatcgtactttgccaaggggttcctgagcattgattccggatatttttcagctaaatgctacagtcgcacatctgacagcggcctccagcttatcaatgtcaccagacactccacaaggatagccgatactcccggccctaagattaccaacctgaagacgatctcatgtattaatttgaaagcaagcgttttcaaggagcaccgggaagtggagatcaacgtactactgccacaggtggctgtcaacctctctaattgccatgtgaccatcaaatcccacgtttgtgactatagtctggacattgatgggacagtgcgccttccccatatacaccatgaaggaacttttatcccgggtacctacaagattgtcatcgacaaaaagaacaaactgaatgatcgatgcacattgttcactaactgtgtgataaagggcagagaggtaaggaaggggcaaagcgttctccggcagtacaaaaccgagattcgtatcggaaaggcctctacgggctcccgcagactgttatcagaagagagtggtgacgattgcatcagcaggacacagctgctacggaccgaaactgcggagattcacggggacaattatggcggacctggcgataaaatcacaatttgtaacgggtcgaccatagtggaccagcgactcggatccgagatgggttgctacactatcaatcgcgtcaagtcttttaaactgtgcgaaaacagcgccaccggcaagtcatgtgagattgatagtatcccagtgaagtgcagacaagggtattgtcttaaaatcacacaggaaggaaggggccacgtcaagttgtcccggggttctgaggtgattctggacgcatgcgatagctcctgtgaagttatgatacccaaagggacgggcgacatcctcgtggactgctcaggaggccagcagcatttcctgaaggataatcttattgacctggggtgtcctagcatccccttgctcggaaaaatggctatttacatctgccgcatgagtaaccacccaaagaccactatggccttcctgttttggttctcttttggttatgtaataacatgtatcttatgcaaggctattttctacctgctaatcattgtcggcaccctcgggaaaagatttaagcaatatagggagctgaaacctcagacatgtactatctgcgagaccacgcccgccaatgcaatagatgccgaaatgcatgaccttaactgctcctacaatatttgtccatactgcgctagccgtttgacatcggatggactggcgcggcacgtgacccagtgtccgaagcgaaaagagaaggttgaagagactgaactctatctgaacttagagagaatcccttgggtggtcaggaagctgcttcaggtgtcagagtctaccggcgtagcattgaaacgcagttcctggctcattgtgctgctagttctgttcgccatcagcctctctcccgtccaaagcgctccaatatcccacggtaagacaatcgaaacttaccaggcccgggaggaatatacctcaatttgcctgtttgtgcttgggagtatcttgttcattgtgagctgtctgatgaaaggcttagtcgactctatcggaaatatatttttccccggcctctccatttgcaagacatgttcaatcgggagtatcaacggatttgagattgaaagccataaatgctactgttccctgctttgctgtccttattgcagacactgctctgcagatagggagatccatcagctgcacttgtcgatttgtaagaaacgcaagacgggcagcaacgttatgctcgccgcttgcaagcgaatgtgtttccgggccaccatggaggtgtcaaataaagcactgctaatacgttccatcattaacactacatttgtggtatacatcctgattctcgcggtctgcgtggttagtacctctgctgtggaaatggagagcctgccagccggtacttgggaaagagaggaggaccttacaaatttctgtcatcaggaatgccaagtcaccgagacggaatgtttgtgcccctatgaggcactggtgttaaggcgccctctcttcctggattccatcgttcgggggatgaagaacccgcttaattcaacttctctggaaaccagcctaagtatagaggccccatggggagctatcaacgtgcagtccacatacaaacccaccgtaagcactgccaatattgcactctcttggtcatccgtcgagcacagaggcaacaagatcctggtgagtggtaggagcgaatcgattatgaaattggaggaacgaacaggcatctcttgggacctgggggtggaggatgcttccgaaagcaagttactcaccgtctcagttatggacctgagtcagatgtactctcctgtgtttgagtatctttccggagatcgccaagtagaggaatggccaaaggccacatgtactggcgactgccccgagcggtgtgggtgcaccacgagcacatgcctgcacaaagaatggcctcattcaagaaattggaggtgtaacccgacctggtgctggggagtgggcactggttgtacctgctgtgggttggacgtcaaggatctcttcacagactacatgatagtgaaatggaaggttgagtatattaaaactcgtggaatcgtgtgcgtcgaactgaccagtcaggagcgccagtgtagcctaatcgaggcgggcacgcggtttaatctgggttccgtgacaattaccctttctgaacccagaaacatacagcaaaagctcccacctgagatcattactctgcaccccaggatcgaagagggcttctttgatttgatgcatgttcagaaggtgctgagcgcctccacagtctgcaaattacagtcatgtacccacggggtaccaggagacctccaggtgtaccatgttggcaatctgcttaagggggataaagtgaacggacacctgattcacaagatcgagcctcatttgaatacttcttggatgagttgggacggctgcgatctcgactattactgtaacatgggtgattggccctcgtgcacatataccggggtcacgcaacacaaccatgctagcttcgtgaatctgctaaacatagaaactgactacaccaaatcctttcacttccactctaagcgagtaacagcacatggagataccccacagctggaccttaaggcccggccgacatacggcgctggtgagatcactgtgctcgtcgaagttgccgatatggagtttacccctaaaaagattgaaatctcaggcctgaaattcgcgagcttgacgtgcacagggtgttatgcatgctccagtggaatttcttgtaaggtgcgcatccacgtggacgagcccgacgagttaactgtccatgtgaaaagcgatgacccagatgttgtagccgcttcatccagtctgatggccagaaagctcgaatttggcaccgacagcacattcaaagcattttctgctatgcccaagacctccctgtgcttctacatagtggagagggaatattgtaagtcatgcagcaaagaggatactcagaagtgtgtcaataccaaacttgaacagcctcaatcgattctgatcgagcacaaggggacaatcattggaaaacagaacaatacgtgcactgccaaggcatcttgttggttggagagtgtgaagtccttcttttacggcttgaaaaacatgctgagcggtatcttcgggaactttttcatgggaatatttctcttcctggccccatttattcttttaatcctgttctttatgttcggctggcggattctcttttgcttcaagtgttgccgaagaacccgcggcttgttcaaatataggcatctgaaggacgatgaagagacagggtaccgtcggatcatagaaagactcaataataaaaagggaaagaacaaactgcttgacggtgagaggctggctgatcgccgaattgcggaattgttttcaaccaagactcacatcggctga

SEQ ID NO: 10282 - RNA, 5070 nt, synthetic construct
  misc_feature 1..5070: note = derived and/or modified CDS sequence (opt3) from CCHFV(75024)__AB069671.1__GP
  source 1..5070: mol_type = other RNA
atgcccgtgagcatcatgcacatttccctgatgtgcgccgtcctctgtcttcagctgtacggcttgggggagacccatggatcttcaaacgaaacagagcacaataagactaacgttgtgacgacccctggtgacagtcaaagcccagaaccgttagtatccacaactctgcccgtgaccctagattcttcgacagtcacccctactacaccagcttcaggccccgaggggagcggagaagtgtataccagtcctccaataacgactgagggcctctccccctctgaggcaaccagcgaactgcctgccacaactggtatcgggatttcctcagcgagtgacgttgatagctctacccaggctgccggagacacatccaccccaacggtgagaacttcaccgcccaatagcagttctacacctccaacctcccaggatactcatcaccccatgaggaaccttctgagcgtcacatcgttgaaacctgaggaaacctctgcaccatccaagtcaggcaaagagagtcccgccgctagctccccgcatcctgtggcatctcggcccccaacgcctcccaccacagcccagggcccaatcgagaataacagccacaatactaccgggcaactcgaatcagtaacacagagtgctactctgggacccatggcctcccctacccagacagttctgagccagaacgtgacctctattgcgatccaagacactcacccatcaccgacgaatcgcagtaagcgaaacctcgagatggaaataatcttaacactgccccagggtcttaaaaagtactatggcaaggtcttgcgtctgctacagctcaccctggaggaagatactgaggggcttctggagtggtgcaaaagaaatttgggactcgactgtgatgacaccttctttcagaagaggattgaagagttctttatcacaggcgaaggtcatttcaacgaggtgctgcaatttcggacccctgggactttaagcacaacggaatccacccacgcagagtctccaactgccgagcccttcaaatcgtactttgctaagggattcctgagcattgattccggctatttttcagccaaatgctacagtcgcacatctaatagcggcctccagcttatcaacgtgaccagacattccacaaggatagcagacactcctgggccaaagattaccaatctgaagacgatctcatgtattaacttgaaagctagcgtcttcaaggaacaccgggaggttgaaatcaacgtgctactgccccaggtagccgtgaatctctctaactgccacgtcaccatcaaatcccatgtgtgtgattatagtctggacattgacggaacagttcgccttccgcacatacatcacgagggtacttttatccctggcacctacaagattgtgatcgataaaaagaataaactgaacgaccgatgcacattgttcactaattgtgtcataaaggggagagaagtgaggaagggacaaagcgtactccggcagtacaaaaccgagattcgtatcggcaaggcgtctacgggttcccgcagactgttatcagaggaaagtggggatgactgcatcagcaggacacagctgctacggaccgagactgccgaaattcatggcgataactatggaggcccaggggacaaaatcacaatttgtaatggatcgaccatagttgatcagcgactcggttccgagatgggctgctacactatcaaccgcgtgaagtcttttaaactgtgcgagaatagcgcaaccgggaagtcatgtgaaattgacagtatccccgtcaagtgcagacaaggatattgtcttaaaatcacacaggagggcaggggtcacgtgaagttgtcccgggggtctgaagtcgtgctggatgcttgcgacagctcctgtgaggttatgattcctaaaggcacgggagatatactcgtggactgctcaggcgggcagcagcacttcctgaaggacaaccttatcgatctgggatgtcccagcattccattgctcggtaaaatggccatctacatttgccgcatgagtaatcatcctaagaccactatggctttcctgttttggttctcttttggctatgtaatcacatgtatattatgcaaggccatcttctacctgctaattatcgtcgggaccctcggaaaaagatttaagcaatatagggaactgaaaccccagacatgtactatttgcgagaccacgccagcaaacgccatcgacgctgagatgcacgatcttaattgctcctacaacatatgtccgtactgcgcgagccgtttgacatcggacggcctggcacggcatgtgacccagtgtcctaagcgaaaagaaaaggttgaggaaactgagctctatctgaatttagaaaggattccctgggtggtcagaaagctgcttcaggtgtcagagtctaccggtgtagccttgaaacgcagttcctggctcatcgtgctgctagttctgttcgctattagcctctctccagtccaaagcgcccccatcgggcacggcaagacaatagagacttaccaggcacgggaagagtatacctccatctgcctgtttgtgcttggatcaattttgttcatcgtgagttgtctgatgaaaggcttagtcgatagcattgggaacatctttttccctggactctctatatgcaagacatgttccattggctcaatcaacggttttgaaatcgagagtcacaaatgctactgtagcctgctttgctgtccatattgcagacattgctccgccgacagggaaattcaccagctgcatttgtctatctgtaagaaacgcaagacggggtcgaatgttatgctcgctgtgtgcaagcgaatgtgtttccgggccaccatggaggtgagcaacaaagcactgctaattcgttcaataatcaatactacatttgtagtctgcattctgatcctcgcggtgtgtgttgtgtccaccagtgctgtcgagatggaatctctgcccgccggaacttgggagagagaagaggatcttacaaacttctgccaccaggagtgtcaagtgaccgaaacggagtgcttgtgtccttacgaagcactggttttaaggcgcccgctattcctggacagcattgtgcggggcatgaagaatcagcttaactccacttcactggagacctctctaagcatcgaagccccatggggtgctataaatgtacagagtacatataaacccaccgtctccactgccaacatcgcactcagctggtcttcagtggagcatagaggcaataagattctggtgtccgggaggagtgagagcatcatgaaattggaggaacgaacaggaatttcgtgggatctgggcgtcgaagacgcttctgagtccaagttactcaccgttagcgtgatggatctgtcacaaatgtacagtcctgtatttgaatacctttctggggaccgccaggtggaggagtggccaaaggccacatgcactggagattgtcccgaacggtgcggctgcaccacgtccacatgtctgcacaaagagtggcctcacagcagaaactggaggtgcaatccgacctggtgttggggtgtcgggactggatgcacctgttgcggcttggacgtgaaggacctcttcacagattatatgatcgttaaatggaaggtggaatacataaaaactgaggcgattgtctgtgtggaactgacctcacaggagcgtcagtgcagtctaatcgaggccggtacgcgctttaacctgggcagcgttacaatcaccctttccgaaccccggaatattcaacagaagctcccacctgagataatcactctgcatcccagaattgaagaggggttctttgacttgatgcacgtgcagaaggtcctgtctgctagcacagtatgtaaattacagtcctgcacccatggagtgccaggcgatctccaagtttatcacgtggggaacctgcttaagggagacaaagtcaatggccatctgatccacaagattgagcctcacttgaacacttcatggatgtcttgggatggttgtgacctcgattactattgcaacatgggggactggcccagttgcacatacaccggagtgacgcagcataatcacgcatcgttcgtaaacctgctaaatatcgaaactgattataccaagagctttcatttccactccaaaagggtgacagcccacggcgacaccccacagctggatcttaaggctcgaccgacatacggtgccggcgagataactgtcctcgttgaagtggcagacatggagtttacccctaaaaagatcgaaatttctgggctgaaattcgcgtcattgacgtgtacaggatgctacgcctgtagctccggcatcagttgcaaggtgcggattcatgtcgatgagcccgacgagttaactgtgcacgttaaatctgacgatccagacgtagtggctgccagctcatccctgatggcacgcaagctcgaatttgggaccgatagtacattcaaggcttttagcgccatgcccaaaacctctctgtgtttctatatcgtcgagagagaatactgcaagtcctgttcaaaagaggacactcagaagtgcgtgaacaccaaacttgaacaacctcagagcatactgattgagcataagggaacaatcatcggcaaacagaataacacgtgtactgcaaaggcctcgtgctggttggagtctgttaagagtttcttttatggtctcaaaaatatgctgtccgggattttcggaaacctctttatgggcatcttcctgtttcttgctccattcatattactgattctctttttcatgtttggctggaggatcttgttctgttttaagtgctgccggcgaaccagagggctgttcaaataccgccacctcaaggatgacgaagagacaggatataggcgtattatcgaacggctgaataacaaaaagggtaagaataaacttctggatggcgagagattggcggacaggcgcatagccgaactattcagcaccaagactcatattgggtga

SEQ ID NO: 10283 - RNA, 5070 nt, synthetic construct
  misc_feature 1..5070: note = derived and/or modified CDS sequence (opt3) from CCHFV(66019)__AB069669.1__GP
  source 1..5070: mol_type = other RNA
atgcccgccaacatcatgtacaccctgctcgtgtgcgctgtcctttgtcctcagctgtggagcttggagggcacacacgttccacataatgaaactaagcacaacgggacgggaattaccgcagccccgggtgagtcccaaggccccatgtctcctgcgtcaacagctgtgccattaactcccgaacctccaaataccaaacccgccgcaagtgccagcgagctggaatcctctggggagggacatacatcgctactcgctaccactcagggcctgacatcacctgaggcaaccccagaacttccgacgactaccgacacaggtgtaagcagtacttccgtggtcgatatagggacccagatggccaaggacacacccacctctacggctcacactagcctgccttccaacccatcagcccccagtacagcgcagggaacccatcacactatcagaggcttgctcagcgtgacatctaccaaacctgaggaagcatccacgccaaccgatcccggcaaggccggggctgagacaggatcaccgaggcctgccattagccggaaacccactctgagtccaaccgcagaggctcctacagaaatcaataactcttccactcccaagcaaccagagcccagcattcagcctgccaccccatcgctggttatctctccggcgcagcccgccttccctcagtccgcaacatcaaccgctgcccaagacatatatagtagcccaactaatcgctccaagcgaaacctcaaaatggaaatcattttaacgctgtctcagggtcttaagaaatactatggcaagatccagaaaacattggggctgaccctagaggaagatactgagggactcctggagtggtgcaagcgtaatcttggcctgacctgtgacgataactttttccagaagagaattgaagagtttttcttgacaggtgaagggtactttaatgaggtgctccaattcaaaacccccagcactcctggatcaacagaaccaacgcacaccgaggctcccactgtcaagccgtttaaaagttatttcgccaggggctttctgacaatcgactccggctacttcagcgcaaagtgctattctcggacctcaaacagtgggttacagctgataaatgtgacacagcatcctgcccgcattgctgatactccaggacccaaaatcaccaacctcaagacgattaattgtatcaaccttaaagcgagcgtatttaaggagcacagagaaatcgagattaacgttctgttgcctcaagtggcagtcaatctatccaactgccatgtgctgataaagtctcacgtgtgtgactactcgctcgatatcgacggtaccattaggctgccccggatctaccacgaaggcacattcataccagggacttataaaattgtcatcgataagcgcgacaaacagaatgaccgatgcacccttgttacaaactgtgtgatcaagggaagagaggtaaggcggggccagagcgccctgcgtcagtaccgcactgaaattagaatcggtaaagctagcgccgggtcaaggcggttgctcagtgaggagtctggcgatgactgcattagccgaacccaactgttacgcacggaaacagcagaggtgcatggagataattatggcgggcctggagacaagataaccatctgtaacggttccactattgtcgatcagagactgggctcagaactagggtgctacacaatcaatagggtgaagtcctttaaactctgcgagaactctggaaccggcaagtcctgtaaaatcgacaatactcccgttaagtgccggcagggtttctgtctgaaaattacccaggaggggcgcggccacgtgaaacttagtagaggaagcgaagtcgtgttggatgcctgcgactcttcctgtgagataatgatcccaaagggcacaggggatattctggtagactgctcaggaggtcaacagcatttcctcaaagataacctggttgaccttggctgtccgaatatccctctgttggggaagatggctatttatatctgcaggatgagtaaccaccccaaaacgaccatggcctttctcttctggtttagcttcggatacgtgataacttgtatcttttgcaagattatcttctatctgttaattgtcgtgggcacactgggtaaaaagtttaagcagtaccgtgaactaaaaccacagacctgtacaatctgcgagactacccccacgaatgcaatagacgcggaaatgcatgatctcaagtgctcgtacaacatttgtccttattgcgcttcccggctgacatctgacgggcttgcccgacacgtcacccaatgtccaaaaagaaaggagaaagtggaggaaactgagttgtacctgaatctcgaaaggatcccctggattgttcgcaagctgttacaggtgagcgagtcaaccggcgtagcactgaaacggagttcctggcttatcgtcttgctcgtgctgctaacagtttctctgagccctgtgcagtccgccccgataggacacggcaagactatcgaagcatatcagaccagagaggggtacacatcagtctgcctcttcatgctgggaggcattctttttgtggtaagctgtttgatgaagggtctggtggatagtgtttctaactccttctttccagggttaagcatctgcaaaacgtgttcgattggatcagtcaacggcttcgagatcgaatctcataagtgctattgtagtctcctgtgctgtctttactgcaggcactgctccgccgaccgcgagatacatcaactgcacttgagcatttgtaaaaagcgacgggctggtggcaatgtgatgctcgctgtgtgcaaacgtatgtgtctgagagccaccatggaagtctctaacaaggttctatttatcaggagcatcattaatactacattcgtgatctgcattctggtgctcgcggtatgtatagtctccacctcagccgtggagatggaaagtctgcccgctgggacttgggagcgcgaggaagatcttacaaacttctgccaccaggagtgtcaggttaccgaaacggagtgcttgtgtccttatgaggcactggtgttacggaagccactctttagcgactctatcgtcaaaggaatgaagaatctgcttaactccacttcactggaaaccagtctaagcattgaggccccctggggcgctatcaatgtgcaatccacattcaaacctaccgtttctactgccaacattgcactctcgtggagctcagtggaacatagagggaataagatcctggtatccggaaggagtgagtctataatgaaattggaggaacgaacaggcatcagctgggatctgggtgtcgaggacgcgtccgaatcaaagttactcaccgtgtctgtgatggatctgagccagatgtacagtccggtctttgagtacctttccggggaccgccaggttgaagagtggcccaaggccacatgcactggaaactgtccagatcggtgcggctgcaccagctctacgtgtctgcacaaagaatggcctcattcaagaaattggaggtgcaaccccacatggtgttggggtgtgggcaccgggtgcacttgttgcggattggacgtaaaggatctcttcaccgactatatgtttgtgaaatggaaggtcgagtacattaaaacagaggctatcgtgtgtgttgaactaaattcccaggagcgtcaatgcagtctgattgaagccggcactcgcttcaacctggggccagtgaccatcacgcttagcgagcctcggaatatacagcagaagctcccctcggaaattatcacactgcacccaagaatcgaggagggatttttcgacttgatgcatgtccagaaggtgctgtctgcatccaccgtttgtaaattacaaagctgcactcacggcgtgccgggtgatctccagatttatcacatagggaacctgcttaagggagacagggtcaacggccatctgatccacaaaattgaacctcattttaatacatcatggatgagttgggatggttgtgacttggattactattgcaacatgggcgactggccctcttgcacctacactggggtaacacagcacaatcatgctgccttcgtgaacctcctgaatatcgagaccgattatacgaagaactttcacttccactccaaacgagttactgcacatggagacaccccacagctagatctgaaggcccggcccacatacggcgctggggaaattaccgtgcttgtcgaggtggcggacatggagctccacacaaagaagatcgccataagcggactgaagtttgcatcattgacttgtaccggctgctacgcttgtagtagcggtatctcctgcaaagtacgcattcatgtggatgaacctgacgagttaacggtccacgttaagtctgaagatccagacatcgtggccgccagctcctcactgatggctagaaaactcgagttcgggacagactctactttcaaggcatttagtgccatgcccaaaacctcgctgtgtttctatattgtggaaagggagtactgcgagagctgttccaaggaagatacacaaaagtgcgtcaataccaaacttgagcagcctcagtctatcctgatagaacacaagggaactattatcggcaaacaaaacgacacctgtacagcgaaggcttcatgctggttggagagcgtgaaatcctttttctatggcctaaagaatatgctgagtgggatctttggaaacgttttcattggtatctttctcttcctggccccgtttatacttttaattctgttctttatgttcggctggcggatcctcttctgttttaagtgctgccgaagaacgcgcgggttgttcaaatacaggtatctgaaggatgacgaagagtctggataccgtcggattatcgagagactcaataacaaaaagggcaaaaataagctgcttgatggtgaaaggctggcagaccgccgaatagccgagttgtttagcactaagacccatattgggtga

SEQ ID NO: 10284 - RNA, 5070 nt, synthetic construct
  misc_feature 1..5070: note = derived and/or modified CDS sequence (opt3) from CCHFV(BA8402)__AF350449.1__GP
  source 1..5070: mol_type = other RNA
atgagcttctccgtgatgtacacacccctgctctgcgccgtcctttgtctgcagttgtggtctttagagggctcacacgggctgagtaacaagacacaacatagcaatacttccacgaccaaagctcctgaagtttctcaggagctaggactcccagtgtcgacagtatcaactatcaccagcgaaccgcccagtattacatccgcagtgtctgtcagcggttccgagggctcaggggacaccaacactagccctagcgtgacaacccagggaccaacgctgcccgaaactacccttgagcctctgacaactaccgatacagacgcctcttccaccgttgtggtcgatgtgtcaacgcagactgtaaaggacacaccaataagcaccacttatacaagtttgccctctaccccttccgagccaacgaccccgcaaggcacacaccatactgcgagaggtctcctgagcgttacctcgacaaaacccgaagaggcttctcctcaggccaatccagggaagatctccatggaaactaacggacccaggctggcaatttcagagacccctagttttagcccaacaacccaggcccccactgaaaattccaacccgatcacgtctaaacagctcatgttaagcgctcaacctgtgacacccaatccaatgacctcacctgtccagcccgcactgagtcagtccgatactagcaccgccattcaggacgtgcacccatctcccacaggccggtcaaagcgcaaccttgaaatggagatcatattgaccctgagtcaaggcctaaagaaatactatgggaagatcctcaaactgcttgatctgactttggaagaggacacagaaggactcctggagtggtgcaagcgaaatttaggtctggtgtgtgatgacaacttctttcagaaacgtattgaggagttctttctcacgggcaaggggcatttcaatgaggtccttcagtttaagacccctagcactctgtccccaacaggaccggctagaaccggctctcccacagttgaacctttcaaatcgtactttgccaagggtttcttgagcatggattccgggtatttttcagcgaaatgctacccaagggcaagtaactctggactacaactgatcaatgtgactcagcacagcacccggattacggacacccccggccctaagatcacaaacctcaaaactataaattgtattaacctgaaggcctccgtattcaaagagcaccgcgaaatcgagattaacgtgcttctgccacaggtcgctgtgaatttgtcaagctgccatgttctcatcaagtctcacgtgtgtgattattccctggacatcgacggccccgtcagattaccgaggattcatcacgaggggacctttatacctggaacatacaagatcgtgattgataaaaagaacaaacagaatgaccggtgcactctggtaaccaactgtgttatcaagggtcgcgaaatacgaaaaggccaaagtgtgctaagacagtacaggacggagattaagatcgggaaggccagctctggatcccggcgtctcctgtcagaagagagtggcgatgactgcatcagccgcacacagcttttgagaaccgaaactgcagagattcacaatgataactatggtgggccaggcgacaaaatcacaatttgtaatggatcgaccgtcgtggatcagaggctgggctccgagctcgggtgctacactataaaccgggtcaattctttcaacctgtgcgaaaataccgctacaggaaagagctgtgagatcgactcaacgcccgtgaaatgccgacaaggtttctgtcttaagattacccaggaaggccgcgggcatgttaaactgagtagaggatccgaggtggtattggatgcctgcgagtctagctgtgaaatcatgatccctaagggcactggtgacattctcgtcgattgctccgggggccagcagcactttctgaaggacaacttaatagacctgggatgtcccaatatcccactactcggcaaaatggcgatttatatctgcaggatgtcaaaccatcctaagacaaccatggccttcctgttttggttcagctttgggtacgtggttacatgtattctttgcaaagtgatcttctatttgctgatagtcgtgggaactctcggtaagaaatttaagcaataccgggagctgaagccccagacctgtacgatctgcgaaacaaccccagtaaatgcaattgatgctgagatgcacgacttaaactgcagttataacatctgtccgtactgcgcctctcgccctacttccgatggcctggctagacatgtgatgcagtgtcccaaaaggaaggaaaagattgaggagaccgccctttacttgaatctcgaacgtatcccatgggttgtccggaagctgctacaggtgagcgagtcgacaggggtggcactgaaacgatcatcttggctcgtcgttctgcttgtgttgctgactgtgagtttatcccccgtacaaagcgcccctataggacacggcaagaccgtcgaaacatatcagacgagagagggttacacctctatttgcctcttcgtgctggggagcatcctttttattgtttcctgtctgatgaaaggcttggtggactcagtcggaaacagtttctttccaggcctcagcatctgcaagacttgttctatagggtccgtgaatggattcgaaatcgagtcacacaagtgctattgtagtctgttttgctgtccctactgcaggcattgcagcgctgatcgcgagattcaccggctacatctgtccatctgtaaaaagagaaaaacaggctctaacgttatgctcgcggtgtgcaagaggatgtgtttccgcgcaaccgtagaagtctcgaataaagccctgcttattcgaaacatcataaatactacattcgtgttgtgcattctgatcttagctgtgtgtgtcgttagcacctcagccgtggagatggaatccctccctgcaggtacgtgggagcgggaagaggacctgactaacttttgccaccaggagtgtcaagtaaccgaaacagagtgcctttgtccgtatgaagccctggtgctacgtaagccactcttcagtgattctatcgtcaaggggatgaaaaatctgttgaacagcacctccctggagacttcattatctattgaggctccctggggagccatcaatgtgcagagcacatttaagcctaccgttagtgcagcgaacattgctctctcctggagctctgtggaacacagaggcaataaaatactggtctcaggtaggtccgagagtatcatgaaacttgaggaacgcacaggcattagctgggacctgggggtggaagatgcctcggagtctaaattgctcactgtttccgtgatggacctgagccagatgtactcaccagtcttcgagtatctaagtggagatcggcaggtagaagagtggcccaaggcaacctgcacgggcgactgtcctgaaagatgcgggtgcacatcttccacctgtctgcataaggagtggccgcacagcaggaactggcgatgcaatcccacttggtgttggggagtgggcaccggttgcacatgttgcgggcttgatgttaaagacctctttactgactacatgttcatcaagtggaaagtggaatacattaagaccgaggccatcgtctgtgtggagctgacgtcacaagaacgccagtgcacattgatagaggctggaacccggtttaacctgggcccagtaactatcacattaagtgaacctagaaacattcagcagaaactgcccccagagatcgtgaccctccatcctaggattgaagagggtttctttgatcttatgcacgtccaaaaggttctgagcgcctccactgtgtgtaagttgcagtcttgcacacatggcgtgcccggggacctccaggtctatcacatcggaaatctgctaaaaggcgataaggtgaacgggcacctgatacataaaattgagccacacttcaataccagctggatgtcctgggacggatgtgatcttcattactattgcaacatgggcgactggccgtcatgcacgtacactggtgttacccagcacaatcatgcagcttttgtaaacatgctcaatatcgaaacagattataccaagaacttccactttcactctaaacgtgtgacagcccatggggacactcctcaactggatttgaaggcgcgccccacctacggagccggcgagatcacggtcttagtggaagttgctgacatggagctgcacaccaaaaagattgagataagtggtctcaagttcgcatcgctgacttgtaccggctgctatgcctgtagctccgggatctcttgcaaagtgcggattcatgtcgatgaaccagacgagcttacagtgcacgtaaagtcagaagatcccgacatcgtcgctgccagctccagtctgatggcaagaaaattggagttcggaaccgactctacttttaaggcgttcagcgccatgcctaaaacctcactatgtttttacattgtggaaagggagtactgcgagtcctgtagtaaggaagatacacagaagtgcgttaatacgaaactggagcagccacaaagcatcctcatagaacacaagggcactatcattgggaaacagtctaacacctgtacagctaaggcctcctgctggctggagtcagtgaaaagtttcttttatggacttaagaatatgttatcgggcatcttcggtaacgtctttattggggtgttcctgtttttcgcaccctttatcctcttgatactgttcttcatgtttggatggcggattctcttctgttttaagtgctgccgacgcaccagaggcctgttcaaatacaggcatcttaaggacgatgaagagactggctatcggaaaatcatcgagcgactgaataacaagaaagggaagaataagttgctagacggagaaagactggctgatcgcaaaattgccgagctcttttctacaaagacccacatcggttga

SEQ ID NO: 10285 - RNA, 5070 nt, synthetic construct
  misc_feature 1..5070: note = derived and/or modified CDS sequence (opt3) from CCHFV(BA66019)__AF350448.1__GP
  source 1..5070: mol_type = other RNA
atgcccgccaacatcatgtacaccctgctcgtgtgcgctgtcctttgtcctcagctgtggagcttggagggcacacacgttccacataatgaaactaagcacaacgggacgggaattaccgcagccccgggtgagtcccaaggccccatgtctcctgcgtcaacagctgtgccattaactcccgaacctccaaataccaaacccgccgcaagtgccagcgagctggaatcctctggggagggacatacatcgctactcgctaccactcagggcctgacatcacctgaggcaaccccagaacttccgacgactaccgacacaggtgtaagcagtacttccgtggtcgatatagggacccagatggccaaggacacacccacctctacggctcacactagcctgccttccaacccatcagcccccagtacagcgcagggaacccatcacactatcagaggcttgctcagcgtgacatctaccaaacctgaggaagcatccacgccaaccgatcccggcaaggccggggctgagacaggatcaccgaggcctgccattagccggaaacccactctgagtccaaccgcagaggctcctacagaaatcaataactcttccactcccaagcaaccagagcccagcattcagcctgccaccccatcgctggttatctctccggcgcagcccgccttccctcagtccgcaacatcaaccgctgcccaagacatatatagtagcccaactaatcgctccaagcgaaacctcaaaatggaaatcattttaacgctgtctcagggtcttaagaaatactatggcaagatccagaaaacattggggctgaccctagaggaagatactgagggactcctggagtggtgcaagcgtaatcttggcctgacctgtgacgataactttttccagaagagaattgaagagtttttcttgacaggtgaagggtactttaatgaggtgctccaattcaaaacccccagcactcctggatcaacagaaccaacgcacgctgaggcccccaccgtcaagccgtttaaaagttatttcgcaaggggctttctgactatcaactccggctacttcagcgccaagtgctattcttggacatcaaatagtgggttacagctgataaacgtgacccagcatcctgctcggattgcggacacaccaggacccaaaatcactaatctcaagaccattaactgtatcaaccttaaagcaagcgtatttaaggagcaccgcgaaatcgagattaatgttctgttgcctcaagtggccgtcaacctatccaattgccatgtgctgataaagtctcacgtgtgtgattactcgctcgacatcgatggtacgattagactgcccaggatctaccacgaaggcaccttcataccagggacatataaaattgtcatcgacaagcgggataaacagaacgaccgctgcactcttgttaccaattgtgtgatcaagggacgagaggtaagaaaaggccagagcgctctgaggcagtaccggacagaaattcgtatcggtaaggcctccgcagggtcacgcagattgctcagtgaggagtctggcgacgattgcattagcaggactcaactgttacggaccgaaacggccgaggtgcatggagacaactatggcgggcctggagataagataacaatctgtaatggttccaccattgtcgaccagcgactgggctcagaactagggtgctacactatcaaccgcgtgaaatcttttaagctctgcgagaatagcggaacaggcaaatcctgtaagatcgataaacaccccgttaagtgcagacagggtttctgtctgaagattacccaggaggggaggggccatgtgaaacttagtcggggaagcgaagtcgtgttggacgcttgcgattcttcctgtgagataatgatcccaaagggcactggggacattctggtagattgctcaggaggtcaacagcacttcctcaaagacaacctggttgatcttggctgtccgaatatccctctgttggggaagatggccatttatatctgccgcatgagtaaccatcccaaaaccacaatggcatttctcttctggtttagcttcggatacgtgataacgtgtatcttttgcaagattatcttctatctgttaattgtcgtgggcaccctgggtaagaaatttaagcagtacagagaactaaaaccacagacttgtacaatctgcgagaccacacccactaatgcgatagacgctgaaatgcacgacctcaagtgctcgtacaacatttgtccttattgcgcctccaggctgacctctgatgggcttgcacgtcacgtcacgcaatgtccaaaacggaaggagaaagtggaggaaacagagttgtacctgaatctcgaacgaatcccctggattgttagaaagctgttacaggtgagcgagtcaaccggcgtagccctgaagaggagttcctggcttatcgtcttgctcgtgctgctaactgtttctctgagccctgtgcagtccgctccgataggacatggcaaaaccatcgaagcctatcagacacgcgaggggtacacttcagtctgcctcttcatgctgggaggcattctttttgtggtaagctgtttgatgaagggtctggtggacagtgtttctaactccttctttccagggttaagcatctgcaaaacctgttcgattggatcagtcaacggcttcgagatcgaatctcacaagtgctattgtagtctcctgtgctgtctttactgccggcattgctccgcagatagagagatacaccaactgcacttgagcatttgtaaaaagaggcgcgctggtggcaatgtgatgctcgccgtgtgcaagcgaatgtgtctgcgggcgacaatggaagtctctaacaaagttctatttatccgtagcatcattaatacgaccttcgtgatctgcattctggtgctcgccgtatgtatagtctccacttcagctgtggagatggaaagtctgcccgcagggacatgggagagagaggaagaccttaccaacttctgccatcaggagtgtcaggttactgaaacagagtgcttgtgtccttatgaggccctggtgttaaggaagccactctttagcgattctatcgtcaaaggaatgaagaatctgcttaactccacctcactggaaacgagtctaagcattgaggctccctggggcgccatcaatgtgcaatccactttcaaacctaccgtttctacagcaaacattgcgctctcgtggagctcagtggaacaccgcgggaataagatcctggtatccggacggagtgagtctataatgaagttggaagagagaaccggcatcagctgggacctgggtgtcgaggatgcctccgaatcaaaattactcactgtgtctgtgatggacctgagccagatgtacagtccggtctttgagtacctttccggggataggcaggttgaagagtggcccaaggctacatgcaccggagactgtccagatcgatgcggctgcacaagctctacttgtctgcataaagaatggcctcactcacgcaactggcggtgcaatcccacctggtgttggggtgtgggcacggggtgcacatgttgcggattggacgtaaaggatctcttcaccgactatatgtttgtgaaatggaaggtcgagtacattaagactgaggccatcgtgtgtgttgaactgaactcccaggagagacaatgcagtctaattgaagcaggcaccaggttcaatctggggccagtgacaatcactcttagcgagcctcgtaacatacagcagaaactacccccagaaattatcaccctgcatccgcgcatcgaggagggatttttcgacttgatgcacgtccagaaggtgctgtcggcttctacggtttgtaaattacaatcctgcacacacggcgtgcctggtgatctccagatttatcatatagggaatctgcttaagggagaccgggtcaacggccacctgatccataaaattgaaccccactttaacaccagctggatgtcatgggatggttgtgacttggattactattgcaatatgggcgactggccaagttgcacttacacaggggtaacccagcataaccacgccgcattcgtgaatctcctgaacatcgagactgattatacaaagaattttcacttccattctaaaagagttaccgcccacggagacacgccccagctagatctgaaggctaggcctacttacggcgcgggggaaattaccgtgcttgtcgaggtggccgacatggagctccatacaaagaaaatcgcaatatccggactgaagtttgctagcttgacctgtacaggctgctacgcctgttcaagtggtatcagctgcaaagtacggattcacgtggatgaaccagacgagttaactgtccacgttaagtccgaagatcccgacatcgtggccgcttctagctccctgatggcacgaaaactcgagttcgggaccgactcaacgttcaaggccttttctgcgatgcctaagacaagtctgtgtttctatattgtggaacgcgagtactgcgagtcgtgtagcaaagaagatactcaaaagtgcgtcaacaccaaacttgagcagccgcagtccatcctgatagaacataagggaacaattatcggcaaacaaaatgacacctgtactgctaaggcctcttgctggttggagtcagttaagagctttttctatggcctcaaaaacatgctgtccgggatctttggaaatgtgttcattggtatctttctcttcctggcaccatttatacttttaattctgttctttatgttcggctggagaatcctcttctgttttaagtgctgcaggcggacccgagggttgttcaaatacagatatctgaaggatgacgaagagagtggataccgcaggattatcgagcgtctcaacaataaaaagggcaagaacaaactgcttgatggtgaacggctggccgacagaaggatagctgagttgttttctacaaagacgcacattgggtga

SEQ ID NO: 10286 - RNA, 5070 nt, synthetic construct
  misc_feature 1..5070: note = derived and/or modified CDS sequence (opt3) from CCHFV(BA88166)__AF338470.1__GP
  source 1..5070: mol_type = other RNA
atgagcttctccgtgatgtacactcccctgctctgcgccgtcctttgtctgcagttgtggtctttagagggctcacacgggctgagtaacaagacacaacatagcaatacttccacgaccaaagctcctgaagtttctcaggagctaggactcccagtgtcgacagtatcaactatcaccagcgacccgcccagtattacatccgcagtgtctgtcagcggttccgaaggctcaggggataccaacaccagtcctagcgtgacaacccagggaccaacgctgcccgagactacccttgaacctctgacaactaccgacacagatgcctcttccaccgttgtggtcgacgtgtcaacgcagactgtaaaggatacaccaataagcaccacttatacaagtttgccctctaccccttccgagccaacgaccccgcaaggcacacaccatactgcgagaggtctcctgagcgttacctcgacaaaacccgaggaggcttctactcaggccaatcctgggaagatctccatggagaccaactcaccaaggctggcaattagtgaaacacccagcttttcccctaccactcaggccccaacggaaaattctaaccccatcacaagcaaacagctcatgttatcagctcaaccggtgacccctaatcccatgaccagtccagtccagcctgcactgtcccagagcgacacttctacagccattcaggatatccacccctcaccaaccggacggagtaagcgcaaccttgagatggaaataatcttgactctgagccaaggcctaaagaaatactatggcaagattctcaaactgcttgacctgacattggaggaagatacggaggggctcctggaatggtgcaagcgaaatttaggactggtgtgtgacgataacttctttcagaaacgtatcgaggagttctttctcaccggtaagggccatttcaatgaagtgcttcagtttaagactccctccacactgtctcctaccgggccagctagaacaggatcgccgactgtcgagcccttcaaaagctactttgccaagggcttcttgtccatggactcaggttattttagtgcgaaatgctaccctagggcatctaacagcgggctacaactgattaatgttacccagcactccacgcggatcaccgatacaccaggacccaagataactaacctcaaaaccattaattgtatcaacctgaaggcctcagtgttcaaagaacaccgcgagattgaaatcaacgtacttctgcctcaggtggctgtcaatttgagctcttgccatgtgctcatcaagtcccacgtttgtgactatagtctggacattgatggcccagtgagattacccaggatacatcacgagggcacatttatcccggggacttacaagattgtcatcgacaaaaagaacaaacagaatgatcggtgcaccctggtgacgaactgtgtaataaagggacgcgagattcgaaaaggtcaaagcgttctaagacagtacaggacagaaatcaagatcggcaaggcctcttccgggtcacggcgtctcctgagtgaggaaagcggagacgattgcatttcgcgcacccagcttttgagaactgagacagcagaaatccactccgacaattatggcggtcctggggataaaattaccatatgtaacggctctactgtggtcgaccagaggctgggaagcgagctcggctgctacaccatcaatcgggtgaagtcattcaaactgtgcgagaacagtgctacagggaagtcctgtgaaattgattctacgccagtcaaatgccgacaaggattctgtcttaagatcacccaggagggtcgcggccatgtgaagctgagcagagggtccgaagttgtgttggacgcctgcgattcaagctgtgagatcatgattcccaaaggaactggcgacatactcgtagactgcagtggtgggcagcagcactttctgaaggataatttaatcgacctgggctgtcctaacattcccctactcggaaaaatggcgatctatatttgcaggatgtctaatcatccaaagacaaccatgggcttcctgttttggttctcctttgggtacgtcgtgacatgtatcctttgcaaaggaatattctatttgctgatcgttgtgggtactctcggcaagaagtttaaacaataccgggagctgaagcctcagacctgtacgatttgcgaaacaacccccgtcaacgccatcgatgcagagatgcacgacttaaattgcagctataacatttgtccatactgcgcttcgcgcctgacttcagatgggcttgccagacatgtgatgcagtgtccgaaaaggaaggaaaagatcgaggaaaccgagttgtacctcaatctggagcgtataccttgggtagtgcggaagctactgcaggtttctgaaagtacaggagtcgctctcaaacgatccagctggctggtggtgcttttggtcctgttaactgtttctctcagccccgtgcaatccgccccaattggccacggtaagaccgtggagacatatcagacgagagaagggtacacctcaatctgcctgttcgtacttggcagtattctgtttatcgtcagctgtttgatgaagggactcgtggactctgttggcaactccttctttcccgggctgtcaatatgcaaaacttgtagtatcggaagcgtgaacggcttcgagattgaatcccacaagtgctattgttctctattttgctgtccttactgcaggcattgctcggcagatcgcgagatccaccggctgcatctcagcatttgtaaaaagagaaaaacatggtcaaatgtcatgctggccgtgtgcaagaggatgtgtttccgcgctaccgttgaggtgtccaacaaggcgcttttgatccgaaatataattaacactacattcgtactgtgcatcttaatcctcgcagtctgtgtggtgagtacctctgccgtcgaaatggagagcctgccagctggtacgtgggaacgggaggaagaccttactaatttttgccaccaggagtgtcaagttaccgagacagaatgcctgtgtccctatgaggccctagtgctccgtaaacctctgtacttggattccattgtaaaggggatgaaaaacctgttaaattcaacctctctcgaaactagcctgagtatcgaggcaccgtggggagccattaacgtgcagtccacattcaagccaaccatgagcgctgccaatatagcactttcttggtcatccgtcgagcacagaggcaacaaaatcctggtgagtggtaggagcgaatcgattatgaagttggaggaacgcacaggcatctcttggaatctcggggttgaggacgcgtccgaaagcaagctgctaactgtgtcagtcatggatctgagtcagatgtattctcccgtgtttgagtacctttccggagaccggcaggttgaggaatggcctaaagctacctgcacgggcgattgtccagagagatgcgggtgcacaagctcaacctgtctccataaggaatggccccacagtaggaactggcgatgcaatcctacttggtgttggggagtgggcaccggttgcacatgttgcgggctggacgtcaaagacttgttcactgattacatgtttattaagtggaaagtagagtatatcaagaccgaagccatagtgtgtgttgagctgacgagccaagagcgccagtgcacattaatcgaagcaggaacccggttcaacctcggcccggtgattatcactctgtccgagcccagaaatattcagcagaaacttccacctgaaatcgtcacactgcatcccaggatagaggaaggctttttcgacttgatgcacgtgcaaaaagtactctctgccagcaccgtgtgtaagctgcagtcctgcactcatggtgtcccaggggatctacaggtttaccacattggaaacctgcttaaaggcgacaaggtgaacgggcacctcatccataaaatcgagcctcactttaatacatcatggatgtcttgggatggatgtgacctggattattactgcaacatgggcgactggcccagttgcacctatacgggtgtgactcagcataatcacgctgccttcgtcaacatgttgaatattgagaccgattacacaaagaactttcatttccactcgaaacgtgtgaccgcacacggggacacaccacaattagatctgaaggctcgcccgacttatggagccggcgaaataaccgttctcgtagaggtggcggacatggaactgcatacgaagaaaatcgagattagcggtcttaagtttgcctccctgacatgtactggctgctacgcttgttcttcagggatcagctgcaaagtccggattcacgtggatgagcctgacgaattgaccgttcatgtgaagtccgaggaccccgatatcgtcgcagccagttctagcctaatggctagaaaactggagttcggaacagactcaaccttcaaggccttttccgcaatgccaaagaccagtctctgtttctacatagtggaaagggaatattgcaaaagctgttctaaggaggatactcagaaatgcgtaaatacaaagctggagcagccccaatccatccttattgaacacaaaggcacgatcattgggaagcagaacaatacttgtaccgcgaaggcctcatgctggttagagagcgtcaaatcgtttttctacggactgaagaacatgctctctggcatctttggtaatgtgttcataggggtttttcttttctttgctcctttcattctgctcatcctgtttttcatgttcggatggcgaatcttgttttgtttcaaatgctgccggcgcacaagaggcctgtttaagtataggcacttgaaagacgatgaagagaccggctaccggaagattatcgaacgactaaacaataagaaagggaagaacaaactgctcgacggagagagattagccgatcgcaagatagcagagctgttcagtactaaaacacatattggttga

SEQ ID NO: 10287 - RNA, 5070 nt, synthetic construct
  misc_feature 1..5070: note = derived and/or modified CDS sequence (opt3) from CCHFV(UCCR4459)__KY484032.1__GP
  source 1..5070: mol_type = other RNA
atgagcttctccatcatgtacactcccctgctctgcgccgtgctttgtctgcagttgtggtctttagagggctcacacgggctgagtaacaagacacaacatagcaatacttccacgaccaaagctcctgaagtctctcaggagtttggactaccagtttcgacagtgtcaactattaccagcgacccgcccagtataacatccgcagtatctgtgagcggttccgaaggctcaggggataccaacacttcacctagcgtcacaacccagggactcacgctgccagagactacccttgaactgttgacaactaccgacacagatgcctcttccaccgtggttgtggacgtctcaacgcagactgtgaaggatacacccatcagcaccactcacacaagtctcccttctaccccatccgcgacgaccacaccccaaggcactcatcacaccgctagaggtctgctgagcgtaacatcgactaaacctgagggggcctctacccaggcaaatccagagaagatttccatggaaacaaactcaccgaggctcgccatcagtgagacccccagcttctcccctactacgcaggctccaacagaaaattctaaccccattaccagcaaacagttaatcttttcagcacaacctgttactccaaatcccgtgaccccgcctgtccagcccgccctgagtcagtccgacacaagcaccgctatacaggatatccatccatctcctacttcacggagtaagcgcaaccttgagatggagattatcttgacactgagccaaggactaaagaaatattacggcaagattctcaaactgcttgacctgacgttggaagaggataccgaaggcctcctggagtggtgcaagcgaaatttagggctggtgtgtgacgatgacttctttcagaaacgtatcgaagagttctttctcactggagagggtcacttcaacgaagtgcttcagtttaagacaccctccaccctgtctccaacaggccccgccagaactgggtcgcctaccgtcgagccattcaagagctattttgcgaaaggattcttgtccatggattcaggctactttagtgcaaagtgctatccgagggcctctaatagcggtctacaactgataaacgttacgcagcactccacccggattacagacactcccgggcctaaagtgaccaatctcaagacaatcaactgtattaatctgaaagctagtgtattcaaggaacatcgcgagatcgaaatcaacgtgcttctgccacaggtcgccgtgaacttgagctcttgccacgttctcattaaatcccatgtgtgtgactacagtctggatatagacggacccgtcagattacctaggatccaccacgagggcactttcattccaggcacctataagctggtgatcgataagaaaaataagcagaacgaccggtgcacgctaataacaaattgtgtaattaaagggcgcgagatccgaaagggacaaagcgttctcagacagtacaggaccgaaatcaaaattggtaaggcatcttccggctcacggcgtctgcttagtgaggaaagcggggatgactgcatctcgcgcactcagttgtccagaacagagaccgctgaaattcattctgataactacggaggccccggtgacaagataactatctgtaatgggagcaccattgtggatcagaggctgggctcagagctcggatgctatacaatcaaccgggtcaaaagttttaagctgtgcgaaaattccgccacgggcaaatcttgtgaaatcgacagcaccccgattaagtgccgacaagggttctgtcttaaaataactcaggagggacgcggtcacgtgaagctgtccagaggctcagaagtcgtgttggatgcgtgcgacagcagttgtgagatcatgattcctaaggggacaggagacatcctcgttgattgctctggcggtcagcagcattttctgaaagacaacttaattgatctggggtgtccaaatatccccctactcggcaagatggccatatacatctgcaggatgtccaaccaccctaaaaccacaatggcattcctgttttggttcagctttggatatgtgattacttgtatcctttgcaaggtaattttctacttgctgatcgtcgtgggcaccctcgggaaaaagtttaagcaatatcgggagctgaaaccccagacgtgtacaatatgcgaaaccactccagttaatgctattgacgccgagatgcatgatttaaactgctcgtacaatatctgtccttattgcgcttcacgcctgacctctgacggacttgccagacacgtgatgcagtgtcccaagaggaaagaaaaggtcgaggaaacagagttgtacctcaacctggagcgtattccatgggtggtacggaaactacttcaggtgagtgaatccactggtgttgcactcaagcgaagctcttggctggtcgtgcttttggtgctgttaaccgtcagcctctccccggttcaatcagcccctatcggccacgggaaaacagtggagacgtaccagaccagagaaggatataccagtatatgcctgttcgtgcttggcagcatcctgtttattgtatcttgtttgatgaagggtctcgtcgattccgtgggcaattcattctttcccgggctgagtatctgcaagacatgtagcattggatccatcaacggcttcgagatagaatctcataaatgctactgttcgctattctgctgtccatattgcaggcactgcagcgctgaccgcgagattcataagctgcacctctcaatctgtaaaaagcggaaaaccgggtccaacgttatgctggcggtgtgcaagagaatgtgttttagggcaactgtcgaggtgagtaataaggcccttttgatccgcaacattatcaatacaaccttcgttgtgtgcattctgatattagctgtatgtgtcgtgtctacgagcgccgtggaaatggagtccctccccgcaggaacttgggaacgagaggaagatctgaccaacttttgccaccaggagtgtcaagtcacagagaccgaatgcctttgtccttacgaggccctggttctacggaaaccactcttctcagactctatcgtgaagggcatgaaaaatctgttgaacagcacaagtctggaaacttccttaagcattgaggctccctggggtgccatcaatgtacagtctacctttaagcctacagtgtcagcagcgaacattgctctctcctggagtagcgtcgagcatcgtgggaataaaatcctggtgtcgggaagatctgaatccataatgaagctggaggaaaggactggcatcagctgggatctgggtgttgaggacgcctcagaaagtaagttgctcaccgtgtctattatggatctgtcccagatgtatagcccggtcttcgagtacctatcaggcgaccgccaggtggaggaatggccaaaagcaacgtgcacaggggactgtcccgagcggtgcggatgcaccagtagcacttgtctgcacaaggaatggcctcattccagaaactggaggtgcaatccaacctggtgttggggcgttgggacaggatgcacttgttgcggccttgatgtgaaagacctctttaccgattatatgttcgtcaagtggaaagtagagtacatcaagacggaagccattgtgtgtgttgagctgacatctcaagagcgacagtgcagcttgatcgaagctggtacccgctttaacctggggcccgtgactataacattatccgagcctcggaatattcagcagaagctcccgcccgaaatcgtcaccctgcacccaagaatcgaggaaggattctttgaccttatgcatgtgaaaaaggtactgtcagcctctactgtgtgtaaattgcaaagttgcacacacggcgtccctggtgatctccaggtttaccacattggcaacctgctaaagggggacaaagtgaatggacatctgatacacaagatcgagccccatttcaacacctcgtggatgagctgggatggctgtgaccttgattattactgcaacatgggggactggccatcctgctcttatacgggagtgactcagcacaatcatgcagcttttgtcaacatgctcaatattgagaccgattacacaaaaatcttccacttccactcaaagagggtgaccgcccatggcgacacacctcagctggatttgaaggcgcgtcccacttatggtgccggggaaattaccgttttagtagaggtggctgacatggaactgcacacgaaaaagatcgagataagcggactcaaatttgcatccctgacatgtactggctgctacgcctgtagttctggtatcagctgcaaggtccgcattcatgtggacgagccagatgaacttaccgttcacgtgaaatcagaggacccggatatcgtcgctgcctccagtagcctgatggcacggaagttggagttcggcacagactctacctttaaggcgttctccgccatgcctaaaacttcactatgtttttatattgtggagagagaatactgcaagagctgttcgaaagaggatacccaaaagtgcgtaaacacaaaactggagcagccccagtctatcctcatagaacacaaggggacgattatcggaaagcaaaatgacacttgtaccagtaaagctggctgctggctggagtccgtcaagagcttcttttacgggcttaaaaacatgttatcaggaatcttcggcaatgtgtttattggtatcttcctgtttctcgccccattcatattgctgattctcttctttatgttcgggtggaggatcctgttttgtttcaagtgctgccgacggacacgcggactttttaaatatagacatctgaaggatgacgaagagaccggctacaggaagattatcgaacggttgaacaataaaaagggcaaaaacaagctactggatggggagcgactcgcagacagaaaaatagctgagttattctccactaagacacacattggatga

SEQ ID NO: 10288 - RNA, 5070 nt, synthetic construct
  misc_feature 1..5070: note = derived and/or modified CDS sequence (opt3) from CCHFV(K168_125)__KX013460.1__GP
  source 1..5070: mol_type = other RNA
atgcccatcagcaccatgcacatttccctgatgtgcgccgtgctctgtcttcagctgtacggcctcgggggaacacatggtttacacaacggcactgagcataataagacgaacgctgtcaccacatcttcaaatagtcaaagctccgaatctcctgcaagaactgccccaccggttacccccgactcgcctacagtgaccccaactacacccgcgtcagctcctgaggggagcggagaagcccacagttccccacccaacaataccgagggcccttctctgccagaaagcacgtccgagccgcccgcagccacttcaaccggtatacctagtgctagcgatgtaaactcttccacacaggcagccagggacacttcaaccccaacagtgcggaccagtccccctaatagcccatctacgcccccgactcctcaggagacacatcaccccgtccgcaacctactctccgtgaccagccacaaaccagaagagacttcggctccttctgaatccgggaaggagtcacccgccgcgaatagtccacatcccgttgcaagccgacctccaacaccgtccaccacggcccagggacccaccgagaacaataactataatacaactggccaactggaatctcttacccagagcacaactctgggccctatgacctcattgacacagaccgatctcccacagagtgtgacttccatcgctgtccaagacacgcaccccagccctacaaaccgttctaaaagaaatctggagatggaaattatcctgaccctcccacaggggttaaagaaatactatggaaaggtgctgaggcttttgcagctgactctagaggaagataccgagggtctcctggagtggtgcaagcggaaccttggcctggactgtgatgacacattctttcagaaacgcattgaagagttctttatcaccggggaaggacatttcaacgaggtattgcaatttagaactcccggcacactctcaacgaccgaaagtactcacgccggtctgccgacagcagagcctttcaagagctactttgctaaagggttcttatccatagattctggatatttttcggccaagtgctacagcaggacctccaattcaggcctgcagctcatcaacgttacacggcacagtactcgcattgcggacaccccaggccttaaaatcacgaatctgaagaccatttcttgtatcaacttgaaggccagcgtgttcaaagagcatcgagaagtcgagataaatgtgctactgccccaggtggcagtcaacctctccaattgccacgttacaattaagtcacatgtgtgtgattatagcctggacatcgatgggactgtaagacttcctcacattcatcacgacggaacctttatccccggtacatacaaaatcgtgattgacaggaagaacaaactgaatgatcggtgcactttgttcaccaactgtgtcataaagggccgtgaagtgcgcaaagggcaatctgttctcagacagtacaagacggagatcaggattggaaaggcttccacaggcagtcggcgactgttaagcgacgaatctggtgatgactgcatctcccgcacccagctgctaagaactgagacagccgagatacacggggataattatggcggaccaggcgacaaaattaccatctgtaacgggtcaactatcgtggatcagaggctcggaagtgaactgggttgctacaccattaatcgggtcaagagctttaaactttgcgagaactcggctacaggcaagtcctgtgaagtggactctatccctgtaaaatgccgccaagggtattgtttgaagattacgcaggagggaagaggccatgttaagctgagcaggggttcagaggtggtcctcgatgcctgcgacagttcctgtgaagtgatgatacccaaagggaccggcgatatcctggtcgactgctctggaggccagcagcacttccttaaggacaatctgattgatttggggtgtccaaaagtgccgctcctgggaaagatggcaatctacatctgccgtatgagcaaccatcctaaaactacaatggccttcttattttggttctcctttggttatgttattacctgtatagtgtgcaaggctatcttctacctgctaattatcgtaggcacactcgggaagcggtttaaacaatatcgagagctgaagccccagacttgtaccatttgcgaaacgacaccaaccaacgcgatcgacgcagagatgcacgatcttaattgctcatacaacatatgtccctactgcgccagcagattgaccagtgacggactggctaggcacgtcacccattgtcctaaacgcaaggaaaaagtggaggagacagaactctatctgaatttagagcggatcccatgggttgtgagaaagctgcttcaggtctctgaatccactggcgtggccttgaagaggagctcgtggctcattgtactgctagtgctgttcgcagtttcactctctcccgtccagagtgcccctatcggtcacgggaaaaccattgagacataccaagtgcgcgaagagtatacgtccatctgcctgtttgtgcttggcagcatattgttcattgtctcttgtctgatgaagggattagttaacagcgtgggcaatatctttttcccggggctctccatttgcaaaacctgttcaatcggaagtataaacggctttgagatcgaaagccataagtgctactgttctctgctttgctgtccatattgccgacactgctccgctgatcgggagattcatcagctgcacttgtcaatctgtaaaaagcgtaaaactggtagtaatgtgatgctcgccgtatgcaagagaatgtgtttcagggcaacagtcgaagtgagcaacaaggcgctgtccattcgctctatcataaataccacttttgttgtgtgcattctaatcctggctgtctgtgtggtttcgacaagcgccgtggagatggaatcactccccgcagggacctgggagcgggaggaagacctgacgaacttctgccaccaggagtgtcaggtaactgaaaccgagtgcctttgtccttacgaggccttggtcctgagaaggccattattcctcgattccatcgtgaaaggaaagaaaaatctgcttaacagtacatctctggaaaccagcctatccattgaggctccctggggcgccatcaatgtgcaatcaacttataagcctacagtctctgcagctaacattgccctcagctggagttccgttgaacatcgaggtaataaaatactggtgagcggccgctctgagtcaatcatgaagttggaagaacggaccgggatttcctgggacctgggagtagaggatgcgagtgaaagcaagttactcacagtgtcggtcatggacctgtctcagatgtactccccggtgtttgagtaccttagcggcgatagacaggttgaagagtggcccaaagccacttgcaccggggactgtccagaaaggtgcggatgcacgtcaagtacatgtctgcacaaggagtggcctcattctcgtaactggcgctgcaaccccacctggtgttggggcgtgggtactgggtgcacctgttgcggattggatgtcaaagacctcttcacagactatatgtttgtgaagtggaaagttgagtacatcaagactgaagctattgtgtgtgtcgagctgacctcccaagaacggcagtgcagcctaatcgaggcaggcacgagattcaatctgggtccagtaacaataaccctttcagaacctaggaacatccagcagaagttgcccccagagattatcactctgcacccgcgaattgaggaaggctttttcgatttgatgcatgtgcaaaaagttctgagtgccagcacagtgtgtaagttacagtcctgcacccacggggtccctggagacctccaggtgtatcacatcggcaatctgcttaaaggggataaggtaaacggacatctgatacacaaaattgagccccattttaatacttcttggatgagctgggacggctgtgatttggactactattgcaacatgggtgattggccatcctgcacatacaccggggtgacgcagcacaatcacgcttcattcatcaacctcctgaatatcgaaactgactataccaagtcttttcatttccacagtaagcgggtcacagcccatggagatactccccaactagacctgaaagcacgccctaactacggcgcgggtgagattacagttcttgtggaggtggccgatatggaactccacactaagaaaatagagatctcgggcctgaagtttgctagcttgacctgtacggggtgctacgcctgttcctctggaatttcatgcaaagtcagaatccatgtggacgaaccagatgagttaacagttcacgtaaagagcgacgaccccgatgtggtcgcagcttccagttctctgatggccaggaaactcgagttcggcactgacagcacctttaaggcattctcagccatgcctaagacatccctgtgtttctatattgtggagcgggagtactgcaaaagttgtagcaaggaagatacccagaaatgcgttaatactaaacttgagcacccgcagtctatcctgatagaacataaggggaccatcattggaaagcagaacaatacatgtacggctaagacttcctgctggttggagtcagtgaaatcgtttttctatggcctaaagaacatgctgagcggtatctttgggaatgtcttcgtgggaatttttctcttcctggcgccatttatccttttaatactgttctttatgttcggctggcgaatcctcttttgtttcaaatgctgcagacgcaccaggggcttgttccgttacaagcacctggaagacgatgaggagacagggtatcggagaattatcgaaaggctcaacaacaaaaagggaaagaataaactgcttgacggtgagcgcctggccgatcgaagaattgcagaattgttttctaccaagactcatatcggctga

SEQ ID NO: 10289 - RNA, 5070 nt, synthetic construct
  misc_feature 1..5070: note = derived and/or modified CDS sequence (opt3) from CCHFV(K168_40)__KX013457.1__GP
  source 1..5070: mol_type = other RNA
atgcccatcagcaccatgcacatttccctgatgtgcgccgtgctctgtcttcagctgtacggcttgggagggacacatggtttacacaacggcactgagcataataagacgaacgctgtcaccacatcttcaaatagtcaaagctccgaatctcctgcaagaactgccccaccggttacccccgactcgcctacagtgaccccaactacacccgcgtcagctcctgaggggagcggagaagcccacagttccccacccaacaataccgagggcccttctctgccagaaagcacgtccgagccgcccgcagccacttcaaccggtatacctagtgctagcgatgtaaactcttccacacaggcagccagggacacttcaaccccaacagtgcggaccagtccccctaatagtccatctacgcccccgactcctcaggagacacatcaccccgtccgcaacctactctccgtgaccagccacaaaccagaagagacttcggctccttctgaatccgggaaggagtcacccgccgcgaatagtccacatcccgttgcaagccgacctccaacaccgtccaccacggcccagggacccaccgagaacaataactataatacaactggccaactggaatctcttacccagagcacaactctgggccctatgacctcattgacacagaccgatctcccacagagtgtgacttccatcgctgtccaagacacgcaccccagccctacaaaccgttctaaaagaaatctggagatggaaattatcctgaccctcccacaggggttaaagaaatactatggaaaggtgctgaggcttttgcagctgactctagaggaagataccgagggtctcctggagtggtgcaagcggaaccttggcctggactgtgatgacacattctttcagaaacgcattgaagagttctttatcaccggggaaggacatttcaacgaggtattgcaatttagaactcccggcacactctcaacgaccgaaagtactcacgccggtctgccgacagcagagcctttcaagagctactttgctaaagggttcttatccatagattctggatatttttcggccaagtgctacagcaggacctccaattcaggcctgcagctcatcaacgttacacggcacagtactcgcattgcggacaccccaggccccaaaatcacgaatcttaagaccatttcttgtatcaacctgaaggccagcgtgttcaaagagcatcgagaagtcgagataaatgtgttgctacctcaggtggcagtcaacctgtccaattgccacgttacaattaagtcacatgtgtgtgattatagcctcgacatcgatgggactgtaagactgccccacattcatcacgacggaacctttatcccaggtacatacaaaatcgtgattgacaggaagaacaaacttaatgatcggtgcactctgttcaccaactgtgtcataaagggccgtgaagtgcgcaaagggcaatctgttttgagacagtacaagacggagatcaggattggaaaggcttccacaggcagtcggcgactcctgagcgacgaatctggtgatgactgcatctcccgcacccagttactgagaactgagacagccgagatacacggggataattatggcggacctggcgacaaaattaccatctgtaacgggtcaactatcgtggatcagaggctaggaagtgaactcggttgctacaccattaatcgggtcaagagctttaaactgtgcgagaactcggctacaggcaagtcctgtgaagtggactctatccccgtaaaatgccgccaagggtattgtcttaagattacgcaggagggaagaggccatgttaagttgagcaggggttcagaggtggtcctggatgcctgcgacagttcctgtgaagtgatgataccaaaagggaccggcgatatcctcgtcgactgctctggaggccagcagcacttcctgaaggacaatcttattgatctggggtgtccgaaaatccctttgctcggaaagatggcaatctacatttgccgtatgagcaaccatcccaaaactacaatggccttcctgttttggttctcctttggttatgtgataacctgtatcgtttgcaaggctattttctacttactgatcattgtgggcacactagggaagcggtttaaacaatatcgagagctcaagccacagacttgtaccatctgcgaaacgacacccaccaacgcgatagacgcagagatgcacgatctgaattgctcatacaacatctgtccttactgcgccagcagacttactagcgacggattggctaggcacgtaacccattgtccaaaacgcaaggaaaaagtcgaggagacagaactgtatctcaatctggagcggattccctgggtggttagaaagttacttcaggtgtctgaatccactggcgtcgcccttaagaggagctcgtggttgatcgtgctcctggtactattcgcagtgtcactgtctcctgttcagagtgccccgattggtcacgggaaaaccatcgagacataccaagtccgcgaagagtatacgtccatatgcctctttgtgctgggcagcattcttttcatcgtgtcttgtttgatgaagggactggtcaacagcgttggcaatattttcttcccagggttatccatctgcaaaacctgttcaataggaagtatcaacggctttgagattgaaagccataagtgctactgttctctcctgtgctgtccctattgccgacactgctccgctgatcgggagatccatcagcttcacctgtcaatttgtaaaaagcgtaaaactggtagtaatgtgatgttggccgtgtgcaagagaatgtgtttcagggcaacagtagaagtcagcaacaaggcgctctccatccgctctataattaataccacttttgtggtttgcatcctgatcctagctgtgtgtgtcgtgtcgacaagcgccgttgagatggaatcactgcctgcagggacctgggagcgggaggaagacctcacgaacttctgccaccaggagtgtcaggtgactgaaaccgagtgcctgtgtccatacgaggcccttgtattgagaaggcccctgttcttagatggaattgtcaaaggcatgaagaatctcctgaactccacaagtcttgaaacctctctgagcatcgaggctccttggggtgccattaatgtgcaatccacttataaaccgacagtgtcagcagctaacatagccctatcttggagcagtgtcgaacatcgaggcaataagatcctcgtttccgggcgcagcgagtctattatgaaactggaggaacggaccggaatctcatgggacttgggcgtggaggatgcgtccgaaagtaagctgttaacagtaagcgtgatggacctctcgcagatgtactctcccgtctttgagtacctgtccggggatagacaggtggaagagtggccaaaggccacttgcaccggagactgtcctgaaaggtgcggctgcacgagctcaacatgtcttcacaaagagtggccccatagtcgtaactggcgctgcaacccaacctggtgttggggtgttgggactggatgcacctgttgcggcctggatgtgaaggacttgttcacagactatatgtttgtcaaatggaaggtggagtacattaaaactgaagctatcgtttgtgtggagctcacctctcaagaacggcagtgctccctgatagaggcaggtacgagattcaatctaggccctgtcacaatcaccctgagcgaacccaggaacattcagcagaagctgccaccggagatcattactctccaccctcgaatcgaggaagggtttttcgatctgatgcatgtacaaaaggtgttgtcagccagtacagtttgtaaactgcagagctgcacccacggagtgcccggcgacttacaggtctatcacatagggaatctcctgaagggagataaagtgaacggccatcttattcacaagatcgagccacattttaatacttcctggatgtcttgggacggttgtgatctggactactattgcaacatgggggattggcccagctgcacatacaccggagtaacgcagcacaatcacgcttccttcatcaacttgctcaatattgaaactgactataccaaatcatttcatttccactctaagcgggtgacagcccatggcgatacccctcaactggacctaaaggcacgcccaaactacggtgcgggcgagataacagtcctggttgaggtggccgatatggaacttcacactaaaaagatcgagattagtgggctcaaatttgcttcgctgacctgtacgggatgctacgcctgtagctccggcatctcttgcaaggtgaggattcatgtcgacgaacccgatgagttgacagtgcacgttaaatcagacgaccctgatgtagtggcagctagctccagtttaatggccagaaagctggaatttgggactgactctacctttaaagcattcagcgccatgccgaagacatcactctgtttctatatcgtcgagcgggagtactgcaagtcctgtagtaaagaagatacccagaagtgcgtgaatactaaactggagcacccacagagcatacttatcgaacataagggaaccattatcggcaaacagaacaatacatgtacggctaagacttcttgctggctggagtccgttaagtcatttttctatggtttgaaaaacatgctaagcgggatttttggaaatgtgttcgtcggcatctttctgttcctcgcgccctttatactgcttattttattctttatgttcggctggcgaatcctgttttgtttcaagtgctgcagacgcaccaggggactcttccgttacaaacacttggaagacgatgaggagacagggtatcggagaatcattgaaaggctgaacaacaagaaaggtaagaataagctcctggacggcgagcgccttgccgatcgaagaatcgcagaactgttttcgaccaaaactcatatagggtga

SEQ ID NO: 10290 - RNA, 5070 nt, synthetic construct
  misc_feature 1..5070: note = derived and/or modified CDS sequence (opt3) from CCHFV(K128_76)__KX013454.1__GP
  source 1..5070: mol_type = other RNA
atgcccatcagcgtgatgcacatttccctgatgtgcgccgtcctctgtcttcagctgtacggcctagggggaacccatggttctcacaacgagacagaacataataagactaacgctgttacgacctcaagtgacagccaatcccctgagccaccgacaagaactaccttacccgtgacacctgattctccaaccgtaactcccacaacccctgcatcggccccagaaggctcaggggaggtgcacacgagtccccctaatactaccgaaggaccaagtctgccggagtccacacccgagcctccaactgcgacctctacaggcatacccagcgcttccgacgtcaactcaagtacccaggccgcaagggatacgagcactcctacagtgcatacctctccacccaattccccgtcaactcctcccacactacaggaaacccaccacccaatgcggaacctcctgagcgttacgagtcataaacctgaggaaacctctgccccctccgagagcggtaaggagtcgccagctgcaaattctccccaccctgtggccgaccgcccatccacatcaagtactaccgctcaggggccgacagaaaacaatagctataacactaccgagcaacttgaatccctgacacagtctaccactttgggacccatgacgagcctcacacagaccgtcctgtcacagagtgtgacttccatcgccgtacaagatacccatctgagccctacaaatcgatctaaacgtaacctcgagatggaaattatcttaaccctgccacagggccttaagaaatactatggcaaggttttgagactgctacagctcactctggaggaggacacagaagggcttctggagtggtgcaagaggaatttggatctcgactgtgatgacacgttctttcagaaacggattgaagagttctttatcaccggagaaggttacttcaacgaggtgctgcaatttcgcactcccggcacattatcaaccacagagagtactcacgcggggctgcctaccgcagaaccattcaagagctattttgccaaaggattcctctccatagattctggctacttttcggctaagtgctatagcagaacgtccaattcaggtcttcagctgatcaacgtcaccaggcacagtacacggattgccgacactcccgggccgaaaatcaccaacttgaagacaatttcttgtatcaatctaaaggcaagcgtgttcaaagagcatcgcgaagtggagataaacgtcctgctccctcaggttgctgtgaatctgtccaactgccacgtaactattaagtcacatgtgtgtgattacagccttgacatcgacggaaccgtcaaactgccacacattcatcacgatggcacgtttatccccggcacatacaagatcgtgattgaccgaaagaataagttgaacgatagatgcaccctcttcactaattgtgttataaaagggagggaagtgcggaagggacaatctgtcctgcgtcagtataagacagagatccgcattggtaaagcctccaccggcagtagaaggttactgagcgacgagtctggggatgactgcatctcccggactcagctactccgaaccgaaacagcggagatacacggagataactacggcggtcctggggacaagattacgatctgtaatggctcaaccatcgtggatcagcgcctgggaagtgaacttggctgctatactattaacagagtaaagagctttaaattgtgcgaaaattcggccacagggaaatcctgtgagatcgactctattcccgttaagtgcaggcaaggatactgtctgaagataacccaggagggtcggggccatgtgaaactcagccgcgggtcagaggtcgtgctggatgcatgcgacagttcctgtgaagtcatgatcccaaagggaacaggcgacattcttgtggattgctctggtgggcagcagcacttcctgaaagacaacttgatcgatctcggctgtcctaagatccccctgttaggaaaaatggctatttatatatgcagaatgagcaatcatccaaagactaccatggccttcctgttttggttctcctttggctacgttatcacgtgtattgtgtgcaaggctatcttctatctactcattatcgtagggacactgggaaaaaggtttaagcaataccgtgagcttaaaccgcagacctgtactatatgcgaaaccacacctactaacgccatcgacgcagagatgcacgatttgaattgctcatacaacatttgtccctattgcgccagccggctgaccagtgacggtctcgctcgacacgtcacacattgtccaaagagaaaagagaaggtggaagagacggaactgtacttaaacctggagaggatcccctgggttgtgcgcaaacttttgcaggtctctgaatccaccggcgtggcgctcaaacggagctcgtggctgattgtactactggttctcttcgcagtgtcactgtctcctgtccagagtgccccaatctcccacgggaagactatagagacatatcaagtgagagaggaatacaccagcatttgcctttttgtgttgggatctatcctgttcattgtcagctgtttaatgaaaggcctcgttaattccgtgggtaacatctttttccccgggctgtcaatatgcaagacttgtagtatcggcagcattaatggatttgagatcgaatctcataaatgctattgttcccttctgtgctgtccttactgcaggcactgctcagctgatcgcgagattcatcagttgcacctcagtatctgtaagaaacgaaagacaggcagcaacgtgatgctggccgtatgcaagcggatgtgtttccgtgcaaccatggaagtctccaataaagccctatttataagatctattatcaacacgactttcgtggtttgcatcctgattctcgctgtgtgtgtcgtgtcgaccagcgccgttgagatggagtcactgccggcagggacatgggaaagggaggaagaccttaccaatttctgccaccaggagtgtcaggtgactgagacagaatgcttgtgtccatatgaggcgctggtattacgccggcccctctttcaagattccatcgtcaagggaatgaaaaacctgcttaatagtacctctctggaaacaagcctatccattgaggctccttggggcgccataaacgtgcagtcaacttacaagccagcagtgtctgccgctaatatcgccctcagctggagttccgtcgaacatagaggtagcaaaattctggtttctgggaggtcagagtccatcatgaagttggaggaacgaaccggaattagttgggacctgggcgtggaggatgcaagcgaatcgaagttactcacggtatctgtgatggacctgtcccagatgtacagccccgtcttcgagtatctttcaggtgatcgccaagtggaagagtggcctaaagctacatgcaccggcgactgtccggagcggtgcgggtgcactagctctacctgtctgcacaaggaatggccccattccagaaactggaggtgcaatccaacatggtgttggggagttggcactgggtgcacctgttgcggattggacgtgaaagatctctttacggactacatgttcgtcaagtggaaagtggagtatatcaagacagaagccatagtttgtgtggagctgaccagccaggaacgtcagtgctcactaatcgaggcgggcactcgctttaacctgggtcctgtcacaattacccttagtgagccccggaatatccagcaaaagctcccacctgaaattatcactctgcaccccagaatagaggaagggttctttgatttgatgcatgtacagaaagtgctgagcgcctccacagtttgtaagttacagtcttgcacccacggagtgccaggcgacctccaggtctaccacattggtaacctgcttaaaggcgatagggtgaacgggcatctgatccacaagatcgagccgcatttcaatacgagctggatgtcctgggacggatgtgatttggactattactgcaacatgggcgattggccttcatgcacttataccggggtaacacaacacaatcacgcttcttttgtgaacctcctgaatattgagaccgactacacaaaaagtttccattttcactcgaagcgagtcactgcacatggagatacaccccagctagacctgaaggcccggccaaactacggcgctggtgaaataacggttcttgtggaggtggccgatatggaactccacaccaaaaagatcgagattagcgggctgaaattcgcatccttgacttgtaccggatgctatgcgtgttcttcaggcatcagctgcaaggtccgcattcatgtggacgaacccgacgagttaacagttcacgtaaaatccgatgaccctgatgtggtcgccgctagttctagcctgatggccagaaagctcgagtttggtaccgactcaactttcaaagcattctccgctatgccaaagaccagtctgtgtttttacatcgtggaaagggagtattgcaagagctgttctaaagaagatacacagaagtgcgttaatacgaaacttgagcagccccaatccatactgatcgaacacaagggcactattatcgggaaacagaacaatacctgtacagccaagacctcatgctggttggagagcgtgaagtcgttcttttacggattgaaaaacatgctgtctggcattttcgggaatgtctttgtgggaatcttcctctttctggcacctttcatacttttaattctgtttttcatgtttggctggcggatcctcttctgtttcaagtgctgccgaagaactcgcggtttgtttaggtataaacatctggagaacgacgaagagacagggtaccgtcggatcattgaaagactcaataacaagaaaggaaagaataagctgcttgatggcgagaggctggccgaccgccgaatcgctgaattgttcagtaccaaaacgcacataggctga

SEQ ID NO: 10291 - RNA, 5070 nt, synthetic construct
  misc_feature 1..5070: note = derived and/or modified CDS sequence (opt3) from CCHFV(Hodzha)__KX013448.1__GP
  source 1..5070: mol_type = other RNA
atgcccgtgagcatcatgcacattctgctcatgtgcgccgtcctttgtctgcagcaatacggcttgggggagacccatagacctaacaatggaacagaacacaacaagactaatgttttaacgaccccatccgacaaactgtctccggagccccctgtgtcaacagctctaagtgtaactccagatagctccaccgtgacacccaccactcctgtctctggtctcgaaggctcgggggaggtgtatacatcaccacccgttaccacgaagggactgagccctagtaaagcaacttccgaacttccagccaccacaggcatagacacttctagcgcgtccgatgtggactcaagtacccaggctgccagggatacaagcaccctgacggtccggacttctccgccctcctcacctagcacaccacccaccagtcaggacacttaccatttggtgcgcaacctcctgtctgtaacatcccctcgaccagaggagaccacggcacccagcaagtcgggtaaagaatctccggttgccaattcccctcaccccgtgacctcacgtccaagtagccctcccatcacagtccaggggccaactgagaactcctctcataataccacaggacaactggaaagcatggctcagtcaactaccctcgtgcccatggcaagtcctacacagaccgtgttatcccagagcgtcacttctctggccgttcaagatgctcacccatcaccgacgaacagaagtaagaggaatcttgagatggagattatcttgacactgccccagggcctaaagaaatattacggcaaggtgctccggctgcttcagctgaccttggaagaggacactgaagggctcctggagtggtgcaaacgcaacttaggactggattgtgacgataccttctttcagaagagaattgaagagttctttatcacaggtgagggccacttcaatgaagtactccaatttaaaacccctagcactctttccacaacggagtctacccatgccgtgtcgccaactgcggaacccttcaagagctattttgcaaaggggttcctgtccatagactcaggatactttagtgccaaatgctattctaagacaagcaactccggcttgcagctaatcaatgtcaccaggcactcaacacggattgctgatactcctggtccaaaaatcaccaacctgaagacgattagctgtatcaatctcaaagcctctgtgttcaaggagcatcgcgaagttgagataaacgtgctgcttccccaggtcgcagtgaacctgtccaattgccacgtaaccattaaaagtcacgtttgtgactacagcttggacgtggatgggacagtccgactcccgcatatccaccatggaggcacttttattcctggcacctacaagatcgtgatcgacaagaaaaacaagctgaatgatagatgcacattatatactaactgtgtcattaaagggagggaggtgcggaagggacaatctatactgcgtcagtacaaaaccgaaatccgcattggtaaggcttccacgggctcaagaaggctactcagtgaggaaagcggggacgattgcatctcgcggacacagctgcttcgaaccgagactgccgaaatacacggagacgattatggcggtccaggggacaagattacaatctgtaatggctccaccatcgttgatcagcgcttgggatctgagctgggctgctacactattaacagagtgaaatcattcaagctctgcgagaatagcgcgaccgggaaaagttgtgaaatcgactccacacccgtaaagtgcaggcaaggatattgtctgaaaattacgcaggagggtcggggccatgtcaaactttctcgcgggagcgaagtggttctggatgcctgcgactcctcatgtgaggtgatgatacctaagggaaccggcgacatcttggtcgattgcagcggtgggcagcagcactttctcaaggacaacctgattgatttaggctgtcccagaatcccactgctaggaaagatggcaatctacatttgcaggatgagtaatcaccctgagactacaatggctttcctcttctggttttctttcggctatgtgataacctgtatcctgtgcaaagccatcttttaccttttgattattgtagggacactgggaaagcgtttcaaacaataccgggaactcaagccccagacttgtaccatctgcgagacgacaccagctaacgccatagacgcagaaatgcatgatctgaattgctcctataacatctgtccgtactgcgccagccgattaacctcggacggtctggctagacacgtgactcagtgtcctaagaggaaagagaaggttgaagagaccgagctttatttgaatctcgaacgcattccctggatcgtccggaaactgctacaggtgtcagagtctacaggcgtggcgctgaagagaagttcctggctcattgtcctgcttgttttgtttgcagtgagcctgtctccagtgcaaagcgcccccatcgggcatggaaaaactatagaaacctaccaggctagggaggaatatacatccatttgcttattcgtactcggctcaatcctgtttattgtcagttgtcttatgaagggtctggtggatagcatcgggaacatattctttcctggcttgacgatctgcaaaacctgttctattggatccatcaatggcttcgagattgagtcacacaagtgctactgtagtctcctgtgctgtccatattgccgccactgccccgccgaccgagaaatccatcagctacacctgagcatatgtaagaaacggaagactgggtccaacgttatgctcgcagtgtgcaaacgtatgtgttttagagccacaatggaggtctctaacaaggctctgcttattaggtcgatcatcaataccactttcgtggtttgcattttgatcctggccgtgtgtgtagtcagcacatcagcagtggaaatggagtccttacctgcgggaacctgggaacgcgaggaggatctcacgaacttttgccatcaggaatgtcaagtgactgagaccgaatgcctgtgtccgtacgaggctcttgtcctgcggagaccactattcctcgacagtattgttaaaggcaagaagaatctgttgaactctacaagcctggagacctccttatcaatagaagccccctggggtgcaatcaatgtgcagtctacttacaaacctacagtaagcaccgccaacattgctctcagttggtccagcgtggagcacagggggaataagatcctggtctctggacgatcagaatccattatgaaacttgaggaacgcacaggcatcagttgggatctgggtgtggaggacgccagcgagtcgaagttgctcactgtttctgtgatggatctgtcccagatgtatagcccagtcttcgaatacctatcaggcgaccggcaagtggaggaatggcccaaagcaacctgcacgggggactgtagtgagagatgcggatgcacatcttccacctgtctgcataaggaatggcctcacagcaggaactggcgttgcaatccgacttggtgttggggcgttgggaccggatgcacatgttgcggccttgatgtgaaggacctctttactgattatatgttcgtcaaatggaaggtagactacataaaaaccgaggctatcgtgtgtgttgagctgacgtcacaggaacgccagtgcagtttggtggaggccggtacacggtttaacctggggcccgtcaccattactttaagcgaaccaagaaatatccagcaaaagctccctcccgagattatcacactgcacccaaggatagaagagggattctttgatcttatgcatgtgcagaaagtactgtccgcgtctaccgtgtgtaagttgcagagctgcactcacggcgtccctggtgacctccaggtttatcatattggcaacctgctaaagggggataaagtgaatggacacctgatccataagatcgagccccacttcaacacatcctggatgtcatgggacggctgtgatcttgactactattgcaatatgggggattggccatcttgcacctacacgggagtgactcaacacaaccatgccagttttgtcaacctcctgaatattgaaaccgactacacaaaatcgttccactttcatagcaagcgagtgaccgctcacggcgatacaccgcagttggacttaaaagcacggcctacttatggtgccggggagataaccgttctggtagaagtggctgacatggagctccacacgaagaaaatcgagattacaggactgaagttcgcctcccttacttgtaccggctgctacgcatgttcttcaggtatcagctgcaaggtccgcattcatgtggatgaacccgacgagctgacagttcacgtgaaatccgatgacccagatgtcgtggcggccagttctagcttgatggctagaaagctagaatttggcaccgactcaactttcaaagccttttccgcaatgcccaagaccagtctgtgtttctatatcgtagagagggaatactgcaaaagctgttctaaggaggatacacagaagtgcgtcaacacgaaactcgagcagcctcaatccatactgatcgaacagaaggggactattatcggaaaacagaataacacctgtacagctaaggcctcatgctggcttgagagcgtgaaatcgttcttttatggcttaaagaatatgctgtctgggattttcggaaacgtttttgtgggcatcttcctctttttggcaccattcatactgctcattctgtttttcatgtttggttggcggatccttttctgttttaagtgctgccgaagaacccgcgggctgttcaaatacaagcatttgaaagacgatgaagagactggatataggcgtatcattgaacggctaaataacaagaaaggcaagaataagctgctcgacggcgagagattagccgataggcgcatcgctgagctgttcagtacaaaaacccacatagggtga

SEQ ID NO: 10292 - RNA, 5070 nt, synthetic construct
  misc_feature 1..5070: note = derived and/or modified CDS sequence (opt3) from CCHFV(Hy13)__AY900145.1__GP
  source 1..5070: mol_type = other RNA
atgagcttctccatcatgtacactcccctgctctgcgccgtgctttgtctgcagttgtggtctttagagggctcacacgggctgagtaacaagacacaacatagcaatacttccacgaccaaagctcctgaagtctctcaggagtttggactaccagtttcgacagtgtcaactattaccagcgacccgcccagtataacatccgcagtatctgtgagcggttccgaaggctcaggggataccaacacttcacctagcgtcacaacccagggactcacgctgccagagactacccttgaactgttgacaactaccgacacagatgcctcttccaccgtggttgtggacgtctcaacgcagactgtgaaggatacacccatcagcaccactcacacaagtctcccttctaccccatccgcgacgaccacaccccaaggcactcatcacaccgctagaggtctgctgagcgtaacatcgactaaacctgagggggcctctacccaggcaaatccagagaagatttccatggaaacaaactcaccgaggctcgccatcagtgagacccccagcttctcccctactacgcaggctccaacagaaaattctaaccccattaccagcaaacagttaatcttttcagcacaacctgttactccaaatcccgtgaccccgcctgtccagcccgccctgagtcagtccgacacaagcaccgctatacaggatatccatccatctcctacttcacggagtaagcgcaaccttgagatggagattatcttgacactgagccaaggactaaagaaatattacggcaagattctcaaactgcttgacctgacgttggaagaggataccgaaggcctcctggagtggtgcaagcgaaatttagggctggtgtgtgacgccgatttctttcagaaacgtatcgaagagttctttctcactggagagggtcacttcaacgaagtgcttcagtttaagacaccctccaccctgtctccaacaggccccgcgagaactgggtcgcctaccgtcgagccattcaagagctattttgcaaaaggattcttgtccatggactcaggctactttagtgccaagtgctatccgagggcttctaatagcggtctacaactgataaacgttacgcagcactccacccggattacagatactcccgggcctaaagtgaccaatctcaagacaatcaactgtattaatctgaaagcctcagtattcaaggaacatcgcgagatcgaaatcaacgtgcttctgccacaggtcgcagtgaacttgagctcttgccacgttctcattaaatcccatgtgtgtgactacagtctggacatagatggacccgtcagattacctaggatccaccacgagggcactttcattccaggcacctataagctggtgatcgacaagaaaaataagcagaacgatcggtgcacgctaataacaaattgtgtaattaaagggcgcgagatccgaaagggacaaagcgttctcagacagtacaggaccgaaatcaaaattggtaaggcttcttccggctcacggcgtctgcttagtgaggaaagcggggacgattgcatctcgcgcactcagttgtccagaacagagaccgccgaaattcattctgacaactacggaggccccggtgataagataactatctgtaatgggagcaccattgtggaccagaggctgggctcagagctcggatgctatacaatcaaccgggtcaaaagttttaagctgtgcgaaaattccgcgacgggcaaatcttgtgaaatcgatagcaccccgattaagtgccgacaagggttctgtcttaaaataactcaggagggacgcggtcacgtgaagctgtccagaggctcagaagtcgtgttggacgcctgcgatagcagttgtgagatcatgattcctaaggggacaggagacatcctcgttgactgctctggcggtcagcagcattttctgaaagataacttaattgacctggggtgtccaaatatccccctactcggcaagatggcaatatacatctgcaggatgtccaaccaccctaaaaccacaatggctttcctgttttggttcagctttggatatgtgattacttgtatcctttgcaaggtaattttctacttgctgatcgtcgtgggcaccctcgggaaaaagtttaagcaatatcgggagctgaaaccccagacgtgtacaatatgcgaaaccactccagttaatgccattgatgctgagatgcatgacttaaactgctcgtacaatatctgtccttattgcgcctcacgcctgacctctgatggacttgcaagacacgtgatgcagtgtcccaagaggaaagaaaaggtcgaggaaacagagttgtacctcaacctggagcgtattccatgggtggtacggaaactactccaggtgagtgaatccactggtgttgccctcaagcgaagctcttggctggtcgtgcttttggtgctgttaaccgtcagcctctccccggttcaatcagctcctatcggccacgggaaaacagtggagacgtaccagaccagagaaggatataccagtatatgcctgttcgtgcttggcagcatcctgtttattgtatcttgtttgatgaagggtctcgtcgactccgtggggaatagtttctttcccggcagtagcatctgcaagacatgttccattggatctatcaacggcttcgagatagaatcgcataaatgctactgtagcctgttctgctgtccatattgcaggcactgctcagcggatcgcgagattcataagctacacctgtccatctgtaaaaagcggaaaaccgggagtaacgttatgctcgcagtgtgcaagagaatgtgttttagggccactgtcgaggtgtctaataaggctctgcttatccgcaacattatcaatacaaccttcgttgtgtgcattttgatactggccgtatgtgtcgtgagcacgtccgcagtggaaatggagtcattacccgccggaacttgggaacgagaggaagacctcaccaacttttgccaccaggagtgtcaagctacagagaccgaatgcctgtgtccttacgaggcccttgtcctgcggaaaccactattctctgatagcatcgttaagggcatgaaaaatctcctgaacagtacttccttggaaacaagcctgtctattgaggcaccctggggtgcgatcaatgtgcagtcaacctttaagcctacagtatccgctgccaacattgcattaagttggagctcggtggagcatcgtgggaataaaatcctcgtctctggaagatccgaaagcataatgaagctggaggaaaggactggcatctcatgggaccttggtgtggaggatgccagtgaatctaagctgttgaccgtttccattatggacctcagccagatgtattcaccggtgttcgagtacctgagtggcgatcgccaggtcgaggaatggccaaaagctacgtgcacaggggactgtcccgagcggtgcggatgcaccagctccacttgtctacacaaggaatggcctcattctagaaactggaggtgcaatccaacctggtgttggggcgtggggacaggatgcacttgttgcggcctggacgttaaagatctttttaccgaccacatgttcgtgaagtggaaagtcgagtatatcaagacggaagccattgtatgtgtggagctcacaagccaagagcgacagtgctccctgatcgaagcaggtacccgctttaacttggggcccgttactataacactgtcagagcctcggaatattcagcagaagttaccgcccgaaatcgtgaccctccatccaagaatcgaggaaggattctttgatctgatgcacgtcaaaaaggtgctttctgctagtactgtatgtaaactgcaatcgtgcacacacggcgtgcctggtgacttgcaggtctaccatattggcaacctcctgaagggggataaagttaatggacacctaatacataagatcgagccccacttcaacaccagctggatgtcctgggacggctgtgatctggactactattgcaacatgggggattggccatcttgctcatacacgggagtgactcagcataatcacgccgcgtttgtgaacatgcttaatattgagaccgactatacaaaaatcttccacttccatagcaagagggtcaccgcccacggcgatacacctcagctcgacctgaaggctcgtcccacttacggtgcaggggaaattaccgtgttggttgaggtagccgatatggaattacatacgaaaaagatcgagatatccggactgaaatttgctagtctcacatgtactggctgctatgcctgttctagcggtatctcatgcaaggtgcgcattcacgtcgacgagccagacgaactgaccgtgcacgttaaatccgaggatccggacatcgtggcagcgagtagctctcttatggcccggaagctggagttcggcacagattccacctttaaggctttctcagccatgcctaaaactagcttgtgtttttacattgtcgagagagaatattgcaagtcgtgttctaaagaggacacccaaaagtgcgtgaacacaaaactagagcagccccagagtatcctgatagaacataaggggacgattatcggaaagcaaaatgatacttgtacctccaaagcaggctgctggctcgagagcgtaaagtcattcttttacgggctgaaaaacatgctttccggaatcttcggcaatgtctttattggtatcttcttatttctggctccattcatactcttgattctgttctttatgttcgggtggaggatcctcttttgtttcaagtgctgccgacggacacgcggactgtttaaatacagacaccttaaggacgatgaagagaccggctataggaagattatcgaacggctgaacaataaaaagggcaaaaacaagttgctagacggggagcgactggccgatagaaaaatagcagagctgttctctactaagacacatattggatga

SEQ ID NO: 10293 - RNA, 5070 nt, synthetic construct
  misc_feature 1..5070: note = derived and/or modified CDS sequence (opt3) from CCHFV(SPU415/85)__DQ211635.1__GP
  source 1..5070: mol_type = other RNA
atgcccgtgaacatcatgtacacccctctggtctgcgccgttatttgtctccagctttggaatctgggcgggacattggtgttcataaacagaactcaacacaatgagacgggaaccgtagctacaccagaaggtactttaaggccgcggctgcccgtgagcaccgcactacctacaaagtccgaccgcccatctgtcggccccgccgcgtcaagtagcgggctcgagggatccggcgaacctaacacctctccatcgatcactacaaaaggtctgactccccctgagacgactccagcccttccgaccgccacagatactgacgcatcaagcaccggggtggttgatgtgagtacacagatgaccaaggacattcccatgtccacggcctatactaatcctccatctacacccagcgctccttccaccccacagggaactcatcacacagcacgaggcctgttgtcagtcgccagtaccaaaagcgaagaggtgtctatgtccacgtcacccgctaagaccagcacagagaccagttctccgcctcccgccacctccgaaacaccaactcctagccccaccacacaggtaccaaccggcaacaataaccccaatacttcgcgtcaacctacgccatctgcgcagccggcaatgtccaaccccgccacaagtcctgctcagccaaatctctcacagagcgctccccctaccgcagatcaaggggttcatccatcccccactaacagatctaaaaggaatctggagatcgaaattatcctgaccctcagccagggattacggaagtactatggtaagatactgaaacttttggacctgacactagaggaggataccgaaggcctcctggagtggtgcaagcgcaaccttgggctgacttgtgacgataactttttccagaaaagaatcgaagagtttttcttgacaggagaaggctactttaatgaggtgctccagttcaaggtcccgtcaacgctgagttccaccgagcctactcacacaaggccacccaccgtggaaccttttaaaagctatttcgctaaggggtttttatctatgaactcaggttacttcagtgccaagtgctatccccggacaagcaattccggactgcaactcattaacgtgactaaacattctgcgaagatcgccgacaccccaggccctaaaattacgaatcttaagaccatcaactgtataaatctgcgcgcatcggtctttaaagagcaccgagaagttgagattaacgtgttgctaccccaggtagctgtgaatctgagcaactgccacgcccagatcaagtcccatgtctgtgattactcactcgctacagacggcatggtgagactgccacacattcatcacgaagggactttcatcccgggaacctacaaaatcgttattgataagaagaataaacaaaacgacaggtgcacacttgtgactaattgtgtcataaagggtcgggaggtgcgtaaaggccagagtgccctgcgccagtataagaccgagatcagaattgggaaagcatctagcggatccaggcggttgctctcagaagagagcgacggcgattgcatctctcgaacgcagctgttacgcacagaaaccactgagatacactccgacaactacggtgggcctggcgataagattacaatctgtaatggaagtaccatcgtagaccaaagactgggcagcgaactagggtgctatactattaacagggttaagtcttttaaactctgcgaaaattccgccaccggaaagtcatgtgagatcgatagtacacccgtgaaatgccggcagggtttctgtctgaagattacgcaggaaggccgcgggcatgtcaaacttagcagaggatcggagatagtgttggacgcttgcgattccaactgtgaaatcatgattccaaagggcaccggtgacatcctggtcgattgctctgggggccagcaacacttcctcaaggacaacctgatcgatcttggatgtcccaatattcctctgttgggcaaaatggcgatatacatctgcaggatgagcaaccatccaaagactacaatggcatttctcttctggttttcattcgggtatgtgattacctgtatcctgtgcaaagttatcttttacttactgattgtggccggaacagtaggtaagaaattcaagcagtatcgtgagctacggccccagacttgtaccatatgcgagacgatccctgtcaatgctattgacgccgaaatgcacgacctcaactgcagttacaatatctgtccgtactgcgcatcccgactgacatctgatggccttgccagacatgtgatgcagtgtccaaagaggaaagagaaggttgaagagaccgaattgtatctgaacctcgagcgcattccctgggtggtccggaaactgttacaagtgagcgagtccactggggtagctctgaagagatcaagctggcttaccgtgttgctcgttctgctaatcgtcagtctgtctcctgtgcagtccgccccaataggacacggcaaaacaattgaaacttaccaggcaagggagggttataccagcttttgcctcttcatcctggggtcgattctttttgtggtctcatgtttggttaagggcctgatcgactctgtgggaaatagtttctttcccggcttatccatatgcaaaacatgtagcatcgggtctattaacggattcgaaatcgagagccacaagtgctactgttccctcttttgctgtccttattgccgccattgctcagcggatcgagaaattcacaagctgcatcttagtatctgtaaaaagcggaaaacgggcagcaatgtgatgctggctgtatgcaagcgtatgtgtttcagagccaccatagaggtctctaacagggcattgctcattcgcaatatcatcaacactacattcgtggtttgcattctgaccctagccgtgtgtgtcgtgtccacttcagctgttgagatggaaagtctgccggccggtacatgggagaaagaagaggacctcaccaatttttgccaccaggaatgtcaagtgacggagactgagtgcctgtgtccctacgaagcacttgtattgcggaagccactgttcttagatagcatcgtcaaggggatgaaaaacctccttaattccacctctcttgagacatcgctgagcattgaagctccttggggagccataaacgtgcagtcaacctttaagcccactgtgtccgcggccaacatcgctctaagttggtctagcgtcgagcacagaggcaataaaattctcgtttccggtaggtcagagtctatcatgaagctggaggagcgaacaggcattagctgggacttgggggtggaagatgcaagtgagtccaaactgttaaccgtaagcgtgatggacctctctcagatgtattcaccagtcttcgaatacctgtccggagatcgccaagtggaggagtggcctaaggccacatgcactggcgactgtcccgaacggtgcgggtgcaccagtagcacgtgtcttcataaggagtggccacactcgagaaactggaggtgcaatccgacatggtgttggggagttggcaccggttgcacttgttgcgggctggatgtgaaagacttgtttaccgattacatgttcgtcaagtggaaagtggaatatatcaagacagaggctatagtttgtgtggaactcacttctcaggagcgtcagtgctccctgatcgaggccggaacccgctttaacctaggccctgtcacgattacactgagcgaaccccggaatatccagcaaaaacttccacccgagattatcaccctccatcctagaatagaagagggtttctttgacctgatgcacgtacagagggtgttgtcagcaagtactgtttgtaagctgcagtcttgcacacatggcgtgccaggggacttacaggtctaccacattggaaacctcctgaagggcgataaagtgaatgggcaccttatccataagatcgaaccccacttcaacacctcctggatgagctgggacggatgtgatctggactattactgcaatatgggcgattggccttcatgcacttatacaggtgtaacccaacataaccacgcggcctttgtgaatttgctcaacattgagacggactacactaaaaatttccattttcacagtaagcgagtcaccgctcacggggatacaccgcagctggacctaaaagcccggccaacctatggagcaggcgaggttacagtgctggtggaagtcgctgatatggagcttcatactaagaaaatagaaatcagcggtctcaagttcgcctccctgacctgtacgggctgctacgcatgttctagcgggatttcctgcaaggtgaaaatccacgttgacgagcccgatgagttgacagtacatgtgaagtcagaagaccctgatattgtcgccgctggatctagtttaatggcgcgcaaactggagttcggcgccgactcgacttttaaggcattcagcgctatgcccaaaacctccctctgtttttacatcgtggaaagagagtattgcaagtcttgttcaagggaagacacacggaagtgcgttaacaccaaactggatcgaccacagagcatacttatcgagcacaaggggactattatcggaaaacagaataacacctgtacagccaaggcctcctgctggctggagagtgtgaaatctttcttttacggcttgaagaacatgctaagcggtattttcgggaatgtctttatcggaatattcctgtttattgctcctttcgtgctcctgatcctgtttttcatgttcggctggagaatcttattttgtttcaagtgctgccgcaggacgcgtggcctgtttaaatatcggcacctcaaggacgatgaagagactgggtacagaaaaattatcgaaaggttgaacaataagaaaggaaagaacaagctgctcgacggtgagcgcctggcagatcgaaaaatagccgaacttttctcaaccaagtcccatattggctga

SEQ ID NO: 10294 - RNA, 5070 nt, synthetic construct
  misc_feature 1..5070: note = derived and/or modified CDS sequence (opt3) from CCHFV(SPU97/85)__DQ211633.1__GP
  source 1..5070: mol_type = other RNA
atgaccgtgaacacagtctgcactcccctggtttgtgccgtgttctgcctccagctttggaatctgggcgggacgttggtacctaccaacagaacacaacacaataagactggaaccatggctacaccagagggtaccttaggcccgaggctgcccgtgagcactgcactacctacaaaatccgaccggccatctgtcgggcccgccgcgccttcaagtggactcgaaggcagcggtgagccaaacacctccccctctatcacgactaaggggctggcccttcctgaaaccacaccagctccgcccactgcaaccgatacagacgcctcgtcaaccggagtggttaatgtgagcacgcagatgactaaagatattcctatgagtacagcttacaccaacccaccctccactccttctgcaccaagcacaccccagggcacccatcacacggcccgcggcctgttgtccgtcgcttcaaccaagagtgaggaagtgagcatgtctacatccccggggaaaacttcaaccgagacaagcagtcctcccccagccacttctgagacccctgcgccctccccaacaacccaggcacccactggaaataacaatcctaacacgagccgacaaccaacaccgtcggcccagcccgctatgtctaatcctaccacttccccagcccagcccaacctcctgcagaatgcacctccaaccgctgaccaaggtgtacatcccggcccgacaaaccgttcaaagagaaatctggaaatggagataatcctcaccttaagtcaggggctgaggaagtattacggaaaaattcttaagtttttggatctgactctagaagaggacacagagggcctcctggaatggtgtaaacggaaccttggtctgacgtgcgatgacaacttctttcagaagcgcatcgaggagttctttttgaccggggaaggatatttcaatgaagttctccagtttaaagtgcctagcactctgtcctctacagagccaacccacacaggcagccccactgtcgagcctttcaagtcatactttgccaagggcttcttaagtatgaactccgggtattttagcgcgaaatgttaccccagaacctctaattcaggactgcaactcattaacgtgacgaagcatagtgccaaaatcgcagataccccaggtcctaagataacaaatcttaaaactatcaactgcattaatctgagggctagcgtgttcaaggaacaccgggaggtcgaaatcaacgttttgctaccccaggtggccgtaaatctgtccaactgtcacgctcagattaaatctcatgtgtgcgactattcgctcgccaccgatggcatggtccgcctgccacgaatccaccatgaggggacatttataccgggaacttacaagattgtgatcgacaagaaaaataagcaaaacgatagatgtacccttgttacgaattgcgtgattaaaggcagggaagtccggaagggtcagagcgcactgcgtcagtacaaaacagagatccgcatcgggaaggcctcctcaggcagtagaaggttgctctctgaggaaagcgacggagactgtatttcccggacccagctgttacgaactgagacagctgaaatacactcagataactatggcgggcctggagacaagatcaccatttgcaatggtagcactatcgtggatcaacgcctgggctctgagctagggtgctacaccataaacagagtaaaatccttcaagctctgtgaaaacagtgcgacaggaaaaagctgcgagattgactctacgcccgttaagtgtaggcagggcttctgcctgaaaatcacccaggagggtcgggggcacgtgaaactttcccgcggctcagaaatcgtcttggatgcatgtgacagtagctgcgagattatgatcccaaagggaactggcgatattctggtggactgttctgggggacagcaacattttctcaaggataatctgatagaccttggttgccccaacatccctctgttgggcagaatggccatttatatctgtaggatgtccaatcacccaaagacaaccatggctttcctcttttggttctcttttgggtacgtcatcacatgcattctgtgtaaagtgatattctatttactgatcgttgccggaactgtgggcaagaaatttaagcagtaccgtgaactacggccccagacctgcacgatttgcgagacaacccctgtaaacgcaatcgatgccgagatgcatgacctcaattgtagctataacatttgcccgtactgtgcttcacgactgaccagtgacggtcttgccagacacgtcatgcagtgcccaaagaggaaagaaaagatcgaggaaactgagttgtacctgaatctcgaacgcataccctgggtggttcggaaactgttacaagtgtccgagtctacaggggtcgcactgaagagaagctcctggcttactgtgttgctcgtactgctaatcgtgtcactgagccctgttcagagtgcgccaattggccatggaaaaaccatcgagacatatcaggctagggaaggctacacgtctttctgtctctttattctggggtccatccttttcatagtcagctgcttggtgaagggactgattgattcggtgggcaactcatttttccccggtttatctatctgtaaaacctgcagtattgggtccgtcaatggatttgagatcgaaagccacaagtgttattgctctctcttctgttgcccttactgccgccactgtagcgccgaccgagagatacataagctgcacctttccatctgcaaaaagcggaaaactggctcaaacgttatgctggcagtgtgtaagcgtatgtgcttcagagccacaattgaagtgagtaatagggctttgctcatccgcagcattatcaacaccacttttgccgtatgtatactgacactagcagtctgcgtggtttctacctccgctgtggagatggagtcactgccggccggtacgtgggaacgggaggaagatctcactaatttctgtcatcaggagtgccaagtcaccgaaacagagtgtctgtgcccctatgaggcgcttgtgttgagaaaaccactgtttttagacagtattgttaagggcaagaaaaacctcctgaatagcacctcccttgaaacttctctgtcgatcgaggccccttggggagctatcaacgtgcagagcacattcaagcccaccgtatcagcagccaacattgctctatcctggagttctgtcgaacacagggggaataaaatcctcgtgagcggccgatccgagtcaattatgaagctggaggaacgcacagggatatcttgggatttgggagtggaggacgccagcgaaagtaaactgttaactgtctccgttatggatctcagccagatgtactctccagtgtttgagtatctgtcaggcgaccggcaagtagaagagtggcctaaggcaacctgtacgggtgattgccccgagagatgcgggtgtacatccagtacctgccttcacaaggaatggccacatagcaggaactggcgttgtaatccgacttggtgctggggagtgggcaccggttgtacatgctgtggcctggacgtcaaagatttgttcactgactacatgtttgtgaagtggaaagttgagtacatcaagaccgaagcgattgtgtgcgtcgagctcacgtcgcaggaacgccagtgttctctgatcgaggccgggacacggttcaacctaggacctgtgaccattactctgtccgagcccagaaatatccagcaaaaacttccacccgaaataatcacactccaccctaggattgaggaaggctttttcgatctgatgcatgttcagaaggtgttgagcgcttcaaccgtctgcaagctgcagagttgtactcacggggtaccaggagacttacaggtgtatcatatcggcaacctcctgaaaggtgacaaggttaatgggcaccttattcacaaaatcgagccccattttaacacatcttggatgtcctgggatggatgcgacctggattactattgcaatatgggcgactggcctagctgtacctacacgggtgtgactcaacacaaccatgccgcattcgtcaatttgctcaacatagaaaccgattatacaaagaattttcacttccattcaaaacgagtgaccgctcacggcgacacaccgcagctggatctaaaggcccggccaacttacggggcaggagaggtaaccgtgctggtcgaggttgccgacatggaacttcacacgaaaaagattgagatcagtggcctcaagttcgctagcctgtcctgcacagggtgttatgcgtgctctagcggaatctcctgtaaagtgcgcattcatgtggatgaacccgacgagttgactgtccacgtgaagtcagaggatcctgacatagttgccgcaggctctagtttaatggctagaaaactggaatttggtgccgattcgaccttcaaggcctttagcgctatgcccaaaacatccctctgcttctacatcgtagagagggaatactgtaagtcttgctcacgggaggacacccagaagtgtgtgaacactaaactggaacgaccacagagcattcttatcgagcataaggggaccattatcggaaaacaaaatgacacatgcacggcaaaggcctcctgttggctggagagtgtcaaatcgtttttctatggccttaagagcatgctatcaggcatatttgggaacgtgttcatcggaatttttctgttcatcgcgccttttgttctcctgattcttttcttcatgtttggttggagaatcttattctgctttaagtgctgtcgcaggactcgtggcctgttcaaataccggcacctcaaggatgacgaagagaccgggtatagaaaaataattgaaaggttgaacaataagaaaggaaagaacaagctgctcgatggcgagcgcctggctgaccgaaaaatcgccgaattgttttccacaaagagtcacatcggttga

SEQ ID NO: 10295 - RNA, 5070 nt, synthetic construct
  misc_feature 1..5070: note = derived and/or modified CDS sequence (opt3) from CCHFV(C-68031)__DQ211629.1__GP
  source 1..5070: mol_type = other RNA
atgagcttctccatcatgtacactcccctgctctgcgccgtgctttgtctgcagttgtggtctttagagggctcacacgggctgagtaacaagacacaacatagcaatacttccacgaccaaagctcctgaagtctctcaggagtttggactaccagtttcgacagtgtcaactattaccagcgacccgcccagtataacatccgcagtatctgtgagcggttccgaaggctcaggggataccaacacttcacctagcgtcacaacccagggactcacgctgccagagactacccttgaactgttgacaactaccgacacagatgcctcttccaccgtggttgtggacgtctcaacgcagactgtgaaggatacacccatcagcaccactcacacaagtctcccttctaccccatccgcgcccacgacccctcaaggcacacatcacactgctagaggtctgctgagcgtaacctcgacaaaaccagagggggcctctactcaggcaaatccggagaagatttccatggaaaccaactcacccaggctcgccatcagtgagacacctagcttctccccaaccactcaggctcccacggaaaattctaaccctattacaagcaaacagttaatcctgtcagcacaaccagttacccccaatccggtgactcctcccgtccagccagcccttagtcagtccgacaccagcacagctatacaggatatccatccttctcccacctcacggagtaagcgcaacttggagatggagattatcctgactctaagccaaggactcaagaaatattacggcaagattctgaaacttctggacttgacactcgaagaggatacggaaggcctgttagagtggtgcaagcgaaatctggggctcgtgtgtgacgatgactttttccagaaacgtatcgaagagtttttccttaccggagagggtcactttaacgaagtgctgcagttcaagactccatccacattgtctcccaccggccctgccagaacagggtcgccaactgtcgagccgtttaagagctatttcgcgaaaggatttctatccatggattcaggctacttcagtgcaaagtgctatcccagggcctctaatagcggtctgcaactcataaacgttacccagcactccacgcggattaccgacacacctgggccaaaagtgactaatctgaagaccatcaactgtattaatcttaaagctagtgtatttaaggaacatcgcgagatcgaaatcaacgtgctgttgccccaggtcgccgtgaacctcagctcttgccacgttctgattaaatcccatgtgtgtgactacagtttagatatagacggacctgtcagactgccaaggatccaccacgagggcacattcattcccggcacttataagctagtgatcgataagaaaaataagcagaacgaccggtgcaccctcataacgaattgtgtaattaaagggcgcgagatccgaaagggacaaagcgttctgagacagtacaggacagaaatcaaaattggtaaggcatcttccggctcacggcgtcttttgagtgaggaaagcggggatgactgcatctcgcgcacccagctgtccagaactgagacagctgaaattcattctgataactacggaggcccgggtgacaagataaccatctgtaatgggagcactattgtggatcagaggctcggctcagagctgggatgctataccatcaaccgggtcaaaagtttcaaactttgcgaaaattccgccacaggcaaatcttgtgagatcgacagcacgcctattaagtgccgacaagggttttgtctgaaaataacccaggagggacgcggtcacgtgaagttgtccagaggctcagaagtcgtgctcgatgcgtgcgacagcagttgtgagatcatgattccaaaggggactggagacatcctggttgattgctctggcggtcagcagcatttcttaaaagacaacctgattgatctagggtgtcccaatatccctctcctgggcaagatggccatatacatctgcaggatgtccaaccaccccaaaacaaccatggcatttcttttctggtttagcttcggatatgtgattacatgtatcttgtgcaaggtaatcttttacctgctcattgtcgtgggcactctggggaaaaagttcaagcaatatcgggagttaaaaccacagacctgtacgatatgcgaaacaacccctgttaatgctattgacgccgagatgcatgatctgaactgctcgtacaatatctgtccctattgcgcttcacgccttacttctgacggattggccagacacgtgatgcagtgtccaaagaggaaagaaaaggtcgaggaaaccgagctctacctgaacctagagcgtattccgtgggtggtacggaaactgctccaggtgagtgaatccacaggtgttgcactgaagcgaagctcttggcttgtcgtgttgctggtgttactcactgtcagcctgtcccctgttcaatcagcccccatcggccacgggaaaaccgtggagacataccagacgagagaaggatataccagtatatgcctttttgtgctgggcagcatcttgttcattgtatcttgtctcatgaagggtctggtcgattccgtgggcaattcatttttcccagggctaagtatctgcaagacttgtagcattggatccatcaacggctttgagacagaatctcataaatgctactgttcgctgttctgctgtccctattgcaggcactgcagcgctgaccgcgagatacataagctccacctgtcaatttgtaaaaagcggaaaaccgggtccaacgttatgcttgcggtgtgcaagagaatgtgtttcagggcaactgtcgaggtgagtaataaggccttgctgatccgcaacatcattaatacaacctttgttgtgtgcatcttaattctcgctgtatgtgtcgtgtctacgagcgccgtggaaatggagtccctgcctgcaggaacttgggaacgagaggaagatcttaccaacttctgccaccaggagtgtcaagtcacagagaccgaatgcctgtgtccatacgaggccctagttctccggaaacccctgttttcagactctatagtgaagggcatgaaaaatttgctgaacagcaccagtttagaaacatccctcagcatcgaggctccttggggtgccattaatgtacagtctaccttcaagccgacagtgtcagcagcgaacatcgctctgtcctggagtagcgtcgagcatcgtgggaataaaattcttgtgtcgggaagatctgaatccatcatgaagctggaggaaaggactggcataagctgggatttgggtgttgaggacgcctcagaaagtaagctcctgaccgtgtctatcatggatctatcccagatgtatagcccagtctttgagtacctgtcaggcgaccgccaggtggaggaatggcccaaagcaacgtgcacaggggactgtcctgagcggtgcggatgcaccagtagcacttgtcttcacaaggaatggccacattccagaaactggaggtgcaatcccacctggtgttggggcgttgggacaggatgcacttgttgcggcctcgatgtgaaagacctgttcaccgattatatgtttgtcaagtggaaagtagagtacattaagacggaagccatcgtgtgtgttgagttgacatctcaagagcgacagtgcagcctgattgaagctggtacccgcttcaacttagggcctgtgactatcacactctccgagccgcggaatatacagcagaagctgcccccagaaattgtcacccttcaccctagaatcgaggaaggatttttcgacctgatgcatgtgaaaaaggtattgtcagcctctactgtgtgtaaactccaaagttgcacacacggcgtccccggtgatctgcaggtttaccacatcggcaacctactgaagggggacaaagtgaatggacatcttattcacaagatagagccacattttaacacctcgtggatgagctgggatggctgtgacctcgattattactgcaacatgggggactggccttcctgctcttatacgggagtgactcagcacaatcatgcagctttcgtcaacatgctgaatatcgagaccgattacacaaaaatttttcacttccactcaaagagggtgaccgcccatggcgacacaccccagttggatttaaaggcgcgtccaacttatggtgccggggaaatcaccgttctggtagaggtggctgacatggaactccacacgaaaaagattgagatcagcggactgaaattcgcatcccttacatgtactggctgctacgcctgtagttctggtataagctgcaaggtccgcatccatgtggacgagccggatgaactgaccgttcacgtgaaatcagaggaccctgatattgtcgctgcctccagtagcttgatggcacggaagctagaatttggcacagactctaccttcaaggcgttttccgccatgcccaaaacttcactgtgtttctatatcgtggagagagaatactgcaagagctgttcgaaagaggatacccaaaagtgcgtaaacacaaaactcgagcagccacagtctattctgatcgaacacaaggggacgataattggaaagcaaaatgacacttgtaccagtaaagctggctgctggcttgagtccgtcaagagctttttctacgggttaaagaacatgctgtcaggaatctttggcaatgtgttcatcggtatttttctcttcttggccccctttatcctgctcatactgttcttcatgtttgggtggaggattcttttctgttttaagtgctgccgacggacacgcggactgttcaaatatagacatttgaaggatgacgaagagaccggctacaggaagatcattgaacggctaaacaataaaaagggcaaaaacaagctgctcgatggggagcgattagcagacagaaaaatcgctgagctgttttccactaagacacacataggatga

SEQ ID NO: 10296 - RNA, 5070 nt, synthetic construct
  misc_feature 1..5070: note = derived and/or modified CDS sequence (opt3) from CCHFV(Baghdad 12)__AJ538197.2__GP
  source 1..5070: mol_type = other RNA
atgcccgtgagcatcatgcacatttccctgatatacgccgtcctctgccttcagctgtatggcttgggggagacccatggatcttcaagtggtacagaacacaacagaactaatgttgtggctacgcctggcgggagccaatccccagagccgttagtatctaccacactgcccgtgactctagactcgtcaaccgtcacccctgcaacccaggccagcggaccagaaggcagtggtgaggtgtacacttctccccctacaaccacggaagggctctccccaagcgatgcgacttccgagctgcccaccacaactggaatcggcatttcaagtagctctgacgttaactcctcaacccaggctgccggcgatacaagcacccctacggcaaggacaagtcttccagactctccgtccactccccctaccagccaggatactcatcacccaatgcggaatctgttgtcggtgacatctctcaagcccgaggaaacccctgccccatccaaatcagggaaggagagtcccgctgcaagctccccgcatcctgtcgcctctagacccccaacgcctagcaccacagctcaaggacccactgaaaacaattcacgaaacaccacagtgcagctgaaaagtgtaactcagtccgccaccctgggtccaatggcgagccccacacagaccgttctcttacaatctgtgacttcaatcgcaattcaggacacgcaccctagtccaacaaatcgtagcagaaggaacctggagatggagatcatacttaccttgccgcagggcctgaagaaatattacgggaaggtcctacggctcctgcagcttactctggaagaggataccgaaggattgctcgagtggtgtaagcgcaatctgggcttagactgcgatgacacattctttcaaaaacgcatcgaagagttctttattaccggtgaggggcacttcaacgaagtgctgcagtttaggactcccggaacactctccacgaccgagtctactcatgccggctcgcctacagtggaaccattcaagagctattttgctaaaggcttccttctgatcgattccgggtacttttcagccaagtgttatagtcggacctctaatagcggattgcagctaattaacgtcacacgccactccactaaaatcgcagacacccccggtcctaagataacgaatctgaagaccatttcatgcatcaacctcaaagctagcattttcaaggagcatcgagaaatcgagatcaatgttctgcttccacaagtggccgtaaacctgtctaactgtcacgtgacaattaaatcccacgtctgcgattacagtttgaatatagacggcactgtgaagctcccccatatccaccatgaggggatttttatcccgggaacctacaaaatagttattgacaagaaaaacaagctgaatgatagatgtacattattcactaactgcgtgatcaagggcagggaagtccggaaaggtcagagcgtgctgcgtcagtataagaccgagatccgcattgggaaagcgtctacgggctccagaaggctactctcagaagagagtggagacgattgtatcagccggacacgactgcttcgcaccgaaactgccgagattcacggcgactcgtacgggggacctggtgataagataacaatctgcaatggctccaccattgtagaccagagattggggtctgagatgggatgttatactatcaacagggttaagagctttaaactgtgcgaaaattcagcaaccggcaagagttgcaaaatcgattccattccagtgaagtgtcggcaaggttactgcctcaaaataacacaggaggggcgcggccatgtcaagctgtctagaggaagcgaagtggtccttgacgcttgtgattcctcatgcgaggtgatgatccccaaaggcacgggggacattctggttgattgtagcggaggtcagcagcacttcttgaaggacaacctcatcgacctgggctgccctaatattcccttactggggaagatggccatctatatatgtaggatgagtaaccacccaaaaaccactatggctttcctattttggttctcttttggatacgtgatcacatgcattctctgtaaggccatcttctatctgcttattatcgtaggcaccttgggtaaacgttttaagcaataccgggagctgaaacctcagacatgcactatatgtgaaaccacgcccgtcaatgcaattgatgccgagatgcatgacctcaactgctcctacaatatctgcccatattgtgctagccgactgacatcggatgggttagcgagacacgtgacccagtgcccgaagaggaaggaaaaagttgaggaaactgagctgtaccttaacttggagcgcattccttgggtggtccggaagctcctacaggtgtcagaatctaccggcgtagcactgaaaagaagttcctggctgatcgtgctcctggttcttttggccgtcagctctagccccgtgcaatccgctccaataggatatggcaagacaatcgagacttaccaggccagggaagggtatacctcaatttgtctgttcgtgttaggaagtatcctctttattgtcagctgcctgacaaaaggccttgttgactctatcggtaatatattctttcccgggctgtccatttgtaagacgtgctcaatcggaagtatcaacggcttcgaggtggaaagccataaatgttactgctccttgctctgttgcccttattgtcgccactgctctgcagatcgagagattcaccagctgcatctatcgatctgcaagaagcggaaaaccggtagctcagtgatgctggccgtatgtaagcgtatgtgctttagagctactatggaggtctccaacaaagccctcctgattaggagtataatcaatacaaccttcgtggtttgtattcttactttggcagtgtgcgtcgtgtctacaagcgcggttgaaatggagtccctgccagctggcacctgggaacgcgaggaagacttaacgaacttttgtcaccaggagtgccaagtgactgagaccgaatgtctctgcccctacgaggccctggtacttcggaagcctctgttcctagattcaatcgtcaaagggacaaagaatctcctgaactctaccagcttggaaacaagtctgtccattgaggcaccgtggggagccatcaatgtgcagagcacttacaagccaaccgtgtctacagctaacatagccttatcatggtccagtgtcgagcatagaggcaataaaatcctcgttagcgggaggtcggaatctattatgaagctggaggaacgaactggaatctcctgggaccttggcgtggaggatgcaagcgaatcaaaactgttgaccgtaagtgtgatggacctctctcagatgtattcccccgtcttcgagtacctgagcggtgatcgccaagtggaggaatggcctaaggctacgtgtacaggggactgcccagagcggtgtggatgcaccacttcaacctgcctacacaaagaatggccccatagtagaaactggaggtgtaatcctacatggtgctggggcgttggtactggctgtacctgctgtgggctggatgtgaaggacctttttacggactatatgttcgtcaagtggaaagtggagtacattaagacagatgccatcgtttgcgtggaactcaccagccaggagcgtcagtgttccctgatagaggcgggaactcgctttaacttgggctctgtcacaattaccctgagcgaaccgcggaatatccagcaaaaattacccccagagatcattactctccaccctagaatagaagaggggttctttgacctgatgcacgtacagaaggtgctttccgcctcaacagtttgcaaactgcagtcttgtacccatggagtgcccggcgatttgcaggtctatcacatcggtaacctcctgaagggggacaaggtgaatggacatctaattcacaaaatcgaaccacatttcaacacgagttggatgtcgtgggatggctgcgacctggattactattgtaatatgggtgactggcctagctgcacttacaccggcgtaacacaacacaaccacgcttcctttgtgaaccttctcaatattgagaccgattacacaaagtctttccattttcactcaaaaagggtcactgcacatggggacacaccccagctggatttgaaggttcgaccaacgtatggagccggcgagatcacagtgttagtggaagtcgctgacatggagctgcacactaaaaagatagaaatcagcgggctcaaattcgcctccctgacctgcacaggatgttacgcatgcagttctggcattagctgtaaggtgcggatccacgttgatgagccggacgagcttaccgtacatgtgaagtcagacgatcctgacgtcgtggcggcctccagtagcctgatggctcgcaaattggaatttggtactgattctaccttcaaggccttttccgcaatgcccaaaacatcactatgcttctatattgttgagagagaatactgtaagagctgctcgaaagaggacacgcagaagtgtgtgaacactaagctggaacagccacaatctatcctcatagagcacaaagggaccattatcggaaagcagaataacacatgcaccgctaaaacaagttgttggctggagtccgtcaagagcttcttttatggccttaaaaatatgttatcaggcatcttcgggaactttttcatgggaatttttctgttcctcgccccctttatcttgctgatactcttctttatgttcggttggaggattctgttttgcttcaagtgttgccggcgaactagaggccttttcaagtaccgccatctgaaagatgacgaagagaccgggtataggcgtatcattgaacggttgaataacaagaaaggaaagaataaactactggatggcgagagactcgcagacaggcgcatcgccgaattattttccacgaagactcacataggttga

SEQ ID NO: 10297 - RNA, 5070 nt, synthetic construct
  misc_feature 1..5070: note = derived and/or modified CDS sequence (opt3) from CCHFV(Hodzha)__AY223476.1__GP
  source 1..5070: mol_type = other RNA
atgcccgtgagcatcatgcacattctgctcatgtgcgccgtcctttgtctgcagcaatacggcttgggggagacccatagacctaacaatggaacagaacacaacaagactaatgttttaacgaccccaggtgacaaactgtccccggagctacccgtgtctacagctctctcagtaactcctgatagtagcaccgtgacaccaaccactcccgtctccggcctggaagggtctggagacgtgtatacatcgcctccagttaccacgaagggcctttcacccagcaaagcaaccagtgagctgcctgcctcctctggtatagatactagctccgcgtcagacgtggatagtagcacacaggctgccagggacacttctaccttgacagtccggacctccccaccgtcaagccccagtacgcctccaacttctcaggatacataccatctcgtgcgcaacctgctgtccgtaaccagcccctggcctgaagagactacagcaccatcgaagtctgggaaagagtcccccgttgccaattcaccgcaccctgtgaccagtcgacccagctccccacctatcacggtccagggacccaccgaaaactctagccataatacaactggccaactcgagtcaatggctcagagtaccacattagtgccaatggcatcccccactcagaccgtgctgagccagtctgtcacatcacttgccgttcaagacgctcaccctagtccaaccaaccgtagcaagagaaatttggaaatggtgattatcctgactctaccgcagggcctcaagaaatattacgggaaggtactgaggcttctgcagttgacgctcgaggaggatacagaaggactgttagagtggtgcaaacggaacctgggtctcgactgtgatgacaccttctttcagaagcgcattgaagagttctttatcactggcgaagggcacttcaatgaggtgcttcaatttaaaaccccctccacactgtctaccactgagtcgacacatgccgtcagccctacggcggaaccattcaagtcctattttgcaaagggattcttgtcaatagatagtggctacttttctgccaaatgctatagcaagacctccaactcaggtctacagctgatcaatgtgactagacacagcacaaggattgctgacacccccgggcctaaaatcacaaacctcaagactatttcttgtatcaatctgaaagcctccgttttcaaggagcatcgggaagtggagataaacgtccttctgccacaggtggcagtaaacttgagtaattgccacgttaccattaaaagccacgtgtgtgactactctctcgatgtcgacggaacggtgcgcctgccccatatccaccatggcggcacctttattccggggacatacaagatcgtcatcgataagaaaaacaagttaaatgaccgatgcactctgtataccaactgtgtgattaaaggaagagaagttaggaagggtcaatccatactacggcagtacaaaacagagatccgtattggcaaggcttcaactgggagtcgcagactcctgagcgaggaatcgggagatgactgcatctccaggacccagcttttgcggacggagacagccgaaatacacggcgatgactatggtgggcctggcgataagattaccatctgtaatggatctactatcgtggaccagcgactgggcagcgagctcgggtgctacacaattaaccgcgtaaaatcattcaagctgtgcaaaaatagtgcgaccggaaagtcctgtgaaatcgattctactccagtcaaatgcagacaaggttattgtcttaagattacccaggagggcagggggcatgtgaagctgagccggggatccgaggttgtgttggacgcctgcgactcaagctgtgaagtcatgatacccaaaggcacaggtgatatcctcgtggactgcagtgggggccagcagcactttctgaaggataacttaattgacctgggatgtcctcgcatccccctactcggcaaaatggcaatctacatttgcagaatgtctaatcacccaaagacgaccatggctttcctgttctggttttccttcgggtatgtaataacttgtatcctttgcaaagccatcttttacttgctgattattgtgggaacactcggtaagaggttcaagcaataccgtgagctgaaacctcagacctgtacaatctgcgaaactacccccgctaacgccatagatgcagagatgcatgacttaaattgcagctataacatctgtccatactgcgcctcgcggctgacgtcagatggccttgctcgacacgttacacagtgtccgaagagaaaagagaaggtcgaagagaccgaattgtatctcaatctggagaggattccttggatcgtgcgcaaactacttcaggtgtctgaaagtactggggtcgcgctcaagcggtccagctggctgattgttcttttggtgctgtttgcagtgtctttaagccccgtacaatccgccccaatcggacatggcaaaaccatagagacataccaggctagagaggactatacttcaatttgcctcttcgtcctgggtagtatcctttttattgtgagctgtctgatgaaggggttggttgattctatcggcaacatattctttcccggactcaccatctgcaagacatgttccattggctcaatcaatgggttcgaaattgagagtcacaaatgctactgtagcctgctatgctgtccttattgcaggcactgctccgccgaccgcgaaatccatcagctgcacctctctatatgtaagaaacgaaagacgggatcgaacgtgatgctggcagtctgcaaacggatgtgttttcgtgccaccatggaggtgagcaacaaggctcttttgattagatcaatcatcaatactacattcgttgtgtgcattctgatcttagccgtatgtgtcgtgtccaccagtgcagtggaaatggagtctctcccagcgggcacttgggagagggaagaggatctgacaaacttttgccatcaggaatgtcaagtcaccgagacggaatgcctttgtccctacgaggctctggttctacgccggcctctcttcctggacagcattgtgaagggtactaaaaatttgctgaactccacctcattagagacatctctcagcatagaagccccgtggggagcaatcaatgtacagagtacctacaagccaactgtgtccacagccaacattgctctgagctggtcttcagtcgagcacagagggaataaaatccttgtgtccggcaggagtgaaagcattatgaagctggaggagcgaaccggtatctcgtgggatttgggcgttgaagacgcctctgagtccaaactcctgacagtgagcgtcatggacctatcacagatgtatagtcccgtgttcgaatacctgtctggggatcgccaagttgaggaatggcctaaggcaacttgcaccggagactgtccagagcggtgcggctgcacgtccagcacatgtcttcataaggagtggccccactcaagaaactggaggtgcaatcctacctggtgttggggagtggggactggctgcacctgttgcggtctcgatgtcaaagacctgtttacagattatatgttcgtaaagtggaaagtggactacataaagactgaagctatcgtttgtgtggagttgaccagtcaggaacgtcagtgcagcctggtcgaggccgggacgcgctttaacttaggaccggtgacaattaccctctccgaaccccggaatatccagcaaaaactgccacctgagattatcactcttcaccccagaatagaggaaggcttctttgatctgatgcatgtacagaaggtgttgtctgcgagcacagtctgtaagctccagtcctgcacccacggtgttccaggcgacctacaggtgtatcatattgggaacctgctgaaaggagataaggtgaatggccaccttatccataaaatcgagcctcacttcaacacttcatggatgtcttgggacgggtgtgatctcgactactattgcaatatgggagattggcccagttgcacatacaccggcgtcacgcaacacaaccatgcctcgtttgtgaacctgttgaatattgaaactgactacaccaagagcttccactttcattccaaaagggttacagctcacggtgacaccccacagttagatctgaaggcacgaccgacatatggggccggagagataactgtactcgtggaagtcgctgacatggagctgcacaccaaaaagatcgagattacgggccttaagttcgcctctctgacatgtactggttgctacgcatgttcaagcggcatctcctgcaaagtgcggattcatgttgatgaacctgacgagttgaccgtgcacgtcaagagtgatgaccccgatgtggtagcggcctctagctcactaatggctcgcaaactggaatttgggacagactccaccttcaaggcctttagtgcaatgccaaaaactagcctctgtttctatatcgtcgagagagagtactgcaagtcttgttccaaggaagatacccagaaatgcgtgaacacaaagctggagcagccccaatcaatacttatcgaaaggaaaggaacgattatcggcaagcagaataacacttgtaccgctaaagccagctgctggttagagtcggttaagtctttcttttatgggctgaagaatatgctcagtggaattttcggcaacgtgtttgtcggtatcttcttgtttctggcacctttcatactcctgattctgtttttcatgtttgggtggcggatcctgttctgttttaaatgctgccgaagaacacgcggattgttcaagtacaaacatctaaaggacgatgaagagaccggctataggcgtatcattgagcggctgaataacaaaaagggcaagaataaactcttagacggggaaagactggccgacaggcgcatcgctgagcttttctccactaagacacacataggatga

SEQ ID NO: 10298 - RNA, 5067 nt, synthetic construct
  misc_feature 1..5067: note = derived and/or modified CDS sequence (opt3) from CCHFV(Kosovo/9553/2001)__AY675511.1__GP
  source 1..5067: mol_type = other RNA
atgcccatcaacattatgcacaccctgctcgtgtgcttcatactttacctgcagttgttaggccttgggggagcccatggtcaaagcaatgctacagagcacaacggcactaatacgaccacagcacctgggacttcccagtctccaaagccgcccgcctcaaccacacctagtcatgcgccagaaagctccaccatcaaactaactacacccacctctgagacggaaggatcgggcgagactacccctccaacatcaactacccagggtagtccccctctcgaaacaaccccagagagaagtacgactacagctacctccacttctgggacagacaacatgaatagcaccacgcagatgaccgataacacaccgactctgaccgcctccacatcacccagtagctctccttccactccatcaaccagccaaggacttcactatcccgtcaggagtctgttgtctgtttccagccctaagacagtgaccactccaacgcccatgtcgccgggcgagatgtcttccgaaacatcaagtcagcatagcgcaatgtcccggacccctactccccacaccgccacacaggtatctaccgagaatgctaaccgcagcacttcacgacagagtgaatccagcgcacaaccagccacacagtctcctgtgacgtcacccgctcagagtattctcctgatgagcgccaccccaactacaatccagaatattcacccctcccctaccaaccgttctaaaagaaatctggagatggagatcatactcacattatcgcaaggcctgaagaaatactatgggaagatccttaagttgctgcatctaactctcgaagaggacaccgaaggactgcttgagtggtgtaaaaggaacctgggtagcaattgcgatgacgactttttccagaagcggattgaagagtttttcatcacgggcgaggggtactttaacgaagtcttgcagttcaaaaccctctccacaccatcaccgactgagcccagtcacgcgcgcctgcctaccgcagaaccatttaagtcttatttcgccaaaggatttttaagcattgattccggctacttctcagctaagtgttatcccagaagctctacatccggtctgcaactcatcaatgtgactcagcatcctgccaggatagcagagaccccagggcccaagattacgagtcttaaaacaatcaactgcattaacctgcgggctagcgtttttaaggaacaccgcgaggtggagatcaatgtcttgctaccgcagatcgccgtgaacctgtctaattgtcacgtagttattaactcccatgtgtgcgattactcactcgacaccgatggacctgtccgactgccaagaatataccacgaaggcactttcatgcccggcacatataaaatcgtgattgacaggaagaataaacttaacgatcggtgtaccctggtgactaattgcgtcatcaaggggcgtgaggttcgcaaaggacagagtgtgttgagacaatacaagaccgaaataaagattggtaaagcgcctacaggcagcaggaagctcctgtcggaggaacccggggacgattgtatctcccggacgcagttactgcgaaccgagactgccgagatccatgacgacaactatggaggcccaggtgataaaattacaatctgcaatgggtctaccattgtagaccagcgcctaggcagcgaactcggatgttacacaataaacagagtgaagtcatttaaactgtgcgagaatagtgcaactggcaagacctgcgaaatcgattccacgcctgtcaagtgtaggcaggggttctgccttaaaattacacaagagggacggggtcacgtgaagttgtctcgcggcagcgaggttgtgctggacgcttgtgattcctcatgcgaagtcatgatccccaaagggaccggagacatcctcgtggattgtagcggcggtcagcagcatttcctgaaggacaaccttattgatctggggtgcccacacataccgttgctcggcaaaatggccatctatattgctagaatgagtaatcaccctaagactaccatggcctttctgttctggttttctttaggatacgtaatcacatgtattctgtgcaaggcactattctattccctcatcataatcggcactctggggaaaaagattaaacagtacagggagcttaagccccaaacctgtacaatctgcgaaacggccccagttaacgctattgacgcggagatgcatgatttgaattgtagctacaacatctgcccctattgcgcatcgcgtctgacctcagacggactcgcccggcacgtgaaacagtgtcctaagcgaaaggaaaaagtcgaggagactgaactgtacttaaacctggagagaataccatgggtggtcaggaaacttctccaggtgtctgaaagtacaggtgttgctttgaaacgctccagctggctgattgtgctactggtactcctgaccgtctctcttagccccgtgcagtccgcccctgttggccatgggaagactatcgagacatatcaaacccgggaaggatttacgtcaatttgcttgttcatgctgggcagtatcttatttatagtgagctgtctcgtcaaaggtctggtggactctgtatccgattcattctttccggggcttagtgtgtgcaagacttgtagcatcggctccattaatggattcgagatcgagtctcacaaatgctactgttcgctgttttgctgtccatattgcagacactgtagcgcagacagggaaattcatcagttgcacctctcaatctgcaagaagcgcaaaaccggctccaacgttatgctggccgtctgcaagcgaatgtgtttccgggctacaatagaggccagtcgtagagcactactgattaggtctatcatcaataccacttttgtgatttgcatcctcacactgaccatttgtgtggcgagcacatccgctgtcgaaatggagactcttcccgccgcaacctgggaacgcgaggaggatttgacgaacttctgccatcaggaatgtcaagttcctgagacagaatgcctgtgtccatacgaggccttagtgctccggaaacccctgttccttgactcaatagtgaaggggatgaaaaatctgctaaactctaccagcctcgagactagcctgtccatcgaagctccttggggagccattaatgtacagagcacctttaagccgacagtctctactgcaaacatcgctttgtcatggtccagtgtggagcacagaggcaataagattctggttaccggtaggagcgaatcgatcatgaaattagaggaacgaacgggggtgtcttgggatctcggagtcgaggacgcctccgagagcaagctgcttacagtgtcaataatggatctgagtcagatgtattctcccgttttcgaatacttgtccggcgaccgccaggtggaggaatggccaaaagcgacctgcactggtgattgtcctgagcggtgcggctgtacaagctcaacctgcctccataaggaatggccccacagtagaaactggaggtgcaatccaacttggtgttggggagtagggacaggctgcacctgttgcggggtcgacgtgaaagatctgtttacggaccacatgttcgtgaagtggaaggtcgagtacatcaaaactgaggccattgtttgtgtggaactaaccagccaagagcgtcagtgctccctgatcgaagctggaacacgctttaaccttggccctgtaaccattacactctctgagccccggaatatccagcagaagctgccaccggaaataattactttgcatcctaaaatcgaggagggtttctttgatctgatgcacgtgcaaaaggtcttaagcgcatccaccgtgtgtaaactccagtcatgcacgcatgggatccccggagacctgcaggtttatcacattggcaaccttctgaagggtgacagagtgaatggccatttgatacacaagatcgaaccacacttcaacacatcttggatgagttgggatgggtgtgacctcgattactattgcaacatgggagactggccctcgtgtacttacaccggcgtcacacagcataatcacgccgcttttgtgaacctgctaaatattgagaccgattatactaaaaccttccattttcacagcaagagggttacagcccacggggacacgcctcaactggatcttaaagcacgaccaacttacggagcgggcgaaatcaccgtgctcgtcgaggtagccgacatggagctgcatacaaagaaagtggaaatttccggtttgaagttcgcttctttagcctgcaccgggtgctatgcatgttcaagcggaatctcctgcaaagttcggatacacgtggatgagcccgacgaactgactgtccatgtgaagagttctgatcctgacgtagtggctgccagcacatcactcatggcacgcaagctggagtttggcaccgattccacgttcaaagccttcagtgctatgccgaagactagcctttgtttttacatcgtcgaaaaagagtactgcaagtcttgttccgaggacgacacaaagaagtgcgttgataccaagctggaacagccacagtcaattttgatcgagcacagaggtaccattatcggcaaacccaacgacacttgtcctgcgaagacaagctgctggctagaatcggtgaaatctttcttttatgggctgaagaatatgctcggaagtgtgttcggcaactttttcatagggattctgctgtttttagcccccttctttctgtggatgctctccttcatgtttggatggaaaatcttgttctgtttcaagtgctgtaggcggacccgaggcctgtttaagtacagacatctcaaagatgacgaggaaacaggttatcgcaggatcattgagcgtctgaataacaagaaagggaagaatcggcttctggatggagagagattggcagacaggaaaatcgctgaactattcagcactaagacgcacataggctga

SEQ ID NO: 10299 - RNA, 5067 nt, synthetic construct
  misc_feature 1..5067: note = derived and/or modified CDS sequence (opt3) from CCHFV(200406546-Turkey)__KR864902.1__GP
  source 1..5067: mol_type = other RNA
atgcccaccaacatcacacacactctgctcgtgtgcttcattctttacctgcagttgttaggcagagggggagcccatggtcaaagcaatgctacggagcacaacggcaccaatacaactaccgcacctgggacatcccagtctcataagccactggtctcaaccactccgccccacacactagaaagtagcaccataaaacatacgactcctacctccgagacagaaggatctggcgagactaccccaccccctaacacaacccagggtccatcgccccctgaagccacgccagagaggccggcgactacagctacctcaactcccagcacagacaataccaacagtacgacccagatgaatgataacaatcctacatccactatctctaccagcccatcctcaagtcccagcacacctccaactccccaagggattcaccacccggcccggtctctcctgtccgtttcaagccttaagaccgcaacaacccctactcccacgagtccaggagagatctcttccgaaacaagctcgcagcattctgccatgtcccgcacccctactctgcacaccacaacccaggtgtcaactgagagtacaaaccatagcacgccccgacagtccgaatctagcgctcaaccaaccactccctcacctatgacaagtccagcacagtccattttgccgatgagcgccgctcccaccgccatccagaatatacacccttctccaacaaaccgttcaaaaagaaatctcgaggtagagatcattctgactctgagtcagggcctcaagaaatattacggcaagatcttaaagctgcttcacttgaccctggaagaggacacggaagggctactcgagtggtgtaaaaggaacctgggaagctcctgcgatgacgactttttccaaaagcggattgaagagtttttcgtgaccggtgagggctattttaatgaagtccttcagttcaaaacactgtctactttgtcgcccaccgagcctagccatgcgaagctcccaacagtggaaccctttaaatcctacttcgcaaaggggtttctgtcaatcgacagtggatatttctctgccaagtgttacccgcgcagctccacttcaggcttacagctgataaacgttacccaacaccctgctagaattgccgagacgccaggtcccaaaacaaccagcctcaagactatcaactgcattaatcttagggcatctgtgtttaaagaacatcgggagatcgagatcaacgtcctgttgcctcagattgctgtgaatctatccaactgtcacgccgtaataaagagtcatgtttgcgattatagcctggacacagatgggcccgtgcgcctcccacacatctaccacgaaggaaccttcattcctggcacttacaaaatcgtcatagacaagaaaaataagctgaacgatcgatgtattcttgtgaccaattgcgtgatcaagggcagagaggtcaggaaagggcagtctgttctgcggcagtataagacagaaatcaaaattggaaaggcgtccacgggttcacgtaaattgctcagtgaggaacccggcgacgattgtatcagccgcacccaactgttaagaactgagacagccgagattcatgacgacaactacgggggaccaggcgataagataaccatctgcaatggttcgacaattgtggaccagaggctggggtccgaactaggctgttatactatcaaccgggtaaagtcttttaaactctgcgagaatagcgcaaccggaaagacgtgcgaaatcgattcaacaccggtgaaatgtcgacagggcttctgcctgaagattacccaggaggggcgcggacacgtcaaacttagtagaggttccgaggtggttttggacgtgtgtgattctagctgcgaagtcatgatacctaagggcactggggacatcctggtggattgttccggaggccaacagcatttcctcaaggacaacctgattgatcttggttgcccccacgtaccactgttggggaggatggctatctacatttgtcggatgtcaaatcacccccgcaccacaatggcctttctcttctggtttagcttcggctatgttatcacttgcatattttgtaaagctctgttctacagtttaatcattatcggaaccctgggcaagaaatttaagcagtatagagagctaaaacctcagacatgcacgatttgtgaaaccgccccagtgaacgcaatcgacgccgagatgcatgatctcaattgctcttacaacatatgcccctactgtgcttccaggctgactagcgacgggcttgcgcgtcacgtccctcaatgcccgaagcggaaggaaaaagtggaggagacagaattgtatctgaacctcgagcgaatcccatggattgtcagaaagctgttacaggtgtcggaatcaaccggagttgcactgaaaaggtctagttggcttattgtgttgctcgtactgctaactgtctccctgagccccgtgcagtctgcccctgttggtcatggcaagacaatcgagacctaccagacgcgcgaagggttcactagcatatgtctctttatgctgggatccatccttttcattgtgtcatgcttggtcaaaggcctggtggacagtgtaagcgattcctttttcccaggtttatctgtgtgtaagacctgctcaatcgggagtattaatggctttgagatcgagagccacaaatgttattgctccctcttctgttgcccctactgtcggcattgctctgctgacagagaaatacaccaactgcacctttcgatttgcaagaagaggaaaacaggaagcaacgttatgctggccgtctgtaagcgcatgtgcttccgagcaaccatcgaggcctcacggcgtgctttgctcatcagatccattatcaatactacatttgtgatttgtatactgaccctaacaatctgcgtggtcagtacttctgccgttgaaatggagaacctgcctgcaggcacctgggaaagggaggaggatctcacgaatttctgtcatcaggaatgccaggtgacagagaccgaatgtctgtgcccgtatgaggcgcttgtgttgcgcaaacccctgtttttagacagcattgtaaaggggatgaaaaacctccttaattccacttcactggagacctctctgagcatcgaagctccatggggagccattaacgtccaaagtacattcaagcctactgtgtccaccgcaaatatcgccctaagctggtcttcaatagagcaccggggcaacaagatcctcgttacgggtagatccgaaagtattatgaaactggaggaaaggacaggggtgagctgggatttgggagtcgaggacgcttcggagtctaagctgttaaccgtgtccatcatggatctcagccagatgtactcacccgtttttgaatatctgagtggcgaccgacaggtggaggaatggccaaaagccacttgtacaggtgattgccctgagcgctgtggctgcacctcttccacttgccttcataaggaatggccccacagccggaattggagatgtaacccaacatggtgctggggtgtaggaaccggctgtacgtgctgtggggtcgacgtgaaagatctgttcactgaccatatgtttgtgaagtggaaggtcgagtacattaaaaccgaggcaatcgtttgcgtggaattgacatcacaggagaggcaatgtagtctcatagaagctggaacccgtttcaatctgggcccggtaacaattactctaagcgagcctcgcaacatccagcagaagctgcccccagaaatcattacccttcaccccaaagtggaggaggggtttttcgatctcatgcacgtccagaaggtgctgtccgcctctacggtttgcaaattgcaaagctgtacacatgggatacctggagacttacaggtgtaccacatcggcaatctgctcaagggtgaccgggtcaacggccatctgattcacaagatcgaaccacactttaacacttcctggatgtcatgggatgggtgcgaccttgattattactgtaatatgggagactggccctcttgcacctatacaggcgtgacccagcataaccacgcggccttcgttaatctgttgaacattgagactgattacaccaaaacatttcatttccacagtaagagagtgacggctcatggggacactcctcagctcgatctgaaagcaaggccgacctatggagccggcgaaatcacagtcctagtagaggtggctgacatggagctgcacaccaagaaagttgaaatatcgggtcttaagttcgccagcctcgcatgcactgggtgttacgcgtgctcctctggaatctcatgtaaagtgcggattcacgtcgatgagccagacgaactgacagtgcatgtaaagagctccgatcccgacgtggtcgccgctagtacctctttgacggcccgaaagttagagtttggcactgatagcacattcaaagcattttcagctatgcctaagacctccctgtgcttctatatcgttgaaaaagagtactgtaagagttgcaatgaggacgacacccaaaaatgtgtggatactaagctcgaacagccccagagcattctgatcgagcacaagggtacaataattggcaaacaaaacgatacctgcacagccaaggcatcttgttggcttgaatccgtgaaatcatttttctacgggctgaagaatatgttgggaagcgtctttggcaacttctttatcgggatcctactgttcctcgccccatttgtgctgcttgttttattcttcatgtttggatggaaaattctgttctgctttaagtgttgccgcagaactaggggcctcttcaagtatcggcatttgaaagatgacgaggaaacgggttacaagcgaatcatagagagactgaataacaaaaaggggaaaaatcgcctcctggatggagagaggcttgctgaccgtaagattgcggaactgttttcgaccaagacacacatcggctga

SEQ ID NO: 10300 - RNA, 5067 nt, synthetic construct
  misc_feature 1..5067: note = derived and/or modified CDS sequence (opt3) from CCHFV(Haskovo-V46/13)__KR092379.1__GP
  source 1..5067: mol_type = other RNA
atgcccaccaacatcatgcacacactgctcgtgtgcttcattctttacctgcagttgttaggcctagggggagcccatggtcaaagcaatactacggagcacaacggcaccaataacacaactgctcctgggacctcccagtctccaaagccgcatatgtcaacaactccccctcacgcaccagaaagtagcactataaaacccacaacccctacgtccgagactgaaggatctggcgagaccacaccaccctcgaatactacccagggtccttcaccaccggaaacaaccagcgagagacccgccacgactgcgatcagtacatcctctaccgacaacatgaatcctactagccagatgacagataacaccccaacgtccaccgtctcaattagtccctctagctccccttcaacaccaagcactccccaagggatgcatcacccggctaggagtctgctctctgtttccagccctaagaccgccacaactcccaccccaacatcgcctgtggaggtaggatctgaaacctcctcacagcacagtgcaatgagctccactcccacgccacatacagccacccaggtgtctactgagaataccaaccacagcacaccccggcagtcagaacctagtgctcaacagaccactccatccccgatgcccagccctgcacagtctacactgcttatgtcagccgctccaacggccgtccagaatacccatcccagtcctactaaccgcagcaaacgaaatctggagatggagatcattttgacactctcccaaggcctgaagaaatattacggcaagatcctgaagctcttacacctgacccttgaagaggacacagaagggttgctggagtggtgtaaacgtaacctaggatctaattgcgatgacgactttttccagaagagaatagaagagtttttcatgactggtgagggctattttaacgaagtgctccagttcaaaaccctgtcgacgcttagcccaatggagccctcccacgcggaactgccgaccgcagagccttttaagtcatacttcgccaaagggtttttgagtatcgactctggatatttcagcgctaagtgttacccaaggtcctcaacaagcggcctccaactgattaacgttactcagcatcccgcccggatcgcagaaacccctggtcccaagacaacttctttaaaagctattaattgcatcaacctgcgcgcctccgtgtttaaggagcacagagagatagaaattaatgtcctccttccacagatcgcggtgaacctgagtaattgtcatgtagttattaacagccacgtgtgcgattattctttggacaccgatgggcctgtcaggctaccccatatctaccacgagggaacgttcatcccaggcacatacaaaattgtgatagacaagaaaaataagctgaacgatcggtgtaccctcgtgactaattgcgtcatcaaaggccgcgaagttcgaaaggggcagtccgtgctgagacaatataagacagagattaaaatcggaaaggcctcaaccggtagtaggaaacttctgagcgaagagttgggcgacgattgtatatcgcggactcagctcctgcgtaccgagacagcagaaattcacgacgacaactacgggggaccgggcgataagatcacgatctgcaatggttccaccattgtagaccagcgcttagggtctgagctgggctgttatactatcaacagaggaaagagctttaaactatgcgaaaattcagctacaggcaagacctgcgagattgatagtacacctgtgaaatgtaggcaggggttctgcctcaagataactcaagagggacggggtcatgtcaaactgtcccgaggctctgaagtggttcttgacgcctgtgatagctcctgcgaggtgatgatccccaaggggaccggagacattttggtcgattgttcaggcggtcagcagcacttcctgaaagacaacctcatcgatctggggtgcccacatatcccccttctgggcaagatggctatttacatatgtcgcatgagcaatcaccctagaacgacaatggcctttttgttctggtttagtttcggatatgtgattacctgcatcttttgtaaggcactcttctactctctgatcattatcggcactttagggaaaaagataaaacagtatagggaactgaagccacaaacctgcacaatctgtgagactacccccgtaaacgccattgacgctgaaatgcacgatctaaactgctcctacaatatctgcccttactgtgcgagccggctcacatcggacggactggcacgccatgttacgcagtgcccgaaaagaaaggagaaggtggaggaaaccgagctttatttgaacctggaaaggattccatggatcgtccgtaaactcttacaggtgtcagagtctactggtgtcgccctgaagcggagttcctggctgatagtgcttttggttctcctgcccgtgagcctatctcctgtacagagcgctccagtcggccacgggaaaacaattgaaacctaccaaactcgagagggatttacatccatctgtctgttcatgctcggctcaattctgtttatcgtgagttgccttgttaagggtttggtggacagcgtcggggattctttctttcccggcctgtccgtgtgtaaaacctgctcaataggaagtatcaatggcttcgagattgaaagccataagtgttattgctccttattttgttgcccttactgtagacactgctctgccgacagggagatccatcagctccacctgtcgatttgcaaaaagcgcaagacggggagcaacgtaatgcttgcagtgtgtaaacggatgtgcttcagagccactatcgaggcttcaaggcgcgccctgttgatacgatccattatcaataccacattcgcaatgtgtatcctcaccctgactatttgcgttgtcagtacatctgcggtggaaatggaaaacctaccggctggaacctgggagcgggaggaagatctgacaaatttttgtcaccaggagtgccaagtgactgaaaccgagtgtctctgcccctatgaggccctggtccttcgtaagccattgttcctggacagcatcgttaaaggcatgaagaacttactcaattccacgtcactggaaacatctcttagcattgaggcaccttggggtgccataaacgtgcagagtacctttaaacccactgtgtccaccgctaatatcgccctgagctggtcttcagtagaacatagagggaacaagattctagtcacaggaaggtccgagagtatcatgaagctcgaggaacgcactggcgtgagctgggatctgggtgttgaggacgcatcggaatctaaattgctgaccgtgtccattatggatttaagccagatgtactcaccagtcttcgagtatctcagtggcgacagacaggtggaagagtggcctaaggctacgtgtacaggggattgccccgaacggtgtggatgcacctcttccacttgcctgcacaaagagtggccacatagcaggaattggcgatgtaacccgacatggtgctggggcgttgggaccggatgtacttgctgtggcgtggacgtaaaggatctttttacagaccacatgttcgtcaaatggaaggtggagtacatcaagaccgaagccatagtgtgcgtcgagctgacgtcacaagaacgccagtgtagtttgatcgaggcgggtactcggtttaatctcgggcctgttaccattacactgagcgaacccagaaacatccagcagaaactaccacccgagattatcaccctgcatcctaagatagaggaaggattctttgatcttatgcacgtgcaaaaagtactctccgcctctacagtgtgcaagctgcagagctgtactcacggcattccaggtgacttgcaggtctaccatatcggcaacctgttaaaaggggacagggtgaatggacacctcatccataagattgagccccacttcaacacctcctggatgtcatgggatggctgcgacctggattattactgtaatatgggggactggccttcttgcacgtatacaggagttactcagcacaaccatgctgcatttgtgaatcttctgaacatagaaaccgattacacaaagaccttccactttcatagtaaacgtgtcactgcccacggcgacaccccgcaattggatctcaaggctcgcccaacatatggtgccggggagatcacggtgctggttgaggtggcagacatggaactacatactaaaaaggtcgagatttcgggactgaaattcgcgagccttacctgcacaggctgttacgcctgctcctctggtatctcatgtaaggtacggattcacgtggatgaacccgacgagctcaccgttcacgtgaaaagctccgatcctgacgtcgtggctgccggcaccagtctgatggcaagaaagttggagttcgggacagattctacctttaaggctttcagcgccatgcccaaaacgtcattatgcttttatatcgtagaaagggagtactgtaagtcctgcagtgaagacgacactcagaaatgtgtggatacaaagctggagcagccacaaagcatactcatcgaacataaaggaaccattatcggcaagcagaatgatacctgcactgcacgagcctcttgttggctggagtccgtcaagtcattcttttacgggcttaaaaacatgctgggaagcgttttcggcaatttcttgattggtatcctactgtttctcgctccttttgtgctgcttgtgttattctttatgttcgggtggaagatactgttctgctttaaatgttgccggcgcacaagaggactcttcaagtataggcacttgaaagatgacgaagagaccggctaccggcgaattatcgagagactgaactcgaagaagggcaaaaatcgcctcctggatggggaaaggcttgcggaccgtaagatcgccgagctgttttctacaaaaactcatattggatga

SEQ ID NO: 10301 - RNA, 5067 nt, synthetic construct
  misc_feature 1..5067: note = derived and/or modified CDS sequence (opt3) from CCHFV(VLG/TI29414)__AY179961.1__GP
  source 1..5067: mol_type = other RNA
atgcccaccaacatcatgcacacactgctcgtgtgcttcattctttacctgcagttgttaggccttgggggagcccatatacaaagcaatgctactgagcacaacggtacgaataccacaactgcaccttccacctctcagtcaccaaagccgctagtcagtacagcgccccctcatgccctcgaaagctccaccatcaaaccaactacacccgtttctgagaccgaaggcagtgggggaacgactcctccacccaacaccacacagggcccttcaccaccggaggctactcccgaaagacctgccaccacagcaaccagcacgccaagtactgacaatacaaactccaccactcacgtgacagataataaccccacctctacgattagcacctccccttcaagtagcccatctacaccctccactccgcagggtatccatcaccctgccaggaatctgctttcagtaagcagtcccaagaccgctacaactccaacccctacatctcccggggacatttccagcgagacctcgtctctgcactccgcaatgtcacggacttcgacgttgtatacagccacccaagtgagcactgagaacgctaatcattccgccccacgccagtctgaaagctcagcgcagcagaccacaaccagtcccatgacttcccctgcacaaccaatcctcgtcatgagcgccgctccgacagccatacagaacatccacccctctcctacgaatcgatcaaaacgtaacctggagatggaaattatcctgaccctcagtcagggattaaagaaatactatggcaagattctgaaacttttgcatctgactctagaggaggatacagaaggcctcctggagtggtgtaagagaagccttgggtccaattgcgacgatgactttttccagaagaggatcgaagagtttttcatgaccggagaaggttactttaacgaggtgctgcaattcaaaacattgtctactctctcgccaaccgagcccagccacgcacggcctccaacggttgaaccctttaagtcctatttcgctaaaggctttctgtcaatagatagtgggtacttctctgccaagtgttatccgcgcttaagcacctccggactgcagctcattaacgtgacacagcaccctgcgagaatcgccgagactccaggccccaagaccacatcacttaaaactattaattgcatcaacctgagggcaagcgtctttaaggaacatcgggagatcgaaattaatgtgttgctacctcaaatagctgtaaacctgtctaattgtcacgttgtgatcaactcccatgtctgcgactacagtctcgataccgacggtcccgtgcgcctgccacacatttaccatgaggggacgttcatccctggaacatataaaatagtgattgataagaaaaataaacttaacgaccgatgtaccctggtcactaattgcgttatcaagggcagagaggtgaggaagggccagagcgtattgcggcagtacaagacagaaatcaaaattgggaaggcctctaccggatcccgtaaactcctgtcagaggaacccggtgatgactgtatcagtcgcactcagttactgagagctgagccagccgaaattcacgacgataactatggcgggccgggagacaagataaccatctgcaatggcagcacaattgtggatcaaaggctaggttcggagctcgggtgttacacgatcaaccgggtcaaatcctttaagctgtgcgaaaattctgcaaccggcaagacttgcgaaatcgacagcacacctgtgaaatgtcgacagggattctgccttaagattacccaggagggccgcgggcacgttaaattgtcaagaggaagtgaagtggtcctggatgcctgtgactcctcttgcgaggtgatgatacccaagggtacaggcgatatcctcgtagactgtagcgggggacagcaacatttcctgaaagataaccttattgacctgggctgcccacacatccccttgctcggtaagatggctatttatatctgtaggatgtccaatcatcctcggactaccatggcgtttctgttctggttttcattcgggtacgttataacgtgcatcttttgtaaggcattattctatagcctgattatcattggcacactagggaaaaagatcaaacagtaccgcgagctcaagccacagacctgcactatatgtgaaaccgcccccgtgaacgctattgatgccgagatgcacgacctgaactgcagttacaatatctgcccttattgtgcatctagacttacatccgacggcttggccaggcacgtcccgcagtgcccaaaacgtaaggaaaaggtggaggaaactgagctgtacctcaacctggagcggattccctggaatgtccgaaaattactgcaagtgagcgaatcgaccggggttgctcttaagagatcatcttggttgatcgtgctcctggtactactgacagtcagtctctcccctgtgcagagcgccccagttggacatggtaaaacgatagagacctatcagactagggaaggctttacatctatctgtctgttcatgcttgggagcattttgtttctggtgtcctgcttagtcaagggactcgtggattcagtaagtgacagcttctttcccggcctgtctgtgtgtaaaacctgctccatcggttcaattaacgggttcgagatcgaaagtcacaagtgttactgcagcctgttttgttgcccttattgtcgccattgctccgcagatcgggagatacaccagctgcatttgtctatttgcaaaaagagaaagatgggctcgaatgttatgctcgcggtctgtaaaaggatgtgcttccgcgctactatcgaggccagccgacgggcactgctaatccgttcaattatcaacacaaccttcgtgatttgtatactgacgctcactatctgcgtggtctccaccagtgccgttgaaatggagaatctgccgtctggaacatgggaaagagaggaagaccttaccaacttttgtcaccaagagtgccaggtgactgagacagaatgtttgtgcccctacgaggctctggtgttaaggaagccactcttcctggatagcattgtaaaaggcatgaagaatcttctgaactccaccaatctagaaacatcactctctatcgaggccccttggggagcaattaacgtccagagcacttttaaacccaccgtgagtacggctaatatcgccctgtcctggagctctgttgagcaccgcggaaacaagatattggtgacaggccggtcagaatccatcatgaagctggaggaaagaaccggtgtcagttgggacttaggggtggaggatgcgagcgaatcgaaactcctgactgtttctattatggacctttcccaaatgtatagcccagtgttcgagtacctgtcaggagataggcaggtagaggaatggcctaaggccacctgtacaggcgactgccccgagcgatgtggttgcaccagttctacttgcttgcataaagaatggccacactcccgcaattggcggtgtaacccgacgtggtgctgggaggtcggcacagggtgtacctgctgtggatggaacgtgaaggatctctttactgaccatatgttcgtgaaatggaaggtcgaatacatcaagacagaggctattgtttgcgtggagctgaccagccaggaaagacagtgttcactaatcgaggcaggcactaggtttaatctggggcctgtaacaataacccttagtgaaccccgtaacattcaacagaaactcccacccgagatcatcacgctgcaccctaaggtggaagagggattctttgatttgatgcatgtccagaaagtgctgagcgcctccactgtttgcaagttacagtcttgtacccacggcattccaggtgacctccaagtgtatcacatagggaatctgcttaaaggagaccgcgtcaacggccatctgatccacaagattgagccccatttcaatacaagctggatgtcctgggatggttgcgacttggattactattgtaacatgggcgactggccttcatgcacctacacagggatgactcagcacaatcacgctgcctttgtgaacctcctgaatatcgaaaccgattatacgaagacattccattttcactctaaacgggttactgcacatggagacaccccgcagctagatctgaaggcgagaccaacatacggcgccggggagattaccgtgcttgtcgaagtagctgacatggagctccacactaaaaaggtggagatcagtggactgaaattcgcctcgttggcatgcaccggctgttatgcttgcagctccggtatatcttgtaaggttaggatccatgtggatgaacccgacgagttaacagtccacgtgaaatcaaacgatcctgacgtaattgccgcaagcacgtccctgatggcccgaaagctcgagttcgggactgatagtacctttaaggctttctctgcgatgcccaaaacaagcctgtgcttttacatcgccgagcgggaatactgtaagtcatgctccgaggaggacacccagaaatgtgtggacactaaacttgaacaaccacagagtattctgatcgagcacaagggaacaataattggcaagcagaatgatacctgcacggcaaaggctagctgttggttggaatctgtcaaatccttcttttatggtctaaagaacatgctgggctcagttttcgggaactttttcatcggaatcctcctgtttcttgcccctttcgtgttactggtgctctttttcatgttcggctggaaaattttgttttgcttcaagtgttgccgcagaactagggggctgctcaaataccggctgcttaaggacgatgaggaaacaggatatcgaagaatcatagagcgcctgaataataagaaaggcaagaacaggttgctagacggtgagcgtctggccgatcggaaaattgctgaactctttagcaccaagacccatatcgggtga

SEQ ID NO: 10302 - RNA, 5067 nt, synthetic construct
  misc_feature 1..5067: note = derived and/or modified CDS sequence (opt3) from CCHFV(UCCR4405)__KY484029.1__GP
  source 1..5067: mol_type = other RNA
atgcccatcaacattatgcacgccctgctcgtgtgcttcatactttacctgcagttgagcggcttagggggagctcatagacaatccaatgcaaccgagcacaacggtacaaatactacgaccgcccctggcacatctcagtcaccaaagccgcccgtcagtactaccctgcctcatacaccagaagcgagcaccatcaaactaactacacccacctccgagacggaagggtctggagagactacccctccacccaacacaactcagggcctccctctgccaggtaccacaccggaaaggtcggctaccacggccacttcaacaagcagtaccgacgatatgaactccactacacagatgaccgacaatacgcccacctctacagttagcattgggctttcctcaagtcctagcatgccatctacttcccaaggaatccactatcccgtgcggtcactgttgagcgtaagttctcctaagaccgcaacaactccaacccccatgtccccgggcgaggtgagccctgagacatcgtctcagcattccgccatgtcacgcattcccaccctctacactgctacgcaggtcagtacagaaaataccaaccgaagcatcccacgtcagtccgagtctagcgtgcaacctgcaactcagtcacccataaccagtccagcccagacaatcctgctgatgtccgctgcccccaccgcgattcaggatatgcaccctagccccaaaaatagatctaagaggaacctcgaagttgagatcattttaactctgtcacaaggccttaaaaagtattacgggaagatcttgaaactgctacacctcacactggaggaagacacggagggacttctggaatggtgtaagcggaatttgggtagtaactgcgatgacgactttttccagaaacgcatagaggaatttttcattaccggcgaggggtattttaatgaggtgctccagttcaagactccgagcacactgtcccccaccgaaccttctcatgtcagattaccaacagcagagccctttaaatcgtacttcgccaagggatttctgagcatcgattccggctatttctcagctaagtgttaccctaggagttctactagcggtctccaacttattaacgtgacccagcacccagcccggatcgcagaaacgcccgggccgaaaaccacatccctgaagactatcaattgcattaacttgcgcgcttcagtatttaaagagcatcgagaagttgagataaacgtgctactgcctcagatcgccgtcaatctcagcaactgtcacgtggtgattaattctcacgtctgcgattactccctggacaccgatggaccagttagacttcccaggatccatcacgagggcgcgttcatacctggcacatataagattgtgatcgacaaaaagaacaaactgaatgatcggtgtagtttggtaactaactgcgtgatcaaggggcgtgaagtccgcaagggacagagcgtgctcagacaatacaaaaccgagattaagatcggtaaagcctctacgggctccaggaagctgttatcagaggaacccggggacgactgtattagtcggacacagctgctaaaaaccgaaactgcagagatacatgatgacaattatggaggcccaggtgataagatcacaatttgcaacgggagcaccatcgttgaccagcgactcggctcggagctgggatgttacactatcaatcgcgtgaagtcctttaaactttgcgaaaactctgctaccggcaagacatgcgagattgatagcacgcctgtcaaatgtagacaggggttctgcttgaagataacccaagaaggaaggggtcacgtgaaactgtcacggggcagtgaggtagttctcgacgcctgtgattcctcttgcgaggtgatgatccccaaggggactggagacattctggtcgattgtagcggcggtcagcagcatttccttaaggacaatctgatcgatttggggtgcccacacattccgctcctgggcaaaatggctatctatatatgtcgcatgtccaaccaccctagaacaaccatggcctttttattctggttttcattcggatacgtgatcacatgcatcttttgtaaggcactgttctatagcctaattattatcggcactctcgggaaaaagataaaacagtacagggaactgaagccccaaacctgcacgatttgtgagacagccccagtcaatgctatcgacgcggaaatgcatgaccttaagtgcagttacaacatttgcccctattgtgcatctcgtttgacctccgatggactggcccggcacgtgactcagtgccctaaacgaaaggagaaagttgaagagaccgagctctacctgaatttagaaagaatcccatggatagtgaggaagctgcttcaggtaagcgagtcgacaggtgtcgctttgaaacgctcatcttggctcatcgtgctgctagttctgctcactgtgagtctgtcccccgtccagagcgcccctgtgggccatgggaagaccattgaaacatatcaaacgcgggagggatttacctctatctgtcttttcatgttgggcagcattctgtttatcgtatcctgcttagtgaaaggtctcgttgactcagtcagtgatagcttctttccggggctgtctgtgtgtaagacttgctccataggctcaattaacggattcgaaatcgagagtcacaagtgttactgcagcctgttttgttgcccatattgtagacactactccgcagacagggagatccatcagctgcacttgtctatttgcaaaaagcgcaaaacaggctcgaacgtgatgctcgccgtctgcaagcgaatgtgtttcaaagctaccatcgaagccagccggcgtgcactgctaattagatcaataatcaatactacattcgttatttgcatcctgattctcgcgatctgtgtggtgtccaccagtgctgtagagatggaaaacctgcccgccgggacgtgggagagggaagaggatcttactaatttttgccatcaggagtgtcaagtcaccgaaacagagtgcttgtgtccttatgaagcactggtgttacgcaagccactcttcctggactctaccgttaagggaatgaaaaaccttctgaatagcacttccctagagacatcactctctatagaggccccctggggcgctatcaacgtgcagagcacctttaagcctacagtcagtactgccaatattgcactgtcctggagctctgtggaacaccggggtaacaaaatcttggttaccgggagatcagagtccattatgaagctggaagagaggacgggagtgagttgggatttaggcgtagaagacgctagcgagtcgaaactcctgacagtctctatcatggatctttcccagatgtacagcccggtgttcgagtacctgtcaggtgaccgacaggtggaagagtggcccaaggcaacctgcactggcgattgtccagaacgctgcgggtgtaccagttctacatgcttgcataaggagtggcctcactcccggaattggagatgcaaccccacttggtgttggggagtcggcaccgggtgcacgtgttgcggagttgacgtgaaagatctctttacagaccacatgttcgtaaagtggaaagtggaatatataaagaccgaggcgattgtctgtgtggagctgactagccaagaaaggcagtgctcactaatcgaggccggcacacgttttaatctgggtccagttaccatcactcttagtgaacctcgcaacattcagcagaaactcccaccagagataatcacactgcatccgaagattgaagaggggttctttgacttgatgcacgtgcaaaaggtcctgagcgcttccaccgtgtgtaaattacagtcttgcacgcatggaatccctggcgatctccagatttaccacatcggtaatctgcttaagggcgaccgggttaacgggcatctgatacacaaaatcgagccccacttcaatactagctggatgtcctgggatggatgtgacttggattattactgcaacatgggcaactggccatcatgtacctatacaggggtgacccagcataatcacgcagcctttgtcaacctcctgaatattgaaacagactacactaagaccttccattttcactctaaaagagtaacggctcacggagatacaccccaactagacctgaaggccaggcctacttatggcgccggtgagatcaccgtgcttgttgaagtggcggatatggagctccataccaaaaaggtcgagattagtgggctgaagttcgcctcgttggtgtgcacaggatgctacgcttgtagctccggcatctcttgcaaagtacgaatacacgtggacgaaccagatgagttaactgtccatgttaagtcaagcgaccccgatgtggtggccgcatccaccagtctgatggctcggaaactcgagttcggtacagactctatttttaaggccttcagcgcaatgcctaaaacgtcactgtgtttttacatcgtcgaacgcgaatattgcaagtcctgtagtgaggacgatactaagaaatgcgtggacaccaaacttgagcagccgcagagcatcctgattgaacacaaaggcacaatcatagggaagcaaaacgatacctgtactgccaaggcttcttgctggttggagtccgttaagtcattcttttacggactaaagaatatgctgggcagcgtattcgggaactttttcgtgggcattctcctgtttcttgcgccattcgtcttactggtgctctttttcatgttcggatggaaaatcttgttttgtttcaagtgctgtagaaggacacggggtctgtttaaatatcgacatctcaaggacgatgaagagaccgggtacagacgcattatcgaaaggcttaattcgaaaaagggaaagaaccgtcttctggacggcgagcggttggccgatagaaaaatagcagagctattctctacgaagactcacattggctga

SEQ ID NO: 10303 - RNA, 5067 nt, synthetic construct
  misc_feature 1..5067: note = derived and/or modified CDS sequence (opt3) from CCHFV(Ast133)__KX056060.1__GP
  source 1..5067: mol_type = other RNA
atgcccatcaacattaagcacaccctgctcgtgtgcttcatactttacctgcagttgagcggcttagggggagcccatggtcaatccaatgctacagagcacaacggcactaatacgaccacagtccctgggacttctcagtcaccaaaaccgcccgcaagtaccacacctccacatacccccgaaagctccactgttaagctgacaacccctacgtctgagactgaaggatcgggcgagaccacaccaccccctaacactacccagggtctaccactcccggggacaacccccgaaagatcagccacgactgcgacaagcaccagttccactgacaatatgaactctacaacccaggtgacggataatacccctacaagcactgtatccatctcaccaagtagctctccctccatgccttcaaccagccaagggattcaccatccagtgaggagtctgctttctgtctccagccccaaaacagtgactaccccgacacctatgtcgcccggcgagatgtctccagagacctcctcacagcactttgctatgagtcggatccctactctgtatacggccacacaggttagcaccgaaaacactgaccgctccacaccccgacagtctgagagctcagtgcaaccagcaacccagagtcccattacctcccctgcccagactatcttgctcatgagcgctgcaccaaaggccatacaggatatgcacccgtctcccacaaatcgttcaaaaagaaacctggaagtcgagatcattctgacgctcagtcaaggcttaaagaagtactatgggaaaatcctgaagctgttgcatctgaccctagaggaagacactgagggactcctggaatggtgtaaaaggaatcttggtagcaactgcgatgacgatttctttcagaagcggattgaggagttctttatcacaggcgaagggtacttcaatgaggtgctgcagtttaaaaccttgtccacactctctcctactgaaccatcgcacgtacgcctgcccaccgctgagcctttcaagagctattttgccaagggattcttatccatagactcaggctactttagtgcgaaatgttatccaagatctagcacgtccggtctgcaactcattaacgttacccagcatcccgcaaggatcgccgaaacaccggggcctaagactacctcacttaaaacaattaattgcatcaacctgcgggctagcgtgttcaaggagcaccgcgaagtcgagatcaacgtgttgctaccacagattgccgtgaatctgtctaactgtcacgtcgttataaattcccatgtgtgcgattacagtctcgacactgatggacccgtacgactgcctagaatccaccatgagggcacctttattcccggcacgtacaaaatcgtgatagacaggaagaacaaacttaatgatcggtgtagcctggtcacaaactgcgtgattaaggggcgtgaagttcgcaagggacagtctgtgttgagacaatataaaaccgagatcaagatcggtaaagcatccactggctcaaggaagctcctgagtgaggaaccagacgacgattgtattagccggacacagttactgaaaaccgaaactgctgagatccacgacgataattacgggggacctggcgacaagattaccatatgcaacggttcgacaatcgtcgatcagcgactagggtccgagctcggctgttatacgattaatcgcgtgaagtctttcaaactgtgcgaaaacagcgccaccggaaagacttgcgagatcgactcaacacccgtaaaatgtagacagggcttctgccttaagatcacccaagaagggaggggacatgttaaattgagtcggggttccgaggtggtcctggatgcgtgtgactctagctgcgagattatgataccaaagggcacaggggatatcctcgtggactgttccggaggccagcagcactttctgaaggataatcttattgacctgggttgcccgcacatccctttgctcgggaaaatggccatttacatctgtcgcatgtcaaaccatcccagaactaccatggcattcctgttttggttcagctttggctatgtcataacgtgcatcttctgtaaggctttattttacctgctaattatcattggaacactcggcaaaaagatcaaacagtatagggaactgaagccacaaacctgcactatatgtgagaccgcccccgtgaatgctattgacgccgaaatgcacgatcttaactgcagttacaatatctgcccttactgtgcatctcgtttgacatccgacgggctggcccggcatgttactcagtgcccaaagcgaaaagagaaggtggaagagaccgagctctatctgaacttagaaaggattccctggatcgtaagaaaactgcttcaggtcagcgagtcgacaggagtggctttgaagcgctcatcttggctcatagttctgctagtgctgctcacggtcagtctgtcccctgtgcagagcgcgccggtaggtcacggcaaaaccatcgaaacttaccaaacacgggaggggttcacctctatttgtctttttatgttgggaagcatcctgttcattgtgtcctgcttagttaagggcctcgtcgattcagtgagtgacagctttttcccaggtctgtctgtgtgtaaaacttgctccatcgggtcaataaacggctttgaaattgagagtcacaagtgttattgcagccttttctgttgcccctactgtagacattgctccgcagatagggagatccaccagctgcatttgtctatctgcaagaaacgcaagacaggatcgaatgtcatgctcgccgtttgtaaacgaatgtgcttcaaggctaccattgaagccagccggcgtgcactgctaatcagatcaattataaacacgacttttgtgatgtgtatcctgaccctcgccatttgcgtggtatccacaagtgctgtcgagatggaagacctgcctgccggcacctgggagagggaagaggatcttactaatttctgtcaccaggagtgccaagtgacagaaaccgagtgtttgtgcccatatgaagcactggttttacgcaaacccctcttttctgacagcatcgtgaaggggatgaagaacctgcttaattccacatcactggagacttctctaagcattgaggcgccttggggagctatcaacgtccagagtaccttcaaaccgacggtgtccacagccaatatagcactcagctggtcttcagttgaacatcggggcaacaagatcctggtgaccggtagatccgagagtattatgaaattggaagagaggactggggtaagctgggatctgggagtcgaagacgcctcggagtctaagttactcaccgtgtccatcatggatctgagccagatgtactcacccgtgtttgagtatcttagtggcgaccgacaggtcgaagagtggccaaaagctacatgtactggtgattgccctgaacgctgtggctgcacctcttccacgtgcctgcacaaggagtggccccacagccggaattggagatgtaacccaacatggtgctggggagttggaaccggctgtacttgctgtggggtggacgtaaaggacttgttcacagatcatatgtttattaaatggaaggtggaatacatcaaaaccgaggccatagtctgcgtggagctcacttcacaagaaaggcagtgtagtctgattgaggcaggaacacgtttcaatctaggccctgttaccatcacgctgagcgaaccccgcaacatccagcagaaacttccaccggagattataactctccaccctaaaatcgaagaggggtttttcgacctgatgcatgtgcaaaaggtcttgtccgcttctaccgtgtgcaagctgcagagctgtacacacggtattcccggagatttacagatctaccatattggcaatctcctgaaaggtgaccgggttaacggccaccttatccacaagatagagccacattttaatacctcctggatgtcatgggatgggtgcgacctggattattactgtaacatgggagactggccctcttgcacatatactggcgtgacccagcacaaccatgccgcgttcgtcaatttgctcaacatcgaaacggattacacaaaaacttttcacttccacagtaagagagtaaccgcccatggggacacacctcaactggatctaaaagctaggccaacctatggagcaggcgagattactgtgctggttgaagtggccgacatggagcttcacaccaagaaagtcgagatctcgggtctcaagttcgctagcctgacatgcacggggtgttacgcctgctcctctggaatttcatgtaaggtgcgaatccatgtagatgaacccgacgagttgactgtgcacgtcaaaagctccgaccctgatgttgtggcagcgagtacctctttaatggcccggaagctggaatttggcacagacagcaccttcaaggctttttcagccatgccgaagacttccctctgcttctatatagtggagcgcgaatactgtaaaagttgcagcgaggatgacacaaagaagtgtgtcgataccaaactggagcagccacagtctattcttatcgaacataagggtacgatcattggcaaacaaaatgacacttgcacagcaaaggcttcctgttggctggagtcagtgaaatcgtttttctacgggttgaagaacatgctaggaagcgtttttggctctttctttgtagggatccttctcttcctggccccctttgtgcttttagtcctgttcttcatgtttggatggaagatactcttctgctttaaatgttgcagaaggacccggggcttgttcaagtatcgacacctgaaagatgacgaagagaccggttacagacgcattatcgaaaggctcaatagtaagaaagggaagaaccgtctgcttgatggagagcggctggcagacagaaagattgccgagttgttttccagcaaaactcacatcggctga

SEQ ID NO: 10304 - RNA, 5067 nt, synthetic construct
  misc_feature 1..5067: note = derived and/or modified CDS sequence (opt3) from CCHFV(Ast137)__KX056057.1__GP
  source 1..5067: mol_type = other RNA
atgcccatcaacattatgcacaccctgctcgtgtgcttcatactttacctgcagttgagcggcttagggggagcccatggtcaatccaatgctacagagcacaacggcactaatacgaccacagtgcctgggacttctcagtcaccaaagccgcccgcaagtaccacactgcctcataccccagaaagctccactgttaaactaacaacccccacgtctgagactgaaggatcgggcgagaccacacctccacccaacactacccagggtctccctccaccggggacaacccccgaaagacctgccacgactgcgacatcaaccagcagtactgacaatatgaactccacaacccaggtgacggataataccccaacatctactgtaagcatctccccctcaagtagcccttctatgccatccacctcacaaggcattcactatcccgtgaggagcctgcttagtgtctcttccccgaagacagtgactacccctacacccatgagcccaggagagatgtcgcctgagacctcttcccagcattcagctatgagtcggatccccactctgtacacggccgcacaggttagcacagaaaacaccaatcgctccactccacgacagtctgagagctcagcccaacccgctacccagagtcctacaacctttccagcacagactattttgctcatgtccgccgctccgaaagccatccaggacatgcaccccagccctacaaaccgttctaagagaaatctggaagtggagataatcctgacgctctcacaaggcctgaaaaagtattacgggaagattttaaaacttttgcacctgaccctagaggaagatactgagggactcctggaatggtgtaagaggaaccttggtagtaattgcgacgatgacttctttcagaaacggatcgaggagttctttattacaggcgaagggtatttcaacgaggtcctgcagtttaagaccttgagcacactctccccaactgaaccctctcatgtgcgcctgcctaccgcggagccattcaaatcgtactttgcaaagggattcttaagcatcgattccggctatttttcagccaagtgttaccccagaagttctacgagcggtctgcaactcataaatgtaacccagcacccggctaggattgccgaaacacctgggccaaaaactacctcccttaagacaatcaactgcattaacctgcgggcatcagttttcaaagagcatcgcgaagtggagatcaatgtcttgctaccccagatcgctgtgaacctgagcaattgtcacgtggtcattaactctcacgtttgcgactactccctcgatactgacggacctgtgcgactgcccagaatacatcacgagggcacctttatcccaggcacgtataagattgtaatcgataaaaagaataaacttaacgacaggtgtagtctggtgacaaattgcgtcataaaggggcgggaagtgcgtaagggacagagcgttttgcgccaatacaaaaccgagattaagatcggtaaagcctctactggctccagaaagctcctgtcagaggaacctggggatgactgtatcagtaggacacagttactgaaaaccgaaactgcggagattcatgacgataactatggaggccccggtgacaagatcaccatttgcaatgggagcacaatagtggatcagcggctaggctcggagctcggatgttacacgatcaaccgagtcaagtccttcaaactgtgcgaaaattctgccaccggcaagacttgcgagattgacagcacaccagtgaaatgtcgccaggggttctgccttaagatcacccaagaaggaagaggtcacgtaaaattgtcaaggggcagtgaggttgtgctggatgcatgtgactcctcttgcgagatcatgattccgaaggggacaggagatatactcgtcgactgtagcggcggtcagcagcattttctgaaggataaccttatcgacctggggtgccctcacattcccttgctcggcaaaatggctatccacatttgtcggatgtccaatcatccacgcactaccatggccttcctgttttggttctcatttggatatgtgatcacgtgcatattctgtaaggctttattttacagcctgatcattatcggcacactagggaaaaagattaaacagtatagagaactcaagccccaaacctgcactatctgtgagaccgcccctgtcaacgcaatagatgccgaaatgcacgacctgaattgcagttacaacatttgcccatactgtgcttctaggcttacatccgacggattggcgcgtcatgtgactcagtgccccaagcggaaagagaaggttgaagagaccgagctgtatctcaacctggaacgaatcccttggattgtgagaaaattactgcaggtaagcgagtcgacaggtgtcgcacttaagaggtcatcttggttgatcgtgctcctggttctactgacggtgagtctctccccggtccagagcgccccagtgggccacgggaaaaccatagaaacttaccaaacacgcgagggattcaccaatatctgtctgtttatgcttggctctattttgttcatcgtaagctatctggtgaagggtttagttgattccgtctcagactcatttttccccgggctcagcgtgtgcaaaacttgttctattggctccatcaacggatttgaaatagagtcacacaagtgctactgtagtctgttctgctgtccttattgccggcattgtagcgctgatagagagattcaccagcttcatctgggcatctgcaagaaaaggaagacagggtccaatgtgatgttggccgtctgcaaacgcatgtgtttcaaggcaaccatcgaagcctctcgacgggctctcctgattcgttcgatcattaacacgacttttgttatatgcatcctaaccctggccatttgtgtggtgagcacatcagcagtagagatggaaaatctcccagcgggaacctgggagagagaagaggacctgactaacttctgccaccaggagtgtcaagtcacagaaaccgagtgcctttgtccctacgaggctttggtgctgaggaaacctttatttctcgattccatcgttaagggcacaaagaatctgcttaacagtacttctctggaaaccagcctatccattgaggccccgtggggtgcaatcaatgtgcagtcaacgttcaaacccacagtctctaccgccaacatagctctcagctggagttccgtggaacatcgcgggaataagatcctggttactggacggagcgagtctattatgaaattggaagagagaaccggcgtgtcatgggacctgggtgtagaagatgcctccgagagtaagttactcacagtcagcatcatggacctgtcgcagatgtattctccagtgtttgagtacctttccggcgatcgacaggtggaagagtggcctaaagcaacttgcaccggggactgtcccgaaaggtgcggatgtacgagctcaacatgcctgcacaaggagtggccacacagtcgcaactggcggtgcaatcctacctggtgttggggcgtcgggactggatgcacatgttgcggcgttgatgtgaaggacttgttcaccgatcatatgtttattaaatggaaggtagaatacatcaaaactgaggctatagtgtgtgtcgagctcacatctcaagaaagacagtgctccctgattgaggccggtaccaggttcaacctagggcccgtgacgatcactctgagcgaaccacgtaatatccagcagaaacttccgcctgagattataaccctccaccccaaaatcgaagagggatttttcgacctgatgcatgttcaaaaggtgttgtcagcgagtacagtctgtaagctgcagagctgcacccacggcattccaggtgacttacagatctatcatattggcaacctcctgaaaggggatcgccttaacggacacctgatccacaagatagagccccattttaatacatcctggatgtcttgggacggctgtgatttggactactattgcaacatgggggattggcctagctgtacttacaccggagtgacgcagcacaatcatgccgctttcgttaacctcctgaatatcgaaacagactatactaaaacctttcacttccactccaagcgggtgacagcacatggcgataccccacaactagacctgaaagccagacccacttacggtgctggggagattaccgtccttgtagaagtggccgatatggagctccacacaaagaaagttgaggtgtcaggactgaagttcgcatctttggcgtgcacgggctgctatgcctgtagttcgggtatcagctgcaaggtcaggattcatgtggacgaacctgatgagttaactgtacacgtgaaatcctctgacccggatgtcgttgctgcctcaaccagcctgatggcacgaaagctcgaatttggcacagactccaccttcaaggcttttagtgccatgccaaagacttctctgtgtttctacatcgtggagcgggaatactgcaaaagctgttcagaggacgatacaaagaagtgcgtggacaccaaacttgagcagccccagtccatactgattgaacataaggggacgatcatcggaaaacaaaacgatacttgtacagcaaaggccagttgctggttggagagcgtcaaatcctttttctatggcctaaagaatatgctggggtctgtgtttggaaacttctttgttggcattctcctgttccttgctccttttgtattactggtcctcttcttcatctttggttggaagatattgttctgttttaaatgctgtcgcagaaccagggggctgttcaagtaccggcacctcaaagacgatgaagagaccggatatcgaaagattatcgaaagactgaatagtaaaaagggcaagaaccgccttctggacggcgagaggttggcggatcgtaaaattgccgagctatttagcactaagacacacatcgggtga

SEQ ID NO: 10305 - RNA, 5067 nt, synthetic construct
  misc_feature 1..5067: note = derived and/or modified CDS sequence (opt3) from CCHFV(Ast149)__KX056054.1__GP
  source 1..5067: mol_type = other RNA
atgcccatcaacattatgcacaccctgctcgtgtgcttcatactttacctgcagttgagcggcttagggggagcccatggtcaatccaatgctacagagcacaacggcactaatacgaccacagcacctgggacttctcagtcaccaaagccgcccgccagtaccacacctccacatacccccgaaagctccactgtcaaactgacaacccctacgtctgagactgaaggatcgggcgagaccacaccaccccctaacactacccagggtctaccaccgcccgggacaacccctgaaagaccagcgacgactgctacatcaaccagcagtactgacaatatgaactccacaacccaggttacggataatacccccacatctactgtgagcacctccccttcaagtagcccatctatgccctccacatcacaaggaatccactatccggtaaggagcctcctgagtgtgtcttcccctaagactgtcaccacacccaccccaatgagccctggcgagatgtcgcccgagacttcttcccagcattcagccatgagtcggattccaacgctttacacagcagcccaggtgagcaccgaaaacgctaatcgctccactccccgacagtctgagagctcagcacaacctgccacccagagtccaacaacctttccggctcagactatcctgttgatgtccgccgcgcccaaagcaattcaggacatgcaccctagcccaacaaaccgttctaagagaaatctcgaagttgagatcatactgacgctgtcacaaggcctcaaaaagtattacgggaagatcttaaaactgcttcacttgaccctggaggaagatactgagggactactcgaatggtgtaagaggaacctgggtagtaattgcgacgatgacttctttcagaaacggattgaggagttctttatcacaggcgaagggtatttcaacgaggtgcttcagtttaagaccctgagcacattgtcccccactgaaccttctcatgtccgcctcccaaccgccgagcccttcaaatcgtactttgctaagggattcctgagcattgattccggctatttttcagccaagtgttacccgagaagttctacgagcggtttacaactgatcaatgtgacccagcaccctgcaaggatagctgaaacaccagggcccaaaactacctccctcaagacaattaactgcatcaaccttcgggcctcagtattcaaagagcatcgcgaagttgagattaatgtgctgttgcctcagatcgcggtcaacctaagcaattgtcacgtggtgatctactctcacgtctgcgactattccctggatactgacggacccgttcgactcccaagaatacatcacgagggcacctttatacctggcacgtacaagatcgtgattgataaaaagaacaaactgaatgacaggtgtagtcttgtaacaaactgcgtgatcaaggggcgggaagtccgtaagggacagagcgtgctgcgccaatataaaaccgagataaagattggtaaagcctctactggctccagaaagttgctctcagaggaacccggggatgactgtatcagtaggacacagctgttaaaaaccgaaactgcagagatccatgacgataattacggaggcccaggtgacaagattaccatctgcaacgggagcacaattgttgatcagcggctgggctcggagctaggatgttatacgataaatcgagtgaagtccttcaaactctgcgaaaactctgctaccggcaagacttgcgagatcgacagcacaccggtcaaatgtcgccaggggttctgcctgaagattacccaagaaggaagaggtcacgtgaaactttcaaggggcagtgaggtagttttggatgcctgtgactcctcttgcgagatcatgatccctaaggggacaggagatattctggtggactgtagcggcggtcagcagcattttctcaaggataatctgatagaccttgggtgcccccacatcccactgttgggcaaaatggctatttacatctgtcggatgtccaaccacccccgcactaccatggccttcctcttttggttctcatttggatatgtcattacgtgcatcttctgtaaggcactgttttacagcttaataatcattggcacactggggaaaaagatcaaacagtacagagaactaaagcctcaaacctgcactatttgtgagaccgccccagtgaatgctatcgatgcggaaatgcatgacctcaactgcagttataatatatgcccctactgtgcatctaggctgacatccgacggacttgcccgtcacgtcactcagtgccctaagcggaaagagaaggtggaagagaccgagttgtatctgaacctcgaaaggattccgtggatcgttagaaaactgttacaggtgagcgagtcgacaggtgtagctctgaagaggtcatcttggcttattgtcttgctcgtgctgctaacggttagtctgtccccagtgcagagcgcccccgtcggccatgggaaaaccatcgaaacttaccaaacacgcgagggattcaccaacatatgtctctttatgctgggctctatccttttcattgtgagctgcttggtaaagggtctggtggattccgtttcagacagtttcttccctgggttaagcgtctgtaaaacttgctctatcggctccattaatggatttgaaatcgagtcacacaagtgttattgcagtctcttctgttgcccatactgtcggcactgcagcgcagatagagagatacatcagctgcaccttggcatttgcaagaaaaggaagacagggtccaacgtgatgctggccgtgtgtaaacgcatgtgcttcaaggctaccatcgaagcctctcgacgggcattgcccatccgttcgattatcaatacgacttttgtcatttgtatactcaccctggcgatctgcgttgtgagcacatcagctgtggagatggaaaacctacctgccggaacctgggagagagaagaggacctgactaatttctgtcatcaggagtgccaagtaacagaaaccgagtgtctctgcccgtatgaagcactggtccttaggaaacccttgtttctggattccattgtgaagggcatgaagaacttactcaatagtacatctctggagactagcctttccatcgaggccccatggggtgctattaacgttcagtcaaccttcaaacctacggtgtctacagccaatatcgcactgagctggagttccgtcgaacaccgcgggaacaagattctagtgaccggacggagcgagtctatcatgaaactcgaagagagaactggcgtttcatgggacctgggtgtggaagatgcttccgagagtaagttgctgaccgtaagcattatggacttatcgcagatgtactctcccgtctttgagtacctctccggcgatcgacaggtggaagagtggccaaaagccacatgtactggggactgccctgaacgatgtggatgcaccagctcaacgtgcctgcataaggagtggccccacagtcgcaattggcggtgtaacccaacatggtgctggggcgtggggaccggatgtacttgctgtggcgtcgatgttaaggaccttttcacagatcacatgtttatcaaatggaaggtggaatatattaaaaccgaggcgatcgtatgcgtggagctgacttctcaagaaagacagtgttccttgatagaggccggtacaaggttcaatctcgggccggtcaccattacgctgagcgaacctcgtaacatccagcagaagctacccccagagatcattactctgcatcccaaaatagaagagggatttttcgaccttatgcacgtgcaaaaggttctctcagctagtaccgtgtgcaagctgcagagctgtacacatggcatccctggtgacttgcagatttaccacatcggcaatctgttaaaaggggatcgcctcaacggacatctgattcacaagatcgagccacactttaacacctcctggatgtcttgggacggctgcgatcttgactattactgtaatatgggggattggcccagctgcacatatactggagtcacccagcataaccacgcagccttcgtgaatctgttgaacatagaaacggactacacaaaaacttttcatttccactccaagcgggttaccgctcacggcgatacacctcaactcgacctgaaagccagaccgacctatggtgcaggggagatcactgtgctagtcgaagtagcggatatggagctgcataccaagaaagtggaggtttcaggacttaagttcgcctctctcgcttgcacaggctgttacgcctgcagttcgggtattagctgtaaggtgaggatccacgtcgacgaaccagatgagctgacggtgcatgtaaaatcctctgaccccgatgtggtcgcagcttcaactagcttgatggcccgaaagttagaatttggcaccgactccacattcaaagcatttagtgccatgcctaagacctctctgtgcttctacattgttgagcgggaatattgtaaaagctgctcagaggacgatactaagaagtgtgtggacacaaaactcgagcagccccagtccatcctgatagaacacaaggggaccattatcggaaaacaaaatgatacgtgcactgctaaggcgagttgttggcttgagagcgtgaaatcatttttctacggcctgaagaacatgttggggtccgtctttggaaatttctttgtgggcatcctactgttcctcgccccatttgttctgcttgcattattcttcatttttggttggaagatcctgttctgctttaaatgttgccgcagaacaagggggctctttaagtatcggcatttgaaagacgatgaagagaccggataccgaaagataattgaaagactgaactctaaaaagggcaagaatcgcctcctggacggcgagaggcttgctgatcgtaaaatcgccgagctgtttagcaccaagactcacattgggtga

SEQ ID NO: 10306 - RNA, 5067 nt, synthetic construct
  misc_feature 1..5067: note = derived and/or modified CDS sequence (opt3) from CCHFV(Ast199)__KX056051.1__GP
  source 1..5067: mol_type = other RNA
atgcccatcaacattatgcacaccctgctcgtgtgcttcatactttacctgcagttgagcggcttagggggagcccatgtccaatccaatgctacagagcacaacggtactaatacgaccacagttcctggcacttctcagtcaccaaagccgcccgcaagtaccacactgcctcataccccagaaagctccactgtgaaactaacaacccccacgtctgagactgaagggtcgggagagaccacacctccacccaacactacccagggcctccctccaccgggtacaacccccgaaagacctgccacgactgcgacaaccacttcaagcacagacaatatgaacagtaccacgcaggtaaccgataatacaccaacttccaccgtgtctatcagcccctcctcaaaccctagtatgccaagcacatctcaagggattcactatcccgtcaggtccctgctttcagtgagcagtccgaagactgttaccacacctacccccatgtctccaggagagatgtcccctgagactagctcgcagcattctgctatgtcccggatccccacgctgtacacagccgcacaggtgtcaaccgaaaatactaaccgcagtaccccacgacagagcgagtcctctgcccaacccgctacacagagccctaccacttttccagcacagacaattccgttgatgtcagccgctcccaaagccatccaggacatgcaccctagtccaacgaatcgttccaagagaaacctcgaagtcgagataatcctgaccctgagccaaggcctcaaaaagtattacggcaagattttaaaactgcttcacttgactctggaggaagatacagaggggctactcgaatggtgtaagaggaatctgggatctaactgcgacgatgacttctttcagaaacggatcgaggagttctttattaccggtgagggctatttcaatgaggtgcttcagtttaagacaccctcaactctgagtcctaccgaaccaagccatgtacgcttgcccacggcggagccgttcaaatcctactttgcaaaggggttcctctctatcgattcgggatattttagcgccaagtgttaccctagatcctcaaccagtggcctgcaattaataaacgttacacagcacccagctaggattgccgaaactcccggtcctaaaaccacatctctgaagactatcaactgcattaatctccgggcaagcgtgttcaaagagcatcgcgaagtcgagatcaacgtgcttctgccccagatcgctgtgaatttgtccaactgtcacgtcgttattaattcacacgtgtgcgactacagcctagataccgacgggccagtacgactgcctagaatacatcacgagggaacgtttatccccggcacatataagattgtgatcgataaaaagaacaaactcaatgacaggtgttctctggtcaccaactgcgtgataaagggccgggaagttcgtaaggggcagtccgtgcttcgccaatacaaaactgagattaagatcggaaaagccagtacaggtagcagaaagctgttgtctgaagaaccaggcgatgactgtatctccaggacccagctcctgaaaactgaaaccgcggagattcatgacgataattatgggggaccgggcgacaagatcacaatttgcaacggttcaacgatagtcgatcagcggttagggagtgagctgggctgttacaccatcaatcgagtaaagagcttcaaactatgcgaaaactcggccactggaaagacatgcgagattgactccacccctgtaaaatgtcgccagggcttctgcctcaagatcacacaagaagggagaggacacgttaaactgtctaggggtagcgaggtggtccttgatgcatgtgactcaagttgcgagatcatgattcccaagggcactggggatatattggtggactgttccggaggccagcagcattttctgaaggataatctcatcgacctgggttgcccacacattccccttctggggaaaatggctatctatatttgtcggatgtctaaccaccctcgcaccacgatggccttcttgttttggttcagctttggctacgtcatcacatgcatattctgtaaggctctcttttattccctgatcattatcggaaccttaggcaaaaagattaaacagtacagagaactgaagccacaaacttgcaccatctgtgagacagcccccgtgaatgcaatagatgccgaaatgcatgacctaaactgctcatacaacatttgcccttattgtgctagcaggctcaccagtgacgggctggcgcgtcacgttactcagtgcccgaagcggaaagagaaggtggaagagacagagctttacttgaatctggaacgaatcccatggattgtaagaaaactcctgcaggtctctgagtccacgggagtggcattaaagaggtgtagctggctgatcgttcttttggtgctcctgaccgtctcgctatcacccgtgcagtctgcccctgtaggtcatggcaaaactatagaaacatatcaaacccgcgaggggttcactaacatctgcctgtttatgctcggaagtattctgttcatcgtgtcctgtcttgttaagggcttggtcgatagcgtgtctgacagctttttcccaggtctgtccgtgtgcaaaacatgttcaattgggagtatcaatggctttgaaatagagagccacaagtgctactgttctttattctgctgtccctattgccggcactgctccgctgatagagagattcatcagctccacctgggaatctgtaagaaaaggaagaccggctcaaacgtcatgcttgccgtttgcaaacgcatgtgtttcaaggcaacgatcgaagccagtcgacgggctctgttgattcgtagcatcattaatactacctttgtgatatgcatcctcacactggccatttgtgtggtatccacctctgcagtcgagatggaaaacctacctgcggggacttgggagagagaagaggacctgacaaatttctgccatcaggagtgtcaagtgaccgaaacagagtgcctctgtccgtacgaagctctggttcttaggaaacccttgtttctggattcgatcgtgaagggaatgaagaacttactcaatagcacttcactggagacctcccttagtattgaggccccatggggcgcaatcaacgtccagtctacgttcaaacctacagtgagcaccgccaatatagctctgtcctggtcatctgttgaacaccgcggtaacaagatcctagtgactgggcggagcgagagtattatgaaactcgaagagagaaccggagtatcctgggacctgggcgtcgaagatgccagcgagtctaagttgctgacagtgtcaatcatggacttatcccagatgtatagtcccgtgtttgagtacctcagcggtgataggcaggtcgaagagtggccaaaagcaacttgcaccggcgactgtcctgaacgatgcgggtgcacgtcgtctacatgtctgcataaggagtggccccactcccgcaattggcggtgcaacccaacctggtgttggggagttggcactgggtgcacatgttgcggagtggatgtaaaggaccttttcaccgatcacatgtttattaaatggaaggtggaatacatcaaaactgaggctatagtctgtgtggagctgacaagccaagaaagacagtgctcattgattgaggccggcaccaggttcaatctcggtccggttacgatcactctgagtgaacctcgtaacatccagcagaagctacccccagagattataaccctgcatcccaaaatcgaagaggggtttttcgaccttatgcacgtgcaaaaggtcctctctgcgtccacagtgtgtaagctgcagagctgcacccatggcattcctggagacttgcagatctatcacattggtaacctgttaaaaggcgatcgcctcaatgggcatctgatccacaagatagagccacactttaacacatcatggatgagttgggacggatgtgatcttgactactattgcaatatgggcgattggcccagctgcacttacaccggggttacgcagcataaccacgccgctttcgtgaatctgttgaacatcgaaacagactatactaaaacctttcatttccactccaagcgggtcacagcacacggagatacccctcaactcgacctgaaagccagaccgacttacggcgctggtgagattaccgtgctagtggaagttgccgatatggagctgcatacaaagaaagtggaggtctctgggcttaagttcgcaagcctcgcgtgtacgggatgctatgcctgttcctcaggcatctcttgcaaggtgaggattcacgtagacgaaccagatgagctgactgtgcatgtcaaaagttcggaccccgatgttgtggctgccagcacctccttgatggcacgaaagttagaatttggtacagactctaccttcaaggctttttcagccatgcctaaaactagcctgtgtttctacatcgtggagcgggaatactgcaaatcctgtagtgaggacgatacaaagaagtgcgtcgacaccaaactcgagcagccccagtctatactgattgaacacaagggcacgatcatcgggaaacaaaatgatacttgtacagcaaaggccagctgctggcttgagtcagtgaaatcctttttctatggactgaagaacatgttgggcagtgtttttgggaatttctttgtaggcattctactgttcctcgctccatttgtgctgcttgtcttattcttcatctttggatggaagatactgttctgttttaaatgctgccgcagaaccaggggtctcttcaagtaccggcatttgaaagacgatgaagagaccgggtatcgaaagattatcgaaagactgaacagcaaaaagggaaagaatcgcctcctggacggcgagaggcttgcggatcgtaaaattgccgagctgttttctactaagacacacatcggctga

SEQ ID NO: 10307 - RNA, 5067 nt, synthetic construct
  misc_feature 1..5067: note = derived and/or modified CDS sequence (opt3) from CCHFV(Saf)__KX013487.1__GP
  source 1..5067: mol_type = other RNA
atgcccaccaacatcatgcacacactgctcgtgtgcttcattctttacctgcagttgttaggccttgggggagcccatggtcaaagcaatgctactgagcacaacggcacgaataccacaactgcaccttccacctctcagtcaccaaagccgctagtcagtacagcgccccctcatgccctcgaaagctccaccataaaaccaactacacccgcttctgagaccgaagggtcgggagagacgactcctccacccaacaccacacagggcccttcaccaccggaaactacccccgagagacctgccacaaccgcaacgagcactccaagtacagacaataccaactccactacacacgttaccgataataaccccacgtctaccatcagcacatccccttcaagtagcccatctactccctccaccccgcagggtattcatcaccctgccaggaatctgctttcagtgagcagtcccaagacagctactaccccaacacctacctctcccggggagatctccagcgaaacttcgtctctgcactccgcaatgtcacggacgagtacattgtataccgccactcaagtaagcaccgagaacgctaatcattccgccccacgccagtctgaaagctcagcgcagcccacaaccacaagtcctatgacttccccagcacagagcattctcgtgatgtctgccgctccgacggccatccaaaacatacacccctcacctaccaatcgaagtaaacgtaacctggagatggagatcattctgactctcagccagggattaaagaaatactatggcaagatcctgaagctgttgcatctgacactagaagaggacaccgaaggcctcctggagtggtgtaaaagaaatcttgggtccaactgcgatgacgactttttccagaagaggattgaagagtttttcatgacaggagagggttactttaacgaagtcctgcagttcaaaactttgtctaccctctcgccaacggagcccagccacgcacggcctccaaccgtggaaccctttaagtcctatttcgctaaaggctttctgtcaatcgatagtgggtacttctctgccaagtgttatccgcgcagctccacatcaggattacaactgataaatgttactcagcaccctgcgagaattgccgagaccccaggccccaagacaactagcctcaaaaccatcaactgcattaatcttagggcatctgtgtttaaggaacatcgggagatcgagatcaacgtcctgttgcctcagattgctgtgaatctatccaactgtcacgtagttataaatagtcatgtgtgcgattacagcctggacacggatggtcccgtccgcctcccacacatccatcacgaagggacattcattcctggaacctacaaaatcgtgatagacaaggagaacaaactgaatgatcgatgtactcttgtgacaaactgcgtcattaagggcagagaagttaggaaaggccaatctgtgctgcggcagtataagaccgagatcaagatcgggaaagcctccactggatcacgtaagttgctcagtgaggaacccggtgacgattgtattagccgcacccagctgttaagaacagagacggctgaaatccacgacgacaattacggcgggccaggagataaaattaccatatgcaacggctcgactatcgtagaccagaggctgggttccgagctagggtgttatacaattaatcgggtgaagtcttttaaactctgcgaaaacagcgccaccggcaagacatgcgagatcgattcaactccggtcaagtgtcgacaaggattctgcctgaaaatcacccaggagggccgcgggcatgtgaagctgagtagaggatccgaagttgtgttggacgcatgtgattctagctgcgaggtcatgattcctaaaggtacgggcgacatactggtggattgttccgggggacagcagcactacctcaaggacaatctgatcgatcttggctgcccccatattccactgttgggtaaaatggccatctatatttgtaggatgtcaaaccacccccggacaaccatggctttcctcttttggttcagctttgggtacgtaatcacttgcatattctgtaaggcgctgttttatagtttaatcattatcggcaccctgggaaagaaaattaagcaataccgcgaactaaaacctcagacatgcactatctgtgagaccgcaccagttaacgccatagacgctgaaatgcacgatctcaattgctcttacaacatttgcccctattgtgcctccagactgacaagcgacggccttgcaaggcatgtgcctcagtgcccgaagcgtaaagagaaggtcgaggaaacggagttgtacctgaatctcgaacggatcccatggattgtgcgaaagctgttacaggtctcggagtcaaccggggtggccctgaaaagatctagttggcttatcgttttgctcgtgctgctaactgtatccctgagccccgtccaatctgctcctgtgggacacggtaagacaatagaaacctatcagactagggagggcttcacaagcatctgtctctttatgctggggtccattcttttcttggtttcatgcctggtgaaaggattagtcgacagtgtgagcgattcctttttcccaggcctctctgtatgtaagacctgctcaatcggtagtattaacgggtttgagatcgaaagccataaatgttactgctccctgttctgttgcccctattgtcgccactgctctgccgaccgggagatacatcagcttcacctgtcgatttgcaagaaaagaaagacgggcagcaatgtgatgttggcagtttgtaagaggatgtgctttcgcgcgactatcgaggcttcacgacgggccctcctgatccgttccattatcaacaccacattcgtcatttgtatactaaccctgactatctgcgtggtgagtacatctgcagtcgaaatggaaaatctccctagcggaacctgggagagagaggaagatctgacaaacttctgtcaccaggagtgccaagttactgaaaccgagtgtctttgcccgtacgaggccttggtgctgaggaaacccttattttccgactcaattgtgaagggcatgaaaaatctcctgaactctacgagccttgaaacaagtctgtccatcgaggctccatggggagccattaatgtacagagcaccttcaagcctactgtctctaccgcaaacatcgctctatcatggtccagtgtggaacatcgcgggaataaaatactcgttacaggccggagcgagtcgatcatgaagctggaagagagaactggtgtgtcttgggatttgggggtcgaggacgcctccgaaagcaagctgttaaccgtgtcaattatggatctcagtcagatgtattctcccgtttttgagtacctgtccggagacaggcaagtggaagagtggccaaaagcgacgtgtacaggcgattgccctgaacgatgtggttgcaccagctcaacttgccttcacaaggagtggccccatagtcgcaactggcggtgtaatccaacatggtgctggggcgtagggaccggatgtacttgctgtggcgtcgacgtgaaagatctgttcacagaccacatgtttgtgaagtggaaagtcgagtacatcaagaccgaagccattgtttgcgtggagttgacgagccaggaaagacagtgttccctcatcgaggctgggactaggttcaacctgggaccggtaaccataacactatctgaacctcgtaacattcagcaaaagctgcccccagagatcatcacccttcatcccaaagtggaggaaggctttttcgatctcatgcacgtccagaaggtgctgagcgcatccacagtttgcaaattgcagtcatgtactcacggtattcctggggaccttcaggtgtatcatataggaaatttactcaagggcgaccgcgtcaacggtcacctgatccataaaattgagccacactttaatacctcttggatgagttgggatggctgcgaccttgattactattgtaacatgggggactggccctcgtgcacgtacacaggagtgactcaacacaatcatgccgctttcgttaacctgttgaatatcgaaaccgattatatgaagacatttcacttccatagcaagcgggtgaccgcccacggcgacactcctcagctcgatctgaaagcaagaccgacctacggggcgggagagattacagtcctagtagaggtggccgacatggaactgcatacgaagaaagttgagatctccggccttaagtttgtgtctctcgcttgcactggttgttatgcctgctcaagcgggatatcctgtaaagtcaggatccacgtggatgaaccagacgagctgaccgtacacgtgaagagttctgatcccgacgtcgttgcagctagcacatcattgatggcccgaaaattagagttcggaaccgattccactttcaaggcatttagtgccatgcctaagacaagcctgtgcttctacattgtggaacgggagtactgtaaatcttgctccgaagaggacacccagaagtgtgtggacacgaaactcgaacagccccaatcaatcctgattgagcataagggcactatcataggtaaacagaacgatacatgcaccgctaaggcgagctgttggcttgaatcggtcaagtctttcttttatggcctgaaaaatatgttggggagtgtgtttggaaacttctttattggcatcctactgttcctcgccccatttgttctgcttgtattattctttatgttcgggtggaagatcctgttctgctttaaatgttgccgcagaaccaggggactcttgaagtaccggcacctgaaagacgatgaggagactggctatcgaagaattatcgaacgcctcaataacaagaagggtaaaaataggctgcttgacggggagcgtctggcagatcggaagatagctgaattgttctccacaaaaacccatattggatga

SEQ ID NO: 10308 - RNA, 5067 nt, synthetic construct
  misc_feature 1..5067: note = derived and/or modified CDS sequence (opt3) from CCHFV(Min)__KX013481.1__GP
  source 1..5067: mol_type = other RNA
atgcccaccaacatcatgcacacactgctcgtgtgcttcattctttacctgcagttgttaggccttgggggagcccatggtcaaagcaatgctactgagcacaacggcacgaataccacaactgcaccttccacctctcagtcaccaaagccgctagtcagtacagccccgcctcatgcgctcgaaagctccaccataaaaccaactacacccgcttctgagaccgaagggtcgggagagacgactcctccacccaacaccacacagggcccttcaccaccggaaactacccccgagagacctgccacaaccgcaacgagcactccaagtacagacaataccaactccactacacacgttaccgataataaccccacgtctaccatcagcacatccccttcaagtagcccatctactccctccaccccgcagggtattcatcaccctgccaggaatctgctttcagtgagcagtctgaagacagctactacccccacaccaacctctcctggggagatctccagcgaaacttcgtctttgcactccgcaatgtcacggacgagtacactctataccgccactcaagtaagcaccgagaacgctaatcattccgcgccccgccagtctgaaagctcagcccagccaacaaccactagccccatgacatcccctgcacagagcattctggtgatgtctgccgctccaatcgccatacaaaacatccacccgtcacccacgaatcgaagtaaacgtaacctggagatggagattatcctcaccttaagccagggactgaagaaatactatggcaagattcttaagttgctgcatctaactctcgaagaggacacagaaggcctgcttgagtggtgtaaaagaaatctggggtccaactgcgatgacgactttttccagaagaggatcgaagagtttttcatgaccggagagggttactttaacgaagtcttgcagttcaaaacactctctactctgtcgcctaccgagccaagccacgcacggccccctacggtggaaccatttaagtcctatttcgctaaaggctttttatcaatagatagtgggtacttctctgccaagtgttatccccgcagctccacctcaggactgcaactcattaatgttacacagcacccggcgagaatcgccgagactcctggcccaaagaccacaagccttaaaactattaactgcatcaatctgagggcatctgtgtttaaggaacatcgggagatcgagattaacgtcttgctaccccagatagctgtgaatctgtccaactgtcacgtagttatcaatagtcatgtgtgcgattacagcctcgacaccgatggtcctgtccgcctgccccacatttaccatgaagggacgttcatcccaggaacatataaaatagtgattgacaagaaaaacaaacttaatgatcgatgtaccctggtgactaactgcgtcatcaagggcagagaggttaggaagggccaatctgtgttgcggcagtacaagacagaaatcaaaattgggaaggcctccaccggatcacgtaaactcctgagtgaggaacctggtgacgattgtatcagccgcactcagttactgagaaccgagacagctgagattcacgacgacaattatggcgggcccggagataagataacgatctgcaacggctcgaccattgtagaccagaggctaggttccgaactcgggtgttacactatcaatcgggtgaaatcttttaagctgtgcgagaacagcgccacaggcaagacctgcgaaatcgattcaacaccagtcaaatgtcgacaaggattctgccttaagattactcaggagggccgcgggcacgtgaaattgagtagaggatccgaggttgtgctggacgcatgtgattctagctgcgaagtcatgataccgaagggtaccggcgacatcctcgtggattgttccgggggacagcagcatttcctgaaagacaatcttattgatctgggctgccctcacatccccttgctcggtaagatggccatttatatctgtaggatgtcaaaccatccacggacgacaatggcttttctgttctggtttagcttcgggtacgtaataacctgcatcttttgtaaggcgttattctatagtctgattatcattggcactctagggaaaaagatcaaacaataccgcgagctcaagccccagacctgcacaatatgtgaaactgcacctgttaacgccattgacgctgagatgcacgatctgaattgctcttacaacatctgcccatattgtgcctccagacttaccagcgacggcttggcaaggcacgtgccccagtgccctaaacgtaaggaaaaggtcgaggagacagaactgtacctcaatctggagcggattccgtggatcgtgcgaaaattactgcaggtctcggaatcaacgggggtggcccttaagagatctagttggttgatagttctcctggtgctactgaccgtatccctcagcccagtccaatctgctcccgtgggacatggtaaaactatcgagacatatcagaccagggaaggctttactagcatttgtctgttcatgcttgggtccatcttgtttctggtttcatgcttagtgaagggactcgtcgacagtgtgagcgattctttctttcctggcctgtccgtatgtaaaacatgcaccattggttcaatcaacgggttcgagatagagagtcacaagtgttactgcagcctgttttgttgcccatattgtcgccattgctccgccgaccgggaaattcaccagctgcatttgtctatctgcaaaaagagaaagacgggctcgaatgtgatgctcgcagtttgtaaaaggatgtgcttccgcgcgactatcgaggctagccgacgggccctgctaattcgttcaatcattaacaccacattcgtcatatgtatcctgaccctcactatttgcgtggtgtccacaagtgcagtcgaaatggagaatctgccctctggaacctgggaaagagaggaggatcttacaaacttttgtcaccaggaatgccaagttactgagaccgaatgtttgtgcccttacgaggccctggtgttaaggaagcccctcttcctggacagcatcgtgaaaggcacgaagaatcttctgaactccacatcactagagacctctctcagcattgaagctccctggggagccatcaatgtacagagtacttttaaaccaaccgtctccacagcaaacatagctctgagctggtcttcagtggagcaccgcggaaataagatcttggttactggccggtccgaaagtattatgaagctggaggaaagaaccggtgtgagctgggatttaggggtcgaggacgcctcggagtctaaactcctgacggtgtccatcatggatcttagccagatgtattcacctgttttcgaatacctgagtggagacaggcaagtggaggaatggcccaaggcgacatgtaccggcgattgcccagagcgatgtggttgcacttcttccacatgcttgcataaagaatggcctcacagccgcaactggcggtgtaatcccacctggtgctggggcgtagggactggatgtacatgctgtggcgtcgacgtgaaggatctctttaccgaccatatgttcgtgaaatggaaggtcgagtacattaagacggaggccatcgtttgcgtggaactgacttcacaggagagacagtgtagtctaatagaagctgggaccaggtttaacctgggaccagtaacaattacccttagcgagccgcgtaacatccagcaaaaactccctcccgaaatcattacactgcacccaaaggtggaggagggcttctttgatttgatgcatgtccagaaagtgctgtccgcatctactgtttgcaagttacagagctgtacccacggtatacccggggacctccaggtgtatcacatcggaaatctgcttaaaggcgaccgcattaacggtcatctgatccacaagattgaacctcatttcaatacgtcctggatgtcatgggatggctgcgacttggattactattgtaacatgggggactggccatcttgcacatacactggagtcacccaacacaatcacgccgcttttgtgaacctcctgaatatcgagacagattataccaagactttccattttcacagtaaacgggttaccgcccatggcgacacaccccagctagatctgaaggcaagacctacgtacggggcgggagaaataactgtgcttgtcgaggtagccgacatggagctccacaccaaaaaggtggaaatctcgggcctgaaattcgctagcttggcctgcacaggttgttatgcatgctcctctgggatttcatgtaaggttaggatccatgtggatgagccggacgaattaaccgtccacgtgaaaagctccgatccagacgtagtggctgccagtacttctctgatggcacgaaagctcgagttcggaacagatagcacctttaaggccttctcagctatgcccaaaacgtccctgtgcttttacattgtcgaacgggagtactgtaagagttgcagcgaggaagacactcagaaatgtgttgacacaaaacttgagcagcctcaatctatcctgatagaacacaagggcaccattatcggtaagcagaacgatacctgcactgcgaaggcctcctgttggttggagtcagtgaaaagtttcttttatggcctaaagaatatgctggggtcggtgttcggaaactttttcatcggcattctcctgtttcttgcacccttcgtcttactggtgctctttttcatgttcgggtggaaaatcttgttttgcttcaagtgttgccgcagaacaaggggactgctcaaataccggcatctgaaggacgatgaagagaccggctatcgaagaataattgagcgccttaataacaagaaaggtaagaataggctgttggacggggaacgtctagctgatcggaaaatcgccgagctgttttctacaaagactcacattggatga

SEQ ID NO: 10309 - RNA, 5067 nt, synthetic construct
  misc_feature 1..5067: note = derived and/or modified CDS sequence (opt3) from CCHFV(Mamon)__KX013478.1__GP
  source 1..5067: mol_type = other RNA
atgcccaccaacatcatgcacacactgctcgtgtgcttcattctttacctgcagttgttaggcctagggggagcccatggtcaaagcaatactacggagcacaacggcaccaatacaactaccgctccttccacatctcagtcaccaaagccgctagtcagtaccgcaccccctcatgccctcgaaagctccactataaaaccaacaacccccgcgtctgagacggaagggtcgggagagactacccctccacccaacatcacacagggcccttcaccaccggaaactacccccgagagacctgctacaaccgccacgagcactccaagtacagacaataccaactccactacacacgttaccgataataaccccacgtctaccattagcacatccccttcaagtagcccatctactccctccaccccgcagggtatccatcaccctgcaaggaatctgctttcagtgagcagtcccaagacagccactaccccaacacctacctctcccggggagatttccagcaaaacttcgtctctgcactccgctatgtcacggacgagtacattgtataccgcaactcaagtaagcaccgaaaacgccaatcattccgctccacgccagtctgagagctcagcccagcccacaaccacaagtcctatgacttccccagcgcagagcatcctcgtgatgtctgcagccccgacggctatacaaaacatccacccctcacctaccaatcgaagtaagcgtaacctggaaatggagattatcctgactctcagccagggactgaaaaagtactatggcaagattctgaaacttttgcatctgacactagaggaagacaccgagggcctcctggaatggtgtaagagaaatcttgggtccaactgcgatgacgatttcttccagaaaaggatcgaggaatttttcatgacaggagagggttactttaacgaggtcctgcagttcaagactttgtctaccctctcgccaacggaacccagccacgcccggcctccaaccgtggagccctttaaatcctatttcgcaaagggctttctgtcaatagacagtgggtacttctctgctaagtgttatccgcgcagctccacatcaggattacaactgattaatgttactcagcaccctgccagaatcgcggaaaccccaggccccaaaacaactagcctcaagaccattaactgcatcaatcttagggcctctgtgtttaaagagcatcgggaaatcgagattaacgtcctgttgcctcagatagcagtgaatctatccaactgtcacgtagttatcaatagtcatgtgtgcgattacagcctggacacggatggtcccgtccgcctcccacacatttaccatgaggggacattcatccctggaacctataagatagtgattgacaaaaagaacaaactgaatgatcgatgtactcttgtgacaaactgcgtcatcaagggcagagaagttaggaagggccaatctgtgctgcggcagtacaaaaccgagatcaagattgggaaggcttccactggatcacgtaagttgctcagtgaggaacccggtgacgattgtatcagccgcacccagctgttaagaacagaaacggccgagattcacgacgacaattatggcgggccaggagataaaataaccatctgcaacggctcgactattgtagaccagaggctgggttccgagctagggtgttacacaatcaatcgggtgaagtcttttaagctctgcgaaaacagcgctaccggcaaaacatgcgagatcgattcaactccggtcaagtgtcgacaaggattctgcctgaaaattacccaggaaggccgcgggcacgtgaaacttagtagaggatccgaggttgtgtctgacgcctgtgatagctcctgcgaggtcatgatacctaaaggtacgggcgacatcttggtggattgttcagggggacagcagcatttcctgaaggacaatctcattgatctgggctgcccccacatcccacttctgggtaagatggcaatttatatctgtaggatgagcaaccatccccggacaaccgtagcctttttgttctggtttagtttcgggtacgttataacttgcatcttttgtaaagctctcttctattctctgattatcattggcaccttaggaaagaaaatcaagcaataccgcgaactgaaacctcagacatgcactatatgtgagaccgcgccagtgaacgcaattgacgccgaaatgcacgatctaaattgctcctacaacatctgcccctattgtgctagcagactcacatcggacggcctggccaggcacgtccctcagtgcccgaagcgtaaggagaaagtggaagagacggagctttacttgaatctggaacggattccatggatcgtccgaaagctcttacaggtgtcagagtctaccggggttgcattaaaaagaagttcctggctgatagtgcttttggtactcctgactgtcagcctatctcccgtgcaaagcgcccctgttggacatggtaagacaatcgaaacctatcagactagggagggctttacatccatttgtctgttcatgctcgggtcaatcctgtttcttgtgagttgcttggtcaaaggactggtggacagcgtatctgattccttctttccaggcttatcagtgtgtaagacctgcagtattggtagcatcaacgggttcgaaatagagtcccacaaatgttactgctctctcttttgttgcccctattgtcgccattgctcggctgaccgggagattcaccagctgcatcttagcatctgcaagaagagaaaaacgggctcaaatgttatgctggccgtctgtaagaggatgtgcttccgcgcaactatcgaagcgtcccgacgggctttgctcattcgtagtatcattaacaccacattcgtgatatgtatcctgaccctaactatttgcgtggtctctacaagcgccgttgagatggaaaatctgccttccggaacctgggagagagaagaggatctcacaaacttttgtcaccaggagtgccaagtgactgaaaccgagtgtctgtgcccgtacgaagcacttgtgttgaggaaacccctgttcttagactcaatcgtaaagggcatgaaaaatctcctgaactctacgagccttgagacaagtctgtccattgaggccccatggggagctatcaatgtccagagcacctttaagcctactgtgtctaccgccaacatagcactatcatggtccagtgttgaacaccgcgggaataagatcctcgtgacaggccggagcgagtcgattatgaaactggaagagagaactggtgtctcttgggatttgggggtggaagacgcttccgagagcaagctgttaaccgtttcaatcatggatctcagtcagatgtattctcccgtgttcgagtacctgtccggagacaggcaagtagaagagtggccaaaagccacgtgtacaggcgattgccctgaacgatgtggttgcaccagctcaacttgccttcataaggagtggccccacagtcgcaactggcggtgtaatccaacatggtgctggggcgtcgggaccggatgtacttgctgtggcgtggacgtgaaagatctgtttacagaccatatgttcgtcaagtggaaggttgaatacattaaaaccgaggcgatcgtgtgcgtagagttgacgagccaggaaagacagtgttccctcatagaggccgggactaggtttaacctgggaccggtgaccattacactatctgaacctcgtaacatccagcaaaagctgcccccagagatcattacccttcaccccaaagtcgaagagggcttctttgatctcatgcatgtgcagaaggttctgagcgcttccacagtgtgcaaattgcagtcatgtactcacggtatacctggggacctgcaggtctatcacatcggaaatttactcaagggcgaccgcgtgaacggtcatctgattcacaagatcgagccacatttcaatacctcttggatgagttgggatggctgcgaccttgattactattgtaacatgggggactggccctcgtgcacgtacacaggagttactcaacacaatcacgcagcctttgtgaacctgttgaatattgaaaccgattatacaaaaaccttccattttcacagcaagcgggtcactgctcatggcgacacccctcagctcgatctgaaagccagaccgacatacggggcaggagagatcacggtactggtggaagttgcggacatggagctgcacactaagaaagtggagatatccggccttaagttcgcctctctcgcttgcaccggttgttatgcctgctcaagcgggatctcctgtaaagtcaggattcatgtggatgaaccagacgagctgacagtacacgtgaagagttctgatcccgacgtcgttgcagctagcacctcattgatggcccgaaagttagaatttggaactgattccacatttaaagcattcagtgccatgcctaagaccagcctgtgcttttacatcgtggagcgggaatactgtaaatcttgctccgaggaggacacgcagaagtgtgtggacactaaactcgaacagccccaatcaattctgatcgagcacaagggcacaataattggtaagcagaacgatacctgcaccgctaaaactagctgttggcttgaatcggtcaagtctttcttttatggcctgaaaaatatgttggggagtgtgttcggaaactttttcatcggcatcctactgtttctcgcgccattcgttctgcttgtattatttttcatgttcgggtggaagattctgttttgcttcaaatgttgccgcagaacaaggggactcttgaagtaccggcatctgaaggacgatgaggaaaccggctatcgaagaatcatagagcgcctcaataacaaaaagggtaaaaataggctgcttgacggggagcgtctggccgatcggaagattgcagaattgttttccacaaaaactcacatcggatga

SEQ ID NO: 10310 - RNA, 5067 nt, synthetic construct
  misc_feature 1..5067: note = derived and/or modified CDS sequence (opt3) from CCHFV(K340_6)__KX013475.1__GP
  source 1..5067: mol_type = other RNA
atgcccatcaacattatgcacaccctgctcgtgtgcttcatactttacctgcagttgagcggcttagggggagcccatgtccaatccaatgctacagagcacaacggtactaatacgaccacagcacctggcacttctcagtcaccaaagccgcccgccagtaccacactgcctcataccccagaaagctccactgttaaacccacaacccctacgtctgagactgaagggtcgggagagaccacaccaccccctaacactacccagggcctaccaccgacaggtaccacgcccgaaagatcagcgactacagctaccagcactagctccacagacaatatgaactctaccacacaggtgaccgatagcacacctacttccaccgtatcaacaagtccaagttcttcctcaagcatgcccagtacttctcaagggatccaccatcctgtgaggtccctcctgagcgtctcgtctccaaagaccgtgacaacccccactccgatgtcccctggagagatgtcacccgagacgagtagccagcactccgccatgtctcgggttccaacactttataccgcaactcaggtgagcaccgaaaatacagaccgctcaacccctcgacagagtgagtccagcgtccaacccgccactcagtctccaattacatcacccgctcagacgatcctgttgatgagtgcagcccctaaagctattcaggatatgcacccaagcccgaccaaccgttccaagagaaatctcgaagtggagatcatactgactctgtctcaaggcctcaaaaagtactatggcaagatcttaaaactgcttcatttgacactggaggaagacaccgaggggctactcgaatggtgtaagaggaacctgggatcgaattgcgatgacgatttcttccagaaacggattgaggaatttttcatcacaggtgagggctactttaacgaggtacttcagttcaagactctgagcaccttgtcccccacggaaccttcacacgttcgcctcccaaccgccgagccctttaaaagttatttcgcgaaggggtttctgtctattgacagcggatacttctccgcaaagtgttatcctagatcaagcacatctggcttacaactgatcaatgtgactcagcatccagccaggatagctgaaacccccggtccgaaaacaacttccctcaagaccattaactgcatcaatcttcgggccagtgtctttaaagagcaccgcgaagtggagattaacgtgctgttgcctcagatcgcagtcaacctaagcaattgtcacgttgtgatcaactctcatgtatgcgattactccctggacacggatgggccagtgcgactccccagaatacaccatgagggaacattcattcctggcacctacaagatcgtcattgacaggaaaaataagctgaacgatcggtgttcacttgtgactaattgcgttatcaaaggccgtgaagtgcgcaaggggcagagtgtcctgagacaatataagacagagataaaaattggaaaggctagcaccggttcgaggaaattgctctccgaggaacccggcgacgactgtatctctcggactcagctgttaaagaccgaaacagccgagatccacgatgacaactacgggggaccaggcgataaaattacgatctgcaatggtagcaccattgtggaccagcgactggggtcagagctaggctgttatactataaaccgcgtaaagagttttaagctctgcgaaaattccacaaccggaaaaacatgcgagatcgattctactcctgttaagtgtagacagggcttctgcctgaaaattacccaagaagggaggggacatgtgaagctgagccggggttccgaggtcgtgttggacgcgtgtgattcaagctgcgagatcatgatccccaaaggcacgggggacattctggtcgattgtagtggaggccagcagcacttcctcaaggacaacctgatagatcttggttgcccacacatcccgcctctggggaagatggccatttacatctgtcgcatgtctaatcatcccagaacaaccatggcatttttgttctggttttccttcggctatgtgattacttgcatcttttgtaaagctctcttctacagcctgataatcattggaaccttaggcaagaaaatcaagcagtatagggaactgaaaccacaaacatgcactatttgtgagaccgcccccgttaacgctatcgacgccgaaatgcacgacctaaattgctcgtacaacatatgcccttactgtgcatcacgtctcacatctgatgggctggcccggcatgtgacgcagtgcccaaagcgaaaggagaaagtagaagagaccgagctttatttgaatctggaaaggattccctggatcgtcagaaagctccttcaggtgagtgagtccactggagttgctttaaaacgcagctcttggctgattgtgcttttggtcctcctgacagtgagcctatcccctgtacagtcagcgccggtgggtcacggcaagaccatcgaaacttaccaaacacgggaggggtttaccagtatatgtctgttcatgctcggaagcatcctgtttattgtttcttgccttgtcaaaggcttggtggactccgtgtcagatagtttctttccaggtctgagcgtctgtaagacgtgctccatcgggtctattaacggcttcgaaatcgagtcgcacaaatgttattgcagcttattttgttgcccctactgtagacattgctcagcagacagggagatacaccagctccatctgtccatttgcaagaagcgcaaaactggaagtaacgttatgcttgccgtgtgtaagcgaatgtgcttcaaagctaccatcgaagcctctcggcgtgcactgttgatcagaagcattatcaatacaaccttcgtgatgtgtattctcactctggccatatgcgtagtctccacatcagctgtggagatggaagatctacctgccggcacctgggagagggaagaggacctgacaaacttttgtcaccaggagtgccaagttactgaaaccgagtgtctctgcccatatgaagcactggtgcttcgcaagcccttgtctctggatagcatcgtcaaagggatgaagaatttactcaacagtacgtccctggagacaagcctttctattgaggcgccttggggagctatcaatgtgcagtcaaccttcaagccgactgtttccaccgccaacattgcactgagttggagctcggtggaacatcggggcaataaaatcctagtaacaggtagatctgagtccataatgaagctcgaagagaggactggggtcagctgggacctgggagtggaagatgcctcagagagtaaattgctgaccgtgtctatcatggacttatcccagatgtacagccccgtctttgagtatctctcaggcgatcgacaggttgaagagtggccaaaggctacgtgtacaggtgactgccctgaacgctgtggctgcaccagtagcacttgcctgcacaaagagtggccccactcccggaactggagatgtaatccaacatggtgctggggtgtgggaaccggctgtacttgctgtggggtagatgtgaaggaccttttcacagaccatatgtttattaagtggaaagtcgaatacatcaagaccgaggccattgtgtgcgttgagctgacgtctcaagaaaggcagtgtagcttgatcgaggcaggaactcgtttcaacctcggccctgtgaccataacactgtccgaaccccgcaatattcagcagaaactaccaccggagatcatcaccctgcaccctaagattgaagaggggtttttcgatcttatgcatgtccaaaaagtgctctcagcttctacagtttgcaagctgcagagttgtactcacgggatacccggagacttgcagatctaccatattggcaacctgttaaagggtgatcgggtgaatggccacctcatccacaaaattgagccacattttaacacctcgtggatgagctgggacgggtgcgatctggactattactgtaatatgggagattggccctcctgcacgtatacaggcgtcactcagcacaaccatgccgcgttcgtaaaccttctgaatatcgaaaccgactacacaaagacctttcacttccactctaaaagagtgactgcccatggggatacccctcaattggacctcaaggctaggccaacatatggagcaggcgagataacggttctggtggaagtcactgatatggagctacacaccaaaaaggtggagatctcaggtctgaaatttgccagccttacatgcaccgggtgttacgcttgctccagtggaatttcttgtaaggtacgaatccatgtggacgaacccgatgagctcactgtccacgttaagagctcagaccctgacgtggtggccgcatccacaagtctgatggcgcggaaattggaatttggcaccgatagcacgttcaaggccttttctgctatgccgaaaacttccttatgcttctatattgtcgagcgcgaatactgtaagtcatgcagcgaggacgatacgaaaaagtgtgtggacaccaagctggagcagccacagtcgatcctcatagaacataaaggtaccattatcggcaagcaaaacgatacttgcacagccaaagcatcttgttggctggagagtgttaagtcctttttctacgggcttaaaaatatgctgggaagcgtatttggctcattctttgtggggatcttgctattcctggctccctttgtcctcctggtgcttttctttatgttcggatggaagattttattctgctttaagtgttgcagaaggacccggggcctgttcaaatatcgacactttaaggacgatgaagagacaggttacagacgcatcatagaaaggctcaactccaaaaaggggaaaaatcgtttgctggacggagagcggctcgccgatagaaagattgcagagctgttctctactaagacgcacatcggctga

SEQ ID NO: 10311 - RNA, 5067 nt, synthetic construct
  misc_feature 1..5067: note = derived and/or modified CDS sequence (opt3) from CCHFV(K323_27)__KX013472.1__GP
  source 1..5067: mol_type = other RNA
atgcccatcaacattatgcacaccctgctcgtgtgcttcatactttacctgcagttgagcggcttagggggagcccatggtcaatccaatgctacagagcacaacggcactaatacgaccacagtccctgggacttctcagtcaccaaagccgcccgcaagtaccacactgcctcataccccagaaagctccactgttaaactaacaacccccacgtctgagactgaaggatcgggcgagaccacacctccacccaacactacccagggtctccctctgccagggacaaccccggaaagatcagccacgactgcgacaagcaccagttccactgacaatatgaactctacaacccaggtgacggataatacccccacaagcactgtatccatctcacctagtagctctccatccatgccctcaaccagccaaggcattcaccatcctgtgaggagtcttctgtctgtctccagcccaaagacagtgactacccccacaccgatgtcgcctggagagatgtctcccgagacctcctcacagcacagtgctatgagccggatcccaactttgtatacggccacacaggtttccaccgaaaacactgaccgctctacccctcgacagagcgagtcaagtgtgcaacccgcaacacagtccccaattaccagccccgcccagactatcctcctgatgtctgctgcacctaaagccatacaggatatgcacccatcaccgacaaatcgtagtaagagaaacctggaagtcgagatcattctcacgttaagccaaggcctgaaaaagtactatgggaagatccttaaattgctgcatctaaccctcgaggaagacactgagggactgcttgaatggtgtaagaggaatctgggttccaactgcgatgacgactttttccagaaacggattgaggaatttttcatcacaggcgaggggtactttaatgaggtgttgcagttcaagaccctctctacactgtcgcccactgaaagctcccacgtacgcttacctaccgctgagccatttaaatcatatttcgccaagggatttctgagtatagattctggctacttcagcgcgaagtgttatcccagatcctcaacgagcggtctccaacttattaacgttacccagcatcctgcaaggatcgccgaaacaccagggcccaaaactacctctctgaagacaattaattgcatcaacttgcgggcttccgtgtttaaagagcaccgcgaagtcgagatcaacgtgctactgccgcagattgccgtgaatctcagtaactgtcacgtcgttataagctctcatgtgtgcgattactccctggacactgatggacctgtacgacttccaagaatccaccatgagggcaccttcattcccggcacgtacaagatcgtgatagacaggaaagataagctgaatgaccggtgttcattggtcacaaactgcgtgattaaagggcgtgaagttcgcaagggacagagtgtgctcagacaatataagaccgagatcaaaatcggtaaggcaagcactggctcgaggaaactgttatccgaggaacctggggacgattgtatttctcggacacagctgctaaagaccgaaactgctgagatccacgacgataattacggaggccccggtgacaaaattaccatatgcaacgggagcacaatcgtcgatcagcgactcggctcagagctgggatgttatacgattaatcgcgtgaagagttttaagttatgcgaaaactccgccaccggcaaaacttgcgagatcgactctacaccagtaaagtgtagacaggggttctgcttgaaaatcacccaagaaggaaggggtcatgttaagctgagccggggctccgaggtggtcctcgatgcgtgtgactcaagctgcgagattatgatacctaaagggacaggagatatcctggtggactgtagtggcggtcagcagcacttccttaaggataatctgattgacttggggtgcccccacatcccactcctgggcaagatggccatttacatctgtcgcatgtctaaccatccgagaactaccatggcatttttattctggttttccttcggatatgtcataacgtgcatcttttgtaaagctctgttctacctactcattatcattggcacactggggaagaaaatcaagcagtatagggaacttaaacctcaaacctgcactatatgtgagaccgcccccgtgaatgctattgacgccgaaatgcacgatttgaactgcagctacaatatctgcccatactgtgcatcgcgtctgacatcagacggactcgcccggcatgttactcagtgccccaagcgaaaggagaaagtggaagagaccgagctgtatttaaacctggaaaggattccttggatcgtaagaaaacttttgcaggtctctgagagtacaggtgtggctctcaagcgctccagctggctgacggttctactggtgctcctgaccgtctctcttagcccagtgcagtccgcgcccgtaggccacgggaatactatagaaacataccaaacccgggagggatttacttcaatctgtttgttcatgctgggcagtattttatttatcgtgagctgcctcgttaagggtctggtcgattctgtgtccgactcattctttcctgggcttagtgtgtgtaaaacatgcagcattggctccatcaacggattcgaaatagagtctcacaagtgttattgctcgctgttttgttgcccgcattgtagacacaggagcgcagatcgcgagattcatcagttgcacctctcaatctgcaaaaagcgaaagaccggctccaacgtcatgctggccgtttgcaaacggatgtgtccaaaggctacgatcgaagccagtcgtagagcactacccattaggtctatcattaatactaccctggtgatgtgcatactcacactggccatctgtgtggtaagcacctccgctgtcgagatggaagaccttcctgccgggacttgggagcgcgaagaggatttgacaaacttctgccatcaggagtgtcaagtgaccgaaacagagtgcctgtgtccatacgaagcattagttctccggaaacccctgttccttgactcaattgcgaagggaatgaaaaatctgctaaactctactagcctcgagaccagtctgtccatcgaggctccttggggcgccattaatgtgcagagcacgtttaagccgacagtctctaccgcaaacatcgccttgtcatggtccagtgtggaacacagaggtaataagatactggttactgggaggagcgagtcgatcatgaaattagaggaacgaaccggagtgtcttgggatctcggcgtagaagacgcttccgagagcaagctgcttacagtctcaattatggatctgagtcagatgtattctcccgtgttcgagtacttgtccggtgaccgccaggtggaagagtggccaaaagccacttgcaccggcgattgtcctgaacggtgcgggtgtacgagctcaacatgcctccacaaggagtggccccatagtagaaactggaggtgcaatccaacctggtgttggggagtcggcactgggtgcacatgttgcggagttgacgtgaaagacctgtttaccgatcacatgttcatcaagtggaaggtagaatatattaaaactgaggcaatcgtgtgtgtcgagctaacaggccaagaacgtcagtgcagcctgatagaggctggtacccgctttaaccttgggcctgtgacgattactctctccgaaccccggaatatccagcagaagctgccaccggagatcattaccttgcatcctaaaatagaagagggattctttgacctgatgcacgttcaaaaggtgttatctgccagcacagtctgtaaactccagtcctgcacccatggcatccccggtgatctgcagatttaccacatcggcaaccttctgaagggggacagagtgaatggacacttgattcataagatcgagccacacttcaacacatcatggatgtcttgggatggctgtgacctcgattactattgcaatatgggggactggcccagttgtacttacaccggagttacgcagcataaccacgcggcctttgtgaacctgctaaatatagaaacagattatactaaaaccttccactttcattcgaagagggtcacagctcacggcgacacccctcaactggatcttaaagcacgaccaacttacggtgccggggagatcaccgtactcgtggaagttgctgacatggagctgcatacaaagaaagtggagattagcggattgaagttcgcctccttaacgtgcactggctgctatgcatgttcttcaggtatcagctgcaaagtccggattcacgtggatgaacccgacgagctgaccgtacatgtgaagtccagtgaccctgatgtcgttgcggcctctacaagcctcatggctcgcaagctggaatttggcaccgactcaactttcaaagccttctccgcaatgccgaagacaagtctttgtttttacatcgtggagagagaatattgcaaaagctgttctgaggatgacaccaagaaatgcgtggatacgaagctggagcagccacagtccatattgattgaacacaaggggactatcatcggaaaacaaaacgacacatgtaccgctaaggcctcatgctggctagagagcgtcaaatcgttcttttacggcctgaagaatatgctcgggtctgtgttcggatcctttttcgttggcattctgctttttcttgcacccttcgtactgctcgtgttgtttttcatgtttggttggaaaatcctgttctgtttcaagtgctgtaggcggacccgagggctctttaagtacagacacctgaacgatgacgaagagactggatatcgcaggataattgaacgtcttaatagtaaaaagggcaaaaaccggctgttggatggcgagagactagccgacaggaagatcgctgagctgttcagcacaaaaacccatattgggtga

SEQ ID NO: 10312 - RNA, 5067 nt, synthetic construct
  misc_feature 1..5067: note = derived and/or modified CDS sequence (opt3) from CCHFV(K315_14)__KX013469.1__GP
  source 1..5067: mol_type = other RNA
atgcccttcaacatcatgcacaccctgctcgtgtgctttattctttacctgcagttgagcggcttagggggagcccatggtcaatccaatgagacagaacacaacggcactaatacgaccacagtccctgggacttctcagtcaccaaagccgcccgctagtaccacactgcagcatacccctgagagctccactgttaaactaacaaccccaacgtctgaaactgagggatcgggcgaaaccacaccccctccaaacactacccagggtctgccccctccagggacaaccccggagagatcagcaacgactgccacaagcaccagttccactgacaatatgaactctacaacccaagtgacggataatacccccacaagcactgtatccatatcacctagtagctctccatccatgccctcaaccagccagggaatccactatcctattaggagtctgctttctgtgtccagcccaaagacagtcactacccccacaccgatctcgcctggcgagatgtctcccgaaacctcctcacagcatagtgcgatgagccggattccaactctgtacacggctacacaggtgtccaccgagaacactaatcgctctacccctcgacaaagcgaatcaagtgttcagcccgccacacagtccccaatcaccagccccgcacagactatattgctcatgtctgccgctcctaaagcaatccaagacatgcacccatcaccgacaaaccgtagtaagagaaatctggaggtggagattatcctgacgctcagccagggcctgaaaaagtattacgggaagattctgaaacttttgcacctgaccctagaagaggatactgaaggactcctggagtggtgtaagaggaaccttggttccaattgcgacgatgacttctttcagaaacggatcgaagagttctttataacaggcgaggggtatttcaacgaagtcctgcaatttaagaccttgtctacactctcgcccactgagcctagccatgtgcgcctgccaaccgccgaacccttcaaatcctactttgctaagggattcttatcaattgatagtggctatttttctgccaagtgttaccctagaagctccacgtcaggtctgcagctcatcaatgtaacccagcacccagcgaggattgcagagacacccgggccgaaaactaccagccttaagacaatcaactgcatcaacctgcgggcctctgttttcaaagaacatcgcgaggtggagattaatgtcttgctacctcagatagctgtgaacctgtccaattgtcacgtggtcatcaacagtcacgtttgcgactacagcctcgatactgacggaccagtgcgactgcccaggattcatcacgaaggcacctttatccctggcacgtataagatagtaattgataaaaagaataaacttaacgacagatgttctctggtgacaaattgcgtcatcaaggggcgggaggtgcgtaagggacaatccgttttgcgccagtacaaaaccgaaatcagaattggtaaggcctcaactggcagtaggaaactcctgagcgaggaacccggggatgactgtatctcgcggacacagttactgaagaccgagactgcagagattcatgacgataactatggaggcccaggtgacaaaataaccatctgcaatgggtccacagtggtcgatcagcgactaggctctgaactcggatgttacacgattaaccgcgtaaagagcttcaagctgtgcaaaaattcagctaccggcaagacttgcgagatcgacagtacacctgtgaaatgtagacaagggttctgccttaagatcacccaggaaggaaggggtcacgttaaattgtcccggggctctgaggtggtcctggatgtgtgtgacagctcctgcgagattatgatacccaaggggacaggagatatcctcgtcgactgttcaggcggtcagcagcattttctgaaggataaccttattgacctggggtgcccacacatcccgttgctcggcaaaatggccatttatatctgtcgcatgagcaatcaccctagaactaccatggcgttcctgttttggttcagttttggatacgtgataacgtgcatcttctgtaaggccttattttattctctgattatcattggcacactagggaaaaagatcaaacaatacagggaactcaagccccagacctgcactatatgtgagaccgcaccagttaacgctattgatgccgaaatgcatgacctgaattgctcctacaacatctgcccctattgtgctagccgtcttacatcggagggattggcccggcacgtgactcagtgccctaagcgaaaagaaaaggtagaggagaccgaactgtacctcaacctggagaggattccatggatcgtcagaaaattactccaggtgtcagaatctacaggtgttgcacttaagcgcagttcctggttgatagtgctcctggtcctactgacggtgagcctctctcccgtacaaagcgcccctgtgggccatgggaaaaccatcgagacttatcagacacgggaaggattcacctccatttgtctgtttatgcttggctcaatcttgttcattgttagttgcctggtcaagggtttagtgtacagcgtgtctgactcctttttcccggggctctcagtctgtaaaacttgcagtatcggcagcataaatggatttgagattgagtcccacaagtgttattgctctctgttctgttgcccatactgtagacactgctcggctgatagggaaatccatcagcttcacctgagcatctgcaagaaacgcaagacaggctcaaacgttatgttggcggtgtgtaaacgaatgtgcttcaaggcaaccattgaggcctcccggcgtgctctcctgatcagaagtattataaatacgacttttgtgatctgtattctaaccctggccatctgcgtagtctctacaagcgcagtggaaatggaggacctccccgccgggacctgggaaagggaggaggatctgactaacttctgtcatcaagaatgccaggttacagagaccgaatgtctttgcccttatgaggctttggtgctgcgcaaaccattatttctcgactccattgtcaagggaatgaagaaactgcttaattcaacatctctggagactagcctaagtatcgaagccccctggggcgcaataaacgtgcagtccaccttcaagcctacggttagcacagcgaatatcgctctctcttggtcatccgtggagcaccggggtaacaaaattctggtaaccgggagaagtgaaagcatcatgaagttggaggaaaggactggagtctcgtgggatctgggcgtggaggacgcctctgagtccaaattactcaccgtgagcattatggatctgtcacagatgtacagtccggtctttgaatacctttctggtgaccgacaagttgaggaatggcccaaggcaacatgtactggcgattgcccagagcgctgtgggtgcacctccagcacgtgcctgcataaggaatggcctcactcacggaattggagatgtaaccccacatggtgctggggagtgggcaccgggtgtacttgctgtggagtagacgtgaaagatttgttcacagaccacatgtttatcaagtggaaagtcgagtatataaagaccgaggccattgtgtgcgttgaactcacttctcaggagaggcagtgtagcctgatcgaagctggcacacgtttcaatctaggtccagtgaccatcacgctgtccgagcctcgcaacattcagcaaaaacttcccccagaaataatcactctccatccgaagattgaggaggggtttttcgatctgatgcacgtccagaaggtgttgtctgccagcaccgtttgcaaactgcagtcctgtacacatggaatccctggcgacttacagatttaccacatcggtaatctcctgaagggcgaccgggtgaacgggcatcttatacacaaaatcgaaccccactttaatacctcatggatgtcttgggatggatgcgacctggattattactgtaacatgggcgactggccaagttgcacatatactggggtcacccaacataaccacgcagctttcgtaaatttgctcaacattgagacggattacacaaagacttttcatttccactcgaaaagagtgaccgcccacggagacacaccccagctggatctaaaggcgaggcctacctatggcgccggtgaaatcactgttctggtggaggtcgctgacatggagcttcataccaaaaaggtggaaattagcgggctcaagttcgcatccctgacatgcacgggatgttacgcctgcagttcaggcatcagctgtaaagtacgaatacacgtggatgagccagacgaattgactgtccatgttaagtccagtgatcccgacgtggtggctgcctctaccagcttaatggcacggaaactggagtttggtacagattcaaccttcaaggcgttttccgccatgcctaaaacaagtctctgcttctacattgtcgaacgcgagtattgtaagagctgctctgaggacgacactaagaaatgtgtggataccaagctggaacagccgcaatccatccttatcgagcacaaaggcacgattatcgggaagcagaatgacacttgcacagctaaagcctcatgttggctggaaagcgttaagtcgtttttctacggattgaagaacatgctaggctctgtatttgggagtttctttgtgggaatattactcttcctggcaccatttgtccttttagtgctgttcttcatgtttggctggaaaattctcttctgctttaagtgttgcagaaggacccggggtttgttcaaatatcgacatctgaaggatgacgaggaaaccgggtacagacgcatcattgagaggctcaattccaaaaagggaaagaaccgtctgcttgatggcgagcggctggctgacagaaaaatcgccgaattgtttagcactaagacacacataggctga

SEQ ID NO: 10313 - RNA, 5067 nt, synthetic construct
  misc_feature 1..5067: note = derived and/or modified CDS sequence (opt3) from CCHFV(K229_243)__KX013466.1__GP
  source 1..5067: mol_type = other RNA
atgcccaccaacatcatgcacacactgctcgtgtgcttcattctttacctgcagttgttaggcctgggaggagcccaaggtcagagcaatgctactgagcataacgaaacgaataccacaactgcaccttccacctctcagtcaccaaagccgcccgtcagtacaacccctccacacgccctagagagctccactataaaacccacaacccctgcgagagaaacggagggctctggggaaactaccccaccccctaacacaactcagggaccatcgccgcccgaggctacccctgagaggccagccacaaccgcaacgtcaactcccagcacagacaataccaacagtactacacatgttaccgataataaccctacgtccaccatctctacaagcccatcctcaagtcccagcactccgtttacccctcaaggcattcaccatcccgcccggaatctcctgtctgtgtcctcaccaaagacagctactacccctacacccaccagcccacgcgaacttagttctgagacttccagcctgcactcggcaatctctcgaacgtccacattgtataccgccactcaggtatcaaccgaaaacgctaatcacagtgcgccccgtcagagcgagtcctctgcccagcctacaaccactagcccaatgacatcaccggcacaaagtattctcgtgatgtccgccgctcccacggccatccagaacatacatcctagcccaaccaatagatctaaaaggaacctggagatggaaatcattctgactctctcacagggtttaaagaaatactatgggaagatcctgaagctgttgcacctgacactagaggaagacaccgagggactcctggaatggtgtaaacggaatcttggcagtaactgcgatgacgatttctttcagaagcgcattgaggagttctttatgacaggcgaagggtacttcaacgaggtcctgcaatttaaaactttgagcaccctctcccccacggaaccttctcatgcaagaccacccgctgtggagccgttcaagtcgtattttgccaaaggattcctgagcatcgactccggttacttttcagcgaagtgttatcctaggagttctaccagcggcttacagctgataaatgttacacagcacccagcccggattgcagaaactcccgggcctaagaccacatccctcaaaactatcaactgcattaatcttcgcgcttcagtgttcaaggagcaccgagagatcgaaatcaacgtcctgttgccccaaattgccgtgaatctaagcaactgtcatgtagttataaattctcacgtgtgcgattactccctggacaccgatggaccagtcagactccctcatatctaccacgagggcacgtttattcccggtacatataaaatcgtgatagacaagaaaaacaagctgaatgataggtgtacccttgtgactaactgcgtcattaaagggcgggaagttcgtaagggacagagtgtgctgcgccagtacaagacagagatcaaaatcggcaaggctagcaccggctctagaaaattgctctccgaggaaccaggggacgattgtatttcaaggactcagctgttacggaccgagacagccgaaatccatgacgacaattatggaggtccgggcgataagattacgatatgcaacgggagtaccatcgtagaccaacgactgggaagcgagctaggctgttacactattaatcgcgtgaaatcgttcaagctctgcgaaaactccgcaacaggtaagacctgcgagatcgattctacacctgtcaaatgtagacaggggttctgcctgaagatcactcaggagggcaggggacacgtgaaacttagccggggctcagaagttgtgttggacgcctgtgatagttcctgcgaggtcatgattcccaaggggaccggagacatactggtggattgttctggtggccagcaacactttctcaaagacaatctgatcgatcttgggtgcccacatattcccctgttgggaaagatggctatctatatttgtcgcatgagcaaccaccctagaacgacaatggcgttcctcttttggttctcctttggctacgtaattacctgcatattctgtaaggcactgttttattcattaatcattatcggtactctggggaaaaagattaaacagtacagggaactaaagccacagacctgcacaatctgtgagactgcccccgttaacgctatagacgccgaaatgcatgatctcaattgcagctacaacatttgcccttattgtgcaagtcgtctgacctctgacggccttgcccggcacgtgccgcagtgcccaaaacgaaaggagaaggtcgaggaaacagagttgtacctgaatctcgaaagaatcccctggattgtgaggaaactgttacaagtctccgagagcacgggagtggctctgaagcgctcgtcatggcttatcgttttgctcgtgctgctaaccgtatctctgagtcctgtccagtccgccccagtgggccacgggaaaactatagaaacatatcagacccgggagggattcactagcatctgtctctttatgctgggttctattcttttcttggttagctgcctggtgaagggcttagtcgactccgtgtcagatagctttttccccgggctcagtgtatgtaaaacatgctctatcggatccattaacggctttgagatcgaatcacataagtgttactgcagtctgttctgttgcccttattgtagacactgcagcgcagacagggagatacatcagcttcacctgtccatttgcaaaaagcgcaagaccggttctaatgtgatgttggcggtttgtaaacgaatgtgcttccgggctacgatcgaagcctcgcgtagagcactcctgatcaggagcattatcaacactacctttgtcatttgtatactaacactgaccatctgcgtggtgtcaacttccgccgtcgagatggaaaatctcccggctgggacatgggagcgcgaggaagatctgaccaacttctgtcatcaagagtgccaggttacagaaactgagtgtctttgcccctacgaggccttggtgctgcggaagccattatttctcgacagtattgtgaaaggcatgaagaatctgcttaactctaccagcctggaaacgtccctatcaatcgaggcaccttggggagctattaatgtacagtctacattcaaacccaccgtcagcactgccaacatcgcgctcagttggtccagcgtggaacacagaggcaataagatactggttaccgggaggtctgagtcaatcatgaagttggaggaacgaacaggagtgtcctgggatctgggcgtcgaggacgccagtgaaagcaaattactcactgtgtcgattatggatctgtctcaaatgtattccccagtttttgagtaccttagcggtgaccgccaggtggaagagtggcctaaggctacctgtacgggggattgccccgaacggtgtggatgcacatcaagtacctgcctgcacaaagagtggccacattctagaaactggaggtgtaatccgacttggtgctggggcgtaggtacaggctgtacctgctgtggggtcgacgtgaaggatttgttcactgaccacatgtttgtgaaatggaaggtcgagtacatcaagacagaagcaattgtttgcgtggagctcacctcccaggaacgtcagtgtagcctgatcgaggccggaacgcgcttcaacctaggccctgtaactataaccctgtcagaaccccggaacattcaacagaaacttccacccgagatcatcacactccatcctaaggtggaggaagggtttttcgatctgatgcacgtccagaaagtgttgagtgctagcaccgtttgcaagctgcagtcctgtacacatggaatcccaggcgacttacaagtgtatcacataggtaatctcctgaaaggggacagagtcaacggacaccttatccataagattgagccccactttaatacttcttggatgagctgggatggctgcgacctggattactattgtaacatgggtgactggccttcctgcacctacacgggcgtgacacagcataatcacgccgcattcgttaacttgctcaatatcgaaactgattataccaagacatttcacttccattcaaaaagggtgaccgcgcacggggacactccgcagctggatctaaaggcccgaccaacctacggagctggcgagattacagtcctggtagaggtggccgacatggaacttcatacgaaaaaggttgagatctctgggctcaaattcgcaagtctggcttgcactggatgttatgcctgctcgagcggcatatcctgtaaggtgcggatccacgtcgatgaacccgacgagttgaccgtgcatgtaaaatcttcagatcctgacgtggtcgcagccagcacatccttaatggctcgcaagctggaatttggtaccgatagtactttcaaggcgttttctgccatgcccaaaacaagcctctgcttctacattgttgagaaggagtactgtaaatcatgctccgaagaggacacccagaagtgtgtggacacgaaactggaacaaccacagagtatccttattgagcacaaggggactatcataggaaagcagaacgatacatgcaccgcaaaagctagctgttggctggaatctgtgaagtcctttttctatggcttgaaaaatatgctaggttcagtctttggcaacttctttattgggatccttctcttcctgaccccttttgtgcttttagttctgttcttcatgtttggatggaagatcctcttctgctttaaatgttgcagaaggactcggggcttgctgaagtaccgacacctcaaggacgatgaggagacagggtatagacgcattatcgaaaggctgaataacaaaaaggggaaaaatcgtcttctggacggcgagcggttggccgatagaaagatagccgaactattcagcaccaaaacacatattggttga

SEQ ID NO: 10314 - RNA, 5067 nt, synthetic construct
  misc_feature 1..5067: note = derived and/or modified CDS sequence (opt3) from CCHFV(K229_194)__KX013463.1__GP
  source 1..5067: mol_type = other RNA
atgcccatcaacattatgcacaccctgctcgtgtgcttcatactttacctgcagttgagcggcttagggggagcccatggtcaatccaatgctacagagcacaacggcactaatacgaccacagtccctgggacttctcagtcaccaaagccgcccgcaagtaccacactgcctcataccccagaaagctccactgttaaactaacaacccccacgtctgagactgaaggatcgggcgagaccacacctccacccaacactacccagggtctccctccaccggggacaacccccgaaagacctgccacgactgcgacatcaaccagcagtactgacaatatgaactccacaacccaggtgacggataataccccaatctctacagtaagcatttccccctcaagtagcccttctatgccatccacttcacaaggaatccactatcccgtgaggagcctgcttagtgtctcttccccgaagaccgtgacaactcctacccccatgagcccaggcgagatgtcgcctgagacatcttcccagcattcagctatgagtcggattcccaccctgtacactgccacgcaggttagcacagaaaacaccaatcgctccactccacgacagtctgagagctcagcacaacccgccacccagagtcctacaacctccccaactcagacaatcttgctcatgagcgctgcaccgaaagccatacaggacatgcacccctctcctacgaaccgttcaaagagaaatctggaagtggagatcattctgaccctcagtcaaggcctgaaaaagtattacgggaagatcctgaaacttttgcacctgactctagaggaagatacagagggactcctggaatggtgtaagaggaaccttggtagcaattgcgacgatgactttttccagaaacggattgaggaatttttcatcaccggcgaggggtattttaacgaggtcctgcagttcaagacattgaatactctctccccaaccgaaccctctcatgtgcgcctgcctacggctgagccatttaaatcgtacttcgccaagggatttttaagcgtagattccggctatttctcagcgaagtgttaccccagaagttctaccagcggtctgcaactcataaacgttacacagcacccggcaaggattgccgaaactcctgggccaaaaaccacatcccttaagactatcaactgcattaatctgcgggcttcagtgtttaaagagcatcgcgaagtcgagatcaacgtgttgctaccccagatcgccgtgaatctgagcaactgtcacgtcgttattaattctcacgtgtgcgactactccctcgataccgacggacctgtacgactgcccagaatacatcacgagggcacgttcatcccaggcacatataagattgtgatcgataaaaagaacaaacttaatgacaggtgtagtctggtcaccaactgcgtgataaaggggcgggaagttcgtaagggacagagcgtgttgcgccaatacaaaactgagattaagatcggtaaagcatctacaggctccagaaagctcctgtcagaagaacctggggatgactgtatcagtaggacccagttactgaaaactgaaaccgctgagattcatgacgataattatggaggccccggtgacaagatcacaatttgcaacgggagcacgatagtcgatcagcggctaggctcggagctcggatgttacaccatcaatcgagtgaagtcctttaaactgtgcgaaaactctgccactggcaagacatgcgagattgacagcaccccagtaaaatgtcgccaggggttctgccttaagatcacacaagaaggaagaggtcacgttaaattgtcaaggggcagtgaggtggtcctggatgcgtgtgactcctcttgcgagatcatgattccgaaggggactggagatatactcgtggactgtagcggcggtcagcagcatttcctgaaggggaatcttatcgatctgggctgccctcacattcccttgctcggaaaaatggccatctatatttgtcggatgtccaaccacccacgcaccacgatggcatttctgttctggttttcattcggctacgtcatcacatgcatattttgtaaggctttattctatagcctgatcattatcgggaccctagggaaaaagattaaacagtacagagaactcaagccccaaacttgcaccatctgtgagacagcccctgtgaatgctatagacgccgaaatgcatgatctgaactgcagttacaacatttgcccatattgtgcatctaggcttacttccgacggtttggcccgtcacgttacccagtgccccaagcggaaagagaaggtggaagagacagagctgtacctcaatctggaacgaatcccttggattgtaagaaaattactgcaggtcagcgagtcgacgggcgtggctcttaagaggtcatcttggttgatcgttctcctggtgctactgaccgtcagtctctccccggtgcagagcgcgccagtagggcatggaaaaactatagaaacatatcaaacccgcgagggctttactaacatctgtctgttcatgcttggttctattttgtttatcgtgagctgcctggttaaggggttagtcgactccgtgtcagatagtttctttcccggcctcagcgtgtgtaaaacatgctctattggatccatcaatggcttcgaaatagagtcacacaagtgttactgcagtctgttttgttgcccttattgtcggcactgcagcgcagacagagagattcatcagcttcacctggggatctgcaagaaaaggaagaccggatccaacgtcatgttggccgtttgtaaacgcatgtgcttcaaggctacgatcgaagcctctcgacgggcactcctgattcgttcgatcattaatactaccttcgtgatatgtatcctaacactggccatttgcgtggtaagcacctcagctgtcgagatggaaaacctcccagccggcacttgggagagagaagaggatctgacatccttttgtcatcaggagtgccaagtgaccgaaacagagtgtctttgcccctacgaagcattggttctgaggaaacctttattcctcgacagtatcgtgaagggtaagaaaaatctgcttaactctactagcctggagacctccctatcaattgaggcgccgtggggagctatcaatgtccagtctacgtttaagcccacagtgagcaccgccaacatagcactcagttggtccagcgttgaacaccgcggaaataaaatcctggtgactggccggtctgagtcaattatgaagttggaagagagaaccggtgtatcctgggatctgggcgtcgaagacgccagtgagagcaaattactcacagtgtcgatcatggatctgtctcagatgtattccccagtgttcgagtaccttagcggggacaggcaggtcgaagagtggcctaaggctacttgtaccggagattgccccgaacgatgtggctgcacgtcaagtacatgcctgcataaggagtggccacactctcgcaactggcggtgtaatcctacctggtgctggggagttgggactggctgtacatgctgtggtgtggacgtaaaagatttgtttaccgaccacatgttcattaagtggaaagtggaatacatcaagactgaggccatagtctgcgtggagctcacatcccaagaaagacagtgtagcctgattgaggcagggaccaggtttaacctaggacccgttacgatcactctgtcagaaccacgtaatatccagcagaaacttccgcctgagattataaccctccatcccaagatcgaagagggcttctttgatctgatgcacgtgcaaaaggtcttgagtgctagcacagtgtgcaaactgcagtcctgtacccatggtattccaggcgacttacagatctatcacattgggaacctcctgaagggagaccgccttaacggccatctgatccacaaaatagagccccacttcaatacatcttggatgagctgggatgggtgcgacttggattactattgtaacatgggagactggccttcctgcacttacaccggcgttacgcagcataatcacgccgcgtttgtgaacctcctgaatatcgaaacagattatactaagaccttccattttcactcaaaacgggtcacagcccacggtgacaccccacaactagatctgaaggctagacccacttacggggcaggagagattaccgtacttgtggaagttgccgacatggagctccatacgaaaaaggtggagatctctggcctgaagttcgctagtttggcctgcacaggttgttattcgtgcagctccggcatttcttgtaaagtcaggatccacgtggatgaacctgacgagttaactgtacatgtgaagtcaagcgatccggacgtcgttgcagcgtccaccagtctgatggcccgaaaactcgagttcgggacagattctacctttaaggctttcagcgccatgccaaaaacttcactgtgcttttacatagtggagcgggaatactgtaagtcctgcagtgaggacgacacaaagaaatgtgtggataccaaacttgagcagccccagagcattctgatcgaacacaaaggaacgatcattggcaagcaaaacgacacttgcacagcaaaggcttcttgttggttggagtccgtcaagtcattcttttatgggctaaagaatatgctgggaagcgtgttcggcaactttttcgttggtatcctcctgtttcttgcccctttcgtattactggtgctctttttcatgttcgggtggaaaatattgttttgcttcaagtgttgccgcagaaccaggggactgtttaaataccggcatctcaaggatgacgaagagaccggctatcgaaaaattatcgaaagattaaattcgaagaagggcaaaaaccgccttctggatggggagaggttggcagaccgtaagattgccgagctattctctactaaaacacacatcggatga

SEQ ID NO: 10315 - RNA, 5067 nt, synthetic construct
  misc_feature 1..5067: note = derived and/or modified CDS sequence (opt3) from CCHFV(Gaib)__KX013445.1__GP
  source 1..5067: mol_type = other RNA
atgcccgtgagcatcatgtacattcctctggtctatgccgttatatacctccagctttatggcctgggcggagctcacggtttgttaaacaagaccgagcaaaatgaaacaggcatcactgcaacgcatgggagagtgcagggaccaccgtccgcctctattaccctgcccgtaacacctgacccactatcagcgactagcgctgccagcacctccggccccgagggttctggggaagtgcctacatcgccatcaaccatcactcagggactcacaagcagtgagaacacaccccagctgcctacggcaactgataccggcatttcctctacaagcatcatagacgtctccactcaaaccgccggcgatacatcaaccccaacggctcacactagccttccgaatagcccctctgcacctttcacatcccaggacaccaggcatactgtgcgggggctgttgacagttacctcaacgaaaagcgatgaagccagtaccctcacagacccaaaggaggcttctactgaggcccgctcccccagcccttcgatctctcgaaccccaacaccctccccgactgtgcaggcgtcaaccgaaaacaatacacctagtactccccgtcagccagagcctactacgagacccgcactgccaagccccacaacctcccctactcaaccatctctgagccagtcagccaccagtgctgccattcaggatatgcacccgtcccccacaaacaggagccggcgcaatctcgaaatggagatcattttaaccctgtctcagggacttaaaaagtactatggtaaaatcttgaagctgctagacctcactctggaggaagatacagagggccttctggaatggtgcaagagaaacttggacctcacgtgtgatgagaactttttcctgaaaaggatagaagagtttttcttatcaggggagggacattttaatgaagtcctgcaattcaaggcacctagtaccatgagctccactgagccaacacacgctgggccccctaccgtggaaccatttaaatcttacttcgccaagggttttctctcgattgacagcgggtatttctccgcgaaatgctacccccggacatcaaatagtggacttcagctgatcaacgtaactcagcacaccgcccgcattgcagatacgccgggccctaagatcaccaatgttaagacaatcaactgtattaatttgaaggcttctgtgtttaagaaacatcgagaggtcgaaataaacgtgctactgccacaaatcgccgtgaacctcagcaattgccacgtcctgattaagtcccatgtttgtgactactcacttaacttcgacggcatggtgagactgcccaggatccaccacgaggggacttttatacctggaacctataaaattgtaatcgatcggaagaataaacagaacgaccgttgcacattggtgactaattgtgtcatcaagggtcgcgaggtgagaaagggccagagcgctctcaggcagtaccggaccgaaattaaaatcggggaggcctctattggatcccgacgcctgttaagtgaagagagctctgatgactgcatatccagaacgcaactgctaaggacagaaaccgcagagatccataacgataattatggcggtcccggggacaagattactatctgtaacggctcaacaatcgttgatcagcggctcggaagtgagctgggctgctacaccattaatcgcgtgaaaagtttcaaactttgtgaaaactcggccactgggaaatcctgcgagatagactctatcccagtcaagtgcagacagggattctgtttgaagattacccaggaaggtaggggccacgtgaaactgagccgtgggtcagaggtagttctcgatgcttgcgacagttcctgtgagatcatgattcctaagggaacaggcgatatcctggtggactgctctggtgggcaacagcattttcttaaagacaatctgatagatttgggctgtcccaacatcccactcctgggaaagatggcgatttatatctgccggatgagcaatcacccgaaaacgaccatggcattcttattttggttctcctttggctacgtcattacttgtatcttctgcaaggccatattttatctgctaattatcgtggggacactcggaaagaaattcaagcagtaccgagaactgaaacctcagacctgtacaatttgcgagactacccccgtcaacgctatcgacgccgaaatgcatgatcttaattgttcatacaacatatgcccatattgcgcaagcagattgacgagtgacggtctggccaggcacgtggttcactgtcccaagcgcaaagagaagatcgaagagacagagctctacctgaacttagaacgggtgccttgggtagtcagaaagctgcttcaagtgtctgagtccaccggcgttgctttgaaaaggagctcgtggctcattgtgctgctagtcctgctcactgtgtcactgtctccagtacagagtgcccccatcgggcatggaaagaccattgaaacatatcagactcgcgagggctacacctccatctgcctttttgtgttgggtgggatactgttcattgttagctgtttaatgaaaggcctcgtcgattctgtgggaaataactttttccctggcctgacaatctgcaagacgtgtagcatctcctcaattaatgggtttgaaatcgagagtcacaaatgctattgtagccttctgtgctgtccgtactgccgacattgttctgcagaccgggagattcaccagttgcacctctccatatgcaagaaacgtaagaccggatcaaacgtgatgctggcggtctgcaagagaatgtgtctaagggttactacagaagtgagtaatcgcgctctgttcatccggagcattatcaacaccactttcgtgatttgcatcctcatactggccgtatgtgtcatctccacatctgcagtggagatggaaaatcttccagccggcacctgggagagagaagaggatttgacgaacttttgccatcaagagtgtcaggttactgaaaccgagtgcctgtgtccctatgaggctttagtgctcaggaaacctctgttctcggacagcattgtcaagggtatgaaaaatcttctgaactcaacatccctagaaaccagtctctctatcgaggccccatggggagcaattaatgtgcagagcacttttaagcccacagtttccaccgctaacatcgccctgtcatggtctagcatagaacaccgagggaataaaattttggtgagtggccgctccgagagcatcatgaagctggaggaacggacaggtatctcttgggatttaggcgtagaagacgcgtcagagtccagactcctgactgtcagtgtgatggatcttagccaaatgtactcgcctgtgttcgagtacctgtctggggacaggcaggtcgaagagtggccgaaggctacctgcacgggagattgtcccgaacgttgcggctgtacatccagtacctgcttgcataaagagtggccacactcacgcaactggcggtgcaatcctacttggtgttggggagttgggaccggctgcacatgttgcggtctcgacgtgaaggacctgtttactgattatatgttcgtaaaatggaaggtggaatacattaaaaccgaggccatagtctgtgtggagctaacgagtcaggaaagacagtgctctctgatcgaggcagggacaaggtttaaccttggacccgttaccattactctctccgaaccacgaaacatccaacagaagctgcctcccgagattatcacattgcatccacggatagaagagggcttctttgacctgatgcacgtgcagaaggtcttaagcgcctcaaccgtgtgtaaactccagagttgcactcacggtgttccgggcgatctgcaagtgtatcatatcgggaatcttctgaagggagacaaagtcaacggccacttgattcataagatcgagcctcacttcaatacaagctggatgtcctgggatgggtgtgacctcgattactattgcaacatgggagactggccctcttgtacctacacgggcgtaactcagcataatcacgctgcctttgtgaacctgctaaatattgaaaccgattataccaaaaacttccactttcatagcaagcgcgttaccgcacacggtgacacaccacagctggatcttaaggcgagacccacttacggggccggagagatcaccgtgctcgtcgaagtggctgacatggagctgcatacgaaaaagatagagatttccggcttgaaattcgcctcattaacatgcactggttgctacgcatgttctagtggcatctcgtgcaaggtaaggatccacgtggatgaacctgacgagctgaccgtccacgttaaaagcgaagacccagatattgtggctgcctcctcttcactcatggcacggaagctggagttcgggacagacagcacctttaaagccttctccgctatgcccaagaccagtctttgtttttatatcgtggaacgagagtactgcaagtcttgtagcagagaggatacccagaaatgcgtctcaacaaagctggaacaacctcagtccatattgattgagcataaaggaacgatcattggcaagcagaataacacttgtaccacaaaaaccacttgctggctagaaagtgttaagagcttcttttatgggctgaagaatatgctctcttccatcttcggaaacgtgtttgtaggcatattctcatttctggcgccgttcattcttttaatcctgtttttcatgttcggttggcgcatcctcttttgtttcaaatgctgtaggcgtacacgggggttgtttaagtacagacacctgaaagacgatgaggaaaccggatataggcgcattatcgagcgactcaataacaagaaaggcaagagcaagctgcttgacggcgagagactggccgatcggaaaattgcagaattgttctcgacgaagactcatatagggtga

SEQ ID NO: 10316 - RNA, 5067 nt, synthetic construct
  misc_feature 1..5067: note = derived and/or modified CDS sequence (opt3) from CCHFV(Kosova Hoti)__EU037902.1__GP
  source 1..5067: mol_type = other RNA
atgcccatcaacattatgcacaccctgctcgtgtgcttcatactttacctgcagttgttaggcctgggaggagcccatggtcaaagcaatgctacagagcacaacggcactaatacgaccacagcacctgggacttcccagtctccaaagccgcccgcctcaaccacacctagtcatgcgccagaacccagcaccatcaaactaactacacctacctccgagacggaaggatctggcgagactaccccacccacaaacactacccaggactcgcctccactcgaaacaaccccggagagatcagctacgactgccacaagcaccagtggtactgataatatgaactccacaacccagatgacggacaatacccccacatctactgtcagcacctccctgtcaagtagcccttctacaccatccacttcacaagggatgcaccatcccgttaggagccttctgagtgtgtcttcccctaagaccgcaacaaccccaactcccatgagcccgggagagatgtcgtctgaaacgtcctcacagcacagtgccatgagccggacacctacaccccacactgctacccaggtatccacagagaacgcaaatcgctctaccagccgacagtcagaaagttccgcccaaccagctactcagagccctgtgacatctcccgcccagtcaattttgctcatgagtgcgacgccaaccactatccagaacattcatcccagccctacaaatcgttccaaaagaaacctggagatggagatcatactgaccctctctcaaggcttaaagaaatattacggcaagatcctgaaacttttgcacctgacactagaagaggatactgaagggctcctggagtggtgtaaaaggaatcttggatcgaactgcgacgatgactttttccagaagcggattgaagagtttttcatcaccggtgagggctattttaatgaagtcctgcagttcaaaacgttgagcaccccatcctcaacagagccgagtcatgcacgcctccccactgccgaaccttttaagtcttacttcgctaaagggtttctgagcattgattccggatatttctcagccaagtgttacccaagaagctctacctccggcttacaactgatcaacgtgacacagcaccccgcaaggatagctgagactcctggtccaaagaccacgagtctcaaaacaattaactgcatcaatcttcgggccagcgtttttaaggaacaccgcgaggtggagattaacgtcctgttgccccagatcgcggtgaatctatctaactgtcatgtagttatcaattcccacgtgtgcgactattcactggataccgacgggccggtccgactccctagaatttaccatgaaggaactttcatgccaggcacatacaaaatagtgatcgataggaagaacaaactgaatgaccggtgtacccttgtgactaactgcgtcattaagggccgtgaggttcgcaaagggcagagtgtgctgagacaatataagaccgaaatcaagataggaaaagcccccacaggtagcaggaagttgctctcggaggaacctggcgatgactgtatttcccggacgcagctgttacgaaccgagactgcagagatccacgacgataattacgggggacccggcgacaaaatcacaatttgcaacggttctaccatcgtagatcagcgcctggggagcgaactaggctgttatacaattaatagagtgaagtcatttaaactctgcgagaacagtgctactggaaagacctgcgaaatagactccacgccagtcaagtgtaggcagggcttctgcctgaaaatcacacaaaaggggcggggacatgtgaaactttctcgcggtagcgaggttgtgttggatgcctgtgactccaattgcgaggtcatgattcctaagggcaccggggatatcctggtggactgttcaggaggccagcagcacttcctcaaagataacctgatcgaccttggttgcccccacattccactgttggggaagatggctatatacatctgtagaatgagcaatcatccgaagactaccatggcctttctcttctggtttagtttcggctatgtaattacatgcatcttttgtaaagcactgttctactctttaattatcataggaactctgggcaagaaaatcaagcagtatagggaactaaaacctcaaacctgcacaatttgtgagacggcccccgttaacgctatcgatgcggaaatgcacgacctcaactgctcctacaatatttgcccatactgtgcaagccgtctgacctcggacgggcttgcccggcatgtgaagcagtgccccaagcgaaaagagaaggtcgaagagactgagttgtatctgaacctcgaaagaatcccttgggtggtcaggaaactgttacaggtgtcagagtctacaggagttgctctgaagcgcagttcctggcttatagtgttgctcgtactgctaaccgtcagcctgtctccagtgcagagcgcccccgttggtcacggcaaaactattgaaacataccaaacccgggaggggtttacgtccatctgtctcttcatgctgggatcaattctttttatcgtgagttgcttggtcaagggcctggtggatagcgtatctgactccttctttcctggtttatcagtgtgtaaaacttgcagtatagggagcatcaatggcttcgaaattgagtcccacaagtgttattgctctctcttttgttgcccgtactgtagacattgctcggcagatagggagatccaccagctgcatcttaacatttgcaagaaacgcaagaccggaagcaatgttatgctggccgtctgtaaacgaatgtgcttccgggctacaatcgaagcctcacgtagagcattgctcataaggtccattatcaacaccactttcgtgatctgtattctgacactaaccatctgcgtggtcagtacatctgcggttgagatggaaaatctgccagctggcacttgggagcgcgaagaggacctcaccaacttttgtcaccaggagtgccaagtgacggaaacagagtgtctgtgcccctatgaagcccttgtgttgcggaagcctctgttcttagatagcattgtaaaagggatgaagaatctcctgaactccacctcacttgagacttctctgagcatagaggcaccatggggagccatcaatgtccagagtacctttaagcccacagtgtccactgctaacattgccctaagctggtcttcagttgaacatagaggcaataaaatcctcgtgaccggtaggtccgagagtattatgaagctggaggaacgaacggggatcagctgggacttgggagtcgaagatgcatcggagtctaaactgttaacagtgtccataatggacctcagccagatgtactcacctgttttcgagtatctgagtggcgatcgccaggtggaagagtggccgaaggctacctgtactggtgactgcccccaacggtgtggctgcacatcttccacttgccttcacaaagaatggccacacagcagaaactggaggtgtaatcctacctggtgctggggagtaggaacaggctgtacctgctgtggggtcgatgtgaaggacctgtttacggatcatatgttcgtgaagtggaaagtcgagtacatcaagactgaagccattgtttgcgtggagttgacctcacaggagcgtcagtgtagtctcatcgaagcgggaacacgctttaacctgggccccgtaaccattacactaagcgagccacggaacatccagcaaaaactgcctcccgaaataattactcttcacccaaagatcgaggaaggtttctttgacctcatgcatgtgcagaaagtcctgtccgcctctaccgtgtgcaagttgcagagctgtacgcacgggatcccgggagacctgcaggtttaccatattggcaatttactcaagggtgatagagtgaacggccacctgatacacaaaatcgagcctcatttcaatacatcctggatgtcatgggacgggtgcgatcttgactattactgtaacatgggagattggccctcttgcacttataccggcgtcacacaacacaatcatgctgcatttgtgaacctgttgaatattgagaccgactacactaagaccttccactttcacagtaaaagggttacagcccatggggatacgccacagctcgacctgaaggctcgacccacttatggagccggcgaaatcaccgtgctagtcgaggtagcagatatggaactgcacaccaaaaaggtggagatttcgggtcttaaattcgcgagcctcgcctgcaccgggtgttacgcttgctcctctggaatctcatgtaaggttcggatacatgtggacgagcctgatgaactgactgtccacgtaaagagctccgacccagatgtggtggccgcaggcacaagtttgatggctcgcaaattagagttcggtaccgactctacgtttaaggccttcagcgcaatgcccaaaacttcactgtgcttttatatcgtcgaaaaggagtactgtaaatcctgcagtgaagacgatacaaagaagtgtgttgacaccaaactcgagcagcctcaaagcattctgatcgagcatagaggcaccattatcgggaagcagaacgatacttgcacagccaaggcttcttgttggcttgaatccgtgaagtcattcttttacggactgaaaaatatgttgggcagcgtgttcgggaactttttcatagggattctactgtttctcgcgccgttcgtcctgcttgtgttatttttcatgttcggctggaagatcctgttttgcttcaagtgttgcaggcggacccgaggtctctttaaatatagacacttgaaggacgatgaggaaacagggtaccgcaggatcattgagcgtctgaataacaaaaaggggaaaaatcggctcctggacggcgaaagacttgccgataggaagatcgcagagctgttctcgactaagacgcacataggctga

SEQ ID NO: 10317 - RNA, 5067 nt, synthetic construct
  misc_feature 1..5067: note = derived and/or modified CDS sequence (opt3) from CCHFV(Turkey200310849)__DQ211636.1__GP
  source 1..5067: mol_type = other RNA
atgcccaccaacatcatgcacacactgctcgtgtgcttcattctttacctgcagttgttatgtctgggcggggcccatggacaactaaatactacggagcacaacggtaccaataacacaactgctcctggcgcaagccagtccccaaagccgcccatgtctaccacacctccacatgcccccgaatcaagtaccataaaacctactacaccaatcagcgaggcggaagggtccggagagaccacgtctactcccaataccacacagggcctctcgtcacctgaaactaccagcgagagaccagctacaaccgccattagtacgtcctctactgacagcacaaacccgaccactcagatgacagataatacccccacgctgaccgtctccacatcacctagtagctctccatccactccctcaacccctcaaggtatctatcacccagcaaggagccttctgagtgtttcttcccccaagacagtgactaccccgacacctaccagccccggggagatgtcgtctgaaacttcctcacagcatagtgccatgagccggattccaacgcctcacacagctacccgcgtatccactgagaacaccaatcactctacaccccgacagagcgaatcaagtgcacagcaaaccactccatcccccatgacaagccctgcccagtctatcttgctcatgtcagctgccccaacggcggtgcaggacatacatccgagtcccaccaaccgtagcaaaagaaatctggagactgagatcattctgacactctcccagggattaaagaaatactatggcaagatcctgaaacttttgcacctgaccctagaagaggatacagaaggcctcctggagtggtgcaagaggaaccttgggtctaattgtgacgatgactttttccaaaagcggattgaagagtttttcatgactggagagggttactttaacgaagtcctgcagttcaaaaccttgtcgacgctcagccctaccgagccatcccatgcacgcctgcccacagccgaaccttttaagtcatatttcgctaaaggctttttaagtatcgattctgggtacttcagcgccaagtgctatccaagatcctcagcaagcggactgcagctcataaatgtgactcaacaccccgctaggattgccgagaccccgggccctaagacaacttctcttaaaaccatcaactgtattaacctgcgggcgtccgtttttaaggaacaccgcgagatcgagatcaatgtgttgctaccacagattgccgtcaacctgagtaattgccatgtggtaataaacagccacgtttgtgactactctctcgatacggacggtcccgtgcgactgcctagaatctaccatgaagggacattcattcccggaacctataaaatcgtcatagataagaaaaataaacttaacgacaggtgcactctggtgacaaattgtgtgattaagggccgggaggtccgtaagggccagtccgttttgcgccagtacaagaccgaaatcaaaatcgggaaggcatcaactggatttagaaaactcctgagtgaggaaccaggtgatgactgcattagcaggacccaattactgcggacagagacggctgagatccacgacgataactatggcgggcctggagacaagattaccatatgtaatggctcgactatcgtggatcagcgactaggttccgaactcgggtgctacacaattaaccgcgtaaaatctttcaagctgtgcgagaatagcgccaccggcaagacatgtgaagtggactcaactcccgtcaaatgcagacagggattctgtcttaagatcacccaggagggcagggggcatgtgaaattgagtcggggatccgaggttgtgctggatgcttgcgactctagctgtgaagtcatgatcccaaagggtacgggcgatattctcgtggactgctccgggggacaacagcactttctgaaagataaccttatagacctgggctgtccgcacatccctttgctcggtaagatggccatttatatctgccgcatgtcaaatcatcccagaacaaccatggcattcctgttttggttcagctttgggtacgtaattacttgtatcagttgcaaggccttattctattctctgataatcattggcaccctagggaaaaagatcaaacagtacagggagctcaagccacagacatgtactatttgcgaaaccgctcccgttaacgcgatcgatgcagagatgcacgacctgaattgctcctacaacatatgtccttattgcgccagccgtcttacatcggacggcttggctcggcatgtgacgcaatgtccaaaacgaaaggaaaaggtcgaggagaccgaactgtacctcaacctggagaggattccctggatcgtgagaaaattactgcaggtctcagaatctactggggtggcccttaagcgcagttcctggttgattgttctcctggtgctactgacagtaagcctctctcctgtccagagcgcaccggtgggacacggtaaaaccatcgagatatatcagactcgggaaggctttgcctccatctgcctgttcatgcttgggtcaattttgtttatcgttagttgtctggtgaagggattagtcgatagcgtgtctgactccttctttccaggcctctcagtatgcaaaacatgtagtattggtagcgtgaatgggttcgagatcgagtcccacaagtgctactgttctctgttttgctgtccctattgcagacattgctcggctgatagggaaatacaccaacttcatctgagcatttgtaaaaagcgcaagaccggctcaaacgttatgttggccgtctgcaaacgaatgtgtttccgggcaacgatcgaggcgtcccgtagagctctcctgatcaggagtattatcaatactaccttcgtgatttgcatactaacactgaccatctgtgtggtctctactagcgccgttgaaatggagaacctccctgcaggaacatgggaacgcgaggaggacctgaccaatttttgccaccaggaatgtcaggtgacagagactgaatgcctttgtccatacgaggccttggtgctgcggaagcccttattcctcgattccattgtaaaaggcatgaagaacctgcttaattcaacctctctggagacgagcctaagtatcgaagctccttggggagccattaacgtccaatccacatttaaaccggcagtgagcaccgctaatatcgccctctcttggtcatccgttgagcatagaggaaacaagatactggtgactggcaggagtgaaagcatcatgaagttggaggaacgaaccggtgtctcgtgggacctgggggtggaggatgcgtctgagtccaaattactcacagttagcattatggacctgtcacagatgtatagtcccgtgttcgaatacctttctggagatcgccaggtagaggaatggccaaaggccacttgcaccggcgactgtcctgagcggtgcggttgcacgtccagcacatgtctgcacaaagaatggccccactcaagaaattggaggtgcaacccaacctggtgttggggcgtcgggactggatgcacatgttgcggcgtggatgtgaaggacttgtttaccgatcatatgttcgtcaaatggaaggttgagtacatcaagactgaggctattgtgtgtgtagaactcacaagtcaggagcgtcaatgcagcctgatcgaagcagggacccgctttaatctaggacctgtgacgataactctgtccgagccccggaacattcagcagaaacttccaccggaaatcatcaccctccaccctaagattgaggagggcttctttgacctgatgcatgtccagaaagtgttgtctgccagcacagtttgtaagctgcaatcctgcacccacggtatacccggggacttacaggtgtatcatatcggaaatctcctgaaaggcgatagagtcaacggtcaccttattcacaagatcgaatcacatttcaacacatcttggatgagttgggacggctgtgatctggactactattgcaatatgggggattggccatcgtgcacttacaccggagtgacgcagcacaaccatgctgcctttgttaatttgctcaacattgagacagactatactaagaccttccactttcacagcaaaagggtgacagcacatggcgatacaccccagctggacctaaaggcgcgacctacttacggggccggagaaatcaccgtcctggtagaggtggctgatatggagcttcacaccaaaaaggttgaaatatccggcctcaaattcgcctctctggcatgtacgggttgctatgcttgttcaagcgggatctcctgcaaggtgcggattcatgtcgacgagccagatgaattgactgtgcacgtaaaaagttctgaccccgatgtggtcgccgcaagcacctcattaatggcccgcaagctggagttcggaacagactccacctttaaggctttcagtgcgatgcctaaaactagcctctgtttttacatcgttgaaagagagtactgcaagtcttgttccgaggacgatacacaaaaatgcgtggacaccaggctggaacagccgcagtcaattcttatcgagcataagggcacgataattggtaaacaaaatgatacttgtacagccaaggcaagctgctggctggaatcggtgaagtctttcttttatggcttgaaaaacatgctagggagtgtcttcggaaatctgtttatcggcatcctcctgttccttgctccatttgtgttactggttctcttctttatgttcgggtggaagattttgttctgttttaaatgctgccggcgaaccagaggactgttcaagtaccgccacctcaaagacgatgaggaaaccggctataggcgtatcatagagcggctgaactccaagaagggtaaaaatagacttctggacggggataggttggccgaccgcaagattgccgagctatttagcactaaaacacacatcggatga

SEQ ID NO: 10318 - RNA, 5067 nt, synthetic construct
  misc_feature 1..5067: note = derived and/or modified CDS sequence (opt3) from CCHFV(Kashmanov)__DQ211631.1__GP
  source 1..5067: mol_type = other RNA
atgcccaccaacatcatgcacacactgctcgtgtgcttcattctttacctgcagttgttaggccttgggggagcccatggtcaaagcaatgctactgagcacaacggcacgaataccacaactgcaccttccacctctcagtcaccaaagccgctagtcagtacagcgccccctcatgccctcgaaagctccaccataaaaccaactacacccgcttctgagaccgaagggtcgggagagacgactcctccacccaacaccacacagggcccttcaccaccggaaactacccccgagagacctgccacaaccgcaacgagcactccaagtacagacaataccaactccactacacacgttaccgataataaccccacgtctaccatcagcacatccccttcaagtagcccatctactccctccaccccgcagggtattcatcaccctgccaggaatctgctttcagtgagcagtcccaagacagctactaccccaacacctacctctcccggggagatctccagcgaagcatcgtctctgcactccgccatgtcacggactagcacgttgtatacagctacccaagtaagcactgagaacgccaatcattccgcgccacgccagtctgaaagctcagcacagcccaccacaaccagtcctatgacttccccagcccagagcattctcgtgatgtctgctgccccgatcgcaatacaaaacatccacccctcacctacaaatcgaagtaaacgtaacctggagatggagattatcctgacgctcagccagggattaaagaaatactatggcaagattctgaagctgttgcatctgaccctagaagaggacactgaaggcctcctggagtggtgtaaaagaaatcttgggtccaactgcgatgacgactttttccagaagaggatcgaagagtttttcatgacaggagagggttactttaacgaagtcctgcagttcaaaaccttgtctacactctcgccaactgagcccagccacgctggccctccaaccgtggaaccctttaagtcctatttcgccaaagggtttctgtcaatagatagtggatacttctctgcgaagtgttatccgcggagctccacgtcaggcttacaactgattaatgttacccagcaccctgcccgcatcgcagagacaccaggtcccaagactaccagcctcaaaacaattaactgcatcaatcttagagcttctgtgtttaaggaacatagggagatcgagattaacgtcctgttgcctcagatagccgtgaatctatccaactgtcacgtagttatcaatagtcatgtgtgcgattacagcctggacactgatgggcccgtccggctcccacacatttaccatgaaggaaccttcatccctggcacgtataaaatagtgattgacaagaaaaacaagctgaatgatcgctgtacacttgtgaccaactgcgtcatcaaaggccgagaggttagaaaggggcaatctgtgctgaggcagtacaagactgaaatcaaaattggaaaggcttccacaggttcacggaaattgctcagtgaggaacccggcgacgattgtatcagccgtacccagctgttacgcactgagaccgccgagattcacgacgacaattatgggggaccaggcgataagataacaatctgcaacggttcgacgattgtagaccagagactggggtccgaactaggctgttacaccatcaatagggtgaaatcttttaagctctgcgagaacagcgcaactggaaagacatgcgaaatcgattcaaccccggtcaaatgtcggcaaggcttctgcctgaagattacacaggaggggcgaggacacgtgaaacttagtcgcggttccgaggttgtgttggacgcctgtgattctagctgcgaagtcatgatacctaagggcactggggacatcctggtggattgttccggaggccagcagcatttcctcaaagacaatctgattgatcttggttgcccccacatcccactgttggggaagatggctatttatatctgtagaatgtcaaaccatcccaggaccacgatggcgtttctcttctggtttagcttcggctacgtaataacatgcatcttttgtaaggcactgttctatagtttaattatcattggaaccctgggcaaaaagatcaaacaataccgggagctaaagcctcagacttgcaccatatgtgaaacagccccagttaacgctattgacgccgagatgcacgatctcaattgctcttacaacatctgcccctattgtgcatcccgcctgactagcgacgggcttgccagacacgtgcctcagtgcccgaaaaggaaggaaaaggtcgaggagaccgaattgtacctgaatctcgagcgtattccatggatcgtgcggaaactgttacaggtctcggaatcaacaggagtggctctgaagcgatctagttggcttatagttttgctcgtgctgctaacggtatccctgagccccgtccaatctgcccctgtgggtcatggcaaaaccatcgagacttatcagacaagagaagggtttaccagcatttgtctcttcatgctgggatccatcctgtttttggtttcatgcctggtgaagggcttagtcgacagtgtgagcgattctttctttccaggtctctccgtatgtaaaacttgcacaattgggtcaatcaacggcttcgagatagagagtcacaagtgttactgcagcctgttttgttgcccctattgtaggcattgctccgcagaccgcgaaattcaccagcttcatctgtctatctgcaaaaagcggaagaccggatcgaatgtgatgttggcggtttgtaaaagaatgtgcttcagggctacgatcgaggccagccgccgagcactcctgattcggtcaatcattaacactaccttcgtcatatgtatcctaacactgaccatttgcgtggtgtccacaagtgccgtcgaaatggagaatctcccttctggcacatgggaacgtgaggaggatctgaccaacttttgtcaccaggaatgccaagttacagagactgaatgtctttgcccgtacgaggctttggtgctgagaaagcccttattcctcgacagcatcgtgaaagggatgaaaaattccctgaactcaacctctcttgagacgagcctgagtattgaagccccatggggagcaatcaatgtacagtccacatttaagcctaccgtcagcactgctaacatagccctatcttggtcatccgtggagcacaggggcaataagatcctcgttaccggtcgcagtgaaagcattatgaagctggaggaacggacaggggtgtcgtgggatttgggagtcgaggacgcgtctgagtccaaactgttaactgtgagcatcatggatctctcacagatgtatagtcccgttttcgaatacctgtctggcgacagacaagtggaggaatggccaaaggccacctgtacgggtgattgccctgagaggtgtggctgcacatccagtacctgccttcataaagaatggccccactcacgaaactggcgctgtaatccaacttggtgctggggagtagggacaggctgtacctgctgtggggtcgacgtgaaggatctgtttactgaccatatgttcgtgaaatggaaggtcgagtacattaagacagaggctatcgtttgcgtggaattgaccagtcaggagcggcagtgtagcctcatagaagcaggaacgagatttaacctgggcccggtaactattaccctatccgagcctaggaacatccagcaaaaactgcccccagaaatcattacacttcaccccaaggtggaggagggtttctttgatctcatgcatgtccagaaagtgctgtctgccagcaccgtttgcaagttgcagtcctgtacacacgggatacctggagaccttcaggtgtatcacatcggcaatttactcaaaggtgaccgtattaacggccatctgatccacaagattgaaccacatttcaatacttcatggatgtcttgggatgggtgcgaccttgattactattgtaacatgggagactggcccagttgcacctacacgggcgtcacacaacacaatcacgctgcctttgtgaacctgttgaatatcgagactgattataccaagacattccattttcactcgaaacgcgttaccgcacatggggacactcctcagctcgatctgaaggcgcggccgacctacggagccggcgaaataacagtgctagtcgaggtagctgacatggagctgcacacgaaaaaggtggaaatcagcggtcttaaattcgcctccctcgcatgcactgggtgttatgcttgttcttcaggaattagctgcaaggttagaatccatgtggatgagccagacgaactgaccgtccacgtgaaatccagtgatcccgacgtagtggccgcatctactagcttgatggccaggaagttagagttcggcaccgattcaacttttaaggctttctccgcgatgcctaaaacaagtctgtgcttttacattgtcgaacgagagtactgtaagagctgctctgaggaagacacccagaaatgtgttgacacgaagctcgagcagccccaatccatcctgatagaacacaaaggtactattatcggcaagcagaacgatacatgcaccgccaaggcatcatgttggcttgagagcgtgaaatcgttcttttatgggctgaagaatatgttgggatctgtgttcggcaactttttcatcgggattctactgtttctcgctccattcgtcctgcttgtgttatttttcatgttcggatggaaaatcctgttttgcttcaagtgttgccggcgcaccagaggcctcttgaaatacaggcatctgaaggacgatgaagagactggttatcggcgaataattgagagactcaataacaagaaagggaagaatcgcctgcttgacggagaaaggctggccgatcgtaaaatcgccgagttgtttagtacaaagacccacattggctga

SEQ ID NO: 10319 - RNA, 5067 nt, synthetic construct
  misc_feature 1..5067: note = derived and/or modified CDS sequence (opt3) from CCHFV(Drosdov)__DQ211630.1__GP
  source 1..5067: mol_type = other RNA
atgcccatcaacattatgcacgccctgctcgtgtgcttcatactttacctgcagttgagcggcttagggggagctcatagacaatccaatgcaaccgagcacaacggtacaaatactacgaccgcccctggcacatctcagtcaccaaagccgcccgtcagtactaccctgcctcatacaccagaagcgagcaccatcaaactaactacacccacctccgagacggaagggtctggagagactacccctccacccaacacaactcagggcctccctctgccaggtaccacaccggaaaggtcggctaccacggccacttcaacaagcagtaccgacgatatgaactccactacacagatgaccgacaatacgcccacctctacagttagcattgggctttcctcaagtcctagcatgccatctacttcccaaggaatccactatcccgtgcggtcactgttgagcgtaagttctcctaagaccgcaacaactccaacccccatgtccccgggcgaggtgagccctgagacatcgtctcagcattccgccatgtcacgcattcccaccctctacactgctacgcaggtcagtacagaaaataccaaccgaagcatcccacgtcagtccgagtctagcgtgcaacctgcaactcagtcacccataaccagtccagcccagacaatcctgctgatgtccgctgcccccaccgcgattcaggatatgcaccctagccccaaaaatagatctaagaggaacctcgaagttgagatcattttaactctgtcacaaggccttaaaaagtattacgggaagatcttgaaactgctacacctcacactggaggaagacacggagggacttctggaatggtgtaagcggaatttgggtagtaactgcgatgacgactttttccagaaacgcatagaggaatttttcattaccggcgaggggtattttaatgaggtgctccagttcaagactccgagcacactgtcccccaccgaaccttctcatgtcagattaccaacagcagagccctttaaatcgtacttcgccaagggatttctgagcatcgattccggctatttctcagctaagtgttaccctaggagttctactagcggtctccaacttattaacgtgacccagcacccagcccggatcgcagaaacgcccgggccgaaaaccacatccctgaagactatcaattgcattaacttgcgcgcttcagtatttaaagagcatcgagaagttgagataaacgtgctactgcctcagatcgccgtcaatctcagcaactgtcacgtggtgattaattctcacgtctgcgattactccctggacaccgatggaccagttagacttcccaggatccatcacgagggcgcgttcatacctggcacatataagattgtgatcgacaaaaagaacaaactgaatgatcggtgtagtttggtaactaactgcgtgatcaaggggcgtgaagtccgcaagggacagagcgtgctcagacaatacaaaaccgagattaagatcggtaaagcctctacgggctccaggaagctgttatcagaggaacccggggacgactgtattagtcggacacagctgctaaaaaccgaaactgcagagatacatgatgacaattatggaggcccaggtgataagatcacaatttgcaacgggagcaccatcgttgaccagcgactcggctcggagctgggatgttacactatcaatcgcgtgaagtcctttaaactttgcgaaaactctgctaccggcaagacatgcgagattgatagcacgcctgtcaaatgtagacaggggttctgcttgaagataacccaagaaggaaggggtcacgtgaaactgtcacggggcagtgaggtagttctcgacgcctgtgattcctcttgcgaggtgatgatccccaaggggactggagacattctggtcgattgtagcggcggtcagcagcatttccttaaggacaatctgatcgatttggggtgcccacacattccgctcctgggcaaaatggctatctatatatgtcgcatgtccaaccaccctagaacaaccatggcctttttattctggttttcattcggatacgtgatcacatgcatcttttgtaaggcactgttctatagcctaattattatcggcactctcgggaaaaagataaaacagtacagggaactgaagccccaaacctgcacgatttgtgagacagccccagtcaatgctatcgacgcggaaatgcatgaccttaagtgcagttacaacatttgcccctattgtgcatctcgtttgacctccgatggactggcccggcacgtgactcagtgccctaaacgaaaggagaaagttgaagagaccgagctctacctgaatttagaaagaatcccatggatagtgaggaagctgcttcaggtaagcgagtcgacaggtgtcgctttgaaacgctcatcttggctcatcgtgctgctagttctgctcactgtgagtctgtcccccgtccagagcgcccctgtgggccatgggaagaccattgaaacatatcaaacgcgggagggatttacctctatctgtcttttcatgttgggcagcattctgtttatcgtatcctgcttagtgaaaggtctcgttgactcagtcagtgatagcttctttccggggctgtctgtgtgtaagacttgctccataggctcaattaacggattcgaaatcgagagtcacaagtgttactgcagcctgttttgttgcccatattgtagacactactccgcagacagggagatccatcagctgcacttgtctatttgcaaaaagcgcaaaacaggctcgaacgtgatgctcgccgtctgcaagcgaatgtgtttcaaagctaccatcgaagccagccggcgtgcactgctaattagatcaataatcaatactacattcgttatttgcatcctgattctcgcgatctgtgtggtgtccaccagtgctgtagagatggaaaacctgcccgccgggacgtgggagagggaagaggatcttactaatttttgccatcaggagtgtcaagtcaccgaaacagagtgcttgtgtccttatgaagcactggtgttacgcaagccactcttcctggactctaccgttaagggaatgaaaaaccttctgaatagcacttccctagagacatcactctctatagaggccccctggggcgctatcaacgtgcagagcacctttaagcctacagtcagtactgccaatattgcactgtcctggagctctgtggaacaccggggtaacaaaatcttggttaccgggagatcagagtccattatgaagctggaagagaggacgggagtgagttgggatttaggcgtagaagacgctagcgagtcgaaactcctgacagtctctatcatggatctttcccagatgtacagcccggtgttcgagtacctgtcaggtgaccgacaggtggaagagtggcccaaggcaacctgcactggcgattgtccagaacgctgcgggtgtaccagttctacatgcttgcataaggagtggcctcactcccggaattggagatgcaaccccacttggtgttggggagtcggcaccgggtgcacgtgttgcggagttgacgtgaaagatctctttacagaccacatgttcgtaaagtggaaagtggaatatatgaagaccgaggcgatagtctgtgtggagctgactagccaagaaaggcagtgctcactaattgaggccggcacacgttttaatctgggtccagttaccatcactcttagtgaacctcgcaacatccagcagaaactcccaccagagattataacactgcatccgaagatcgaagaggggttctttgacttgatgcacgtgcaaaaggtcctgagcgcttccaccgtgtgtaaattacagtcttgcacgcatggcattcctggagatctccagatctaccacattggtaatctgcttaagggcgaccgggttaacgggcatctgatccacaaaatagagccccacttcaatactagctggatgtcctgggatggatgtgacttggattattactgcaacatgggcaactggccatcatgtacctatacaggggtgacccagcataatcacgcagcctttgtcaacctcctgaatatcgaaacagactacactaagaccttccattttcactctaaaagagtaacggctcacggagatacaccccaactagacctgaaggccaggcctacttatggcgccggtgagattaccgtgcttgttgaagtggcggatatggagctccataccaaaaaggtcgagatcagtgggctgaagttcgcctcgttggtgtgcacaggatgctacgcttgtagctccggcatttcttgcaaagtacgaatccacgtggacgaaccagatgagttaactgtccatgttaagtcaagcgaccccgatgtggtggccgcatccaccagtctgatggctcggaaactcgagttcggtacagactctatatttaaggccttcagcgcaatgcctaaaacgtcactgtgtttttacattgtcgaacgcgaatattgcaagtcctgtagtgaggacgatactaagaaatgcgtggacaccaaacttgagcagccgcagagcatcctgatcgaacacaaaggcacaattatcgggaagcaaaacgatacctgtactgccaaggcttcttgctggttggagtccgttaagtcattcttttacggactaaagaatatgctgggcagcgtattcgggaactttttcgtgggaatactcctgtttcttgcgccattcgtcttactggtgctctttttcatgttcggctggaaaattttgttttgtttcaagtgctgtagaaggacacggggtctgtttaaatatcgacatctcaaggacgatgaagagaccgggtacagacgcatcattgaaaggcttaattcgaaaaagggaaagaaccgtcttctggacggcgagcggttggccgatagaaaaatcgcagagctattctctacgaagactcacataggctga

SEQ ID NO: 10320 - RNA, 5067 nt, synthetic construct
  misc_feature 1..5067: note = derived and/or modified CDS sequence (opt3) from CCHFV(1231-CR/TI-2015)__KU161585.1__GP
  source 1..5067: mol_type = other RNA
atgcccatcaacattatgcacaccctgctcgtgtgcttcatactttacctgcagttgttaggccttgggggagcccatgagcaaagcaatgctacagaccacaacagaactaatacgatcaccgcaccttccacatctcagaacccaaagccgcccgcctcaactacccctccacatacacccgaaagtagcaccattaaactaatcacttccacaggtgaggcggaaggctctggggagaccacgcctccactcaatactacccagggaccctttcctccagaaacaacttcggagcacccggcttcaaccgccacaaacaccagcagtaccaattccatgaactctactacacagatgaccgataagactctgacaagcaccgtctccacgtcacttagtattagcccctctaccccttccacatcacaaggcatccattatccaataaggagcctgttgagtgtttctagcccccggactgcagccacccctacaccaatgagcactcgcgagatgtcgtctgaaaccaattcccagcactcagctgtgagtcgaacacccaccttccacactgcaacgcaggtaagcacagagaacgacaatcgttccaccccgagacagtctgaaagctcagcccaacctgctactcagagtcccatgacctccccagcccagagcatcctcctggtgtctgcggcacctacaaccattcagaacatccatccctcaccaactaataggagtaaacggaacctggagatggagattatcctcacattaccccaaggtctgaagaaatactatgggaagatacttaagttgctgcacctaacgctcgaagaggataccgaaggactgcttgagtggtgtaaacgcaatctgggcagcaactgcgacgatgaatttttccagaagagaattgaggagtttttcatcactggcgaagggtactttaacgaggtcttgcagttcaaaacactctccaccctgtctcctatggaaccatcgcatgccaggccgcccacagctgagccttttaagagctatttcgccaaaggatttttatccattgactcaggttacttcagtgcaaagtgttatccacggtctagctcctcaggcctgcaactcatcaatatcactcagcaccccgctcgcattgccgaaacccctgggccaaagacgaccagccttaaaacaataaactgcatcaatctgcgagcgtctgtgtttaaggagcacagagaggttgaaattaacgtgttgctaccccagatcgccgtcaatctgtccaactgtcatgtggtaataaatagtcacgtttgcgattacagcctcgacactgatggaccggtgaggctgcctcggatttaccatgagggcaccttcatcccaggtacatataaaatcgtcattgacaagaaaaacaagctgaatgatcgttgtactctggtgaccaactgcgtgacgaaagggcgcgaagtcagaaagggacagtctgttttgaggcaatacaagacagagatcaaaattggcaaggcatccaccggctcacggaaactcctgagtgaggaacccggggacgattgtataagccgaactcagttactgcgcacagagaccgctgaaatccacgacgacaattatggaggtcctggcgataagattactatctgcaacgggtcgaccatcgtggaccagagactaggatccgagctcggctgttacacaattaatagggtaaaatctttcaagctgtgcgaaaacagcgccacgggtaagacctgcgagatagattcaactcccgtgaaatgtcggcaggggttttgccttaagatcacacaagagggccgcggacatgtcaaattgagtagaggctccgaagtggttctggacgcttgtgattctagctgcgaggtgatgattccaaaggggaccggagacatcctcgtcgattgttccggtggccagcagcacttcctgaaagacaatcttattgatctggggtgccctcacatccccttgctcggaaagatggccatatatatctgtaggatgtcaaaccatccacgtacaactatggcatttctgttctggtttagcttcggctacgtgattacctgcatcttttgtaaggccttattctatagtctgattatcataggtacgctagggaaaaagattaaacagtaccgggaactcaagccgcaaacatgcaccatctgtgagactgctcctgtaaacgcgattgacgcagaaatgcacgatctgaattgctcttacaacatctgcccctattgtgcctcccgacttaccagcgacggcttggctagacatgttacacagtgcccaaaaaggaaggagaaggtggaggaaactgagctgtacctcaatctggaacgcataccctggatcgtccggaaattacttcaggtgtcggagtcaaccggagtcgcccttaagagatctagttggttgattgtgctcctggttctactgacagtgtccctcagccctgtacagtctgcaccagtcggccacgggaaaacgatcgaaacctatcaaactagggagggatttacaagcatttgtctgttcatgcttggttccatcttgtttatagtgtcatgcctggttaagggcttagtggagagtgtcagcgactctttctttcccgggctctccgtgtgtcgcacgtgctcaattggaagtatcaacggcttcgaaatcgagagccacaaatgttactgctccctgttctgttgcccttattgtcgacattgctctgccgatcgggaaattcaccagcttcatctgtcgatctgcaagaaacgtaagactggtagcaatgtaatgttggctgtgtgtaagagaatgtgctttagggccacaatggaggcatcacgccgggcgctcctgattagatccataatcaacaccacgttcgttatttgtatcctaactctgaccatttgcgtcgtgagtacatctgctgtggaaatggagaatctcccggccgggacctgggagagggaagaggacctgactaacttttgtcaccaggaatgccaagtcacagagaccgagtgtctttgcccatacgaagcattggttctgcgaaaacccttattcctcgatagcatcgtgaagggcatgaaaaatctgcttaactccacatcactggagacttctctaagcatagaagccccttggggagctatcaatgtgcagagtacctttaagccaacggtatccacagccaacattgcactcagctggtcttcagtcgagcatcgcggcaataaaatcctggtgaccgggcggtccgaaagtattatgaagttggaggagagaactggagttagctgggacctgggcgtggaagatgcttcggagtctaagttactcaccgtctccatcatggacctgagccagatgtattcacccgtgttcgaataccttagtggtgataggcaggttgaggaatggcctaaagccacatgtactggggactgcccggagcgttgtggatgcacctcttccacgtgcctgcacaaggagtggccccacagccgcaactggcggtgtaatccaacatggtgctggggcgtgggtaccggctgtacttgctgtggggtagatgtcaaagacttgtttacagatcatatgttcgtgaagtggaaagtggaatacataaagaccgaggcgattgtctgcgttgaactcacttcacaagagagacagtgtagtctgatcgaagccggaacaaggtttaacctaggccctgtgaccatcacgctgagcgagccccgaaacattcagcagaagctgccacctgagataatcactctccaccccaaaattgaagaggggttctttgacctgatgcatgtacaaaaggtgttgtccgcttctaccgtctgcaaactgcagagctgtacacacggaatcccaggcgatttacaggtgtatcatattggtaatctcctgaagggggaccgggttaacggacaccttatccacaaaatagaaccgcatttcaatacctcctggatgtcatgggacggctgcgatctggactactattgtaacatgggtgattggccttcttgcacatacactggcgtgacccagcacaatcatgcagcctttgtcaacttgctcaatatcgagacggactatacaaagactttccacttccacagtaagcgcgtgaccgctcatggggatacaccccaactggacctaaaagccagaccaacctacggagcaggcgagattactgttctggtggaagtcgcggatatggagcttcacaccaagaaagtagaaatctcggggctcaagtttgccagcctggcttgcacaggatgttatgcctgctcctctggcatttcatgtaaagtgaggatccatgttgacgagcccgatgaattgacggtgcacgtcaagagctccgaccctgatgtggtagcagctagtacttctttaatggcccggaaactggagttcggtaccgacagcacatttaaggcattctcagccatgccaaagacctccctctgcttttacatagtggagcgagaatactgtaaaagttgcagcgaggatgacactaagaaatgtgtcgacacaaagctggaacagccccagtctattcttatcgagcataaagggaccatcattggaaagcaaaacgatacgtgcactgctaaggcgtcctgttggctggaatcagttaaatccttcttttatggcttgaagaatatgctaggttcggtgttcggcaactttttcatcgggatactgctctttctggcccctttcgtgcttttagtcctgttctttatgttcggatggaaaattctcttttgcttcaagtgttgcagacgcacaaggggcttgtttaaataccgtcacctgaaggacgatgaggagaccgggtatcggagaatcattgaaaggctcaataacaagaaaggaaagaatcgcctgcttgacggcgagcgactggcagatagaaaaatcgctgaattgttctctaccaagactcacataggttga

SEQ ID NO: 10321 - RNA, 5067 nt, synthetic construct
  misc_feature 1..5067: note = derived and/or modified CDS sequence (opt3) from CCHFV(1-CR/HU-2015)__KU161584.1__GP
  source 1..5067: mol_type = other RNA
atgcccatcaacattatgcacaccctgctcgtgtgcttcatactttacctgcagttgttaggcctagggggagcccatgagcaaagcaatgctacagaccacaacagaactaatacgatcaccgcaccttccacatctcagaacccaaagccgcccgcctcaactacccctccacatacacccgaaagtagcaccattaaactgatcacttccacaggtgaggcggaaggctctggggagaccacgcctccactcaatactacccagggaccctttcctccagaaacaacttcggagcacccggcttcaaccgccacaaacaccagcagtaccaattccatgaactctactacacagatgaccgataatactctgacaagcaccgtctccacgtcacttagtattagcccctctaccccttccacatcacaaggcatccattatccagttaggagcctgttgagtgtgtcttcccccaagactgcagccacccctacaccaatgagcactcgggagatgtcgtctgaaacctcctcacagcacagtgctatgagccgcacacccaccttccacactgcaacgcaggtatccacagagaacgccaatcgatctaccccgcgtcagagcgaatcaagtgctcaacctgccactcagtcccccatgaccagcccagcgcagtctatatttctcgtgtcagcagcccctacaaccatccagaacattcatcccagtccaactaatagaagcaaaaggaacctggagatggagatcattctgacactcccccaaggtttaaagaaatactatgggaagatcctgaaacttttgcacctgacgctagaagaggacaccgaaggactcctggagtggtgtaaacggaatcttggctccaactgcgatgacgagttctttcagaagcgcatagaggagttctttattactggcgaagggtacttcaacgaggtcctgcagtttaaaacattgtctaccctctcgcctacagaaccaagccatgctagaccgcccactgccgagcctttcaagtcctattttgcaaaaggattcctgtcaatcgatagtggttacttttctgctaagtgttatccaaggagctccacctcaggcttacaactgattaatatcacgcagcaccccgcccggatcgcggaaacccctgggccaaagacaactagcctcaaaaccattaactgcataaatcttcgcgcctctgtgttcaaggagcaccgagaggttgaaatcaacgtgctgttgccccagattgcagtcaatctatccaactgtcatgtggtaatcaatagtcacgtttgcgactacagcctggatacagacggaccggtgagactccctaggatataccatgagggcactttcattccaggtacctataaaatcgtcatcgataagaaaaacaagctgaatgaccggtgtacgcttgtgacaaactgcgtgattaaagggcgtgaagtccgcaagggacagtctgttctgagacaatacaagaccgagatcaaaattggcaaggcttccactggctcaaggaaattgctcagtgaagaacccggggatgactgtataagccggacacagctgttacgaaccgagactgccgaaatccacgatgacaattatggaggtcctggcgacaagattaccatctgcaacgggtcgacaatcgtggatcagcgcctgggatccgagctaggctgttacacgattaatagagtaaaatcttttaagctctgcgaaaacagcgctaccggtaagacttgcgagatagactcaacacccgtgaaatgtaggcaggggttctgcctgaagatcacccaagagggccggggacatgtcaaacttagtcgcggctccgaagtggttttggatgcctgtgactctagctgcgaggtgatgattccaaaggggacaggagatatcctggtcgactgttccggtggccagcagcactttctcaaagataatctgattgaccttgggtgccctcacatccccctgttgggaaagatggcaatatatatctgtagaatgtcaaaccatccaaggactaccatggccttcctcttttggttcagctttggctacgtgattacgtgcatcttctgtaaggctctgttttatagtttaattatcataggtacactggggaaaaagattaaacagtaccgtgaactaaagccgcaaacctgcactatctgtgagaccgcgcctgtaaacgcaattgatgccgaaatgcacgacctcaattgctcttacaacatctgcccctattgtgcttcccggctgacaagcgatggccttgcccgacatgttactcagtgcccaaaaagaaaggagaaggtggaggaaaccgagttgtacctgaatctcgaaaggataccctggatcgtccgcaaactgttacaggtgtcggagtcaacaggagtcgcactgaagcggtctagttggcttattgtgttgctcgttctgctaacggtgtccctgagccctgtacagtctgccccagtcggccacgggaaaaccatcgaaacttatcaaacaagagagggattcaccagcatttgtctctttatgctgggttccatccttttcatagtgtcatgcttggttaagggcctggtggacagtgtcagcgactcctttttccccgggttatctgtgtgtaggacttgctcaattggaagtatcaacggcttcgagatcgaaagccacaaatgttactgctccctcttttgttgcccttattgtcgccattgctctgctgatcgagagattcaccagctgcatctttcgatctgcaagaaacggaagacaggtagcaatgtaatgctggccgtgtgtaagcgtatgtgcttcagagcaaccatggaagcgtcaaggcgcgctttgctcattcggtccataatcaacacgacttttgttatttgtatcctgaccctaacaatttgcgtcgtgagtacctctgccgtggagatggaaaatctgccggcagggacttgggagagagaggaagacctcacaaacttctgtcaccaggagtgccaagtcaccgaaacagagtgtctgtgcccatacgaggcccttgttttgaggaaacccctgtttttagatagcatcgtgaagggcatgaaaaatctcctgaactccacttcacttgaaacctctctgagcatagaggctccttggggagccatcaatgtgcagagtacgttcaagccaacagtatccaccgcaaacattgctctaagctggtcttcagtcgaacatcgaggcaataaaatcctcgtgactgggcgctccgagagtattatgaagctggaggaacggaccggagttagctgggacttgggcgtggaggatgcctcggaatctaagctgttaacagtctccatcatggacctcagccagatgtattcacccgtgtttgagtacctgagtggtgatagacaggttgaagagtggcctaaagcgacttgtaccggggactgcccggaaaggtgtggatgcacgtcttccacatgccttcacaaggagtggccccacagccgtaactggcgctgtaatccaacctggtgctggggcgtgggtactggctgtacatgctgtggggtagatgtcaaagacctgttcaccgatcatatgtttgtgaagtggaaagtggagtacataaagactgaagccattgtctgcgttgagttgacatcacaagaacggcagtgtagtctcatcgaggctggaaccagattcaacctgggccctgtgacgatcactctaagcgaacccaggaacattcagcagaagctgccacctgagataatcacccttcaccccaaaattgaggaagggtttttcgacctcatgcatgtacaaaaggtgctgtccgcatctacagtctgcaaattgcagagctgtacccacggaatcccaggcgatttacaggtgtatcatattggtaatctgctcaagggggaccgagttaacggacacctgatccacaaaatagagccgcattttaatacatcctggatgtcatgggacggctgcgatcttgactactattgtaacatgggtgattggccttcttgcacttacaccggcgtgacgcagcacaatcatgccgctttcgtcaacctgttgaatatcgaaacagactatactaagaccttccactttcacagtaagcgggtgacagcccatggggatacgccccaactcgacctgaaagcacgcccaacttacggagcgggcgagattaccgttctagtggaggtcgccgatatggaactgcacacaaagaaagtagagatctcggggcttaagttcgctagcctcgcctgcacgggatgttatgcatgctcctctggcatttcatgtaaagtgagaatccatgttgacgaacccgatgagctgactgtgcacgtcaagagctccgaccctgatgtggtagctgccagtacctctttgatggcaaggaaattagaatttggtacagacagcaccttcaaggccttttcagctatgccaaagacttccctgtgcttctacatagtggagcgggagtactgtaaaagttgcagcgaagatgacacaaagaaatgtgtcgacaccaagctcgagcagccccagtctattctgatcgaacataaagggacgatcattggaaagcaaaacgatacttgcacagcgaaggcctcctgttggcttgagtcagttaagagctttttctatggcctgaagaatatgttgggttcggtgtttggcaacttctttatcgggatactactgttcctcgcacctttcgtgctgcttgtcttatttttcatgtttggatggaaaattctgttctgctttaagtgttgccgaagaacccgcggcctcttcaaatacaggcacttgaaggacgatgaagagaccgggtatcgtcggatcattgagagactgaataacaagaaaggaaagaataggctcctggacggcgaacgccttgctgatcgaaaaatcgccgagctgttttctactaagacacacataggttga

SEQ ID NO: 10322 - RNA, 5067 nt, synthetic construct
  misc_feature 1..5067: note = derived and/or modified CDS sequence (opt3) from CCHFV(V42/81)__GU477490.1__GP
  source 1..5067: mol_type = other RNA
atgcccaccaacacaatgcacactctgctcgtgtgcttcatcctttacctgcagttgttaggccttgggggagcccatgtccaacctaatgctacggagcacaacagaaccaatacaactaccgcaccaggtacaagccattccctaaagccgctcgtttctaccactccccctcaggccccagaatcaagtacaattaaacccaccacgcctactagcgagaccgaaggctccggggaggcgacaccactgtctaacactatacaggctccctcgtcacctgaaaccacaagcgagaggccagccaccgcagtgatcagtacgtccggaactgactctacaaatagcaccactcagacaaccgataacaatccgacgaccacagtaggcacttccccctcaagtagcccttctaccccatccacaccccaaggtattcaccatcacgcccggtcacttctgagcgtgaccagtcctgagactgtcacaaccccaaagcccacttctccgcgcgaaatgtccagcgagacgtcgaaccagcactctgctatgtcccgaacacctacccatcacactgtgacccaggtttcaacagaaaataccagtcatagcactccccgtcagccagagtcctctgcacaacctacaagctcaagtcccatgacgtccccagcccagagcaccttgctcatgtctgctgcccccactgcggtgcagtcaatccaccctagtccaacaaacagaagcaaaaggaatctggagaccgaaattatcctgacactctcccaggggttaaagaaatattacggaaagatactgaagctgttgcacctgactctagaggaagacaccgagggcctcctggaatggtgtaaacggaaccttggctctaattgcgatgacgactttttccaaaagcgcatcgaggagtttttcatgacgggggaaggatattttaacgaggtcctgcagttcaaaaccccgtcgacagtgagccccactgaaccttcccatgcaagattgccaaccgccgagccctttaagtcatacttcgctaaaggttttctcagtattgattctggctatttcagcgccaagtgttactccaggtcaagcacatctgggctgcagttaatcaatgtaactcaacaccctgcacggattgctgaaaccccaggacccaagacgacatccctgaaaaccatcaactgcataaacctccgcgccagtgtttttaaggagaatcgagagattgaaatcagcgtgcttctgccgcagattgcggtcaacttgtctaattgtcatgtggtgatcaactcccacgtctgcgattattcactagacactgatggccctgttagactgccaaggatcaatcatgagggtacattcattcccgggacctacaaaatagtgatcgacaagaaaaacaagctcaatgatcggtgtactctggtaaccaactgcgtgattaaaggacgtgaagtccgcaagggccagagtgtgcttagacagtacaagacagagatcaaaataggcaaggccagcacggggtcgaggaaactgttgtccaaggaacctggagacgattgtatttctcggacccaactcatgcgaactgagacagcagagatccacgacgacaattatggtggccccggggataaaatcaccatttgcaacggaagcacaatcgttgaccagcgcctgggctcagaattaggttgttacactattaatagagtgaagagttttaagctgtgcgagaactccgctaccgggaaagcctgcgaagtcgattctacgccagtgaagtgtaggcagggcttctgcctaaaaataacacaggagggacggggccacgtaaagctcagccgcgggtccgaggttgtgctggacgcttgtgattcaagctgcgaagtcatgatccctaaaggaaccggtgacattcttgtggattgtagtggcgggcaacagcatttcttgaaggacaatctgatcgatctcgagtgcccccacatcccactgcttggaaagctggccatttatatatgtagaatgtctaaccatccgaggactaccatggcatttttgttctggtttggcttcggttacgtcatcacatgcattctctgtaaagccctgttttattccttaatcattatcgggactctgggcaagaaaataaagcagtaccgtgaactaaaacctcagacctgcacaatctgtgagacggctcccgtgaatgcgattgacgcagaaatgcacgatctcaactgcagctataacatctgcccatactgtgcctcgcggctgacctcagacggacttgctcgacacgttactcaatgccccaagagaaaggagaaagtggaggaaacagagttgtacctgaatctcgaaaggattccttggatcgtacgcaagctgttacaggtctctgagagtaccggcgtggttctgaaacggtccagctggcttatagtgttgctcgtcctgctaactgtgtctctgagcccagtacagtccgcccccgtggggcatggaaagacaattgaaacctatcagacgagagagggtttcacttcaatctgtctctttatgctgggcagtattcttttcatcgttagctgcatagtcaaagggttggtggactctgtgtccgattcatttttccctggactgagtgtctgtaagacctgcagcatctcctctattaacggctttgagatcgaatcgcacaaatgttactgcagcttattctgttgcccgtattgtaggcattgctcagcagaccgcgagattcaccaactccatctgtccatctgccgaaagcggcgtacaggtagtaatgttatgcttgccgtgtgtaagagaatgtgctttagggctaccatagaagtgtctcgccgggccctgttgattagaagcatcatcaacactacattcgtaatttgtatcctcaccctgacaatttgcgtcgtgtccacttcagcagttgagatggaaaatctaccagcggggacctgggagagggaggaagatctgacgaacttctgtcaccaggagtgccaggtgacagaaaccgagtgtctctgcccctacgaggctctggtccttcgaaaacctttgtttctggactctatagtgaagggcaaaaagaatttactcaacagcaccagtctggaaacttcccttagcatcgaggccccatggggagcaattaatatccaatctacattcaaacccactgtttcagccgctaacattgccctgtcctggagtagcgtggaacaccgcggcaataagatcctagtatcggggcggtctgagtccataatgaagctcgaagagagaaccggagtcagctggaacctgggcgtggaggatgcatcagaaagtaaattgctgacggtgtctatcatggacttatcccagatgtatagccctgtctttgagtacctctcaggtgataggcaggttgaagagtggccgaaggctacatgtaccggggactgccccgaacgttgtggatgcacaagtagcacttgcctgcataaagagtggccacactcccgcaattggcggtgtaaccctacctggtgctggggcgtgggtactggctgtacatgctgtggggtagatgtgaaggaccttttcattgatcatatgtttgtcaaatggaaggtggagtatatcaagaccgaagccattgtttgcgtggagctgacgtctcaggaaagacaatgtagcttgatcgaggcgggaactaggttcaatctcggccccgtcaccataacactgtccgaaccacgaaacattcagcagaaactacctcccgagatcatcaccctgcacccaaagattgaggaagggtttttcgaccttatgcatgtgcagaaagttctctcagcctctacagtgtgcaagctgcaaagttgtactcacggaataccgggcgatttgcaggtctaccacatcggtaacctgttaaaaggggaccgggtaaatggacatctcattcacaagatcgagcctcattttaacacctcgtggatgagctgggacggctgcgatctggactactattgtaatatgggtgattggccctcctgcacgtacacaggcgtgactcagcacaaccacgctgcattcgttaatcttctgaacattgaaaccgactatacaaagacctttcatttccactctaaacgcgtgactgcccatggggagaccccacagttggatctcaaggctagacccgcctacggagcaggcgagatcacagtcctggtggaagtagcggacatggagctacacacgaaaaaggtggaaatatcagggctgaaatttgccagccttgcttgcactggatgttatgcctgctccagtggcatctcttgtaaggtcaggattcatgttgatgagcctgacgaactcaccgtgcacgtgaaaagcaatgatccagacgtcgtggcagcttcaacatccctgatggcccggaagttggagagtggtaccgatagcactttcaaggcattctctgccatgcccaaaacatccttatgcttttacatcgttgagcgagaatattgtaagtcatgcagcgaggacgatacccaaaaatgtgtagaaacgaagctggagcagcctcagtcgattctcatcgaacacaaagggactataattggaaagcaaaacgacacatgcaccgctaaggcgtcttgttggctggagagtgtgaaatccttcttttacggccttaagaatatgctgggtagcgtcttcggcaactttttcatcgggatcttgctatttctggccccgttcgtgctcctggttttgtttttcatgtttggatggaaaattttattctgcttcaagtgttgcagacgcaccaggggcctgtttaaataccgtcatctcaaggaggacgaagagactgggtatcggagaatcatagaaaggcttaattcaaagaaaggaaagaaccgcctgctcgatggcgagcgactggcagacagaaaaattgctgaacttttctccacaaagacccacatcggttga

SEQ ID NO: 10323 - RNA, 5067 nt, synthetic construct
  misc_feature 1..5067: note = derived and/or modified CDS sequence (opt3) from CCHFV(ROS/HUVLV-100)__DQ206448.1__GP
  source 1..5067: mol_type = other RNA
atgcccaccaacatcatgcacacactgctcgtgtgcttcattctttacctgcagttgttaggccttgggggagcccatagacaaagcaatgctactgagcacaacggtacgaataccacaactgcaccttccacctctcagtcaccaaagccgctagtcagtacagccccgcctcatgcgctcgaaagctccaccataaaaccaactacacccgtttctgagaccgaaggctcgggggagacgactcctccacccaacaccacacagggaccttcaccaccggaagctactcccgagaggcctaccacaaccgccacgagcactccaagtacagacaataccaactccactacacacgtgaccgataataaccccacgtctaccatcagcacatccccttcaagtagcccatctactccctccaccccgcagggcattcatcaccctgcacggaatctgctttcagtaagcagtcccaagacagccactaccccaacacctacctctcccggtgagatctccagcgaaacttcgtctctgcactccgctatgtcacgcacgagtacattgtataccgcaactcaagtgagcaccgagaacgccaatcattccgctccacgacagtctgaaagctcagcccagcagacaaccaccagtcccatgacatcccctgcgcaaagcattctcgtcatgtctgcagccccaacggctatccagaacatacacccgtcacccaccaatcgtagtaaaagaaacctggagatggagatcattctgactctcagccaggggttaaagaaatactatggaaagatcctgaaacttttgcatctgacactagaagaggacaccgaaggcctcctggagtggtgtaaaaggaatcttggctccaactgcgatgacgactttttccagaagcggattgaagagtttttcatgacaggggagggatactttaacgaagtgctgcaattcaaaactttgtctaccctctcgcctacggagccaagccacgccagaccccctaccgttgaaccatttaagtcctatttcgcaaaaggttttctgtcaatcgatagtggctacttctctgctaagtgttatccccgcttaagcacatccgggctgcagctcataaatgtgactcagcacccggccaggattgcggagacccctggaccaaagacaacttcacttaaaaccatcaactgcattaatctgcgggccagcgtctttaaggaacatcgcgagatcgagatcaacgtgttgctaccccaaattgcagtaaatctgtctaactgtcacgttgtgataaattcccatgtctgcgattacagtctcgacacggatggccctgtgcgactgccccacatctaccatgaaggtacattcattccagggacctataaaatcgtgatagacaagaaaaacaaacttaatgatagatgtactctggtcacaaactgcgttattaagggaagggaggtgcggaagggccagagcgtattgcgtcagtacaagaccgaaatcaaaatcggcaaggcttctactgggtcccgcaaactcctgtcagaggaacctggagacgattgtattagtagaacccagttactgaggacagagacggccgagatccacgacgacaattatggtggccccggggataagattaccatatgcaacggaagcactatcgtggaccaacggctaggctcggaactcggttgttacacaattaatcgagtcaaatcctttaagctgtgcgagaactctgctaccgggaagacatgcgaaatcgatagcactccagtgaaatgtcgccagggcttctgccttaagatcacccaggagggaagaggccacgttaaattgtcaagggggagtgaggtggtcctggacgcctgtgattcctcttgcgaagtgatgattccgaagggaacgggtgacatactcgtagattgtagcggcgggcagcaacatttcctgaaagacaatcttatcgatctgggatgccctcacattcccttgctcggcaagatggcaatctatatttgtcggatgtccaaccatccacgcacaaccatggcctttctgttctggttttcattcggttacgttatcacttgcatattttgtaaggctttattctatagcctgatcattatcgggaccctaggcaaaaagattaaacagtacagagagctcaagccccagacatgcactatctgtgaaaccgcgcctgtgaacgcaatagacgccgagatgcacgatctgaattgcagttacaacatttgcccatattgtgcttctaggcttacatccgacggattggcccgtcacgtcccccagtgccctaaacggaaggaaaaggtggaggagacggaactgtacctcaatctggagcgaatcccgtggattgtcagaaaattactgcaagtgagcgaatcgaccggcgttgcacttaagaggtcatcttggttgatcgtgctcctggtactactgactgtcagtctctccccagtgcagagcgcccccgttgggcatggaaaaacaatagagacctatcagactcgcgaaggttttacatctatctgtctgttcatgcttggcagcattttgtttctggtgtcctgcttagtcaaggggctcgtggactcagtaagtgatagcttctttcctggactgtctgtgtgtaaaacctgctccatcggctcaattaacggtttcgagatcgagagtcacaagtgttactgcagcctgttttgttgcccatattgtcggcattgctccgctgacagagaaatacaccagctgcatttgtctatttgcaaaaagaggaagacggggtcgaatgttatgctcgccgtctgtaaacgcatgtgcttccgagcaactatcgaggcgagccggcgtgctctgctaatcagatcaattatcaacaccacattcgtgatttgtatactgaccctcactatctgcgtggtctccacaagtgccgttgaaatggagaatctgccctctggcacctgggaaagggaggaggatcttacaaacttttgtcaccaagaatgccaggtgactgagaccgaatgtttgtgcccttacgaggcactggtgttacgcaagcccctcttcctggacagcattgtaaaaggaatgaagaatcttctgaactccacgtcactagagacatctctcagcatcgaagccccctggggcgctattaatgtccagagtacctttaaaccaactgtgtccaccgccaacatcgcactgagctggtcttcagttgagcaccgggggaataagatattggtgacaggaagatccgaaagtatcatgaagctggaggaaaggactggcgtcagctgggatttaggtgtggaggacgcttcggagtctaaactcctgaccgtttccattatggatcttagccaaatgtattcacctgtgttcgaatacctgagtggggaccgacaggtagaggaatggcccaaggccacgtgtacaggagattgcccagagcgctgtggctgcacctcttccacttgcttgcataaagaatggcctcacagccggaactggagatgtaatcccacatggtgctggggtgtcggcaccgggtgtacttgctgtggagtggacgtgaaggatctctttacagaccatatgttcgtcaaatggaaggttgagtacatcaagaccgaggcgattgtgtgcgtagaactgacgtcacaggagaggcagtgtagtctaatcgaagccggcactcgttttaacctggggccagtgaccataacacttagcgagccgcgcaacattcaacagaaactccctcccgaaatcatcaccctgcacccaaaggtcgaggagggattctttgatttgatgcatgtgcagaaagttctgtccgcttctacagtgtgcaagttacagagctgtactcacggcattcccggtgacctccaagtctatcacatagggaatctgcttaaaggagaccgggtgaacggccatctgatccacaagattgaacctcatttcaatacctcctggatgtcatgggatggttgcgacttggattactattgtaacatgggcgactggccatcttgcacgtacacaggggttactcagcacaatcacgcagcctttgtgaacctcctgaatatcgagaccgattatacaaagaccttccattttcacagtaaaagagtcactgctcatggagacactccccagctagatctgaaggccaggcctacatacggcgcaggggaaattacggtacttgtggaggttgcggacatggagctccacactaaaaaggtggaaatctcgggactgaaattcgccagcttggcttgcaccggctgttatgcctgctcctctggtatatcatgtaaggtccgaatccatgtggatgagccggacgaattaacagtacacgtgaaaagctccgatccagacgtcgttgcagctagtacctctctgatggcccggaagctcgagttcgggactgatagcacatttaaggcattctcagccatgcccaaaacctccctgtgcttttacattgtggaacgcgagtactgtaagagttgcagcgaggaagacacgcagaaatgtgtggacactaaacttgagcaacctcagtctatcctgattgaacacaagggaacaatcataggcaagcagaacgatacctgcaccgctaaggcgtcctgttggttggagtcagtcaagagcttcttttatggtctaaagaatatgctgggctcggtgttcgggaactttttcattggaatcctcctgtttcttgcccccttcgttttactggtactctttttcatgttcggctggaaaatcttgttttgcttcaagtgttgcagaaggactcgggggctgctcaaataccgactgcttaaggacgatgaagagacaggatatagacgcattatcgagaggctgaataacaagaaaggcaagaatcgtttgctagacggtgaacggctggcagatagaaaaatagctgagctcttttctaccaagacacatattgggtga

SEQ ID NO: 10324 - RNA, 5067 nt, synthetic construct
  misc_feature 1..5067: note = derived and/or modified CDS sequence (opt3) from CCHFV(5180-R-2011)__KR814874.1__GP
  source 1..5067: mol_type = other RNA
atgcccaccaacatcatgcacacactgctcgtgtgcttcattctttacctgcagttgttaggcctgggtggagcccatagacaaagcaatgctactgagcacaacggtacgaataccacaactgcaccttccacctctcagtcaccaaagccgcccgtcagtacagcccctccatatgcgcccgaaagctccaccataaaacctactacaccagcttctgagaccgaaggctcgggggagacgactccccctccaaacaccacacagggaccgtcaccccctgaagccactccagagaggcccgcaaccacagccaccagcacgcctagtactgacaatacaaactccaccactcatgctacagataataacccaacctctacgatcagcacctccccctcaagtagcccgtctacaccttccactccccagggcattcaccatccagcacggaatctactctcagttagcagtcctaagaccgccacaactcccaccccaacatctcccggtgacatctccagcgagacctcgtctctgcactccgctatgtcacgcactcctacgcttcacacagccacccaagcgagtactgaaaacgcaaatcatagcgccccacgacagtccgagtctagcgctcagcagaccacaacctcaccgatgactagccccgcccaacctattctggtgatgtccgcagctccaacagccatccagaacatacaccccagccctacgaatcgttctaaaagaaacttggaaatggagatcattctcaccctgtcacaggggctgaagaaatactatggaaagatcctcaagttactgcatcttactttggaggaagatacagagggcctgctagaatggtgtaaaaggaatctcggcagtaactgcgacgatgactttttccagaagcggattgaggaatttttcatgaccggggagggatactttaacgaggtactgcaattcaaaacacttagcactctgtccccaaccgaaccctctcacgcgcgcccgcctacggtggagccatttaagtcgtatttcgccaaagggtttttgagcatcgattccggctacttctcagcaaagtgttatcccagactcagtacctctgggctgcagttaataaatgtcacacagcaccctgctaggattgccgaaactcccggaccaaagaccacaagcctgaaaactatcaactgcattaatctccgggcttccgtgtttaaggagcatcgcgaaatcgagatcaacgttcttctgcctcaaattgccgtgaatttgtcaaactgtcacgtcgtgataaatagccatgtatgcgactactctctagataccgacggccccgttcgactgccacacatctaccatgagggtacgttcattccggggacatataaaatcgtgatagataagaaaaacaagctcaatgacagatgtaccctggtcactaactgcgtgattaaaggaagggaaatccggaagggccagtccgtgcttcgtcagtacaagacagagatcaaaattggcaaggcaagtaccgggagccgcaaactgttgtctgaggaacctggagatgactgtatctccagaactcagctcctgaggaccgaaacagccgagattcacgacgataattatggtggccccggggacaagataacgatctgcaacggatcaaccattgtcgatcaacggttaggcagtgagctgggttgttacactatcaatcgagttaaaagttttaagctatgcgaaaactcggctacagggaagacctgcgagatcgactccacaccagtgaaatgtcgccagggcttctgcctcaagattactcaggaaggaagaggccacgtaaaactgtctagggggagcgaggtggtccttgatgcgtgtgacacctcatgcgaggtgatgatacccaagggaacgggtgatatcttggttgactgtagtggcgggcagcaacatttcctgaaagataatctcattgacctgggatgccctcacatcccacttctgggcaagatggcaatttatatctgtcggatgtccaaccatccccgcacaaccatggcctttttgttctggttttctttcggttacgtgataacttgcatcttttgtaaggctctcttctatagcctgattatcattgggaccttaggcaaaaagatcaaacagtacagagaactgaagcctcagacatgcactatatgtgagaccgccccggtcaacgcaattgatgccgaaatgcacgacctaaattgctcctacaacatctgcccatattgtgcttcaaggctcacaagcgacggactggcccgtcacgtgccccagtgccctaaacggaaggagaaggtagaagagacggagctttacttgaatctggaacgaatcccatggattgttagaaaactcctgcaagtgagtgagtctaccggcgtcgcattaaagaggtccagctggctgatagtgcttttggtcctcctgactgtgtcgctatcacccgttcagtctgcgcctgtggggcatggaaaaacaatcgaaacctatcagactcgcgagggttttacaagtgtatgtctgttcatgctcggctccattctgtttcttgtcagctgcttggtgaaggggctggttgattctgtgagcgactccttctttccgggattatcagtctgtaaaacctgcagtatcggcagcattaacggtttcgaaatcgagtctcacaagtgttactgctccctcttttgttgcccctattgtcggcattgctcagctgatagagagatacaccagctgcatcttagtatttgcaaaaagaggaagatggggagcaatgtgatgctggccgtatgtaaacgcatgtgcttccgagcaacgatcgaagcctcccggcgtgctttgctcatcagatctattatcaacactaccttcgtgatttgtatactgacactaaccatctgcgttgtctcgactagcgccgtggagatggaaaatctgccatcaggcacatgggagagggaagaggacctcaccaacttttgtcaccaagagtgccaggtgacagaaactgagtgtctgtgcccttacgaagcacttgtcttgcgcaagcccctgttcttagattccattgttaaaggaatgaagaatctcctgaacagtacctctcttgagacgagcctgtccatcgaggctccatggggcgccattaatgtgcagtcaacatttaaacctaccgtgtctactgcgaacatcgccctaagctggagttccgtagaacaccgggggaataagatactcgtcaccggaagaagcgagtctatcatgaagctggaagagaggacaggcgtgtcatgggacttgggtgttgaagatgcttccgagagtaaactgttaactgtgagcattatggacctctcgcaaatgtattctcccgtcttcgagtacctgtccggggatcgacaggtggaagagtggccaaaggcaacctgtacgggagactgcccggaacgctgtggctgcacaagctcaacctgccttcataaagagtggcctcacagtcggaactggagatgtaatcccacttggtgctggggtgttggcacagggtgtacctgctgtggagtggatgtaaaggacctgtttactgatcatatgttcgtcaaatggaaggtggaatacatcaagacagaggccattgtgtgcgtcgagttgacctctcaggaaaggcagtgttccctcatcgaggctggcacgcgttttaacctggggccagttactataaccctaagcgaaccccgcaacattcaacagaaactgcctccagagatcatcacacttcaccccaaggtggaagagggattctttgacctcatgcatgtacagaaagtgctgtcagccagtaccgtctgcaagttgcagagctgtacacacggcattcctggtgacctgcaagtgtatcacatagggaatttactcaaaggagatcgggttaacggccatctgatccacaagattgagccgcatttcaatacttcctggatgtcttgggacggttgcgatcttgactactattgtaacatgggcgattggccaagctgcacctacacgggggtgacacagcacaatcacgcagcgtttgtcaacctgttgaatatcgaaactgactataccaagacattccattttcactccaaaagagtgaccgcccatggagatactccccagctcgacctgaaggctaggcctacctacggcgccggggagattacagttctagtggaagtcgcagatatggagctgcacacgaaaaaggtagagatctcaggacttaaattcgcttctctcgcctgcactggctgttatgcatgcagttcgggtataagctgtaaggtgcgaatccatgttgacgaacccgatgagctgaccgtgcacgtcaaatccaacgacccagatgtggtagccgcttctacatcattgatggcgcggaagttagaatttgggaccgacagcacttttaaggccttctccgcaatgcctaaaacaagtctgtgcttttacattgtggagcgcgaatactgtaagtcttgcagcgaggaggacacccagaaatgtgtcgatacgaagctcgaacaaccccagtcaatcctgattgagcacaaaggaactatcataggcaagcagaatgacacatgcaccgctaaggcctcctgttggcttgaaagtgttaagagcttcttttatggtctgaaaaacatgttgggctctgtgttcgggaatttcttcattggaatcctactgtttctcgccccattcgtgctgcttgtcttatttttcatgttcggctggaaaatcctgttttgcttcaagtgttgcagaaggacccgggggctcttgaaataccgactgctcaaggatgacgaggaaactggatatagacgcattatcgagaggctgaacaataagaaaggcaagaaccgtcttctggatggtgagcggttggctgacagaaaaatagcagaactattttccacaaagacccatattgggtga

SEQ ID NO: 10325 - RNA, 5067 nt, synthetic construct
  misc_feature 1..5067: note = derived and/or modified CDS sequence (opt3) from CCHFV(5170-R-2011)__KR814873.1__GP
  source 1..5067: mol_type = other RNA
atgcccttcaacatcatgcacaccctgctcgtgtgctttattctttacctgcagttgagcggcttagggggagcccatggtcaatccaatgagacagaacacaacggcactaatacgaccacagtccctgggacttctcagtcaccaaagccgcccgctagtaccacactgcagcatacccctgagagctccactgttaaactaacaaccccaacgtctgaaactgagggatcgggcgaaaccacaccccctccaaacactacccagggtttaccccctccagggacaaccccggagagatcagcaacgactgccacaagcaccagttccactgacaatatgaactctacaacccaagtgacggataatacccccacaagcactgtatccatatcacctagtagctctccatccatgccctcaaccagccagggaatccactatcctattaggagtctgctttctgtgtccagcccaaagacagtcactacccccacaccgatctcgcctggcgagatgtctcccgaaacctcctcacagcatagtgcgatgagccggattccaactctgtacacggctacacaggtgtccaccgagaacactaatcgctctacccctcgacaaagcgaatcaagtgttcagcccgccacacagtccccaatcaccagccccgcacagactatattgctcatgtctgccgctcctaaagcaatccaagacatgcacccatcaccgacaaaccgtagtaagagaaatctggaggtggagattatcctgacgctcagccagggcctcaaaaagtattacgggaagattctgaaacttttgcacctgaccctagaagaggatactgaaggactcctggagtggtgtaagaggaaccttggttccaattgcgacgatgacttctttcagaaacggatcgaagagttctttataacaggcgaggggtatttcaacgaagtcctgcaatttaagaccttgtctacactctcgcccactgagctgagccatgtgcgcttacctaccgccgaaccattcaaatcctactttgctaagggattcctgtcaattgatagtggctatttttctgccaagtgttaccccagaagctccacgtcaggtctccagcttatcaatgtaacccagcaccctgcgaggattgcagagacaccagggcccaaaactaccagcctgaagacaatcaactgcatcaacttgcgggcctctgttttcaaagaacatcgcgaggtggagattaatgtcctactgccgcagatagctgtgaacctctccaattgtcacgtggtcatcaacagtcacgtttgcgactacagcctggatactgacggacctgtgcgacttccaaggattcatcacgaaggcacctttatccccggcacgtataagatagtaattgataaaaagaataaactgaacgacagatgttctttggtgacaaattgcgtcatcaaggggcgggaggtgcgtaagggacaatccgttctccgccagtacaaaaccgaaatcaagattggtaaagcctcaactggcagtagaaagctgttaagcgaggaacctggggatgactgtatctcgaggacacagctgctaaaaaccgagactgcagagattcatgacgataactatggaggccccggtgacaagataaccatctgcaatgggtccacaattgtggatcagcggctcggctctgaactgggatgttacacgatcaaccgagtcaagagcttcaaactttgcgagaatagtgctaccggcaagacttgcgaaatcgacagtacaccagtgaaatgtcgccaagggttctgcttgaagattacccaggagggaagaggtcacgtaaaactgtccaggggctctgaggttgtgctcgatgtctgtgacagctcctgcgaaataatgatccctaaggggacaggagatattctggtggactgttcaggcggtcagcagcattttcttaaggataacctgatcgacttggggtgcccccacattccactcctgggcaaaatggccatctatatatgtcggatgagcaatcacccgcgcactaccatggcgttcttattttggttcagttttggatacgtcatcacgtgcattttctgtaaggccctgttttattctctaatcattatcggcacactcgggaaaaagataaaacaatacagagagctgaagcctcagacctgcactatttgtgaaaccgcacccgtgaacgctatcgatgccgagatgcatgaccttaattgctcctacaacatttgcccatattgtgctagcaggttgacatcggaaggactggcccgtcacgttactcagtgccccaagcggaaagagaaggtggaggaaaccgagctctacctgaacttagaacgaatcccttggatagtaagaaaactgcttcaggtctcagagtctacaggtgtggcattgaagaggagttcctggctcatcgttctgctagtgctgctcacggtcagcctgtctccagtgcaaagcgcccccgtaggccatgggaaaaccattgaaacttatcagacacgcgagggattcacctccatctgtctttttatgttgggctcaattctgttcatcgtgagttgcttagttaagggtctcgtcgacagcgtgtctgattcctttttccctgggctgtcagtgtgtaaaacttgcagtataggcagcattaatggatttgagatcgaatcccacaagtgttactgctctcttttctgttgcccgtattgtcggcactgctcggctgacagagagatccatcagctgcacttgagcatttgcaagaaaaggaagacaggctcaaacgtcatgctcgcggtttgtaaacgcatgtgcttcaaggcaaccatcgaagcctcccgacgggctctgctaattcgtagtataatcaatacgacttttgtgatttgtatcctgaccctcgccatttgcgtggtatctacaagcgcagtcgagatggaagatctgccagccgggacctgggagagagaggaagaccttactaacttctgtcatcaagagtgccaggtgacagaaaccgagtgtttgtgcccctacgaggctctggttttaaggaaacctctctttctggattccatcgtgaagggaatgaagaatcttctgaactcaacatctctagaaactagcctcagtatagaggccccatggggcgcaatcaatgtccagtccaccttcaaacccacggtgagcacagcgaacattgctctgtcttggtcatccgttgaacaccgcggtaataagatcttggtgaccgggcggagtgagagcattatgaaactggaagagagaactggagtatcgtgggacttaggcgtcgaggatgcctctgaatccaagctcctgaccgtgagcatcatggacctttcacagatgtatagtcctgtgtttgagtacctgtctggtgataggcaagtcgaagagtggccgaaagcaacatgtactggcgactgccccgaacgatgtgggtgcacctccagcacgtgcttgcataaggagtggccacactcacgcaactggcggtgtaatcctacatggtgctggggagttggcaccgggtgtacttgctgtggagtggatgtaaaggacctcttcacagatcacatgtttataaaatggaaggtggagtacattaaaaccgaagccatcgtctgcgtggagctgacttcacaggaaagacagtgtagcctaatcgaggctggcacaaggttcaacctgggtcccgttaccattacgctttccgaaccacgtaatatacagcaaaagctccctcccgagatcattactctgcatccaaaaatcgaggaagggtttttcgacttgatgcacgtgcagaaggtcctgtctgccagcaccgtgtgcaagttacagtcctgtacacatggcattccgggagacctccagatctatcacataggtaacctgcttaaaggcgatcgcgttaatgggcatctgatccacaagattgagcctcactttaacacctcatggatgtcttgggacggatgcgatttggactactattgtaacatgggcgattggcccagttgcacatacactggggtgacccaacataatcacgcagctttcgtcaacctcctgaatatcgaaacggactatacaaaaacttttcatttccactcgaagcgggtaaccgcccacggagatacaccacagctagacctgaaagcgagacccacctacggcgccggtgagattactgtgcttgttgaggtggctgatatggaactccataccaagaaagtcgagatcagcgggctgaagttcgcatccttgacatgcacgggatgttatgcctgttcttcaggcataagctgcaaggtgaggattcacgtagacgaacctgatgagttaactgtgcatgtcaaatccagtgacccagatgttgtggctgcctctaccagcctgatggcacgaaagctcgaatttggtacagactcaaccttcaaagcgttttccgccatgcccaagacaagtctgtgcttctacatcgtggagcgggagtactgtaaaagctgctctgaagacgatactaagaagtgtgtcgacaccaaacttgagcagcctcaatccatcctgattgaacacaagggcacgatcatagggaaacagaacgatacttgcacagctaaggcctcatgttggttggagagcgtgaaatcgtttttctatggactaaagaatatgctgggctctgtttttgggagtttctttgtaggcattctcctgttccttgcaccgtttgtgttactggtcctcttcttcatgtttggatggaagatcttgttctgctttaaatgttgccgcagaaccaggggtctgttcaagtaccggcatctcaaagacgatgaagagaccgggtatcgaagaattatcgagcgcctgaactccaagaaaggaaagaataggcttctggacggcgaacgtttggctgatcggaagatagccgagctatttagcactaaaacacacattggctga

SEQ ID NO: 10326 - RNA, 5067 nt, synthetic construct
  misc_feature 1..5067: note = derived and/or modified CDS sequence (opt3) from CCHFV(4701-ST-2009)__KR814872.1__GP
  source 1..5067: mol_type = other RNA
atgcccatcaacattatgcacaccctgctcgtgtgcttcatactttacctgcagttgagcggcttagggggagcccatggtcaatccaatgctacagagcacaacggcactaatacgaccacagcacctgggacttctcagtcaccaaagccgcccgccagtaccacactgcctcataccccagaaagctccactgtcaaactaacaacccccacgtctgagactgaaggatcgggcgagaccacacctccacccaacactacccagggtctccctctgacagggaccacgccagaaagatcagcgactacagctaccagcactagctccacagacaatatgaactctaccacgcaggttaccgataatacaccgactagcaccgtgtccatctcacccagtagttcttcctcaatgcctagcacaccacaaggaactcaccatcccgtaaggagtcttctgtctgtgtccagccctaagaccgtcacaaccccaactcccatgtcgccgggcgagatgtctcctgagacgtcctcacagcacagtgccatgagccgggtgcccacattgtataccgcaactcaggtttccaccgaaaacacagaccgctctaccccacgacagagcgagtcaagtgtgcaacctgccactcagtcccccattacaagcccagctcagacgatcctcctgatgtctgcagcccccaaagctattcaggatatgcacccttcaccaaccaatcgtagtaagagaaacctggaagtcgagatcatactcactttaagccaaggcctgaaaaagtactatgggaagatccttaaattgctgcatctaacactcgaggaagacaccgagggactgcttgaatggtgtaagaggaatctgggttccaactgcgatgacgactttttccagaaacggattgaggaatttttcatcacaggcgaggggtactttaatgaggtgttgcagttcaagactctctctaccctgtcgccgacggaacccagccacgtacgcttacctaccgccgagccatttaaatcctatttcgcgaagggatttctgtcaattgatagtggctacttctctgcaaagtgttatcccagaagctccacatcaggtctccaacttatcaacgttactcagcatcctgccaggatagctgaaaccccagggcccaaaacaactagcctgaagaccattaattgcatcaacttgcgggcctctgtgtttaaagagcaccgcgaagtcgagattaacgtgctactgccgcagatcgcagtgaatctctccaactgtcacgtcgttatcaatagtcatgtgtgcgattacagcctggacacggatggacctgtacgacttccaagaatccaccatgagggcacattcatacccggcacctacaagatcgtgattgacaggaaaaacaagctgaatgatcggtgttctttggtcactaactgcgtgatcaaagggcgtgaagttcgcaagggacagtccgtgctcagacaatataagacagagataaaaattggtaaggcttcaaccggcagtaggaaactgttaagcgaggaacctggggacgactgtatctcgcggactcagctgctaaagaccgaaacagccgagatccacgatgacaattacggaggccccggtgataaaattacgatctgcaacgggtccaccgtcgtggaccagcgactcggctctgagctgggatgttatactattaatcgcgtaaagagctttaagctgtgcgaaaactcagcgacaggcaaaacctgcgagatagatagtacaccagttaagtgtagacaggggttctgcttgaaaatcactcaagaaggaaggggtcatgtgaagctgtcccggggctctgaggtcgtgctcgacgcctgtgatagctcctgcgagattatgatccctaaagggaccggagacatcctggtcgattgttcaggcggtcagcagcacttccttaaggacaatctgattgatttggggtgcccccacataccactcctgggcaagatggcaatctacatttgtcgcatgagcaaccatccgagaacgacaatggcttttcttttctggtttagtttcggatatgtgattacctgcatcttttgtaaagccctgttctactctctaattataatcggcactctcgggaagaaaattaagcagtatagggaactgaaacctcaaacctgcacaatctgtgagactgctcccgttaatgccattgacgcagaaatgcacgaccttaactgctcctacaatatctgcccatactgtgccagccgtttgacctcggatggactggctcggcatgtgacacagtgccccaagcgaaaggagaaagtagaagagacggagctctatctgaacttagaaagaataccttggattgtcaggaagctgcttcaggtgtcagagtctaccggtgttgcgttgaaacgcagttcctggctcatcgtgctgctagtcctgctcactgtgagcctgtctccagtacagagcgcacccgtgggccacgggaagacaattgaaacctaccaaactcgggagggatttacatccatctgtcttttcatgttgggctcaatactgtttatcgttagttgcttagtcaaaggtctcgtggacagcgtgtctgattccttctttcctgggctgtcagtctgtaagacctgcagtattggcagcatcaacggattcgaaattgagtcccacaaatgttattgctctttattttgttgcccgtactgtagacattgctcggccgacagggagatccaccagctgcatttgagcatatgcaagaagcgcaaaacgggctcaaatgttatgctcgctgtgtgtaagcgaatgtgcttcaaagccactattgaagcatcccggcgtgccctgctaatcagaagtatcattaacaccacattcgtgatgtgtatcctgaccctcgctatttgcgtagtctctactagcgccgtggagatggaagatctgccagcagggacatgggagagggaagaggaccttaccaatttttgtcaccaggagtgccaagttacagaaactgagtgtttgtgcccctatgaagcgctggtgttacgcaagcctctcttcctggattccatagtcaaaggaatgaagaaccttcttaattcaacctctctagagacgagcctcagtatcgaggctccatggggcgccattaacgtgcagtccacatttaagcccaccgttagcactgcaaatatcgccctgtcttggtcatccgtggaacatcggggtaacaaaattttggtaaccgggagaagtgagagcatcatgaagctggaagagaggacaggagtctcgtgggacttaggcgtggaagatgcttctgagtccaaactcctgactgtgagcataatggacctttcacagatgtacagtcctgtcttcgagtatctgtctggtgatcgacaggttgaagagtggccgaaggccacctgtacgggcgactgccccgaacgctgtgggtgcacatcctcaacctgcttgcacaaagagtggccacacagccggaattggagatgtaaccctacttggtgctggggagtgggcacagggtgtacctgctgtggagtagatgtgaaggacctctttactgaccatatgttcatcaagtggaaagtcgaatacattaagacagaggcaatcgtgtgcgttgagctgaccagtcaagaaaggcagtgtagcctaattgaggctggcacgcgttttaatctgggtcccgtgactatcaccctttccgaaccacgcaacatacagcagaaactccctcccgagattatcacactgcacccaaagatcgaagaggggttctttgatttgatgcatgtccaaaaagtgctgtctgccagcaccgtttgcaagttacagtcctgtacacacggcattccgggagacctccagatataccatatcggtaatctgcttaagggcgatcgggtgaacgggcacctgattcacaaaatcgagcctcatttcaatacttcatggatgtcttgggacggatgcgatttggactattactgtaacatgggcgattggcccagttgcacctatacgggggtcacacagcacaaccatgcggcctttgtaaatctcctgaacattgaaactgactacaccaagacattccactttcactcgaaaagagtgaccgctcatggagatactccacaactagacctgaaggcaaggcccacctatggcgccggtgagatcacagttcttgtggaagtcgctgatatggagctccacacgaaaaaggtggagataagcgggctgaaattcgcctccttgacttgcaccggatgttacgcatgttcttcaggcatcagctgcaaggtacggattcatgtggacgaacctgatgagttaacagtccacgttaagtccagtgacccagacgtggtggcggcctctaccagcctgatggctcgaaaactcgagttcggtactgattcaacatttaaggccttctccgcaatgcccaaaaccagtctgtgcttttatatcgtcgaacgcgaatactgtaagagctgctctgaggacgatacgaaaaagtgtgtggacactaaacttgagcagcctcagtccattctgatcgaacataaaggcacaataattgggaagcaaaatgatacctgcaccgctaaagcctcatgttggttggagagcgttaagtcgttcttttacggactaaagaacatgctgggctctgtattcgggggatttttcgtgggcatcctcctgtttcttgcaccgttcgtcttactggtgctctttttcatgttcggttggaagatcttgttttgcttcaagtgttgcagaaggactcgggggctgtttaaatatcgacacctcaaggacgatgaagagacaggatacagacgcattatcgaaaggctgaatagtaaaaagggcaaaaaccgtcttctggacggcgagcggttggccgatagaaagatagctgagctattctccaccaagacacacattgggtga

SEQ ID NO: 10327 - RNA, 5067 nt, synthetic construct
  misc_feature 1..5067: note = derived and/or modified CDS sequence (opt3) from CCHFV(4574-ST-2008)__KR814870.1__GP
  source 1..5067: mol_type = other RNA
atgcccaccaacatcatgcacacactgctcgtgtgcttcattctttacctgcagttgttaggccctgggggagcccatggtcaaccaaatgctactgagcacaacagaacgaataccacaactgcaccgagcacctcccagtctcccaagcctccagtctcaacagcgccccctcatgccctggagagtccaaccataaaaagcactacacccacctccgagacggaaggctctggggagactacctcgcctccaaacacaactcagggaccgtcactacccgaaaccacacctaagaggccagctaccacggccactagcacacccagtaccgacaatactaactccacaacccacgttacggataataaccctacctctacaatcagcacttccccatcaagtagcccctctaccccgtccacacctcggggcattcatcaccccgcacgcaatctcctgtcagtgagcagtccaaaaactgccaccacacctacccccacttctccaggtgagatctccagcgagacgtcgtctcttcactccgctatgtcacgaacaagtaccctgtatactgcaacccaggccagcacagaaaacgctaatcattccgcgccccgtcaatctgagagccctgcccagccaaccactacatcattgatgacgagtccggcacagtccattctcgtaatgagcgccgctcccaccgccatccagaacatacacccttctccaactaatagatcaaagaggaacctggaaatggagatcattctgacactcagtcaagggctgaaaaagtactatggaaagatcctgaaacttttgcatctgaccctagaggaagacacagagggcctcctggaatggtgtaagcggaatcttggcagcaactgcgaggatgactttttccagaaacgcattgaagagtttttcatgactggggagggatactttaacgaagtgctgcagttcaagaccttgtccacgctctctcccaccgagccttcgcacgcaagaccacccacagtcgaaccgtttaaaagctatttcgctaagggttttctgtccatcgattcaggctacttcagtgccaagtgttatcctaggtctagcacttccgggttacagctgataaatgtgacccaacacccagcgcggattgccgagacacccggacctaaaactacctcactcaagacgatcaactgcattaatcttcgcgcaagcgtttttaaagaacatcgagagatcgagatcaacgtgctgttgccccagattgctgtcaatctatctaactgtcacgtggtaataaattcccatgtttgcgactacagtctggatacagacggcccagtgagactccctcacatctaccatgaaggtaccttcattcccgggacttataagatcgtcatagataaaaagaacaaactgaatgacaggtgtacacttgtgaccaactgcgtgattaagggacgggaggtccgtaagggccagagcgttctgcgccaatacaaaactgaaatcaagatcggcaaagtgtctaccgggtccagaaagttgctctcagaggaaagtggagatgactgtattagcaggacacagctgttacggacggagaccgccgagatccacgatgacaattatggtggcccaggggacaaaattactatatgcaacggatcgacaatcgtagatcagcgactgggctccgaactaggttgttacaccattaatcgcgtgaagtcttttaagctctgcgagaacagcgctacagggaaaacttgcgaaatcgactcaaccccggtcaagtgtagacagggcttctgcctgaaaatcacgcaagagggaaggggccacgtgaaacttagtcgggggtccgaggttgtgttggatgcctgtgactctagctgcgaagtcatgattcctaaaggaacaggtgatatactggtggactgttccggcgggcagcagcatttcctcaaggataatctgatcgaccttggatgcccccacattccactgttgggcaagatggcaatctatatttgtcgcatgtcaaaccatcccagaaccactatggcctttctcttctggtttagcttcggttacgtaataacctgcctgttttgtaaggctttattctatagtctgatcatcattgggacactaggcaagaaaatcaagcagtacagggagctccgtcctcaaacttgcaccatttgtgaaacagcgccagttaacgcaatcgatgccgagatgcacgacctgaattgctcttacaacatatgcccctattgtgcttcccggcttacgagcgatggattggcccgacacgtgcctcagtgcccgaaaagaaaggaaaaggtcgaggagaccgaactgtacctcaatctggagaggattccatggatcgtgcgcaaattactgcaggtctcggaatcaactggcgtggcacttaagcggtctagttggttgattgttctcctggtgctactgacagtatccctcagccccgtccagtctgcccctgtggggcatggaaaaaccatcgagacttatcaaacaagagaaggttttaccagcatatgtctgttcatgcttggctccatcttgtttctggtttcatgcttagtgaaggggctcgtcgacagtgtgagcgactctttctttccaggactgtccgtatgtaaaacgtgctcaattggcagtatcaacggtttcgagattgagagccacaagtgttactgctcccttctgtgttgcccctattgtaggcattgctctgctgatcgcgaaatccaccagttgcatctctcgatatgcaaaaagcgaaagactgggagcaatgtgatgctggccgtttgtaaacggatgtgctttcgtgcaaccattgaggcgtcaagaagggctctactgatccgctccatcattaacacaaccttcgtcatctgtattctcactctgacaatatgcgtggtgagtacctctgccgtcgaaatggagaatcttcctagcggcacatgggaaaaggaggaggacttgactaacttctgtcaccaggaatgccaggttaccgagacggaatgtctgtgcccgtacgaggcattagtgctccggaaacccctgtttcttgattccatcgtgaagggaatgaaaaatctgctaaactcaacatctctcgagaccagcctgagtattgaagccccatggggcgctatcaatgtacaatccactttcaagcctaccgtcagcacagccaacattgcattgtcttggtcatccgtggagcacagagggaataagatcctggttactggaaggagtgaaagcataatgaaattagaggaacgaaccggcgtgtcgtgggacctcggtgtcgaggatgcttctgagtccaagctgcttacggtgagcatcatggacctgtcacagatgtatagtcccgtttttgaatacttgtctggggatcgccaggtggaggaatggccaaaagccacatgtaccggagactgccctgagcggtgtggctgcacttccagcacatgcctccataaggaatggccccactcaagaaactggaggtgtaatccaacctggtgctggggtgtaggcactgggtgtacatgctgtggagtcgatgtgaaagacctgttcaccgatcatatgtttgtgaagtggaaggtcgagtacattaaaacggaggcgatcgtttgcgtggaactaaccagtcaagagcgtcagtgtagcctgattgaagccggcactcgcttcaaccttgggccggtaacaatcaccctctccgagcctcggaacatacagcagaagctgcccccagaaattatcacattgcaccccaaagtggaggagggatttttcgacctgatgcatgtccaaaaggtgttatctgctagcactgtttgcaaactccagtcctgtacccacggcatccctggtgatttacaggtgtatcacattgggaatcttctgaagggagacagagtcaacggccatttgatacacaagatcgaaccacattttaatacgtcatggatgtcttgggacggttgcgatctcgactactattgtaacatgggcgattggcccagttgcacatacactggggtgacccagcacaatcacgcagccttcgttaacctgctaaatattgagacagactataccaaaacttttcatttccactcgaagagggtgaccgctcatggagatacacctcaactggaccttaaagcccgaccgacgtacggcgcaggggaaatcactgtcctcgtagaggtggcggatatggagctgcacaccaagaaagttgaaattagcggattgaagtttgcctccttagcttgcacaggctgttatgcctgttcttcaggtatcagctgcaaagtgcggatacatgtcgacgagccagatgaactgaccgtgcacgtaaagtccagtgaccccgatgtggtcgcagcttctactagcctcatggcccgcaagctggagttcgggacagactcaaccttcaaagcattttccgccatgcctaagacgagtctttgcttctacatcgttgaaagagagtactgtaaaagctgctctgaggaagatactcagaagtgtgtggacacaaaactggagcagccccagtccattttgatcgaacacaagggaaccattatcggcaagcaaaacgatacctgcactgctaaagcgtcatgttggctagagagcgtgaagtcgtttttctatggtctgaaaaatatgctcggctctgtctttgggaacttctttataggcattctgcttttcttagccccatttgtgctgctcgttttgttctttatgttcggatggaagatcctgttctgctttaaatgttgcaggcgggcacgagggctcctgaagtacagacatcttaaggacgacgaagagacaggatatcgcaaaatcattgagaggctgaataacaagaaaggcaagaatcgtttgctagatggtgaacggctggctgacagaaaaatcgccgaactcttcagtaccaagacacacatagggtga

SEQ ID NO: 10328 - RNA, 5067 nt, synthetic construct
  misc_feature 1..5067: note = derived and/or modified CDS sequence (opt3) from CCHFV(4495-ST-2008)__KR814869.1__GP
  source 1..5067: mol_type = other RNA
atgcccaccaacatcatgcacacactgctcgtgtgcttcattctttacctgcagttgttaggccctgggggagcccatggtcaaccaaatgctactgagcacaacagaacgaataccacaactgcaccgagcacctcccagtctcccaagcctccagtgtcaacagcgccccctcatgccctggaaagtccaaccataaaaagcactacacccacctccgagacggaaggctctggggagactacccctccaccgaacacaactcagggaccctcgcctccagaaaccacacccgagaggcctgctaccacggccacttcaacaccaagcaccgacaatactaacagtacaacccacgttacggataataaccccacctccacaatctctactagcccgtcctcaagtcctagcaccccctctacaccacggggcattcatcaccctgcacgcaatctactctccgtgtcaagccccaagactgccaccacaccaacccccacaagtcctggtgagatctcttccgaaacgagctcgctgcactctgctatgtcccgaacatcaaccctttatactgcaacccaggccagtacagagaacgctaatcatagcaccccacgtcaatccgaatctccggcccagcccactacaacgagcctgatgacctcccctgcgcagagtattttggtaatgtccgcagccccaactgctatccagaacatacaccccagccctacaaatagatctaaaaggaacctcgagatggagatcattctgaccctgtcacaagggctcaagaaatactatggaaagatcttaaagctgcttcatttgacactggaagaggacactgaaggcctactcgagtggtgtaaacggaatctgggcagtaactgcgatgacgactttttccagaagcgcattgaagagtttttcatgaccggggagggatactttaacgaagtgcttcagttcaaaacgctgagcaccttgtccccaacagagccctctcacgccagaccgcctactgtcgaaccatttaagtcgtatttcgcaaaaggttttctcagcatcgattccggctacttctcagctaagtgttatcccaggagttctaccagcgggctgcagttaataaatgtgacacaacaccctgcccggattgcggagactcccggaccaaagaccacgtccctgaaaacaatcaactgcattaatctccgcgcctcagtttttaaggaacatcgagagatcgagatcaacgtgcttctgcctcagattgcagtcaatttgagcaactgtcacgtggtaataaattctcatgtttgcgattactccctagacaccgatggccccgtgagactgccacacatctaccatgaaggtactttcattccggggacatataaaatcgtcatagacaagaaaaacaagctcaatgataggtgtaccctggtgactaactgcgtgattaaaggacgggaggtccgtaagggccagagtgttcttcgccaatacaagaccgaaatcaaaatcggcaaggtgagcacagggtctagaaaactgttgtccgaggaatcaggagacgattgtattagtaggacgcagctcctgcggaccgagactgctgagatccacgacgacaattatggtggccctggggataagattacaatatgcaacggaagcaccatcgtagaccagcgattaggctcggaactgggttgttacacaattaatcgcgtgaaatcctttaagctatgcgagaactctgccactgggaagacctgcgaaatcgatagcacgcccgtcaaatgtagacagggcttctgcctcaagatcacacaagagggaaggggccacgtgaaactgtcacgggggagtgaggttgtgcttgacgcttgtgattcctcttgcgaagtcatgattccaaagggaaccggtgacatattggtggattgtagcggcgggcagcagcatttcctgaaagacaatctcatcgatctgggatgcccccacattcctcttctgggcaagatggccatctatatttgtcgcatgtccaaccatccaagaactaccatggcatttttgttctggttttcattcggttacgtaatcacatgcctcttttgtaaggccctgttctatagcttaataatcattgggactctgggcaaaaagatcaaacagtacagggagctacgtccccaaacctgcacaatttgtgaaacggctcctgttaacgcgatcgacgcagagatgcacgatctcaattgcagttacaacatatgcccgtattgtgcctctcggctgacctccgacggacttgctcgacacgtgccacagtgccccaagagaaaagaaaaggtcgaggagactgaattgtacctgaatctcgagaggattccttggatcgtgcgcaagctgttacaggtcagcgaatcgacaggcgtggccctgaaacggtcatcttggcttattgttttgctcgtgctgctaaccgtaagtctgtccccagtccagagcgcacccgtggggcatggaaagactatcgagacatatcaaaccagagaaggttttacgtctatatgtctcttcatgctgggcagcatcctatttttggtttcctgcctggtgaaagggttagtcgactcagtgagtgatagcttctttcctggactctctgtatgtaagacttgctccattggctcaatcaacggtttcgagattgagagtcacaaatgttactgcagcctgctttgttgcccgtattgtaggcattgctccgccgaccgcgaaatccaccagctgcatttgtctatatgcaagaaacgaaagaccgggtcgaatgtgatgctcgctgtttgtaagcggatgtgctttcgtgccacaattgaggcaagcagaagggcgctgctaatccgctcaatcattaacaccactttcgtcatctgtattctgacactcaccatatgcgtggtgtccacaagtgctgtcgaaatggagaatctgccctctggcacttgggaaaaagaggaggatcttaccaacttctgtcaccaggaatgccaggttacggagacagaatgtttgtgcccatacgaggccctggtgttacggaagcctctctttctggacagcatcgtgaaaggaatgaagaatcttctgaactccacctcactagagacttctctcagcattgaagcaccctggggcgccatcaatgtacaaagtaccttcaaaccaacagtctccactgctaacattgccctgagctggtcttcagtggagcacagagggaataagatcttggttaccggaaggtccgaaagtataatgaagctggaggaacgaacgggcatcagctgggatttaggtgtggaggacgcatcggagtctaaactcctgacagtctccattatggatcttagccagatgtattcacctgtgtttgaatacctgagtggggaccgccaggttgaggaatggcccaaggctacctgtactggagattgcccagagcggtgtggctgcacatcttcaacctgcttgcataaagaatggccgcacagcagaaactggaggtgtaatcctacttggtgctggggtgtgggcacagggtgtacctgctgtggagtagacgtcaaggatctcttcacggaccatatgtttgtgaaatggaaggtggagtacatcaagactgaggccattgtctgcgttgaactgacctcacaagagcgtcagtgtagtctaatcgaagcgggcacacgcttcaacctggggcccgtgaccataacacttagcgagccacggaacattcagcagaaactgccccctgaaatcatcactctccacccaaaggtagaggagggatttttcgatttgatgcatgtgcaaaaagtcctgtccgcctctaccgtgtgcaagttacagagctgtacgcacggcattcccggtgacctccaggtttatcacatagggaatctgcttaaaggagacagagtgaacggccatctgatccacaagattgaacctcattttaatacatcctggatgtcatgggatggttgcgacttggattactattgtaacatgggcgactggccgtcttgcacttacaccggggtcacacagcacaatcacgctgcattcgtgaacctcctgaatatcgagaccgattatactaagacctttcatttccacagtaaaagggttacagcccatggagacacgccacaactagatctgaaggctcgacccacttacggcgccggggaaattaccgtgcttgtcgaggtagcagacatggagctccacactaaaaaggtggaaatctcgggactgaaatttgcgagcttggcctgcaccggctgttatgcttgctcctctggtatatcatgtaaggttcggatccatgtggatgagcctgacgaattaactgtccacgtgaaaagctccgatcccgacgtagtggccgcaagtacatctctgatggctcgcaagctcgagttcgggaccgatagcacgttcaaggccttttcagcaatgccaaaaacttccctgtgcttctacattgtcgaaagagagtactgtaagagttgcagcgaggaagacacacagaggtgtgttgacaccaaacttgagcagcctcagtctatcctgattgaacacaagggaaccatcataggcaaacaaaacgatacttgcacagccaaggcttcctgttggttggagtcagtcaagagctttttctatggtcttaaaaatatgctgggctcggtgtttgggaacttctttattggaatcctcctgttccttgcgccctttgtgttactggtcctcttctttatgttcggctggaagatcttgttctgctttaaatgttgccggcgagccagagggctgctcaagtaccgccatctgaaagacgatgaagagaccggatataggaagattatcgagcgtcttaataacaagaaaggcaagaatcggctgttggacggtgaaagactagcagataggaaaatagctgagctgttctctacaaagactcacattgggtga

SEQ ID NO: 10329 - RNA, 5067 nt, synthetic construct
  misc_feature 1..5067: note = derived and/or modified CDS sequence (opt3) from CCHFV(3809-ST-2007)__KR814867.1__GP
  source 1..5067: mol_type = other RNA
atgcccaccaacatcatgcacacactgctcgtgtgcttcattctttacctgcagttgttaggcctcgggggagcccaaggtcagagcaatgctactgagcataacgaaacgaataccacaactgcaccttccacctctcagtcaccaaagccgcccgtcagtacaacccctctacacgccctcgagagctccactataaaaccaacaacccccgcgagagaaacggagggctctggggaaactacccctccacccaacacaactcagggaccttcgccaccggaggctacccccgagaggcctgccacaaccgcaacgtcagccccaagcactgacaatacaaacagtaccactcatgttacagataataaccccacctccacgatctctaccagcccttcctcaagtccaagcacaccctttactccgcaaggcattcaccatcctgctcggaatctgctttctgtgtcctcacccaagaccgcaacaactccaacccctacaagccccggtgaactgagttctgagacctccagcttgcactcggccatctctcgcacttccacgctctatacagctacccaggtatcaactgaaaacgccaatcacagtgcgccacgacagagcgagtcctctgcacagcccaccacaaccagccctatgacttcaccagcccaaagtattctggtgatgtccgctgccccgacagcaatccagaacatacatcccagccctacgaatcgttctaaaagaaacctggagatggaaatcattctcaccttatcacaggggctgaagaaatactatggaaagatccttaagttgctgcacctaactctcgaggaagacacagagggcctgcttgaatggtgtaaaaggaatctgggcagtaactgcgatgacgatttctttcagaagcggattgaggagttctttatgaccggggaaggatacttcaacgaggtcttgcaatttaaaacactcagcactctgtccccaaccgaaccctctcatgctcgccctccagccgtggagcccttcaagtcgtattttgcgaaaggtttcttaagcatcgactccggctacttttcagccaagtgttatccgagaagttctacgagcgggctgcagctcataaatgttacccagcaccctgcaaggattgctgaaacaccaggacccaagactacctcccttaaaacaatcaactgcattaatctgcgggcctcagtgttcaaggagcaccgcgagatcgaaatcaacgtcttgctacctcaaattgctgtgaatctgagcaactgtcatgtagttataaattctcacgtgtgcgattactccctcgacactgatggccccgtccgactgccacatatctaccacgagggtacctttattcctgggacgtataaaatcgtgatagacaagaaaaacaagctcaatgatagatgtacactggtgaccaactgcgtcattaaaggaagggaagttcggaagggccagagtgtgttgcgtcagtacaagactgagatcaaaatcggcaaggccagcacagggtctcgcaaactcctgtccgaggaacccggagacgattgtatttcaagaacccagttactgaggactgagaccgcagaaatccatgacgacaattatggtggcccaggggataagattacaatatgcaacggaagtacgatcgtagaccaacggctaggcagcgagctcggttgttacaccattaatcgagtgaaatcgttcaagctgtgcgaaaactccgccactgggaagacatgcgagatcgattctaccccggtcaaatgtcgccagggcttctgccttaagatcacacaggagggaagaggccacgtgaaattgagcagggggtcagaagttgtgctggacgcttgtgatagttcctgcgaggtcatgattcctaagggaactggtgacatactcgtggattgttctggcgggcagcaacactttctgaaagacaatcttatcgatctgggatgcccccatattccattgctcggcaagatggcgatctatatttgtcggatgagcaaccacccccgcaccacgatggcattcctgttttggttctcctttggttacgtaatcacatgcatattctgtaaggccttattttattcactgatcattatcgggaccctaggcaaaaagattaaacagtacagagaactcaagcctcagacttgcaccatctgtgagacagctccagttaacgccatagacgcagaaatgcatgatctgaattgcagctacaacatttgcccctattgtgccagtaggcttacttctgacggattggctcgtcacgtgcctcagtgcccgaaacggaaggagaaggtcgaggaaaccgagctgtacctcaatctggaacgaatcccatggattgtgagaaaattactgcaagtctccgagagcacaggcgtggcccttaagaggtcgtcatggttgatcgttctcctggtgctactgacggtatctctcagtcccgtccagtccgcacctgtggggcacggaaaaaccatagaaacttatcagacacgcgagggtttcaccagcatctgtctgtttatgcttggctctattttgttcctggttagctgcttagtgaaggggctcgtcgactccgtgtcagatagctttttcccaggactgagtgtatgtaaaacttgctctatcggctccgtgaacggttttgagattgaatcacataagtgttactgcagtcttttctgttgcccctattgtcggcactgcagcgcggacagagagatccatcagctgcacttgtccgtttgcaaaaagaggaagacagggtctaatgtcatgctcgctgtgtgtaaacgcatgtgcttccgagccaccatagaagcatcgcggcgtgccctgctaattagaagcatcatcaacacgacttttgtgatttgtatcctgaccctcacaatttgcgtcgtttcaacctccgctgtggagatggaaaatctgcctgccggcacttgggagagggaggaagatcttacaaacttctgtcatcaagagtgccaggtgaccgaaacagagtgtttgtgcccgtacgaggcactggtattacgcaagcccctctttctggacagtatagtcaaaggaatgaagaatcttctgaactctactagcctagaaacctccctctcaatcgaggctccatggggcgccattaatgtgcagtctacgttcaaacctacagttagcaccgcgaacatcgccctgagttggtccagcgtggaacaccgggggaataagattttggtcactggaagatctgagtcaatcatgaagctggaagagaggaccggcgtgtcctgggatttaggtgttgaggacgctagtgaaagcaaactcctgacagtgtcgataatggatctttctcaaatgtattcccccgtatttgagtacctgagcggggaccgacaggtcgaagagtggccaaaggcaacttgtaccggagattgccctgaacgctgtggctgcacgtcaagtacatgcttgcacaaagagtggccccattctcggaactggagatgtaatccaacctggtgctggggtgtgggcactgggtgtacatgctgtggagtggacgtcaaggatctcttcaccgaccacatgtttgttaaatggaaggtggagtacatcaagactgaagccattgtatgcgtggagctgacatcccaggaaaggcagtgtagcctaatcgaggctggcacccgtttcaacctggggccggtcacgattactctttcagaacctcgcaacatccaacagaaactgcccccagagataattaccctgcatcccaaggtggaggaaggatttttcgatttgatgcacgttcagaaagtgctgagtgccagcacagtctgcaagttacagtcctgtacccatggcatccctggtgacctccaagtgtatcacatcgggaatctgcttaaaggagaccgggttaacggccacctgattcataagatagagccacactttaatacatcttggatgagctgggatggttgcgacttggattactattgtaacatgggcgactggccctcctgcacttacaccggggtgacgcagcataatcacgcagcgttcgtcaacctcctgaatatcgaaacagattatactaagacctttcacttccattcaaaaagagtaacagcccacggagacacccctcagctagatctgaaggctaggccgacttacggcgccggggagattaccgtgcttgttgaggtggcagacatggaactccatacaaagaaggtcgagatctctggactgaaattcgctagtttggcctgcacgggctgttatgcatgctcgagcggtatttcctgtaaggtgcgaatccacgtagatgaaccagacgagttaactgtgcatgtcaaatcttcagatcccgacgttgtggccgctagcacctccctgatggcgcggaagctcgaatttgggacagatagtaccttcaaggccttttctgcaatgcctaaaactagcctgtgcttctacatagtggagaaggagtactgtcgctcatgctccgaagaggacacacagaaatgtgtcgacaccaaacttgaacaaccccagagtatcctgattgagcacaaaggaacgatcattggcaagcagaacgatacttgcacagctaaggccagctgttggttggaatctgtgaaatcctttttctatggtctaaagaatatgctgggctcagtttttgggaacttctttatcggaatactcctgttccttaccccatttgtattactggtgcttttcttcatgtttggctggaaaattttgttctgctttaagtgttgcagaaggacccgggggctgctcaaataccgacacctgaaggacgatgaggagactggatatagacgcatcatcgaaaggcttaataacaagaaaggcaagaatcgtctgttggacggtgagcggctagccgatagaaaaattgctgaactgttcagcacaaagacccatatcgggtga

SEQ ID NO: 10330 - RNA, 5067 nt, synthetic construct
  misc_feature 1..5067: note = derived and/or modified CDS sequence (opt3) from CCHFV(3756-ST-2007)__KR814866.1__GP
  source 1..5067: mol_type = other RNA
atgcccatcaacattatgcacaccctgctcgtgtgcttcatactttacctgcagttgagcggcttagggggagcccatggtcaatccaatgctacagagcacaacagaactaatacgaccacagtccctggcacttctcagtcaccaaagccgcccgcaagtaccacactgcctcataccccagaaagctccactgttaaactaacaacccccacgtctgagactgaagggtcgggagagaccacacctccacccaacactacccagggcctccctctgccaggtacaaccccggaaaggtcagccacgactgcgacaagcaccagttccactgacaatatgaacacaaccacacaggtgaccgataatacacccacttctaccgtaagcatctccccttcaagtagcccatctatgccctccacatcacaagggattcactatcctgtgcggagccttctgagtgtctcttccccaaagactgtgaccacacccaccccgatgagccctggagagatgtcgcccgagacttcttcccagcattcagctatgagtcgcatcccaacgttgtacacagccacccaggttagcactgaaaacattaatcgatccacccctcgtcagtctgagagctcagtgcaacccgcaacacagagtccaatcacctcccccgcccagactatactcctgatgagcgctgcacctaaagccatccaggacatgcacccatctccgacaaacagatcaaagaggaatctggaagtcgagattatcctcacgttaagtcaaggcctgaaaaagtattacggcaagattcttaaattgctgcacctaaccctcgaggaagatactgaggggctgcttgaatggtgtaagcggaacctgggaagcaattgcgacgatgactttttccagaaacgcatcgaggaatttttcataacaggtgagggctattttaacgaggtgttgcagttcaagaccctctccacactgtctcccactgaaccttcgcatgtaagattaccaaccgctgagccctttaaaagctacttcgccaaggggtttctgtccattgattcaggatatttcagtgcgaagtgttaccctaggtctagcacgtccggcctccaacttatcaatgttacccagcacccagcacggattgccgaaacacccggtccgaaaactacctcactgaagacaatcaactgcatcaacttgcgcgctagcgtgtttaaagagcatcgagaagtcgagattaatgtgctactgcctcagatagccgtgaacctctctaattgtcacgtcgttatcaactcccacgtgtgcgactacagtctggatactgacgggccagtaagacttcccaggattcatcacgagggaaccttcatccctggcacgtataagatagtgattgatcggaaaaataagctgaacgaccgttgtagcttggtcacaaattgcgtgatcaaaggccgcgaagttagaaaggggcagtctgtgctcaggcaatacaagaccgagatcaaaattggaaaggcatccactggttcacggaaactgttaagtgaggaacccggcgatgactgtatcagccgaacacagctgctaaagaccgaaactgctgagattcatgacgataactatgggggaccaggcgacaaaataaccatctgcaatggttcgacaattgtcgatcagcgcctcgggtccgagctgggctgttacacgatcaacagagtgaagtcttttaaactttgcgaaaatagcgccaccggaaaaacttgcgagatcgactcaacacctgtaaagtgtaggcagggcttctgcttgaaaattacccaagaagggcggggacacgttaagctgagtcgcggttccgaggtggtcctcgatgcgtgtgactctagctgcgagataatgatccccaaaggcacaggggatattctggtggactgttccggaggccagcagcatttccttaaggataacctgatcgacttgggttgcccacacattccgctcctggggaagatggccatctatatatgtagaatgtcaaatcaccctaggactaccatggcatttttattctggtttagcttcggctacgtcatcacgtgcatcttttgtaaagctctgttctatagtctaattattatcggaacactcggcaagaaaataaagcagtaccgtgaactgaaaccccaaacctgcactatttgtgagaccgccccagtgaacgctatcgatgccgaaatgcatgaccttaattgctcttacaacatttgcccctattgtgcatcccggttgacaagcgacgggctggcccgacacgttactcagtgccctaagagaaaggagaaagtggaagagaccgagctctacctgaacttagaaaggatcccatggatagtacgcaagctgcttcaggtctcggagtcaacaggagtggctttgaaacggtctagttggctcatcgttctgctagtgctgctcacggtctccctgagccccgtgcagtctgcgcctgtaggtcatggcaagaccattgaaacttatcaaacaagagaggggtttaccagcatctgtcttttcatgttgggatccattctgtttatcgtgtcatgcttagttaaaggcctcgtcgatagtgtgagcgactctttctttccgggtctgtccgtgtgtaagacttgctcaatagggagtattaatggcttcgaaatcgagagccacaaatgttactgctccctcttttgttgcccatattgtaggcactgctctgcagatcgcgagatccatcagctgcacttgtcgatttgcaagaagcgaaaaacaggaagcaacgtcatgctcgccgtttgtaagcggatgtgcttcaaagctaccatcgaagcctcacgtagagcactgctaattaggtccataatcaatacgactttcgtgatttgtatcctgaccctcgccatttgcgtggtaagtacatctgctgtcgagatggaagacctgcccgccggcacctgggagcgcgaagaggatcttactaacttttgtcatcaggagtgccaagtgacagaaaccgagtgtttgtgcccttacgaagcactggttttacggaagccactcttcctggacagcatcgtgaaagggatgaagaatcttctgaactccacatcactagagacttctctcagcatagaggcgccctggggagctatcaatgtccagagtacctttaagcctacggtgtccacagccaacattgcactgagctggtcttcagttgaacacagaggcaataaaatcttggtgaccggtaggtccgagagtattatgaagctggaggaacgaactggggtaagctgggatttaggagtcgaagacgcctcggagtctaaactcctgaccgtgtccatcatggatcttagccagatgtattcaccggtgttcgagtacctgagtggcgaccgccaggtcgaagagtggcccaaggctacatgtactggtgattgcccagaacggtgtggctgcacctcttccacgtgcttgcataaagagtggcctcacagcagaaactggaggtgtaatcccacatggtgctggggagttgggaccggctgtacttgctgtggggtggacgtaaaggatctctttacagaccacatgttcataaagtggaaagtggaatacattaagaccgaggccatcgtctgcgtggagctgacttcacaagaacgtcagtgtagtctaatcgaggcaggaacacgctttaacctgggcccagttaccattacgcttagcgaacctcggaatatacagcagaaacttcccccagagatcattactctgcatccgaagatcgaagagggtttctttgacttgatgcacgtgcaaaaagtcctgtccgcttctaccgtgtgcaagttacagagctgtacacatgggattcctggagatctccagatctatcacataggcaacctgcttaagggtgacagagttaatggccatctgatccacaaaattgagccccacttcaacacctcctggatgtcatgggatgggtgcgacttggattactattgtaacatgggagactggccatcttgcacatacactggcgtgacccagcataatcacgccgcgtttgtcaacctcctgaatatcgaaacggattatacaaagactttccattttcacagtaaaagggtaaccgcccacggggacacaccccaactagatctgaaggctcgacctacctacggagcaggcgagattactgtgcttgttgaagtggccgacatggagctccataccaaaaaggtcgagatctcgggtctgaaattcgctagcttgacatgcacggggtgttatgcctgctcctctggaatatcatgtaaggtgcggattcacgtagatgaaccagacgagttaactgtgcatgtcaagagctccgatcccgacgttgtggcagcgagtacctctctgatggcccgcaaactcgaatttggcacagacagcacctttaaggctttctcagccatgcctaaaacttccctgtgcttttacatcgtggagagagaatactgtaagagttgcagcgaggatgacacgaaaaagtgtgtcgataccaaacttgagcagccgcagtctatcctgattgaacacaaaggtacgatcataggcaagcaaaacgacacttgcacagcaaaggcttcctgttggttggagtcagttaagagcttcttttatgggctaaagaatatgctgggatcggtgttcggctctttcttcgtagggattctcctgtttcttaccccattcgtgttactggtcctctttttcatgttcggatggaagatcttgttttgcttcaagtgttgcaggcggacccgaggcctgtttaaatacagacatctcaaggatgacgaagagactggttatcgcaggattatcgaacgtctgaacagtaaaaaggggaaaaatcggcttctggatggagagagattggccgacaggaagatagcagagctattctccacaaagacccacattggctga

SEQ ID NO: 10331 - RNA, 5067 nt, synthetic construct
  misc_feature 1..5067: note = derived and/or modified CDS sequence (opt3) from CCHFV(81-R-2014)__KR814865.1__GP
  source 1..5067: mol_type = other RNA
atgcccaccaacatcatgcacacactgctcgtgtgcttcattctttacctgcagttgttaggccttgggggagcccatggtcaaagcaatgctactgagcacaacggcacgaataccacaactgtcccttccacctctcagtcaccaaagccgctagttagtacaacaccccctcatgcactcgaaagctccactataaaaccaacaacccccacgtctgagactgaagggtcgggagagaccgcccctctgccaaacacaactcaggggccccctccaccggaaaccacacccgagagacctgcgaccacggtgacttcaacaccaagcaccgacaatactaacagtacaatccacgtaaccgataataaccccacgtccaccatttctacaagcccttcctcaagtccaagcactccctctaccccgcagggtatccatcaccctgctaggtcccttctgtcagtgagcagtcccaagacagccactaccccaacacctacctctcccggggagattaattccgaaactagctcgttgcactctgcaatgtcccggacgccaacactccataccgccactcaagtctcaaccgagaacgctaatcacagtgcaccccgccagagcgaatcctctgcccagcctacaaccactagcctgatgacatcaccagctcagagtatcctgctcatgtccgccgcgccgacggcaatacaaaacacccatcccagccctactaatcgatctaaacgtaacttagagatggagatcattctgacactttcacagggattgaagaaatattacggcaagatcctgaagctactccacctgacccttgaagaggacacagaaggcctgttggagtggtgtaaaagaaatctcgggagtaactgcgatgacgactttttccagaagaggattggagaatttttcatgactggtgagggctattttaacgaggtgctgcagttcaaaaccttaagcacgctgtccccaaccgaaccctctcacgcccggctccctacagttgagccatttaagtcgtacttcgctaaagggtttcttagcatcgattccggatatttctcagccaagtgttacccccgcagttctactagcggcctgcaattgataaatgtgacccagcatccggcaagaattgctgaaacacctggtccaaagactacctccctaaaaacgatcaactgcattaatctgagggcctcagtctttaaggagcaccgggaaatcgagatcaacgtgctcctgccccagattgcggtaaatcttagcaactgtcatgttgtgataaattctcacgtctgcgattattccctggacacagatgggcctgtgcgcttgccccatatctaccacgagggaaccttcattccaggcacttacaaaatcgtgatagacaagaaaaacaagctcaatgatcgatgtacactggtcaccaactgcgttattaaaggcagagaagtgaggaaggggcaaagtgtattacggcagtataagactgagatcaaaatcggaaaggccagcaccggttctcgtaaactgctatccgaggaacctggcgacgattgtatttcacgcacacagctcctgagaacggaaaccgcagagatccacgacgacaattacgggggacccggcgataagattactatatgcaacggtagtacaatcgtggaccagaggcttgggagcgagttgggctgttataccattaatcgggtcaaatcgtttaagctgtgcgaaaactccgctacaggaaagacttgcgagatcgattctaccccagtgaaatgtcgacaaggcttctgcctcaagatcacgcaggaagggcgcggacatgttaaactgagcagaggttcagaggtggtccttgacgcctgtgatagttcctgcgaggtgatgattccgaagggcacaggggacatactggtagattgttctggaggccagcagcacttcttgaaagacaatctcatcgatctgggttgccctcatattcccttactggggaagatggctatctacatttgtaggatgagcaaccacccacggaccactatggcctttctattctggttttccttcggctatgttataacctgcatcttttgtaaggcactcttctactcactgatcattatcggaacacttggcaaaaagattaaacaatatcgcgaattgaagccccagacttgcaccatctgtgagacagcccctgtgaacgctatagacgcggaaatgcacgatctgaattgcagctacaacatttgcccatactgtgcaagtagactcacgtctgacgggctggccaggcatgtcccccagtgccctaaacgtaaggagaaggtggaagagaccgagttatatctgaatcttgaacggatcccgtggattgtccgaaaattgctccaggtgtccgagagcactggagttgctctgaagagatcgtcatggctaatcgtgctgctcgtactgcttacagtctctttgagtccagtgcaatccgcccccgttggtcacggcaaaaccatagaaacttaccagacaagggaggggtttaccagcatctgtctgttcatgttaggatctattctctttctggtgagctgccttgtcaagggcctggtggactccgtatcagatagtttctttcctggtttgagcgtgtgtaaaacgtgctctatcgggtccattaacggcttcgaaatcgagtcacataagtgttattgcagtctcttttgttgcccatactgtcgccactgcagcgcagaccgggagatacatcagctgcacctatccatttgcaaaaagagaaagactggatctaatgttatgctggccgtctgtaaaaggatgtgcttccgcgctaccatcgaagcctcgcgacgggcactcctgatccgtagcattatcaacacaaccttcgtgatttgtatacttactttgacaatctgcgtggtctcaacctccgcggttgagatggaaaatctgcccgctggcacatgggagagagaagaggatttaactaacttttgtcaccaggagtgccaagtgaccgaaacggagtgtctctgcccttatgaagccctggtgcttaggaagccgctgttcctagacagtattgtaaaagggatgaagaatctcctgaactctaccagcttggagacctccctgtcaatcgaggcaccctggggagccattaatgtccagtctacttttaaaccaaccgtgagcacagctaacatcgccttaagttggtccagcgttgaacatcgcggcaataagatactcgtgactggtcggtctgagtcaatcatgaagctggaagagagaaccggggtctcctgggatcttggagtggaagacgcaagtgagagcaaactgttgacggtttcgattatggatctctctcagatgtactcccctgtgttcgagtatctgagcggcgacaggcaagtagaagagtggcccaaggctacatgtaccggtgattgcccagaacgatgtggctgcacttcaagtacatgcctacacaaagagtggcctcattctcgcaactggcggtgtaatcccacctggtgctggggcgtcggaactggctgtacatgctgtggggtggacgtgaaggatctgtttaccgaccacatgttcgtcaaatggaaggttgaatacatcaagacggaggccattgtgtgcgtagagcttacttcccaggaaagacagtgtagcctcatcgaggcgggaaccaggtttaacctgggcccagtgacaataaccttgtcagaaccgcgtaacattcagcaaaaactgcctcccgagatcatcacattacatccaaaggtcgaagagggtttctttgatctcatgcacgtgcagaaagttctgagtgccagcactgtgtgcaagctgcagtcctgtacccacgggattcccggagacctgcaggtctaccatataggcaatttgctcaaaggtgaccgcatcaacggccacctgattcataagatcgagcctcacttcaatacgtcttggatgagctgggatgggtgcgacctagattattactgtaacatgggagactggccatcctgcacatatactggcgtgacccaacacaatcatgctgcatttgttaacctgcttaatattgaaacagattacaccaagactttccactttcattcaaaacgggtgaccgcccacggggacacaccccagctcgatctgaaggctagacctacgtatggagccggcgagatcactgtcttggtagaagtggcagacatggagttacataccaaaaaggttgagatatctggtctgaaattcgcgagtctcgcctgcacagggtgttacgcttgctcgagcggaatctcctgtaaggtgaggattcacgtcgatgaaccggacgagctgaccgtgcacgtaaaatcttcagatccagacgtggtcgccgcaagcacttcccttatggctcgaaagctggagttcggcacagatagtacctttaaggccttctctgcaatgcccaaaacgagcttgtgcttttatatcgttgaacgggaatactgtaagtcatgctccgaggaggacactcagaaatgtgtggacacacgcctagaacagcctcaaagtattctgatcgagcataagggtaccataattggcaaacagaacgatacctgcactgccaaggctagctgttggctcgaatctgtgaagtccttcttttacgggctgaaaaatatgcttggatcagtcttcggcaactttttcatcgggatcttactgtttctcgcgcccttcgtgttgctggttctctttttcatgttcggatggaagattctgttttgcttcaaatgttgcagaaggacacggggccttctgaagtatcgacacttgaaagacgatgaggaaaccggttacagacgcatcatagagaggctaaataacaagaaggggaaaaatcgtctgctcgacggagagcggttagccgatagaaagattgcagaactgtttagcacaaaaactcatatcggctga

SEQ ID NO: 10332 - RNA, 5067 nt, synthetic construct
  misc_feature 1..5067: note = derived and/or modified CDS sequence (opt3) from CCHFV(75-ST-2010)__KR814864.1__GP
  source 1..5067: mol_type = other RNA
atgcccaccaacatcatgcacacactgctcgtgtgcttcattctttacctgcagttgttaggccctgggggagcccatggtcaaccaaatgctactgagcacaacagaacgaataccacaactgcaccgagcacctcccagtctcccaagcctccagtctcaacagcgccccctcatgccctggagagtccaaccataaaaagcactacacccacctccgagacggaaggctctggggagactacccctccaccgaacacaactcagggaccctcgctacctgaaaccacaccagagaggcccgctaccacggccacttcaacacctagcaccgacaatactaacagtacaacccacgttacggataataacccaacctccacaatctctactagcccctcctcaagtccgagcaccccttctacaccccggggcattcatcacccagcacgcaatctcctgtccgtgtcaagccctaagactgccaccacacccaccccaacaagtcccggtgagatctcttccgaaacgagctcgcttcactctgctatgtcccgaacatcaaccctgtatactgcaacccaggccagtacagagaacgctaatcatagcgcccctcgtcaatccgaatctccagcgcagccgaccactactagcttgatgacgtcacccgcacagagtattctcgtaatgtccgccgctcctaccgccatccagaacatacacccaagccccactaatagatctaaaaggaacctggagatggagatcattctgacactctcacaagggttaaagaaatactatggaaagatcctgaagctgttgcatctgaccctagaagaggacacagaaggcctcctggagtggtgtaaacggaatcttggcagtaactgcgatgacgactttttccagaagcgcattgaagagtttttcatgactggggagggatactttaacgaagtgctgcagttcaaaaccttgagcacgctctcccctaccgagccatctcacgcaagacccccgacagtcgaaccttttaagtcgtatttcgctaaaggttttctgagcatcgattccggctacttctcagccaagtgttatccaaggagttctactagcgggttacagctgataaatgtgacccaacaccccgcgcggattgccgagacacctggacccaagactacctccctcaaaacgatcaactgcattaatcttcgcgcatcagtttttaaggaacatcgagagatcgagatcaacgtgctgttgccacagattgctgtcaatctaagcaactgtcacgtggtaataaattctcatgtttgcgattactccctggacacagatggccctgtgagactcccccacatctaccatgaaggtaccttcattccagggacttataaaatcgtcatagacaagaaaaacaagctgaatgataggtgtacacttgtgaccaactgcgtgattaaaggacgggaggtccgtaagggccagagtgttctgcgccaatacaagactgaaatcaaaatcggcaaggtgagcaccgggtctagaaaattgctctccgaggaatcaggagacgattgtattagtaggacacagctgttacggacggagaccgccgagatccacgacgacaattatggtggcccgggggataagattactatatgcaacggaagcacaatcgtagaccagcgactgggctcggaactaggttgttacaccattaatcgcgtgaaatcctttaagctctgcgagaactctgctacagggaagacttgcgaaatcgatagcacccctgtcaaatgtagacagggcttctgcctgaagatcacgcaagagggaaggggccacgtgaaactttcacgggggagtgaggttgtgttggacgcctgtgattcctcttgcgaagtcatgattcccaagggaacaggtgacatactggtggattgtagcggcgggcagcagcatttcctcaaagacaatctgatcgatcttggatgcccacacattcccctgttgggcaagatggcaatctatatttgtcgcatgtccaaccatcctagaaccactatggcctttctcttctggttttcattcggttacgtaattacctgcctgttttgtaaggctttattctatagcctgataatcattgggacactaggcaaaaagatcaaacagtacagggagctccgtccacaaacttgcaccatttgtgaaacagcgcccgttaacgcaatcgacgccgagatgcacgatctgaattgcagttacaacatatgcccttattgtgcttctcggcttacgtccgacggattggcccgacacgtgccgcagtgcccaaagagaaaagaaaaggtcgaggagaccgaactgtacctcaatctggagaggattccctggatcgtgcgcaagttactgcaggtcagcgaatcgactggcgtggcacttaaacggtcatcttggttgattgttctcctggtgctactgacagtaagtctctcccctgtccagagcgccccagtggggcatggaaagaccatcgagacttatcaaacaagagaaggttttacctctatatgtctgttcatgcttggcagcatcttgtttctggtttcctgcttagtgaaagggctcgtcgactcagtgagtgatagcttctttcccggactgtctgtatgtaagacgtgctccattggctcaatcaacggtttcgagattgagagtcacaaatgttactgcagccttctgtgttgcccttattgtaggcattgctccgctgaccgcgaaatccaccagttgcatctctctatatgcaagaaacgaaagactgggtcgaatgtgatgctggccgtttgtaagcggatgtgctttcgtgcaaccattgaggcgagcagaagggctctactgatccgctcaatcattaacacaaccttcgtcatctgtattctcactctgacaatatgcgtggtgtccaccagtgccgtcgaaatggagaatcttccgtctggcacatgggaaaaagaggaggatttgactaacttctgtcaccaggaatgccaggttaccgagacggaatgtctgtgcccctacgaggcattagtgctccggaagccactgtttcttgacagcatcgtgaaaggaatgaagaatctgctaaactccacatcactcgagacctctctgagcattgaagccccttggggcgctatcaatgtacaaagtactttcaaacccaccgtctccacagccaacattgcattgagctggtcttcagtggagcacagagggaataagatcctggttactggaaggtccgaaagtataatgaagttagaggaacgaaccggcgtgagctgggatctcggtgtcgaggacgcttcggagtctaaactgcttacggtgtccatcatggatctgagccagatgtattcaccagtttttgaatacttgagtggggaccgccaggtggaggaatggcctaaggccacatgtaccggagattgccccgagcggtgtggctgcacttcttccacatgcctccataaagaatggccacacagcagaaactggaggtgtaatccgacctggtgctggggtgtaggcactgggtgtacatgctgtggagtcgacgtgaaggatctgttcaccgaccatatgtttgtgaaatggaaggtcgagtacattaagacggaggcgatcgtttgcgtggaactaacttcacaagagcgtcagtgtagtctgattgaagccggcacccgcttcaaccttgggcctgtaacaatcaccctcagcgagccccggaacatacagcagaaactgccacccgaaattatcacattgcaccctaaggtggaggagggatttttcgatctgatgcatgtccaaaaagtgttatccgcttctactgtttgcaagctccagagctgtacccacggcatcccaggtgaccttcaggtgtatcacattgggaatcttctgaaaggagacagagtcaacggccatttgatacacaagatcgaaccccattttaatacgtcctggatgtcatgggatggttgcgacctcgattactattgtaacatgggcgactggccttcttgcacatacactggggtgacccagcacaatcacgcagccttcgttaacctgctaaatattgagacagattataccaagacttttcatttccacagtaaaagggtgaccgctcatggagacacaccgcaactggatcttaaggcccgaccaacgtacggcgcaggggaaatcactgtcctcgtagaggtggcggacatggagctgcacaccaaaaaggttgaaatttcgggattgaaatttgccagcttagcttgcacaggctgttatgcctgctcctctggtatctcatgtaaggtgcggatacatgtcgatgagcccgacgaactgaccgtgcacgtaaaaagctccgatcctgacgtggtcgcagctagtacttctctcatggcccgcaagctggagttcgggacagatagcaccttcaaggcattttcagccatgcccaaaacgtccctttgcttctacatcgttgaaagagagtactgtaagagttgcagcgaggaagacactcagaaatgtgtggacacaaagctggagcagccacagtctattttgatcgaacacaaaggaaccattatcggcaagcaaaacgatacctgcactgctaaggcgtcctgttggctagagtcagtgaaatcgtttttctatggtctgaagaatatgctcggcagcgtctttgggaacttctttataggaatcctgcttttcttagccccttttgtgctgctcgttttgttctttatgttcggctggaaaatcctgttctgctttaagtgttgcaggcgggcacgagggctcctgaaatacagacatcttaaggacgatgaagagacaggatatcgcaagatcattgagaggctgaataacaaaaagggcaaaaatcgtttgctagacggtgaacggctggctgatagaaagatcgccgaactcttctctaccaaaacacacatagggtga

SEQ ID NO: 10333 - RNA, 5067 nt, synthetic construct
  misc_feature 1..5067: note = derived and/or modified CDS sequence (opt3) from CCHFV(75-R-2012)__KR814863.1__GP
  source 1..5067: mol_type = other RNA
atgcccaccaacatcatgcacacactgctcgtgtgcttcattctttacctgcagttgttaggcctagggggagcccatagacaaagcaatgctactggtcacaacggcacgaataccacaactgcaccttccacctctcagtcaccaaagccgctggtcagtacagctccccctcatgcgctcgagagctccataatcaaacacaccactccagtttctgaaacagaggggtcgggagaaaccacgccccctccaaacactacccagggcccctcacctctggagacaactccagaaaggccggctaccacagccaccagcacgcccagtactgacaatacaaactccaccactcatgtgacagataataaccctacctctacgattagcacctccccatcaagtagcccctctacaccttccactccacagggtatccaccaccccgcacggaatcttctgtcagtaagcagtttgaagaccgccacaactccgacccctacatctcccggggagatttccagcgagacctcgtctctccattccgctatgtcacgcacttccacgctgtatacagcaacccaagtgagcactgaaaacgccaatcactccgctccacgacagtctgagagctcagcccagcagaccacaaccagtcctatgacttcccccgcgcaaagcatcctggtcatgtctgcagccccaacagctatacagaacacgcatccctcacctaccaatcgtagtaaaagaaacctcgaaatggagatcattttaactctgagccagggacttaagaaatactatggcaagatcttgaagctgctacacctcacactggaggaagacaccgagggccttctggaatggtgtaaaaggaatttggggtccaactgcgatgacgactttttccagaagcggattgaggaatttttcatgacaggagagggttactttaacgaggtgctccaattcaaaactctgtctacccagtcgccaacggaaccgagccacgccagaccccctaccgttgagccatttaagtcctatttcgcaaaaggctttttatcaatcgatagtgggtacttctctgctaagtgttatccccgcctgagcacatccggactccagcttataaatgtgactcaacatcctgccaggattgcggaaaccccaggccccaagacaacttcactgaaaaccatcaactgcattaatttgcgggccagcgtctttaaggagcaccgcgaaatcgagatcaacgtgctactgccgcagattgcagtaaatctctctaactgtcatgttgtgataaattcccacgtctgcgattacagtctggacacggatggtcctgtgcgacttccacatatctaccacgaggggacattcattcccggaacctataaaatcgtgatagacaagaaaaacaagctgaatgatagatgtactttggtcacaaactgcgttattaaaggcagggaagtgcggaagggccagagcgtactccgtcagtacaagaccgagatcaaaatcgggaaggcttctactggatcccgcaaactgttatcagaggaacctggtgacgattgtattagtagaacccaactgctaaggacagaaacggccgagatccacgacgacaattatggcgggcccggagataagattaccatatgcaacggcagcactatcgtggaccagcggctcggttcggagctggggtgttacacaattaatcgagtcaaatcctttaaactttgcgaaaactctgctaccggcaagacatgcgagatcgatagcgccccagtgaaatgtcgccagggattctgcttgaagatcactcaggaaggcagagggcatgttaaactgtcaaggggaagtgaggtggtcctcgacgcatgtgattcctcttgcgaggtgatgattcctaagggtaccggcgacatactggtagattgtagcgggggacaacagcacttccttaaagacaatctgatcgatttgggctgcccccatattccactcctgggtaagatggccatctatatttgtcggatgtccaaccacccgcgcacgacaatggcctttttattctggttttcattcgggtacgttataacctgcatcttttgtaaggcgctgttctatagcctaatcattatcggcactctcgggaaaaagattaaacagtacagagaactgaagcctcagacctgcacaatctgtgagactgcacccgtgaacgccatagacgctgaaatgcacgatcttaattgcagttacaacatttgcccatattgtgcctctaggttgacctccgacggcctggcacgtcatgtcccccaatgccctaaacggaaggagaaggtggaagagacagagctctacctgaatttagaacgaatcccatggattgtcagaaaactgcttcaggtgagcgagtcgacgggggttgccttgaagaggtcatcttggctcatcgtgctgctagtactgctcaccgtcagtctgtcccccgtgcagagcgctcctgttggacacggtaaaactatagaaacatatcagacccgcgagggctttacttctatctgtcttttcatgttggggagcattctgtttttagtgtcctgcctcgtcaagggactggtgaactcagtaagtgacagcttctttccgggcctttctgtgtgtaaaacatgctccatcggttcaattaatgggttcgaaatcgagagtcataagtgttactgcagcctgttttgttgcccatattgtcggcactgctccgccgatagagagatacatcaattgcacctctctatttgcaaaaagaggaagaccggctcgaacgttatgctggcagtctgtaaacgcatgtgcttccgagcgacgatcgaagctagccggcgtgccctactgatcagatcaattatcaatactaccttcgtgatttgtatactcacactgaccatctgcgtggtctccacaagtgcagttgagatggaaaaccttccctctggaacttgggagagggaagaggacttgaccaatttttgtcaccaggagtgccaggtgacagaaactgagtgtctgtgcccttacgaagccttagtgctccgcaagccactgttccttgatagcattgtaaaaggcatgaagaacctgctaaattccacctcactcgagacgtctctgagcatcgaggctccctggggagccattaacgtccaaagtacatttaaacctaccgtgtccactgcaaatatcgctttgagctggtcttcagttgaacatcggggaaacaagatactggtgaccggcagatccgagagtatcatgaagttagaagagaggacaggtgtcagctgggacctcggggtggaagatgcctcggagtctaaactgcttactgtttccattatggacctgagccagatgtattcaccggtgttcgagtacttgagtggagatcgacaggtagaagagtggcccaaggcgacctgtacgggcgactgcccagaacgctgtggttgcacatctagtacctgcctccacaaagagtggcctcatagccggaattggagatgtaaccccacttggtgctggggcgtcgggacaggatgtacctgctgtggcgtggatgtgaaggacctgtttactgatcacatgttcgtcaaatggaaggttgaatacatcaagacagaggccattgtgtgcgtagagctaacctcacaggaaaggcaatgtagtctgatcgaggctgggacgcgttttaaccttggaccagtgactataaccctcagcgaacctcgcaatattcagcagaaactgcccccagagatcatcacattgcatccgaaggtcgaagagggcttctttgacctgatgcacgtgcagaaagttttatccgcatctaccgtgtgcaagctccaaagctgtacacacggtattcctggggatctgcaggtctatcatataggaaaccttctgaaaggcgaccgggtgaatggtcacttgatccataagattgagccccacttcaacacttcctggatgtcatgggacggctgcgatctcgactactattgtaatatgggggattggccatcttgcacctacacgggagttacacagcacaaccatgccgcttttgtgaatctgctaaacatcgaaactgactataccaagacattccactttcatagtaaaagagtcaccgcccacggcgatactccccagctggaccttaaggcaaggcctacctacggggcgggagagattacagtactcgtggaagttgccgatatggagctgcatacgaaaaaggtggagatctcgggcttgaaattcgctagcttagcctgcactggttgttatgcatgctcctctgggatatcatgtaaggtccgaatccacgtggacgaaccagatgagctgaccgtacacgtgaaaagctccgaccccgatgtcgttgctgccagtacatctctcatggcacggaagctggagttcggaaccgacagcacttttaaggccttctcagctatgcctaaaacatccctttgcttttacattgtggaacgcgaatactgtaagagttgcagcgaggaggatacccaaaaatgtgtggacacgaagctggaacagccgcagtctatcttgattgagcataaaggcactatcataggtaagcaaaatgacacatgcaccgcgaaggcctcctgttggctagaatcagtcaagagcttcctgtatggcctcaagaacatgctggggtcggtgtttggaaatttctttattggcatccttttattcctggcaccatttgttctcttggtactgttctttatgttcgggtggaaaatcctcttctgctttaagtgttgcagaaggacccggggactgcttaaataccgactgttgaaggatgacgaggaaactggctatagacgcattatcgagaggctaaacaataagaaaggtaagaaccgtctgctcgatggggagcggttagctgacagaaaaatagccgaactgttctctacaaagacccacattggatga

SEQ ID NO: 10334 - RNA, 5067 nt, synthetic construct
  misc_feature 1..5067: note = derived and/or modified CDS sequence (opt3) from CCHFV(52-R-2014)__KR814862.1__GP
  source 1..5067: mol_type = other RNA
atgcccaccaacatcatgcacacactgctcgtgtgcttcattctttacctgcagttgttaggcctgggtggagcccatagacaaagcaatgctactgagcacaacggtacgaataccacaactgcaccttccacctctcagtcaccaaagccgcccgtcagtacagcccctccacatgcgcccgaaagctccaccataaaacctactacaccagcttctgagaccgaaggctcgggggagacgactccccctccaaacaccacacagggaccgtcaccccctgaagccactccagagaggcccgcaaccacagccaccagcacgcctagtactgacaatacaaactccaccactcacgctacagataataacccaacctctacgatcagcacctccccctcaagtagcccgtctacaccttccactccccagggcattcatcacccagcacggaatctactctcagttagcagtcctaagaccgccacaactcccaccccaacatctcccggtgacatctccagcgagacctcgtctctgcactccgctatgtcacgcactcctacgcttcatacagccacccaagcgagtactgaaaacgcaaatcacagcgccccacgacagtccgagtctagcgctcagcagaccacaacctcaccgatgactagccccgcccaacctattctggtgatgtccgcagctccaacagccatccagaacatacatcccagccctacgaatcgttctaaaagaaacttggaaatggagatcattctcaccctgtcacaggggctgaagaaatattacggaaagatcctcaagttactgcaccttactttggaggaagatacagagggcctgctagaatggtgtaaaaggaatctcggcagtaactgcgacgatgactttttccagaagcggattgaggaatttttcatgaccggggagggatattttaacgaggtactgcaattcaaaacacttagcactctgtccccaaccgaaccctctcacgcgcgcccgcctacggtggagccatttaagtcgtacttcgccaaagggtttttgagcatcgattccggctatttctcagcaaagtgttaccccagactcagtacctctgggctgcagttaataaatgtcacacagcatcctgctaggattgccgaaactcccggaccaaagaccacaagcctgaaaactatcaactgcattaatctccgggcttccgtgtttaaggagcaccgcgaaatcgagatcaacgttcttctgcctcaaattgccgtgaatttgtcaaactgtcatgtcgtgataaatagccacgtatgcgactattctctagataccgacggccccgttcgactgccacatatctaccacgagggtacgttcattccggggacatacaaaatcgtgatagataagaaaaacaagctcaatgacagatgtaccctggtcactaactgcgtgattaaaggaagggaagtgcggaagggccagtccgtccttcgtcagtataagacagagatcaaaatcggcaaggcaagtaccgggagccgcaaactgttgtctgaggaacctggagatgactgtatttccagaactcagctcctgaggaccgaaacagccgagatccacgacgataattacggtggccccggggacaagattacgatatgcaacggatcaaccatcgttgatcaacggttaggcagtgagctgggttgttatactattaatcgagtgaaaagttttaagctatgcgaaaactcggctacagggaagacctgcgagatcgactccacaccagtaaaatgtcgccagggcttctgcctcaagatcactcaggaaggaagaggccatgtgaaactgtctagggggagcgaggtcgtgcttgatgcgtgtgacacctcatgcgaggttatgattcccaagggaacgggtgatatattggtggactgtagtggcgggcagcaacacttcctgaaagataatctcatcgacctgggatgccctcatgtcccacttctgggcaagatggcaatttacatctgtcggatgtccaaccacccccgcacaaccatggcctttttgttctggttttctttcggttatgtgattacttgcatcttttgtaaggctctcttctacagcctgataatcattgggaccttaggcaaaaagatcaaacagtatagagaactgaagcctcagacatgcactatttgtgagaccgccccggtaaacgcaatcgatgccgaaatgcacgacctaaattgctcctacaacatatgcccatactgtgcttcaaggctcacaagcgacggactggcccgtcatgttccccagtgccctaaacggaaggagaaggtggaagagacggagctttatttgaatctggaacgaatcccatggattgtcagaaaactcctgcaagtgagtgagtctaccggcgtcgcattaaagaggtccagctggctgattgtgcttttggttctcctgactgtgtcgctatcacccgtacagtctgcgcctgtcgggcacggaaaaacaatcgaaacctaccagactcgcgagggttttacaagtgtgtgtctgttcatgctcggctccatactgtttcttgttagctgcttggtgaaggggctggtcgattctgtgagcgactccttctttccgggattatcagtatgtaaaacctgcagtatcggcagcattaacggtttcgaaatcgagtctcataagtgttattgctccctcttttgttgcccctactgtcggcactgctcagctgatagagagattcatcagctgcaccttagtatctgcaaaaagaggaagatggggagcaatgtgatgctggccgtttgtaaacgcatgtgcttccgagcaacgatagaagcctcccggcgtgctttgctcattagatctatcatcaacactaccttcgtcatttgtatcctgacactaaccatttgcgtggtgtcgactagcgccgtcgagatggaaaatctgccatcaggcacatgggagagggaagaggacctcaccaacttttgtcaccaagagtgccaggttacagaaactgagtgtctgtgcccttatgaagcacttgtgttgcgcaagcccctgttcttagattccatagtgaaaggaatgaagaatctcctgaacagtacctctcttgagacgagcctgtccatcgaggctccatggggcgccattaatgtacagtcaacatttaaacctaccgtctctactgcgaacatcgccctaagctggagttccgtggaacatcgggggaataagattctcgttaccggaagaagcgagtctatcatgaagctggaagagaggacaggcgtgtcatgggacttgggtgtcgatgacgcttccgaaagtaaactgttaactgtgagcataatggatctctcgcaaatgtactctcccgttttcgagtatctgtccggggaccgacaggtggaggaatggccaaaggcaacctgtacgggagattgcccggagcgctgtggctgcacaagctcaacctgccttcacaaagaatggcctcatagtcggaactggagatgtaatcccacttggtgctggggtgtaggcacagggtgtacctgctgtggagtcgacgtgaaggatctgtttactgaccacatgttcgtgaaatggaaggtcgagtacatcaagacagaagccattgtttgcgtggagttgacctctcaggagaggcagtgttccctcatcgaagctggcacgcgttttaacctggggccagtaactattaccctaagcgagccccgcaacatccaacagaaactgcctccagaaataattacacttcatcccaaggtggaggaaggattctttgacctcatgcacgtccagaaagtgctgtcagccagtaccgtttgcaagttgcagagctgtacacacggcatccctggtgatctgcaagtgtaccatatcgggaatttactcaaaggagaccgggtcaacggccacctgattcataagatagagccgcacttcaatacttcctggatgtcttgggatggttgcgaccttgattattactgtaacatgggcgactggccaagctgcacctatacgggggtgacacagcacaatcatgcagcgtttgttaacctgttgaatatcgagactgattacaccaagacattccactttcattccaaaagagtgaccgcccacggagacactccccagctcgatctgaaggctaggcctacctatggcgccggggaaattacagtcctagtagaggtggcagacatggaactgcatacgaaaaaggttgagatctcaggacttaaattcgcttctctcgcctgcactggctgttacgcatgcagttcgggtattagctgtaaggtgcgaatccacgtcgatgagcccgacgaactgaccgtgcacgtaaaatccaacgatccagacgtggtcgccgcttctacatcattgatggcgcggaagttagagttcgggaccgacagcacttttaaggccttctccgcaatgcctaaaacaagtctgtgcttttatatagttgaacgcgagtactgtaagtcttgcagcgaagaggatacccagaaatgtgtggacacgaagctcgagcaaccccagtcaatcctgattgaacataaaggaactatcattggcaagcagaatgatacatgcaccgctaaggccggttgttggcttgagtccgtgaaaagtttcttttacggcctgaagaacatgttggggagcgtcttcggaaactttttcatcggcatactactgtttctcgccccattcgtgctgcttgttttatttttcatgttcgggtggaaaattctgttttgcttcaagtgttgcagaaggacccggggactcttgaaatatcgactgctcaaggacgatgaagagactggctacagacgcatcatcgaaaggctgaataataagaaaggtaagaaccgtcttctggacggggagcggttggctgatagaaaaattgcagagctattttctacaaagacccacatcggatga

SEQ ID NO: 10335 - RNA, 5067 nt, synthetic construct
  misc_feature 1..5067: note = derived and/or modified CDS sequence (opt3) from CCHFV(47-ST-2013)__KR814861.1__GP
  source 1..5067: mol_type = other RNA
atgcccatcaacattatgcacaccctgctcgcctgcttcatactttacctgcagttgagcggcttagggggagctcatggtcaatccaatgcaacagagcacaacggcactaatacgaccacagtgcctgggacttctcagtcaccaaagccgcccgccagtaccacactgcctcataccccagaaagctccactgtcaaactaacaacccccacgtctgagactgaaggatcgggcgagaccacacctccacccaacactacccagggtctccctccaccggggacaacccccgaaagatcagcgacgactgctacaagcaccagttccactgacaatatgaactctacaacccagatgacgggaaatacccctacaccaactgttaacatgagcccctcctcaagtcctagcatgccatctacctcccaaggcatccactatcccgtgaggtcactgcttagcgtaccgagtcctaagacagccactacccccacaccagtgtctcctggcgagatgtcccccgagaccagctcgcagcattctgcaacttcccggattccaacgctgtacacagccacccaggtctcaactgaaaataccaaccgcagtacaccccgacagagcaaatcctctgtgcaacctgctacccagagcccaatcactccgcccgcacagacaattttgctcatgtcagccgctcctaaggccatccaggatatgcacccaagtcccacgaatcgttccaaaagaaacctggaggttgaaataatcctgaccctcagccaagggttaaagaagtattacggaaaaattctgaagttgttgcacctgactctagaggaggacacagaaggtctcctggagtggtgtaaaaggaatcttggctctaactgcgatgacgactttttccagaagcggatcgaagagtttttcattaccggggaaggatattttaatgaggtgctgcagttcaaaacattgtcaactctcagtcctaccgagccaagccatgtccgcctgcccacggcggaaccgtttaagtcctactatgcaaagggcttcttatctctggattcgggttactttagcgccaaatgttaccctagatcctcaaccagtgggctccaacttatcaacgtgacacagcacccagctaggatagccgagactcccggacctaagaccacatctctgaaaactattaactgcatcaatttgcgggcaagcgtattcaaggaacatcgcgaggttgaaattaacgtgctactgccccagatcgctgtcaatctctccaactgtcacgtggtgatcaattcacacgtctgcgattatccactggacaccgatggccctgttcgacttcccagaatacatcacgagggcacgtttattccagggacatacaaaatcgtgattgacaagaaaaacaagctgaatgataggtgtagcttggtaaccaactgcgtgatcaagggacgggaggtccgtaaaggtcagtctgtgctccgccaatataagactgaaataaaaattggcaaggcctccacagggagtagaaaactgttaagcgaggaaccgggagacgattgtatctctaggacccagctgctaaagactgagaccgcggaaatccatgacgacaattacggcggtcctggggataagattacaatctgcaacggctccacgattgttgaccagcggctcggatcagagctgggctgttataccataaatcgagtgaaaagtttcaaactttgcaaaaacagcgccactgggaagacatgcgagatcgattcgacccccgtcaaatgtcgccagggattttgcttgaagattacacaagaaggtagaggccacgtgaagctgtccagggggtctgaggtagttctcgacgcatgtgatagctcatgcgaaatcatgatcccaaaaggaactggcgacattctggtggattgtagtggtgggcagcagcatttccttaaggacaatctgatagatttgggctgcccccacatccctctcctgggaaaaatggctatttacatctgtcggatgtccaaccacccacgcaccacgatggccttcttattttggttctcttttggctatgtcattacatgcatcttctgtaaggctctgttttacagcctaataatcattgggaccctcggaaagaagatcaagcagtacagagagctgaaaccccaaacttgcaccatttgtgagacagcccctgtgaatgcaatcgacgccgaaatgcatgatcttaactgctcctataacatatgcccgtactgtgcttcaaggttgactagcgacggtctggcgcgtcacgtcacccagtgcccaaagcggaaagagaaggtggaagagacagaactctatctgaatttagagcgaatcccctggattgttagaaaactgcttcaggtgagtgagtctacgggcgtagcattgaagaggtccagctggctcattgtcctgctagtgctgctcaccgtttcgctgtcacctgtgcagtctgccccagtcgggcatggaaaaactatcgaaacataccaaacccgcgagggcttcactagcatatgtctttttatgttgggttccatcctgttcattgtgagctgcttagtaaaggggctcgtggactctgttagcgattcctttttccccggcctgtcagtctgtcggacatgcagtatcggaagcattaacggctttgaaatcgagtctcacaagtgttattgctcccttttctgttgcccttactgtagacactgctcagctgacagggaaatacatcagctgcacttgagtatttgcaaaaagcgcaaaaccgggagcaatgtgatgctcgccgtgtgtaagcgaatgtgctttaaagcaacgatcgaggcctcccggcgtgctctgttcatcagatctattatcaacactaccttcgtcacatgtattctaaccctggccatatgcgttgtgtcgactagcgcagtggagatggaagatctcccggcgggaacatgggagagggaagaggacctgaccaatttttgtcatcaggaatgccaagtaacagagactgagtgtctttgcccctatgaagctcttgtcctgcgcaagccattattcctcgattcaatcgtgaagggcatgaaaaacctgcttaattccaccagtctggagacgtctctaagcattgaagccccttggggtgcaatcaacgttcagtccacatttaagcccaccgtgtcaactgccaatattgctctctcttggagcagtgtcgagcaccgggggaacaaaatcctggtgaccggaagatccgagagcataatgaagttggaagagaggacaggcgtttcttgggacctgggtgtggaagatgcctcagagtccaaattactcactgtaagtatcatggacctgagccagatgtactcgccagtcttcgaatacctttctggcgatcgacaggtggaggagtggcctaaggcaacctgtacgggggaatgccccgagcgctgtggatgcacatccagtacctgcctgcataaggaatggccacactcacggaattggagatgtaacccgacttggtgctggggcgtggggacaggatgtacctgctgtggcgtcgacgttaaagatttgtttactgaccacatgttcattaagtggaaagtggagtatatcaagacagaagctattgtatgcgtggagctcaccagtcaagagaggcagtgttctctgatcgaagccggtacgcgttttaatctagggcctgtcactataaccctgtccgagccccgcaacattcagcagaaacttccacccgaaatcatcacactccatcctaagattgaggaaggattctttgatctgatgcacgtgcaaaaggttttgagcgcgtcaaccgtgtgcaaactgcagagttgtacacatggcataccaggtgacttacagatctaccacattggcaatctcctgaagggggaccgggtcaacggacatcttatccacaaaattgagccccacttcaacactagctggatgtcctgggatggctgcgacctggattattactgtaatatgggggactggccttcttgcacctatacgggagtgacacagcataaccacgccgcttttgttaatttgctcaacatcgagactgattacaccaagacattccattttcacagcaaaagagtgaccgcacacggcgacactccgcaactggatctaaaggccaggccaacctatggtgctggggaaataacagtcctggtagaggtggccgacatggaacttcatacgaaaaaggttgaggtgtccggactcaagttcgcatcactggcgtgcactggctgttacgcctgctctagtggtatctcgtgtaaagtccggattcacgtggatgagcccgacgaattgaccgtacatgtcaagagctccgatcctgacgtggttgctgcctctacatcattaatggcacgaaaactggagttcggcaccgatagcacttttaaggctttctccgccatgcccaaaacaagtctctgcttttacatcgtggaacgcgagtattgtaagtcttgcagcgaagacgacaccaagaaatgtgtggatacgaagctggagcagccacagtcaattcttatcgagcacaaagggactataattggaaagcaaaatgacacatgcaccgcaaaagcctcctgttggctggaaagtgtcaagagcttcttttacggcttgaagaacatgctagggtctgtgttcggaaactttttcgttggcatcctgctctttctggctcctttcgtacttttagtgctgtttttcatgttcggttggaaaatcctcttttgcttcaagtgttgcagaaggacccgggggttgtttaaatatcgacatctgaaggatgacgaggaaactggatacagacgcattatcgagaggctcaattccaaaaagggcaagaatcgtctgcttgatggcgaacggctggcggacagaaaaatagccgagttgttctcaacaaagacccacattgggtga

SEQ ID NO: 10336 - RNA, 5067 nt, synthetic construct
  misc_feature 1..5067: note = derived and/or modified CDS sequence (opt3) from CCHFV(46-ST-2012)__KR814860.1__GP
  source 1..5067: mol_type = other RNA
atgcccaccaacatcatgcacacactgctcgtgtgcttcattctttacctgcagttgttaggcctgggaggagcccatggtcaaagcaatgctactgagcacaacggcacgaataccacaactgtcccttccacctctcagtcaccaaagccgctagttagtacaactccccctcatgcactcgaaagctccactataaaaccaacaacccccacgtctgagactgaagggtcgggagagaccgcccctctgccaaacacaactcaggggccccctccaccggaaaccacacccgagagacctgcgaccacggtgacttcaacaccaagcaccgacaatacttcctccacaatccacgtaaccgataacaatcccacgtctaccattagcacatccccttcaagtagcccatctactccctccaccccgcagggtatccatcaccctgctaggtcacttctgagcgtgagttctcccaagacagccactaccccaacacctacctcccccggggagattaacagcgaaacttcgtctttgcactccgcaatgtcacggacgccaacactccataccgccactcaagtcagtaccgagaatgctaaccacagcgcaccccgccagtccgaatctagcgcccagcctacaaccacttcactgatgacaagtccagctcagtccatcctgctcatgagcgccgcgccgacggcaatacaaaatatccatccctctcctaccaaccgatcaaaacgtaatttagagatggagattatcctgactcttagtcagggattgaagaaatattacggcaagattctgaagctactccacctgacacttgaagaggacaccgaaggcctgttggagtggtgtaaaagaaacctcgggagcaattgcgatgacgactttttccagaagaggatcgaagagtttttcatgacaggagagggttattttaacgaagtgctgcagttcaaaactttatccaccctgtctccaacggagccctcgcacgcccggctccctaccgttgaaccatttaagagctacttcgctaaaggctttctttccgtggattcagggtatttcagtgccaagtgttacccccgctctagcacatccggactgcaattgataaacgtcactcagcatccggcaagaattgctgagacccctggcccaaagacaacttcactaaaaaccatcaattgcattaacctgagggccagcgtgtttaaggaacaccgggagatcgagatcaatgtactcctgccccagattgcggttaacctttctaattgtcatgtggtcataaactcccacgtgtgcgattatagtctggacacggatggtcctgtgcgcttgccccatatctaccacgaagggacattcattccaggaacctacaaaatcgtcatagacaagaaaaataagctcaacgatcgatgtactctggttacaaattgcgtgattaaaggcagagaggtaaggaagggccaaagcgtgttacggcagtataagaccgaaatcaaaatcgggaaggcctctactggatcccgtaaactgctatcagaggaacctggtgacgattgtattagtcgcacccagctcctgagaacagagacggcagagatccacgacgacaactacggcgggcccggagataagattaccatatgcaatggcagcactatcgtcgaccagaggcttggttcggaattggggtgttatacaattaaccgggtgaaatcctttaagctgtgcgaaaattctgctaccggcaagacatgcgagatcgatagcactccagttaaatgtcgacaaggattctgcctcaagatcacccaggagggccgcgggcatgtgaaactgtcaagaggaagtgaggtcgtgcttgacgcctgtgattcctcttgcgaagtaatgattccgaagggtacgggcgacatactggttgattgtagcgggggacagcagcacttcttgaaagacaacctcatcgatctgggctgccctcatattcccttactgggtaagatggctatctacatttgtaggatgtccaatcacccacggacaaccatggcctttctattctggttttcattcgggtatgtgatcacttgcatattttgtaaggcactcttctacagcctgatcattatcggcacccttgggaaaaagattaaacaatatcgcgagttgaagccccagacatgcactatctgtgaaaccgcccctgtcaacgctatagacgcggagatgcacgatctgaactgcagttacaatatttgcccatactgtgcatctagactcacatccgacggcctggccaggcatgtgccccagtgccctaaacgtaaggaaaaggtcgaggagacggaattatatctgaaccttgagcggatcccgtggattgtgcgaaaattgctccaggttagcgaatcgaccggggtggctctgaagagatcatcttggctaatcgtactgctcgtcctgcttactgtgagtttgtccccagttcaaagcgcccccgtgggacacggtaaaacaatagagacctaccagactagggaaggctttacatctatctgtctgttcatgttagggagcattctctttctggtctcctgccttgtgaagggactggtagactcagtgagtgatagcttctttcctggcttgtctgtttgtaaaacctgctccatcggttcaattaatgggttcgagatcgagagtcataagtgttattgcagcctcttttgttgcccatactgtcgccactgctccgcagaccgggaaatacatcagctgcacctatctatttgcaaaaagagaaagacgggctcgaacgtcatgctggccgtgtgtaaaaggatgtgcttccgcgctactatcgaggccagccgacgggcactcctgatccgttcaattatcaatgcgaccttcgtgatttgtatacttacattgaccatctgcgtcgtttccaccagtgctgtggaaatggagtctctgcccgccggaacatgggaaagagaggaggatttaaccaacttttgtcaccaggaatgccaagtgacagagactgaatgtctctgcccttatgaggcactggtacttaggaagccgctgttcctagacagcattgtcaaaggcatgaagaatctcctgaactccacctcattggagacgtctctgagcatcgaagccccctggggcgctattaatgtgcagagtacatttaaaccaaccgtttccactgccaacatcgcattaagctggtcttcagtggagcatcgcggaaataagatactcgtcaccggccggtccgaaagtatcatgaagctggaggaaagaacaggtgtgagctgggatcttggggttgaggacgcttcggagtctaaactgttgactgtgtccattatggatctcagccagatgtactcacctgtattcgaatatctgagtggagacaggcaagtcgaggaatggcccaaggccacctgtacgggcgattgcccagagcgatgtggttgcacatctagtacctgcctacacaaagaatggcctcatagccgcaactggcggtgtaatcccacttggtgctggggcgtggggacaggatgtacctgctgtggcgtggacgtcaaggatctgtttactgaccacatgttcgttaaatggaaggtggagtacatcaagacagaggcgattgtatgcgtggaacttacctcacaggagagacagtgtagtctcatcgaagccgggacgaggtttaacctgggaccagtcactataaccttgagcgagccgcgtaatattcagcaaaaactgcctcccgaaatcatcacattacatccaaaggtggaggagggcttctttgatctcatgcacgttcagaaagtgctgtccgcttctaccgtctgcaagctgcagagctgtacacacggtattcccggggaccttcaggtgtaccatataggaaacttgctcaaaggcgaccgcatcaacggtcacctgattcataagatcgaacctcacttcaatacttcctggatgtcatgggatggctgcgacctagattattactgtaacatgggggactggccatcttgcacctatacgggagttacacaacacaatcatgcagcctttgtgaacctgcttaatattgagactgattacaccaagacattccactttcatagtaaacgggtcaccgctcacggcgacactccccagctcgatctgaaggccagacctacctatggggcaggagaaatcacagtattggtggaggttgcggacatggagttacatacgaaaaaggtggaaatatcgggcctgaaattcgccagcctcgcttgcactggttgttacgcctgctcctctgggatctcatgtaaggtcaggattcacgtggatgagccggacgaactgaccgtacacgtgaaaagctccgatccagacgtcgttgcagctagtacatctcttatggcccgaaagctggagttcggaaccgatagcacttttaaggcattctcagccatgcccaaaacatccttgtgcttttatatcgtggaacgggagtactgtaagagttgcagcgaggaagacacccagaaatgtgtggacacgcgcctagagcagcctcaatctattctgatcgaacataagggcactataattggtaaacagaacgatacatgcaccgctaaggcgtcctgttggctcgagtcagtcaagagcttcttttacggcctgaaaaatatgcttgggtcggtgttcggaaactttttcatcggcatcttactgtttctcgcccccttcgttttgctggtactctttttcatgttcgggtggaagattctgttttgcttcaaatgttgcagaaggacccggggacttctgaagtatcgacacttgaaagacgatgaagagactggctacagacgcatcatagagaggctaaataacaagaagggtaaaaatcgtctgctcgacggggaacggttagcagatagaaagattgctgagctgttttctacaaaaacccatatcggatga

SEQ ID NO: 10337 - RNA, 5067 nt, synthetic construct
  misc_feature 1..5067: note = derived and/or modified CDS sequence (opt3) from CCHFV(44-ST-2010)__KR814859.1__GP
  source 1..5067: mol_type = other RNA
atgcccatcaacattatgcacaccctgctcgtgtgcttcatactttacctgcagttgagcggcttagggggagcccatggtcaatccaatgctacagagcacaacggcactaatacgaccacagtccctgggacttctcagtcaccaaagccgcccgcaagtaccacactgcctcataccccagaaagctccactgttaaactaacaacccccacgtctgagactgaaggatcgggcgagaccacacctccacccaacactacccagggtctccctccaccggggacaacccccgaaagacctgccacgactgcgacatcaatgagcagtaccgacaatatgaactccactacacaggtgaccgataatacgccaacctctacagtaagcatctccccctcaagtagcccttctatgccatccacttcacaagggattcactatcccgtgaggagcctgcttagtgtctcttccccgaagaccgtgacaactcctacccccatgagcccaggcgagatgtcgcctgagacatcttcccagcattcagctatgagtcggatccccaccctgtacactgccacgcaggttagcacagaaaacaccaatcgctccactccacgacagtctgagagctcagcacaacccgccacccagagtcctacaacctccccaactcagacaattttgctcatgagcgctgcaccgaaagccatccaggacatgcacccctctcctacgaaccgttcaaagagaaatctggaagtggagataatcctgaccctcagtcaaggccttaaaaagtattacgggaagattctgaaacttttgcacctgactctagaggaagatacagagggactcctggaatggtgtaagaggaaccttggtagcaattgcgacgatgactttttccagaaacggatcgaggaatttttcattaccggcgaggggtattttaacgaggtcctgcagttcaagacattgtccactctctctccaaccgaaccctcgcatgtgcgcctgcctacggctgagccatttaaaagctacttcgccaagggatttttatccatcgattcaggctatttcagtgcgaagtgttaccccagatctagcacctccggtctgcaactcataaatgtaacacagcacccggcaaggattgccgaaactcctgggccaaaaaccacatcacttaagactatcaactgcattaacctgcgggctagcgtttttaaagagcatcgcgaagtggagatcaatgtcttgctaccccagatcgccgtgaacctgtctaattgtcacgtggtcattaactcccacgtttgcgactacagtctcgataccgacggacctgtgcgactgcccagaatacatcacgagggcacgttcatcccaggcacatataagattgtaatcgataaaaagaataaacttaacgacaggtgtagcctggtgaccaattgcgtcataaaggggcgggaagtgcgtaagggacagtctgttttgcgccaatacaaaactgagattaagatcggtaaagcatccacaggctcaagaaagctcctgagtgaggaacctggggatgactgtatcagcaggacccagttactgaaaactgaaaccgctgagattcatgacgataactatggaggccccggtgacaagatcacaatttgcaatgggtcgacgatagtggatcagcggctaggctccgagctcggatgttacaccatcaaccgagtcaagtcttttaaactgtgcgaaaatagcgccactggcaagacatgcgagattgactcaaccccagtgaaatgtcgccaggggttctgccttaagatcacacaagaaggaagaggtcacgtaaaattgagtaggggctccgaggttgtgctggatgcgtgtgactctagctgcgagatcatgattccgaaggggactggagatatactcgtcgactgttccggcggtcagcagcatttcctgaaggataaccttatcgacctggggtgccctcacattcccttgctcggcaaaatggccatctatatttgtcggatgtcaaatcacccacgcaccacgatggcatttctgttatggttcagctttggatacgtgatcacatgcatattctgtaaggctctgttttatagtctaatcattatcggcaccctcgggaaaaagattaaacagtacagagaactgaagccccaaacttgcaccatctgtgagacagcccctgtcaacgctatagatgccgaaatgcatgaccttaattgctcttacaacatttgcccatattgtgcatccaggttgactagcgacggactggcccgtcacgtgacccagtgccccaagcggaaagagaaggttgaagagacagagctctacctgaacttagaacgaatcccttggattgtgagaaaactgcttcaggtatcggagtcaacgggtgtcgctttgaagaggtctagttggctcatcgtgctgctagttctgctcaccgtgtccctgagcccggtccagtctgcgccagtgggccatgggaaaactatagaaacatatcaaacccgcgagggattcactaatatctgtctttttatgttgggcagcattctgttcatcgtatcctgcttagtgaagggtctcgttgattcagtcagtgacagctttttccccgggctgtctgtgtgtaaaacatgctcctttggctcaattaacggattcgaaatcgagagtcacaagtgttactgcagccttttctgttgcccttattgtcggcactgctccgcagatagagagatacatcagctgcacttgggcatttgcaagaaaaggaagaccgggtctaatgtgatgctcgccgtctgtaaacgcatgtgcttcaaggctacgatcgaagcctcgcgacgggcactgctaatccgtagcattatcaacactaccttcgttatttgtatactgacactcgccatctgcgtggtgtcaacctccgctgtagagatggaaaatctgccagccggaacttgggagagagaagaggaccttacaaacttttgtcatcaggagtgccaagtcagtgaaaccgagtgtttgtgcccctacgaagcactggtgttaaggaaacctctcttcctggattctattgttaagggcatgaagaatcttctgaacagcacatccctagagacttcactctctatcgaggcgccgtggggtgctattaatgtgcagagcacctttaaacccacggtcagtacagccaacatcgcactgtcctggagctctgtggaacaccgcgggaataagatattggttaccggacggtcagagtccatcatgaaactggaagagagaactggcgtgagttgggacttaggtgtagaagatgccagcgagtcgaagctcctgaccgtctctattatggacctttcccagatgtatagcccagtgttcgagtacctgtcaggcgatcgacaggtggaagagtggcctaaagctacatgtactggggactgccccgaaaggtgtggatgcaccagttctacgtgcttgcataaggagtggccacactcccgcaactggcggtgtaatcctacatggtgctggggcgtcgggaccggatgtacttgctgtggcgttgatgtgaaggacctctttacagatcacatgttcatcaaatggaaggtagaatacattaaaaccgaggccatcgtgtgcgtcgagctgactagccaagaaagacagtgttcactaatagaggcaggtacaaggtttaacctggggcccgtgaccattacgcttagtgaaccacgtaatatccagcagaagctcccgcctgagatcattactctgcatcccaaaatagaagagggattctttgacttgatgcacgttcaaaaggtgctgagcgcttccaccgtctgcaagttacagtcttgtacacatggcatcccaggtgacctccagatttatcacatcggcaacctgcttaaaggggatcgcctgaacggacatttgattcacaagatcgagccccacttcaataccagctggatgtcctgggacggctgcgatctcgactactattgtaacatgggggattggccttcatgcacatacactggagtgacccagcataatcacgccgcgtttgttaacctgctaaatatagaaacggactatacaaaaactttccattttcactctaagcgggtgaccgcccacggcgatacaccacaactggaccttaaagctagacccacctacggtgcaggggagatcactgtcctcgtagaagtggccgatatggagctgcataccaagaaagttgagattagtggattgaagttcgcttcgttagcctgcacaggctgttatgcatgcagctccggtatctcttgtaaggtgaggattcacgtcgacgaacctgatgagctgacggtgcatgtaaaatcaagcgacccggatgtggtcgcggcctccaccagtctcatggctcgaaagctggaatttggcactgactctacatttaaagccttcagcgcaatgccaaagacctcactttgcttttacatcgttgagcgggaatactgtaaatcctgcagtgaggacgatactaagaagtgtgtggacacaaaactggatcagccccagagcatattgattgagcacaaggggaccatcatcggaaaacaaaacgacacgtgcactgctaaggcctcttgttggctagaatccgtgaaatcattcttttatggcctgaagaatatgctcgggagcgtcttcggaaactttttcgtgggcattctgttatttttagcacctttcgttctgctcgtattgtttttcatgtgcggttggaagatcctgttctgttttaaatgctgccgcagaacaaggggactcttcaagtaccggcatctgaaagatgacgaggaaaccggatatcgaagaataattgagcgccttaattcgaagaaaggcaagaacaggctgttggatggcgaacgtctagccgaccggaagatcgctgagctgttttctaccaaaagtcacattgggtga

SEQ ID NO: 10338 - RNA, 5067 nt, synthetic construct
  misc_feature 1..5067: note = derived and/or modified CDS sequence (opt3) from CCHFV(37-R-2013)__KR814858.1__GP
  source 1..5067: mol_type = other RNA
atgcccaccaacatcatgcacacactgctcgtgtgcttcattctttacctgcagttgttaggcctagggggagcccatagacaaagcaatgctactgagcacaacggtacgaataccacaactgcaccttccacctctcagtcaccaaagccgcccgtcagtacagcccctccacatgcgcccgaaaccagcactataaaacctacaaccccagcttccgagacggaaggctctggggagactacaccccctccaaacaccactcagggaccgtcgccccctgaagccaccccagagaggcccgcaacaaccgttacgtcaactcctagcacagacaataccaacagtactacacacgccaccgataataacccaacgtccaccatctctacaagcccctcctcaagtccgagcactccttctacaccccagggcattcatcacccagctcggaatctgctctccgtgtcaagccctaagaccgcaactacccccacaccaaccagtcccggtgacatctcttccgagactagctcgctgcactctgccatgtcccgcacgcctacacttcataccgctactcaagcctcaaccgaaaacgcgaatcacagtgcaccacgacagagcgagtcctctgcccagcagacaaccactagcccgatgacatcacccgctcaacctattctggtaatgagtgccgcaccaacggctatccagaacatacatccctcccctaccaatcgtagcaaaagaaacttggaaatggagatcattctcactctgtctcaggggctgaagaaatattacggaaagatcctcaagttactgcaccttacattggaggaagataccgagggcctgctagaatggtgtaaaaggaatctcggctcaaactgcgacgatgactttttccagaagcggattgaggaatttttcatgacaggggagggatattttaacgaggtgctgcaattcaaaactcttagtaccctgagcccaacggaaccctcccacgcccgcccgcctaccgtcgagccatttaagtcttacttcgcgaaaggatttttgtcgatcgatagcggctatttctccgccaagtgttaccccagactcacaacttcagggctgcagttaataaatgtgacccagcatcctgcaaggattgctgaaacacccggaccaaagactaccagtctgaaaacgatcaactgcattaatctccgggcctctgtttttaaggagcaccgcgaaatcgagatcaacgtgcttctgcctcaaattgctgtcaatttgagcaactgtcatgtggtaataaattcccacgtttgcgactattcactagatacagacggccccgtgcgactgccacatatctaccacgagggtaccttcattccggggacttacaaaatcgtcatagataagaaaaacaagctcaatgacagatgtacactggtgaccaactgcgtgattaaaggaagggaagtccggaagggccagagcgttcttcgtcagtataagactgagatcaaaatcggcaaggcctctaccgggtcccgcaaactgttgagtgaggaacctggagatgactgtattagcagaacacagctcctgaggacggaaaccgcagagatccacgacgataattacggtggccccggggacaagattactatatgcaacggatctacaatcgtggatcaacggttaggctccgagctgggttgttataccattaatcgagtaaaatcatttaagctatgcgaaaacagtgccacagggaagacttgcgagatcgacagcaccccagtgaaatgtcgccagggcttctgcctcaagatcacgcaggaaggaagaggccatgtcaaactgtcgagggggtccgaggtggttcttgatgcttgtgacacatcttgcgaggtgatgattcccaagggaaccggtgatatattggtcgactgtagcggcgggcagcaacacttcctgaaagataatctcatcgacctgggatgccctcatattccacttctgggcaagatggcgatctacatttgtcggatgtcaaaccacccccgcactaccatggcatttttgttctggtttagtttcggttatgtgatcacatgcatattttgtaaggccctcttctactccctgatcattatcgggactttaggcaaaaagattaaacagtatagagaactgaagcctcagacctgcacaatctgtgagacggctccggtaaacgccatagatgcagaaatgcacgacctaaattgctcttacaacatttgcccatactgtgccagcaggctcacctccgacggactggctcgtcatgttccccagtgccctaaacggaaggagaaggtggaagagactgagctttatttgaatctggaacgaatcccatggattgtcagaaaactcctgcaagtgtcagagagcacaggcgtcgccttaaagaggagttcttggctgatcgtgcttttggttctcctgaccgtgtccctaagccccgtacagtcggcacctgtcgggcacggaaaaactatagaaacataccagacccgcgagggttttacgtcagtgtgtctgttcatgctcggctctatcctgtttcttgttagttgcttggtgaaggggctggtcgattccgtgagcgactctttctttccgggattaagcgtatgtaaaacttgctccattggctcaatcaacggtttcgaaattgagagtcataagtgttattgcagcctcttttgttgcccctactgtcggcactgctctgcggatagagagatccatcagctgcacctttccatatgcaaaaagaggaagatggggtcaaatgtgatgctggctgtttgtaaacgcatgtgcttccgagccaccattgaagcaagtcggcgtgccttgctcatcagaagcatcattaacacaaccttcgtcatctgtattctgactctaacaatatgcgtggtgtccacctctgctgtcgagatggaaaatctgccatcgggcacatgggagagggaagaggacctcactaacttttgtcaccaagagtgccaggttaccgaaacggagtgtctgtgcccttatgaagcccttgtgttgcgcaagcccctgttcttagatagcatcgtgaaaggaatgaagaatctcctgaactcaacatcccttgagaccagtctgtctattgaggcaccatggggcgctatcaatgtacagagcacttttaaacctaccgtctccacagccaacattgcgctatcatggtctagcgtggaacatcgggggaataagatcctcgttactggaagaagtgagtccataatgaagctggaagagaggaccggcgtgagctgggacttgggtgtcgatgacgcctctgaatcaaaactgttaacggtgtccatcatggatctcagtcaaatgtacagccccgttttcgagtatctgtcgggggaccgacaggtggaggaatggccaaaggctacatgtaccggagattgcccggagcgctgtggctgcacttcttccacatgccttcacaaagaatggcctcatagccggaactggagatgtaatcccacctggtgctggggtgtaggcactgggtgtacatgctgtggagtcgacgtgaaggatctgtttaccgaccacatgttcgtgaaatggaaggtcgagtacattaagacggaagcaatcgtttgcgtggagttgacttcacaggagaggcagtgtagtctcattgaagccggcacccgttttaacctggggccagtaacaatcaccctatctgagccccgcaacatacaacagaaactgcctccagaaattatcacacttcatcccaaggtggaggaaggattctttgacctcatgcacgtccagaaagtgctgtccgctagcactgtttgcaagttgcagtcatgtacccacggcatccctggtgatctgcaagtgtaccatattgggaatttactcaaaggagaccgggtcaacggccacctgatacataagatcgagccgcacttcaatacgagttggatgagctgggatggttgcgaccttgattattactgtaacatgggcgactggccatcctgcacatatactggggtgacccagcacaatcatgccgcatttgttaacctgttgaatattgagacagattacaccaagactttccactttcattctaaaagagtgaccgcgcacggagacacaccccagctcgatctgaaggccaggcctacgtatggcgctggggaaatcactgtcctagtagaggtggccgacatggaactgcataccaaaaaggttgagattagcggacttaaattcgcatccctcgcttgcacaggctgttacgcctgctcatctggtatcagttgtaaggtgcgaatacacgtcgatgagcccgacgaactgaccgtgcacgtaaaatcgaacgatccagacgtggtcgcagccagcacttccttgatggctcggaagttagagttcgggacagactctacctttaaggcgttctcagccatgcctaaaacgagcctgtgcttttatatcgttgaacgcgagtactgtaagtcctgcagtgaagaggatactcagaaatgtgtggacacaaagctcgagcaaccccagtctattctgatcgaacataaaggaaccattatcggcaagcagaatgtgacctgcactgcaaaggctagctgttggcttgagtcagtcaaatccttcttttacggtctgaagaacatgttgggcagtgtgttcgggaactttttcataggtattctactgtttctcgccccattcgttctgcttgtattatttttcatgttcggctggaaaatcctgttttgcttcaagtgttgcagaaggacacgggggctcttgaaatatcgactgctcaaggatgacgaagagaccggatacagacgcatcattgaaaggctgaataataagaaaggcaagaaccgtcttctggatggtgagcggttggccgacagaaaaatcgctgagctatttagcacaaagactcacatagggtga

SEQ ID NO: 10339 - RNA, 5067 nt, synthetic construct
  misc_feature 1..5067: note = derived and/or modified CDS sequence (opt3) from CCHFV(36-ST-2014)__KR814857.1__GP
  source 1..5067: mol_type = other RNA
atgcccatcaacattatgcacaccctgctcgtgtgcttcatactttacctgcagttgagcggcttagggggagcccatggtcaatccaatgctacagagcacaacggcactaatacgaccacagtccctgggacttctcagtcaccaaagccgcccgcaagtaccacactgcctcataccccagaaagctccactgttaaactaacaacccccacgtctgagactgaaggatcgggcgagaccacacctccacccaacactacccagggtctccctccaccggggacaacccccgaaagacctgccacgactgcgacatcaatgagcagtaccgacaatatgaactccactacacaggtgaccgataatacgccaacctctacagtaagcatctccccctcaagtagcccttctatgccatccacttcacaaggcattcactatcccgtgaggagcctgcttagtgtctcttccccgaagaccgtgacaactcctacccccatgagcccaggagagatgtcgcctgagacatcttcccagcattcagctatgagtcggatccccaccctgtacactgccacgcaggttagcacagaaaacaccaatcgctccactccacgacagtctgagagctcagcacaacccgccacccagagtcctacaacctccccaactcagacaattttgctcatgagcgctgcaccgaaagccatccaggacatgcacccctctcctacgaaccgttcaaagagaaatctggaagtggagataatcctgaccctcagtcaaggcttaaagaagtattacgggaagattctgaaacttttgcacctgactctagaggaagatacagagggactcctggaatggtgtaagaggaaccttggtagcaattgcgacgatgactttttccagaaacggatcgaggaatttttcattaccggcgaggggtattttaacgaggtcctgcagttcaagacattgtccactctctctccaaccgaaccctcgcatgtgcgcctgcctacggctgagccatttaaaagctacttcgccaagggatttttatccatcgattcaggctatttcagtgcgaagtgttaccccagatctagcacctccggtctgcaactcataaatgtaacacagcacccggcaaggattgccgaaactcctgggccaaaaaccacatcacttaagactatcaactgcattaacctgcgggctagcgtttttaaagagcatcgcgaagtggagatcaatgtcttgctaccccagatcgccgtgaacctgtctaattgtcacgtggtcattaactcccacgtttgcgactacagtctcgataccgacggacctgtgcgactgcccagaatacatcacgagggcacgttcatcccaggcacatataagattgtaatcgataaaaagaataaacttaacgacaggtgtagcctggtgaccaattgcgtcataaaggggcgggaagtgcgtaagggacagtctgttttgcgccaatacaaaactgagattaagatcggtaaagcatccacaggctcaagaaagctcctgagtgaagaacctggggatgactgtatcagcaggacccagttactgaaaactgaaaccgctgagattcatgacgataactatggaggccccggtgacaagatcacaatttgcaatgggtcgacgatagtggatcagcggctaggctccgagctcggatgttacaccatcaaccgagtcaagtcttttaaactgtgcgaaaatagcgccactggcaagacatgcgagattgactcaaccccagtgaaatgtcgccaggggttctgccttaagatcacacaagaaggaagaggtcacgtaaaattgagtaggggctccgaggttgtgctggatgcgtgtgactctagctgcgagatcatgattccgaaggggactggagatatactcgtcgactgttccggcggtcagcagcatttcctgaaggataaccttatcgacctggggtgccctcacattcccttgctcggcaaaatggccatctatatttgtcggatgtcaaatcacccacgcaccacgatggcatttctgttctggtttagcttcggatacgtgatcacatgcatattttgtaaggctttattctatagtctgatcattatcggcaccctagggaaaaagattaaacagtacagagaactcaagccccaaacttgcaccatctgtgagacagcccctgtcaacgctatagatgccgaaatgcatgacctgaattgctcttacaacatttgcccatattgtgcatccaggcttactagcgacggattggcccgtcacgtgacccagtgccccaagcggaaagagaaggttgaagagacagagctgtacctcaacctggaacgaatcccttggattgtgagaaaattactgcaggtatcggagtcaacgggtgtcgctcttaagaggtctagttggttgatcgtgctcctggttctactgaccgtgtccctcagcccggtccagtctgcgccagtgggccatgggaaaactatagaaacatatcaaacccgcgagggatttactaatatctgtctgttcatgcttggcagcattttgtttatcgtatcctgcctggtgaagggtttagttgattcagtcagtgacagcttctttcccgggctctctgtgtgtaaaacatgctccattggctcaatcaacggattcgaaatagagagtcacaagtgttactgcagcctgttttgttgcccttattgtcggcactgctccgcagatagagagattcatcagcttcacctgggcatctgcaagaaaaggaagaccgggtctaatgtgatgttggccgtctgtaaacgcatgtgcttcaaggctacgatcgaagcctcgcgacgggcactcctgattcgtagcatcattaacactaccttcgttatatgtatcctaacactggccatttgcgtggtgtcaacctccgctgtagagatggaaaatctcccagccggaacttgggagagagaagaggacctgacaaacttttgtcatcaggagtgccaagtcagtgaaaccgagtgtctttgcccctacgaagcattggtgctgaggaaacctttattcctcgattctatcgttaagggcatgaagaatctgcttaacagcacatccctggagacttcactatctattgaggcgccgtggggtgctatcaatgtgcagagcacctttaaacccacggtcagtacagccaacatagcactctcctggagctctgtggaacaccgcgggaataagatcctggttaccggacggtcagagtccattatgaaattggaagagagaactggcgtgagttgggacctgggtgtagaagatgccagcgagtcgaagttactcaccgtctctatcatggacctgtcccagatgtatagcccagtgttcgagtacctttcaggcgatcgacaggtggaagagtggcctaaagctacatgtactggggactgccccgaaaggtgtggatgcaccagttctacgtgcctgcataaggagtggccacactcccgcaactggcggtgtaatcctacatggtgctggggcgtcgggaccggatgtacttgctgtggcgttgatgtgaaggacttgtttacagatcacatgttcattaaatggaaggtagaatacatcaaaaccgaggccatagtgtgcgtcgagctcactagccaagaaagacagtgttcactgattgaggcaggtacaaggtttaacctagggcccgtgaccatcacgctgagtgaaccacgtaatatccagcagaaacttccgcctgagattataactctccatcccaaaatcgaagagggattctttgacctgatgcacgttcaaaaggtgttgagcgcttccaccgtctgcaagctgcagtcttgtacacatggcattccaggtgacttacagatctatcacattggcaacctcctgaaaggggatcgccttaacggacatctgatccacaagatagagccccacttcaataccagctggatgtcctgggacggctgcgatttggactactattgtaacatgggggattggccttcatgcacatacactggagtgacccagcataatcacgccgcgtttgttaacctcctgaatatcgaaacggactatacaaaaactttccattttcactctaagcgggtgaccgcccacggcgatacaccacaactagacctgaaagctagacccacctacggtgcaggggagattactgtccttgtagaagtggccgatatggagctccataccaagaaagttgagatcagtggactgaagttcgcttcgttggcctgcacaggctgttatgcatgcagctccggtatttcttgtaaggtgaggatccacgtcgacgaacctgatgagttaacggtgcatgtaaaatcaagcgacccggatgtggtcgcggcctccacttcgctgatggctcgaaagctcgagttcggcaccgactctacatttaaagccttcagcgcaatgccaaagacctcactgtgcttttacatagttgagcgggaatactgtaaatcctgcagtgaggacgatactaagaagtgtgtggacacaaaacttgatcagccccagagcattctgatcgagcacaaggggaccatcattggaaaacaaaacgacacgtgcactgctaaggcctcttgttggttggaatccgtgaaatcattcttttatggcctaaagaatatgctggggagcgtcttcggaaactttttcgtgggcatcctcctgtttcttgcacctttcgttttactggtactctttttcatgtgcggttggaagttcttgttttgtttcaaatgctgccgcagaacaagggggctgtttaagtaccggcatctcaaagatgacgaggaaaccggatatcgaagaataattgagcgcctgaatagtaagaaaggcaagaacaggcttctggatggcgaacgtttggccgaccggaagatcgctgagctattctctaccaaaagtcacattgggtga

SEQ ID NO: 10340 - RNA, 5067 nt, synthetic construct
  misc_feature 1..5067: note = derived and/or modified CDS sequence (opt3) from CCHFV(24-R-2012)__KR814856.1__GP
  source 1..5067: mol_type = other RNA
atgcccaccaacatcatgcacacactgctcgtgtgcttcattctttacctgcagttgttaggcctgggtggagcccatagacaaagcaatgctactgagcacaacggtacgaataccacaactgcaccttccacctctcagtcaccaaagccgcccgtcagtacagcccctccacatgcgcccgaaagctccaccataaaacctactacaccagcttctgagaccgaaggctcgggggagacgactccccctccaaacaccacacagggaccgtcaccccctgaagccactccagagaggaccgcaacaaccgccacgagcactcccagtacagacaataccaactccactacacacgctaccgataataaccctacgtctaccatcagcacatccccatcaagtagcccctctactccgtccacccctcagggcattcatcaccccgcacggaatctactctcagttagcagtccaaagacagccactacccctacacccacctctccaggtgacatctccagcgagacttcgtctctgcactccgctatgtcacgcacgcccacacttcataccgccactcaagcgagtaccgaaaacgcaaatcacagcgcccctcgacagtccgagtctagcgctcagcagacaaccacttcaccaatgacaagtccggcccaacccattctggtgatgtccgcagctcctacggccatccagaacatacatccaagccccaccaatcgttctaaaagaaacttggaaatggagatcattctcactctgtcacaggggctgaagaaatattacggaaagatcctcaagttactgcaccttacattggaggaagataccgagggcctgctagaatggtgtaaaaggaatctcggcagtaactgcgacgatgactttttccagaagcggattgaggaatttttcatgacaggggagggatattttaacgaggtactgcaattcaaaactcttagcaccctgtcccctacggaaccatctcacgcgagacccccgaccgtggagccttttaagtcgtacttcgccaaagggtttttgagcatcgattccggctatttctcagcaaagtgttacccacgcctcagtacatctgggctgcagttaataaatgtcactcagcatcccgctaggattgccgaaacccctggacccaagacaactagcctgaaaaccatcaactgcattaatctccgggcttccgtgtttaaggagcaccgcgaaatcgagatcaacgttcttctgccacaaattgccgtgaatttgtcaaactgtcatgtcgtgataaatagccacgtatgcgactattctctagatacggacggccctgttcgactgccccatatctaccacgagggtacattcattccagggacctacaaaatcgtgatagataagaaaaacaagctcaatgacagatgtactctggtcacaaactgcgtgattaaaggaagggaagtgcggaagggccagtccgtccttcgtcagtataagaccgagatcaaaatcggcaaggcaagtactgggagccgcaaactgttgtctgaggaaccgggagatgactgtatttccagaacccagctcctgaggacagaaacggccgagatccacgacgataattacggtggccctggggacaagattaccatatgcaacggatcaactatcgttgatcaacggttaggcagtgagctgggttgttatacaattaatcgagtgaaatcgtttaagctatgcgaaaacagcgctaccgggaagacatgcgagatcgactccactcccgtaaaatgtcgccagggcttctgcctcaagatcacccaggaaggaagaggccatgtgaaactgtctagggggagcgaggtcgtgcttgatgcgtgtgacacgtcatgcgaggttatgattccaaagggaacaggtgatatattggtggactgtagtggcgggcagcaacacttcctgaaagataatctcatcgacctgggatgcccccatattcctcttctgggcaagatggcaatctacatttgtcggatgtccaaccacccacgcaccactatggcctttttgttctggttttctttcggttatgtcattacctgcatattttgtaaggctctcttctacagcctgatcattatcgggacattaggcaaaaagattaaacagtatagagaactgaagccccagacttgcaccatctgtgagacagcccctgtgaacgcaatagatgccgaaatgcacgacctaaattgctcctacaacatttgcccgtactgtgcttcaaggctcacgagcgacggactggcccgtcatgtaccacagtgccccaaacggaaggagaaggttgaagagaccgagctttatttgaatctggaacgaatcccttggattgtgagaaaactcctgcaagtcagtgagtctactggcgtggcattaaagaggtccagctggctgatcgtccttttggtgctcctgacagtttcgctatcaccagtgcagtctgcgcccgtagggcacggaaaaaccatagaaacttaccagacacgcgagggttttaccagtgtctgtctgttcatgctcggctccatcctgtttcttgtgagctgcttggttaaggggctggtggattctgtcagcgactccttctttcctggattatcagtgtgtaaaacgtgcagtattggcagcatcaacggtttcgaaattgagtctcataagtgttattgctccctcttttgttgcccgtactgtcggcactgctcagctgatagagagatccatcagctgcaccttagtatatgcaaaaagaggaagatggggagcaatgtaatgctggccgtgtgtaaacgcatgtgcttccgagcaactattgaagcctcccggcgtgctttgctcatcagatctatcattaacaccacattcgttatctgtattctgaccctaactatatgcgtcgtgtcgacaagcgccgtggagatggaaaatctgccctcaggcacctgggagagggaagaggacctcacaaacttttgtcaccaagagtgccaggtcactgaaaccgagtgtctgtgcccatatgaagcacttgttttgcgcaagcctctgttcttagattccatcgtgaaaggaatgaagaatctcctgaacagtacgtctcttgagacaagcctgtccattgaggctccctggggcgccatcaatgtgcagtcaacctttaaaccaactgtatctaccgcgaacattgccctaagctggagttccgtcgaacatcgggggaataagatcctcgtgacaggaagaagcgagtctataatgaagctggaagagaggactggcgtttcatgggacttgggtgtggaagatgcttccgagagtaaactgttaaccgtcagcatcatggacctctcgcaaatgtactctcctgtgttcgagtatctgtccggggatcgacaggttgaagagtggcccaaggcaacgtgtacaggagactgcccagaacgctgtggctgcaccagctcaacttgccttcacaaagagtggccgcatagtcggaactggagatgtaatcctacatggtgctggggtgtgggcaccgggtgtacttgctgtggagtagatgtcaaggacctgtttacagatcacatgttcgtgaaatggaaggtggaatacattaagaccgaggccatcgtctgcgttgagttgacgtctcaggaaaggcagtgttccctcattgaggctggcactcgttttaacctggggcccgtgaccatcacactaagcgaaccacgcaacatacaacagaaactgccccctgagattatcacccttcatccaaaggtagaagagggattctttgacctcatgcacgtgcagaaagtcctgtcagccagtacagtgtgcaagttgcagagctgtactcacggcatccccggtgacctgcaagtttaccatattgggaatttactcaaaggagatcgggtgaacggccacctgatacataagatcgagcctcacttcaatacctcctggatgtcttgggacggttgcgatcttgactattactgtaacatgggcgattggccgagctgcacgtatacaggggtcactcagcacaatcatgcagcgtttgtgaacctgttgaatattgaaaccgactacacaaagaccttccactttcattccaaaagagttactgcccacggagataccccacagctcgacctgaaggctaggcccacatatggcgccggggagatcacggtgctagtcgaagtagcagatatggagctgcatactaaaaaggtggagatttcaggacttaaattcgcttctctcgcctgcaccggctgttacgcatgcagttcgggtatcagctgtaaggttcgaatacacgtggacgaacctgatgagctgacagtccacgtgaaatccaacgaccccgatgtagtggccgcttctacctcattgatggcgcggaagttagaatttgggactgacagcacatttaaggccttctccgcaatgccaaaaaccagtctgtgcttttatatcgtcgagcgcgaatactgtaagtcttgcagcgaggaggacacgcagaaatgtgttgatactaagctcgaacaacctcagtcaattctgatcgagcataaaggaacaattatcggcaagcagaatgatacctgcaccgctaaggcctcctgttggcttgaaagtgtgaaatctttcttttacggtctgaagaacatgttgggcagcgtgttcgggaatttcttcataggaatcctactgtttctcgcccccttcgtcctgcttgtgttatttttcatgttcggctggaaaatcctgttttgcttcaagtgttgcagaaggactcgggggctcttgaaatatcgactgctcaaggacgacgaggaaacaggatacagacgcatcattgagaggctgaacaataagaaaggcaagaaccgtcttctggatggtgagcggttggctgacagaaaaatcgcagaactattttccaccaagacacacatagggtga

SEQ ID NO: 10341 - RNA, 5064 nt, synthetic construct
  misc_feature 1..5064: note = derived and/or modified CDS sequence (opt3) from CCHFV(Oman-199809166)__KR864901.1__GP
  source 1..5064: mol_type = other RNA
atgcccgtgaacaccatgcacacactgctcgtctacgccgttttctgccttcagctgtggagccctggcgggactagaggattgtccaatgagacgcaacataacgaaaccggtatcacaagggctccagagggctctcaggggccgtcattacccgtgagtactgcaagccctattatgtccgacccatctataaccacactgtcggcctcaaccagcggactagaaggcagtggtgatactacaccccctgcgatcacccaggggccaacgctccccgagactacccctgaaccatccacaactaccggaacaaatgctttttctaccgccattgcaaacgtaagcacgcagactgtgaaggacacaccgacccccactgtccaaacatcccctccatcaacccccgatgccagtacgatccctcagggcacccaccatacagctcggggcctgcttagcgtgactgttaccaaaccagaggaggtgcccacaccgactgggcctgaacaggcatctattgagaccaattcctcacgcctggccacaagcaagacccccagtccatctcctactgctcaggtcacgacagaaaactccaatcccaacaccagccgacaattggtgctctcgactcagccagccacctcttcccccgtaacatctcctgcgcagctgaatttcgttcagagtgcaaccactatcgccgtgcaagacgctcacccaagcccgacaaaccgttccaaaagaaatctggagatggaggtcatactcacgttatctcagggactgaggaagtattacggtcggatccttaaattgctggatctaaccctcgaagaggacactgaaggcctgcttgagtggtgtaagcgcaacctggggttgacatgcgatgacaactttttccagaagagaattgaagagtttttcctcaccggagagggccattttaatgaagtgctgcaattcaaaacacccagcactttatcacctaccgagagtgcctccgtgggtctgccaacggtcgaaccctttaagagctatttcgcaaaagggtttctctctatcgattcaggatacttcagtgctaagtgttatcctagggccagcaattccggccttcagctgattaacgttacccagcactctgcgcggatcgccgacacaccaggccccaaaataactaacttgaagaccattaattgcatcaacctaaaggcactggtgtttaaagagcaccgcgaaattgagatcaatgtactcctgcctcaggtggctgtcaacctttcgaattgtcatgtgcacatcaagagccatgtttgcgattactccctggacattgatgggacagtgcgattgccgagaatacaccacgagggaactttcatcccaggtacctataaaattgtcatcgacaagaaaaacaagcaaaatgacaggtgtaacctcgtgacgaattgcgtaataaaaggccgggaagttcgtaaggggcagtcagtgctgcgccagtacagaacagagattaggatcggaaaggccagttctggcagccggcgattactgtccgaagagtcaggtgaagattgtatcagccgcacccagctactcagaactgagacagctgagattcatggggacaactacggcggacccggcgataaaatcaccatttgcaatgggtctactatagtcgaccaaaggctgggatccgaacttggttgttataccatcaaccgggtgaagagtttcaaattgtgcgagaatagcgccacaggcaagtcttgcgaaattgataacacgcctgtcaaatgtaagcaggggttttgcctgaagatcacccaggagggacgcggccacgtgaaactctccagagactcagaggttgtgctggatgcatgtgacagtagctgcgaaatcatgattcccaagggtactggggatatacttgtagactgttcgggcggacagcaacatttcctgaaagataatttgatcgacctcggctgcccaaacattcctctgttagggaagatggccatctacatttgtaggatgtccaaccaccccaaaacaaccatggcttttctgttctggttttctttcggatatgtcatcacatgcatactatgtaaggtgatcttttacctcctgattgttgtgggtactcttggcaagaaattcaagcagtatcgtgagttgaaaccacagacctgcacgatctgtgaaacaaccccggtcaatgcgattgacgcagagatgcatgatctgaactgcagctacaatatctgcccttattgtgcctcacggctcaccagtgacgggctggctcgacacgtgatgcagtgccccaagagaaaagaaaagatagaggagactgaattatacctgaaccttgagaggattccatgggtagtgcgcaagttgctccaagtttccgaatctacaggagtcgccctgaaacggagctcctggctaatcgtgctgctcgtgctgcttactgtctcattgagccccgttcagagtgcacctattggccacggtaagaccatcgagacataccagacgagagaagggtatacctctatatgtctgtttgtgttaggctccatcctcttcattgtgagccatctgatgaaaggacttgtagattcggtcggcaattcatttttcccagggctgtctatctgcaagacttgtagtattggatccatcaacggctttgagatagagagccacaaatgctactgttctttgttctgctgtccctattgcaggcattgtagcgccgacaaggaaattcacaaactccacctgtccatctgcaagaagcgcaaagctggttcaaatgtgatgctagccgtttgcaagcgaatgtgtttccgggcaacaatggaggtgagtaacaaagcgctgctcatccgtagcgtcattaataccacttttgtggtttgcatcctgattcttgctgtgtgtgtagtctctacatccgccgtggaaatggagtcattgcctgcagggacctgggaaagagaggaggatctgacgaacttctgccatcaagaatgtcaggtgactgagaccgaatgcttatgtccgtacgaggccctcgtcctgaggaagccactttttctggacagtatagctaaaggaatgaagaatctactcaacagcacatccctggagacctctttgtcgatcgaagccccctggggcgcaattaatgttcagagcactttcaagcctacagtgtcaaccgctaacatcgccctgtcctggagttctgtagagcaccgcggtaataaaattttagtgagcggccggtccgaatcaatcatgaagctcgaggaaagaacagggatatcttgggatctgggagtcgaggacgcgagcgagagtaaacttctgactgtgtccgttatggatttgagccagatgtattctccagtgtttgaatacctctcaggcgacaggcaagtcgaggaatggcccaaggctacctgcacgggggattgtcctgagcgatgcggatgtacatccagtacctgcctgcataaagaatggccgcacagccgcaactggcggtgcaaccccacttggtgttggggcgtgggtaccgggtgcacatgttgcggactagacgttaaggatctgttcactgactatatgtttgtgaagtggaaagtcgagtacatcaagaccgaggccattgtatgtgtggaacttacgtcgcaggagagacagtgctctctcatcgaagcaggcacaaggttcaatctgggtccagttaccattactttgtccgagcctcgtaacatccagcaaaaactgcccccagaaatagtgacattacatcctcgcattgaggagggctttttcgacctcatgcacgtccagaaggtgctgagcgcctcaaccgtatgtaaacttcagagttgcactcacggggtgcccggagatctgcaggtctaccatatcggcaatttgctcaagggggacaaggttaacggacacctgatccataaagtggaaccacactttaatacatcttggatgtcctgggatggctgtgacctagattattactgcaacatgggtgactggccgagctgtacctatacgggggtgactcaacataatcacgctgccttcgtcaacctgcttaatattgagaccgattacacaaagaactttcacttccattcaaaacgggtgaccgcacacggagacacacctcagctcgatctgaaggcgagacccaattatggcgccggtgaaataactgttttggtagaggtggctgacatggagttacataccaaaaagatcgaaattagtggcctgaaattcgccagcctcacgtgcacagggtgctacgcatgttcctctggaatcagctgcaaggtcaggattcacgtggatgagccagacgaactgactgttcacgtgaagtccgaggatcccgacatcgtcgctgcctcatctagtcttatggcacgaaaactggaatttggcaccgactcgacattcaaggcctttagcgctatgcctaaaacctccttgtgtttctatatagtggagcgggagtactgcaagtcttgttcaaaagaagatactcagaagtgcgtaaacgcgaagctagagcgcccacaaagcatcctgattgaacataaagggaccatcattggaaagcagaatgacacatgtacggccaaagcatcctgctggctcgagagtgtcaagtcatttttctacggcctgaaaaacatgcttagcggtatctttgggaatgtgttcataggaatctttttattcctggctccctttattctcttgatcctgttcttcatgtttggctggaggattctcttctgttttaagtgctgtagacggactcgaggcctgttcaagtatagacaccttaaagatgacgaagagaccgggtaccgcaagatcatagagaggctgaacaacaaaaagggtaaaaataagttgctagatggagaacgtctggccgaccggaagattgccgagctcttttcaacaaaaacccatatcggctga

SEQ ID NO: 10342 - RNA, 5064 nt, synthetic construct
  misc_feature 1..5064: note = derived and/or modified CDS sequence (opt3) from CCHFV(Oman_812956)__KY362518.1__GP
  source 1..5064: mol_type = other RNA
atgcccgtgaacaccatgcacacactgctcgtctacgccgttttctgccttcagctgtggagccctggcgggactagaggattgtccaatgagacgcaacataacgaaaccggtatcacaagggctccagagggctctcaggggccgtcattacccgtgagtactgcaagccctattatgtccgacccatctataaccacactgtcggcctcaaccagcggactagaaggcagtggtgatactacaccccctgcgatcacccaggggccaacgctccccgagactacccctgaaccatccacaactaccggaacaaatgctttttctaccgccattgcaaacgtaagcacgcagactgtgaaggacacaccgacccccactgtccaaacatcccctccatcaacccccgatgccagtacgatccctcagggcacccaccatacagctcggggcctgcttagcgtgactgttaccaaaccagaggaggtgcccacaccgactgggcctgaacaggcatctattgagaccaattcccccagactggccacatcaaagaccccaagccctagtcccactgctcaggtcacgacagaaaactctaatccaaacacctcccgacaattggtgctcagcactcagcccgccacctcgtctcctgtaacatccccagcgcagctgaatttcgttcagtcagcaaccactatcgccgtgcaagacgctcacccgagtcccacaaaccgtagcaaaagaaatctggagatggaggtcatactcacgttatcccagggactgaggaagtattacggtcggatccttaaattgctggatctaaccctcgaagaggacactgaaggcctgcttgagtggtgtaagcgcaacctggggttgacatgcgatgacaactttttccagaagagaattgaagagtttttcctcaccggagagggccattttaatgaagtgctgcaattcaaaacaccttctactttaagcccaaccgagtcagccagtgtgggtctgcccacggtcgaaccttttaagtcctatttcgcaaaagggtttctcagcatcgattctggatacttctcagctaagtgttatccaagggccagtaatagcggccttcagctgattaacgttacccagcactccgcgcggatcgccgacacacccggcccgaaaataactaacttgaagaccattaattgcatcaacctaaaggcactggtgtttaaagagcaccgcgaaattgagatcaatgtactcctgcctcaggtggctgtcaacctttctaattgtcatgtgcacatcaagtcgcatgtttgcgattacagcctggacattgatgggacagtgcgattgccaagaatacaccacgagggaactttcatccccggtacctataaaattgtcatcgacaagaaaaacaagcaaaatgacaggtgtaacctcgtgacgaattgcgtaataaaaggccgggaagttcgtaaggggcagtccgtgctgcgccagtacagaacagagattaggatcggaaaggcctcaagtggctctcggcgattactgagcgaagagtccggtgaagattgtatctcacgcacccagctactcagaactgagacagctgagattcatggggacaactacggcggacctggcgataaaatcaccatttgcaatgggagcactatagtcgaccaaaggctgggatctgaacttggttgttataccatcaaccgggtgaagtccttcaaattgtgcgagaatagtgccacaggcaagagctgcgaaattgataacacgcccgtcaaatgtaagcaggggttttgcctgaagatcacccaggagggacgcggccacgtgaaactctctagagactccgaggttgtgctggatgcatgtgactcaagttgcgaaatcatgattccaaagggtactggggatatacttgtagactgtagcggcggacagcaacatttcctgaaagataatttgatcgacctcggctgccctaacattcccctgttagggaagatggccatctacatttgtaggatgtcgaaccacccaaaaacaaccatggcttttctgttctggttttccttcggatatgtcatcacatgcatactatgtaaggtgatcttttacctcctgattgttgtgggtactcttggcaagaaattcaagcagtatcgtgagttgaaaccgcagacctgcacgatctgtgaaacaacccctgtcaatgcgattgacgcagagatgcatgatctgaactgctcttacaatatctgcccctattgtgccagccggctcacttcagacgggctggctcgacacgtgatgcagtgcccaaagagaaaagaaaagatagaggagaccgaattatacctgaaccttgagaggattccctgggtagtgcgcaagttgctccaagttagtgaatccacaggagtcgccctgaaacggtctagctggctaatcgtgctgctcgtgctgcttactgtctccttgtcacctgttcagagcgcaccaattggccacggtaagaccatcgagacataccagacgagagaagggtataccagtatatgtctgtttgtgttaggctctatcctcttcattgtgtcccatctgatgaaaggacttgtagatagcgtcggcaattcgtttttccccgggctgtcaatctgcaagacttgttctattggaagtatcaacggctttgagatagagtcccacaaatgctactgtagcttgttctgctgtccttattgcaggcattgttctgccgacaaggaaattcacaaactccacctgagcatctgcaagaagcgcaaagctggttccaatgtgatgctagccgtttgcaagcgaatgtgtttccgggcaacaatggaggtgtcaaacaaagcgctgctcatccgtagtgtcattaataccacttttgtggtttgcatcctgattcttgctgtgtgtgtagtcagcacatctgccgtggaaatggagtccttgccggcagggacctgggaaagagaggaggatctgacgaacttctgccatcaagaatgtcaggtgactgagaccgaatgcttatgtccatacgaggccctcgtcctgaggaagcccctgtttttcgactcaatagctaaaggaatgaagaatcttctaaacagtacaagcctcgagacctccctgtctatcgaagccccttggggcgcaattaatgttcagtcgacttttaagccaacagtgagcaccgctaacatcgccttgtcatggtccagtgtagagcaccgcggtaataaaattctggtgtctggccggagcgaatccatcatgaagttagaggaaagaacagggatatcatgggatctcggagtcgaggacgcgtctgagagcaaactgcttactgtgagtgttatggatctgtcccagatgtatagccccgtgttcgaatacttgtctggcgacaggcaagtcgaggaatggcctaaggctacctgcacgggggattgtccggagcgatgcggatgtacatcaagtacctgcctccataaagaatggccccactcccgcaactggcggtgcaacccaacttggtgttggggcgtgggtaccgggtgcacatgttgcggactggacgttaaggatctatttactgactatatgttcgtgaagtggaaagtcgagtacatcaagaccgaggccattgtatgtgtggaactgacgagccaggagagacagtgctcgcttatcgaagcaggcacaaggtttaatctcggtcctgttaccattactctgtctgagccccgtaacatccagcaaaaattgccacctgaaatagtgacactgcatccccgcattgaggagggcttctttgacttaatgcacgtccagaaggtgctctccgccagcaccgtatgtaaactgcagtcatgcactcacggggtgccaggagatcttcaggtctaccatatcggcaatctgttgaagggggacaaggttaacggacacctcatccataaagtggaaccgcacttcaatacaagttggatgtcttgggatggctgtgacctggattattactgcaacatgggtgactggccttcctgtacctatacgggggtgactcaacataatcacgctgcctttgtcaacctactgaatattgagaccgattacacaaagaacttccacttccatagcaaacgggtgaccgcacacggagacacaccccagcttgatctcaaggcgagaccaaattatggcgccggtgaaataactgttctggtagaggtggctgacatggagttgcataccaaaaagatcgaaatttcaggcttaaaatttgccagtctgacgtgcacagggtgctacgcatgtagctccggaatctcttgcaaggtcaggattcacgtggatgagcccgacgaactcactgttcacgtcaagagcgaggatcctgacatcgtggctgcctcctcatctctgatggcacgaaaacttgagttcggcaccgacagtacatttaaggccttctcggctatgccaaaaaccagcctgtgtttttatatagtggaacgggagtactgcaagtcctgttctaaagaagatactcagaagtgcgtaaacgcgaagttggagcgcccccaatcaatcctaattgaacataaagggaccatcattggaaagcagaatgacacatgtacggccaaagcaagctgctggctggagtccgtcaagagtttcttttacggcctcaaaaacatgctgtctggtatcttcgggaatgtgtttataggaattttcttatttcttgctcctttcatcctgctcatcttgttctttatgttcggctggcgcattctgttttgtttcaagtgctgtaggcggactcgaggcctctttaagtatagacacctgaaagatgacgaagagaccgggtaccgcaagatcatagagaggcttaacaacaaaaagggtaaaaataagctgttggatggagaacgtctagccgaccggaagattgccgagctgttcagcacaaaaacccatatcggctga

SEQ ID NO: 10343 - RNA, 5064 nt, synthetic construct
  misc_feature 1..5064: note = derived and/or modified CDS sequence (opt3) from CCHFV(Oman)__DQ211632.1__GP
  source 1..5064: mol_type = other RNA
atgcccgtgaacaccatgcacacactgctcgtctacgccgttttctgccttcagctgtggagccctggcgggactagaggattgtccaatgagacgcaacataacgaaaccggtatcacaagggctccagagggctctcaggggccgtcattacccgtgagtactgcaagccctattatgtccgacccatctataaccacaccctcggcctcaaccagcggactggaaggcagtggtgatactacacctccagcgatcacccaggggcccacgcctccagagactaccccggaaccctccacaactaccggaacaaatgctttttctaccgccattgcaaacgtaagcacgcagactgtgaaggacacacctaccccaactgtccaaacaagtcccccttcaaccccagatgccagtacgatcccccagggcacccaccatacagctcggggcctactcagcgtgactgttaccaaaccggaggaggtgcctacacccactgggccagaacaggcatctattgagaccaattcccctcgcctggccacatcaaagacccccagcccaagtcccactgctcaggtcacgacagaaaactctaatcctaacacctcccgacaacttgtgctgagcactcagccagccacctcgtctccggtaacatcccccgcgcagttgatcttcgttcagtcagcaaccactgtggccgtccaagacgctcaccctagtccaacaaatcgtagcaaaagaaacctcgagatggaggtgatactgacgctgtcccagggactcaggaagtattacggtcggatcttaaaactgcttgatttgaccctggaagaggacactgaaggcctactcgagtggtgtaagcgcaatctggggcttacatgcgatgacaactttttccagaagagaattgaagagtttttcctgaccggagagggccattttaatgaagtgttgcaattcaaaacaccctctactctcagctcaaccgagagtgcctccgtcggtctgcctacggttgaaccatttaagagctatttcgcaaaagggtttttatctatcgattcaggatacttcagtgctaagtgttatcccagggccagcaactccggcctgcagctcattaatgtgacccagcactctgcgcggatcgccgacacaccgggccctaaaataactaaccttaagaccattaactgcatcaatctgaaggcattggtatttaaagagcaccgcgaaattgagatcaacgtgctactgccacaggtcgctgtgaatctctcgaactgtcatgttcacatcaagagccatgtgtgcgattactccctggacattgatgggacagtccgacttcccagaatacaccacgagggaactttcatccctggtacctataaaattgtgatcgacaagaaaaataagcaaaacgacaggtgtaatctggtaacgaactgcgttataaaaggccgggaagtgcgtaaggggcagtcagtcttgcgccagtacagaacagagattaggatcggaaaggccagttctggcagccggcgactcctgtccgaagagtcaggtgaagattgtatcagccgcacccagttactgagaactgagacagctgagattcatggggacaattacggcggacccggcgataaaatcaccatttgcaacgggtctactatagtggaccaaaggctaggatccgaactcggttgttataccatcaatcgggtcaagagtttcaaactgtgcgagaacagcgccacaggcaagtcttgcgaaattgataatacgccagtgaaatgtaagcaggggttttgccttaagatcacccaggagggacgcggccacgttaaattgtccagagactcagaggtggtactggatgcatgtgacagtagctgcgaaatcatgattcctaagggtactggggatatactcgtcgactgttcgggcggacagcaacatttcctgaaagataaccttatcgacctgggctgccccaatattccattgctcgggaagatggccatctacatttgtaggatgtccaaccacccgaaaacaaccatggcttttctgttctggttttctttcggatatgtgatcacatgcatattatgtaaggttatcttttacctgctaattgtggtcggtactctcggcaagaaattcaagcagtatcgtgagctgaaacctcagacctgcacgatctgtgaaacaacccccgtgaacgcgattgacgcagagatgcatgatcttaattgcagctacaacatctgcccatattgtgcctcacggttgacttccgacgggctggctcgacacgtaatgcagtgccccaagagaaaagaaaagatagaggagaccgaactctacctgaatttagagaggattccttgggtggttcgcaagctgcttcaagtctccgaatctacaggagtggccttgaaacggagctcctggctcatcgtgctgctagtcctgctcactgtttcactgagcccagtgcagagtgcacccattggccacggtaagaccatcgagacataccagacgagagaagggtatacctctatatgtctttttgtgttgggctccatcctgttcattgtaagccatttaatgaaaggactcgtcgattcggtgggcaactcatttttccctgggctgtctatctgcaagacttgtagtattggatccatcaatggctttgagatagagagccacaaatgcttctgttctcttttctgctgtccgtactgcaggcattgtagcgccgacaaggaaattcacaaactgcacttgtccatctgcaagaagcgcaaagctggttcaaacgttatgctcgccgtgtgcaagcgaatgtgttttcgggcaacaatggaggtcagtaataaagcgctgctaatccgtagcgtgattaacaccactttcgttgtgtgcatcctgattctcgctgtatgtgtcgtgtctacatccgccgtggaaatggagtcactgccagcagggacctgggaaagagaggaggatcttacgaatttttgccatcaagaatgtcaggtcactgagaccgaatgcttgtgtccctatgaggccctggttttaaggaagcctctcttcctggacagtatagctaaaggaatgaagaaccttctgaatagcacatccctagagacctctctctcgatcgaagccccatggggcgcaattaacgtgcagagcacttttaagcccacagtatcaaccgctaatatcgccctgtcctggagttctgtggagcaccgcggtaacaaaattttggtcagcggccggtccgaatcaatcatgaagctggaggaaagaacagggatatcttgggatttaggagtggaggacgcgagcgagagtaaactcctgactgtttccgtgatggatcttagccagatgtactctcctgtcttcgaatatctgtcaggcgacaggcaagtggaggaatggccgaaggctacctgcacgggggattgtcccgagcgatgcggatgtacatccagtacctgcttgcataaagaatggccacacagccgcaattggcggtgcaaccctacttggtgttggggcgttggtaccgggtgcacatgttgcggactcgacgtgaaggatctgtttactgactacatgttcgtcaagtggaaagtagagtatatcaagaccgaggccattgtgtgtgttgaactaacgtcgcaggagagacagtgctctctgatcgaagcaggcacaaggtttaaccttggtcccgtgaccattactctctccgagccacgtaatatccagcaaaaactgcctcccgaaatagtcacattgcatccacgcattgaggagggcttctttgacctgatgcacgtgcagaaggtattaagcgcctcaaccgtgtgtaaactccagagttgcactcacggggtcccgggagatctgcaggtttaccatatcggcaaccttctgaagggggacaaggtgaatggacacttgatccataaagtggaacctcacttcaacacatcttggatgtcctgggatggctgtgacctcgattactattgcaatatgggtgactggcccagctgtacctacacgggggtcactcaacataaccacgctgcctttgtgaatctgctaaacattgagaccgattatacaaagaatttccacttccattcaaaacgggttaccgcacacggagacacaccacagctggatcttaaggcgagacccaactacggcgccggtgaagtaactgtgctcgtcgaggtggctgacatggagctgcataccaaaaagatagaaatcagtggcttgaaatttgccagcttaacgtgcacagggtgctatgcatgttcctctggaattagctgcaaggttaggatccacgtggatgagcctgacgaactgactgtccacgtgaagtccgaggatccagacattgtagctgcctcatctagtctcatggcacgaaaactggagttcggcaccgactcgacatttaaggccttcagcgctatgcccaaaacctccctttgtttttacatcgtcgaacgggagtattgcaagtcttgttcaaaagaagatactcagaagtgcgtgaatgcgaagctggagcgccctcaaagcatattgatcgaacataaagggaccattatcggaaagcagaacgacacatgtacggccaaagcatcctgctggctagagagtgttaagtctttcttttacggcctgaaaaatatgctcagcggtattttcgggaacgtgtttatcggaatattcctgtttcttgctccgttcattttactgatcctcttctttatgttcggctggagaatcttgttttgtttcaagtgctgtaggcggactcgaggcctgtttaagtacagacacctcaaagatgacgaagagaccgggtatcgcaagattatcgagaggctgaataacaaaaagggaaagaacaaacttctggatggtgaacgtttggccgaccggaagatagccgagctattctcaacaaaaacccatattggctga

SEQ ID NO: 10344 - RNA, 5064 nt, synthetic construct
  misc_feature 1..5064: note = derived and/or modified CDS sequence (opt3) from CCHFV(3820-ST-2007)__KR814868.1__GP
  source 1..5064: mol_type = other RNA
atgcccatcaacattatgcacaccctgctcgtgtgcttcatactttacctgcagttgagcggcttagggggagcccatggtcaatccaatgctacagagcacaacggcactaatacgaccacagtccctgggacttctcagtcaccaaagccgcccgcaagtaccacactgcctcataccccagaaagctccactgttaaactaacaacccccacgtctgagactgaaggatcgggcgagaccacacctccaaacactacccagggtctccccctgcctgggacaaccccagaaagatcagccacgactgcgacaagcaccagttccactgacaatatgaactctacaacccaggtgacggataataccccgacaagcactgtatccatctcacccagttcatcttcctcaatgcctagcaccagtcaagggattcaccatccagtgaggtctcttctgtccgtcagctcgcccaagacagtgactacccctacaccaatgtctcccggcgagatgtccccggagacctcaagtcagcacagcgctatgtcccgggttcctactttgtatacggccacacagatctctaccgaaaacactgaccgcagcactccccgacagtcagagagttccgtgcaaccagcaacacagagccctattacctctcccgcccagactatcctcctgatgtcagctgcaccaaaagccatacaggatatgcaccccagtcctacaaatcgtagcaagagaaacctggaagtcgagatcattctcacgttatcccaaggcctgaaaaagtactatgggaagatccttaaattgctgcatctaaccctcgaggaagacactgagggactgcttgaatggtgtaagaggaatctgggttctaactgcgatgacgactttttccagaaacggattgaggaatttttcatcacaggcgaggggtactttaatgaggtgttgcagttcaagaccctctcgacactgagcccaactgaaccgtcccacgtacgcttacccaccgctgagccttttaaatcatatttcgccaagggatttctgagtatagattctggctacttcagcgcgaagtgttatccaagatcctcaacgagcggtctccaacttattaacgttacccagcatcccgcaaggatcgccgaaacacctgggccaaaaactacctctctgaagacaattaattgcatcaacttgcgggcttccgtgtttaaagagcaccgcgaagtcgagatcaacgtgctactgccccagattgccgtgaatctcagtaactgtcacgtcgttataaatagccatgtgtgcgattactctctggacactgatggaccggtacgacttcctagaatccaccatgagggcaccttcattccaggcacgtacaagatcgtgatagacaggaaaaacaagctgaatgatcggtgttccttggtcacaaactgcgtgattaaagggcgtgaagttcgcaagggacagtcagtgctcagacaatataagaccgagatcaaaatcggtaagaccagtacaggcagcaggaaactgttatcggaggaacccggggacgactgtatttcccggacccagctgctaaagactgaaaccgcagagatccacgatgacaattacggatctcctggcgataaaattacaatatgcaacggtagcacgatcgtcgaccagcgactcgggtcagagctgggctgttataccattaatcgcgtgaagagttttaaactttgcgaaaactccgctactggaaaaacatgcgagatcgattctacccccgtaaagtgtagacagggcttctgcttgaaaatcacacaagaagggaggggacatgttaagctgagccggggttccgaggtggtcctcgacgcctgtgattcaagctgcgagattatgataccaaaaggcactggggacatcctggtggattgtagtggaggccagcagcacttccttaaggacaatctgattgatttgggttgccctcacatccccctcctggggaagatggcgatttacatctgtcgcatgtctaaccatccaagaaccacgatggcctttttattctggttttccttcggctatgtcataacatgcatcttttgtaaagcactgttctacagcctaattatcattggaaccctcggcaagaaaatcaagcagtatagggaactgaaaccgcaaacttgcaccatatgtgagacagctcctgtgaatgccattgacgctgaaatgcacgaccttaactgctcgtacaatatctgcccctactgtgcctcacgtttgacttctgatgggctggcacggcatgttacccagtgcccaaagcgaaaggagaaagtggaagagacagagctctatctgaacttagaaaggattccctggatcgtaagaaagctgcttcaggtcagtgagtccacgggagtggccttgaaacgcagctcttggctcatagttctgctagtgctgctcgctgtcagcctgtcccctgtgcagtcagcgccagtaggtcacggcaagaccatcgaaacttaccaaacacgggaggggtttaccagtatttgtcttttcatgttgggaagcatcctgtttattgtgtcttgcttagttaaaggcctcgtcgactccgtgtcagatagtttctttcccggtctgagcgtgtgtaagacttgctccatcgggtctataaacggcttcgaaattgagtcgcacaaatgttattgcagcctattttgttgcccttactgtagacattgctcagcagacagggagatccaccagctgcatttgtccatctgcaagaagcgcaaaacaggaagtaatgtcatgctcgccgtttgtaagcgaatgtgcttcaaagctaccattgaagcctctcggcgtgcactgctaatcagaagcattataaacacgactttcgtgatgtgtatcctgaccctcgccatttgcgtggtatccacatcagctgtcgagatggaagatctgccggccggcacctgggagagggaagaggaccttactaatttttgtcaccaggagtgccaagtgacagaaaccgagtgtttgtgcccatatgaagcactggttttacgcaagcccctcttcctggattctatcgtgaaagggatgaagaaccttctgaatagcacaagtctagagacttccctcagcattgaggcgccttggggagctatcaacgtccagtctacctttaagccaacggtgtcaacagccaatatagcactgtcctggagtagcgttgaacatcggggcaacaaaatcttggtgaccggtagatcggagtctattatgaagctggaagagaggactggggtatcctgggacttaggagtcgaagatgccagcgagtcaaaactcctgaccgtgagtatcatggacctttctcagatgtactcccccgtgttcgagtatctgagcggcgatcgacaggtcgaagagtggcctaaggctacatgtactggtgactgcccggaacgctgtggctgcacctcaagtacgtgcttgcacaaagagtggccccacagccggaattggagatgtaacccaacatggtgctggggagttggaaccggctgtacttgctgtggggtggatgtaaaggacctctttacagaccatatgttcattaagtggaaagtggaatacatcaagaccgaggccatagtctgcgtggagctgacttcccaagaaaggcagtgttctctaattgaggcaggaacacgttttaatctgggccctgttaccatcacgcttagcgaaccccgcaacatccagcagaaactcccacctgagattataactctgcaccccaagatcgaagagggtttctttgatttgatgcatgtgcaaaaagtcctgtccgcttcaaccgtgtgcaagttacagtcttgtacacacgggattccaggagacctccagatctaccatattggcaatctgcttaagggtgatcgggttaacggccacctgatccacaaaatagagccgcatttcaataccagttggatgtcgtgggacgggtgcgatttggactattactgtaacatgggagattggcctagctgcacatatactggcgtgacccagcacaaccatgccgcgtttgtcaatctcctgaacatcgaaacggactacacaaagactttccactttcactccaaaagagtaaccgcccatggggatacaccccaactagacctgaaggctaggccaacctatggagcaggcgagattactgtgcttgttgaagtggccgatatggagctccacaccaaaaaggtcgagatctctggtctgaaattcgcttcattgacatgcacggggtgttacgcctgcagctccggaattagttgtaaggtgcgaatccatgtagacgaacccgatgagttaactgtgcacgtcaagtctagcgaccctgacgttgtggcagcgtcaacctccctgatggcccggaaactcgagttcggcacagatagtacctttaaggctttcagcgccatgccaaaaacttctctgtgcttttatatagtggaacgcgaatactgtaagtcctgctcagaggacgatacaaagaagtgtgtcgacaccaaacttgagcagccccagagcattctgatcgaacataaaggtacgatcattggcaagcaaaatgatacttgcacagcaaaggcttcgtgttggttggagtctgtgaagagtttcttttacgggcttaaaaacatgctgggatccgttttcggcagctttttcgtagggatcctcctgtttcttgcccctttcgtgttactggtcctctttttcatgttcggatggaagatattgttttgcttcaagtgttgcagaaggacccggggcctgtttaaatatcgacacctcaaggacgatgaagagaccggttacagacgcattatcgaaaggctgaatagcaaaaaggggaaaaaccgtcttctggacggagagcggttggcagatagaaagattgccgagctattctccactaagacacacatcggctga

SEQ ID NO: 10345 - RNA, 5058 nt, synthetic construct
  misc_feature 1..5058: note = derived and/or modified CDS sequence (opt3) from CCHFV(SR3)__AJ538199.1__GP
  source 1..5058: mol_type = other RNA
atgcacatcagcctgatgtacgccgtgttctgcctccagctttgtggcctggggaagaccaacggaccccataatggtacagagcacaacaatactcatgtcatgacgacccctgacgattcccaatctccagaaccgcccgtttcaacagctttgcctgtgactccagaccccagtaccgtaacacctagcaccccagcatccggcttagaggggtctggagaagtgtatacttcgtcacccattacaaccaaaggcctgagcctacctgaggccacgagtgaaccaccggcgactacctccgtcgtgacatctagcgcttccgatactgactcaagtacccaggccgccggtgatacacccacccctacggttagaactagcctcccatcttccccctcaacacctagcaccagtcaggggactcactacccagtgaggtctctgctttccgtcacaagccccaagccggaggagacccctacgccctcgaaatctggaaaggacgatctggcaaccaactccccacatcctgctacatcacggcccactaccccacccacaactgcacagaaacctaccgaaaataacagtcacaatacaaccgagcaattggaaagcctcactcacctggccacgctgggcctcatgatatccccaacacagaccgtgttaccgcagtctgtaactagcatcgctattcaggacatccataactcacccaccaatcgcagtaagcgaaacctggatatggagattatccttacattgtcccaaggcctgaagaaatattacgggaagatactaaaactcctgcaccttaccctggaggaagacactgagggattgctcgaatggtgcaagcgtaatctgggtttagattgtgacgatacatttttccagaaaagaatcgaggaatttttcattacgggcgaggggcattttaacgaggttctgcagttcaggaccctcggaactcttagcacaaccgaatctacacacgccggctcacctactgtggagccatttaagagttatttcgcgaagggttttctgagcatcgactccgggtacttctctgcaaaatgctattcgcggaccagcaattccggattgcagctaattaacgtcacgcgccactcaaccagaatcgccgacacacccggccctaagataactaatctgaaaaccattaactgtatgaacctcaaggctagtgtgtttaaagaacatagggaggtggaaatcaatgtcctgcttccacaagttgccgtgaacctgtctaattgccacgtagcaattaagagccatatctgtgattactccttggacacagatggcgctatccggctcccccagattcaccatgaggggactttcataccgggaacctacaaaatcgtgattgacaagaagtcacgcctgaacgatcgatgcacgttatttacaaattgtgtcatcaaaggtagagaggtgaggaagggccagagcgttctgcggcaatataaaaccgaaatacgtattgggcgcgcctctactggatccagaaggctactcagtgaggaaagcggcgacgattgcatctctcggacacagctgcttcgaaccgagactgcggaagtgcacggtgacaactacgggggccctggagataagatcaccatttgtaatggctccacagtcgtggaccagcgcttggggtcagagctgggatgctatacgatcaacagagtaaggagtttcaaactctgcgagaatagcgccaccggtaagtcgtgtgaaattgattccataccagttaagtgcaaacagggctactgtctgaagatcactcaagaggggcggggacacgtgaaactttctcgcggcagcgaagtcgtgctggacgtctgcgactcaagttgtgaggtgatgattcccaagggtacaggggatatcttggttgactgctccggcggacagcagcatttcctcaaagataacctggtggacttaggctgtcctaagatccccctgctagggaagatggcaatttatatatgcagaatgtctaatcacccaaaaaccacaatggcttttctcttctggtttagcttcggatacgtaatcacttgtattctgtgcaaggccatctttttccttttgattatctttggtaccctgggcaaaaggttcaagcagtatcgtgagctcaaacctcaaacgtgtacaatatgcgaaaccactcccgtcaacgctatcgatgccgagatgcatgacctgaattgctcctacaacatttgtccatactgcgcatcacggttaaccagcgatgggctggcccgacacgtgacacagtgtccgagaaggaaggaaaaggttgaggaaactgagctttatttgaatctcgagcgcatcccttgggtggtccggaaactgctacaggtgagtgaatctaccggaacagtactgaagagatccagctggctcattgtgctgcttgttttgtttacggtctcgctgtcacccgtgcagtctgctccaatcggccacggtaaaaccatagagacttacagggtgcgcgaagagtatacaagtatttgcttattcgtcctcgggtccatcctgtttattgttagcttccttatgaagggcctggtggacggagtgggcaacatctttttccccgggttgtctgtatgtaaaacctgcagcataggatccatcaacggcttcgaaattgagtcacataagtgttactgcagtctcttttgttgcccttattgtcgacactgcagcgcggatggtgagatccatcaactgcacctatctatttgcaaaaagcggaagactgggtccaatgtcatgctggcagtgtgtaaacgtatgtgcttcagagccacaatggaagtttcaaacaaggctctctttatcaggagtataattaataccacgttcgtgatgtgtatcctgaaaggagagtttgccgcagtcaagagcatccatccaattgaaatggagtcccttcccgccggcacttgggaacgcgaggaggacttgaccaacttctgccaccaggaatgtcaggtgacagagaccgaatgcctgtgtccttacgaggctttagttctccggagaccgctgtttcttgattctatcgtgaaaggtatgaagaatctgctaaactcgactagcctcgagacatcactgtccattgaagccccatggggcgcaataaatgtacagagtacctataagcccacagtctctactgcgaacatcgctttgagctggtcctcagtggagcacagggggaataaagtgctggtctctggacgaagcgaaagtattatgaagttagaggaacgcaccggcatctcctgggacctcggggttgaggatgccagcgagtctaaactgcttacggtgtcagtaatggacctgtcccaaatgtacagtcctgtgttcgaatacttgagcggagaccggcaggtcgaggaatggccaaaggcaacatgcaccggcgattgtcccgagagatgcggttgtacttcgtctacctgcctccataaagaatggcctcactccaggaactggcgttgcaatccgacatggtgttggggagtgggaactggctgcacctgttgcggtctggacgttaaggatctatttacggactatatgttcgtgaagtggaaagtcgagtacattaagacagaggccatcgtgtgtgttgaactgaccagccaggagcgccaatgctcacttatagaagctggcactcggtttaacctcgggagtgtgacaatcaccctgtctgagcccagaaatattcagcagaaattgccacctgaaatcattactctgcatcccaagatcgaggagggattctttgatttaatgcacgtccagaaagtactctccgccagcacagtgtgtaagctgcaatcatgcacccatggcgttccaggggaccttcaggtgtatcacataggaaacctgttgaagggcgatagggtcaatggtcacctcattcataaaatcgaacagcacttcaacacgagttggatgagctgggacgggtgtgatctggactactattgcaacatgggagattggccttcctgtacttacaccggcgtgacacagcataatcacgcatctttcgtaaacctactgaatatcgagaccgactatacaaagacttttcacttccatagcaaacgagtgaccgctcacggtgatacgccccaacttgacctcaaggcccggccaacatacggcgcgggggaaattactgtcctggttgaggtggccgacatggagttgcataccaaaaagatagaaatctccggattaaaatttgctggcctgacatgcaccgggtgctacgcatgttcatctggaattagttgcaaggtgcgcatccacgtcgatgagccggacgaactcactgtgcatgttaagtcggatgaccctgatgtagtggccgctagctcctctctgatggccagaaaacttgagttcggcaccgactcaacatttaaggcattcagcgcgatgcccaaaacgtccctgtgtttttatattgtcgaaagggagtactgcaagagttgtaacaaagaggatactcagaagtgcgtgaataccaagttggaacagccacagtctatcctaatagagcacaaaggtacaatcattgggaagcaaaacaatacctgtactgccaaagctagctgctggctggaatcagttaagtccttcttttatggactcaaaaacatgctgggcggcatcttcgggaatgtgtttattggaatcttcacattccttaccccctttatattactgattctcttctttatgttcggttggcggatcttgttttgtttcaagtgctgtcgaagaacgcgcggcctgtttaagtacaggcacctcaaagacgatgaggaaactgggtatcgtaagatcattgagcggctgaacaataaaaaggggaaaaacagacttctggacggcgagaggttggccgatcgcaagatcgcagaactattcagtacaaagacccatataggttga

SEQ ID NO: 10346 - RNA, 5055 nt, synthetic construct
  misc_feature 1..5055: note = derived and/or modified CDS sequence (opt3) from CCHFV(SPU 187/90)__KJ682814.1__GP
  source 1..5055: mol_type = other RNA
atgcacatcagcctgatgtacgccgtgctctgccttcagctgtgttccttgggcgagacccatagatctcacaacgaaattgggcataataagacagacgtcatgactacgcccggagataacttatcaagtgagcaacctgttagcaccgctctgtccataacaccagacccgtctactgtgacccccacaacccctgcatcgggttcagaaggcagcggggaggtatatacaagttccccaatcactaccgaatctctaagcctccccgagacgactcctgagctgccagccaccacaggaattgattcctcaagtgcgagcggcgtggactcttccactcaggctgccggtgggacctcagcacttacagtcaggaccagcctgcccaatagtccttctacgccatccactccgcaggatacataccaccccgtgcggatcttgctcagcgttaccggacctggcccagaagagacttcgacaccctctggctccgggaaagaatcaagtgccaccagctccctgcatcctatttctgaccgcctgccaacgcccccggctaccgcacagggacctacagagaacaatagccacaacgccactgagcaccccaagccactcacccaatcagctacacctggtttaatgaccagtcccactcagatcgtgcatccacagtccgccacaagcataaccgtccaggatacttatccctctcctaaaaatcgatcaaagcgtaacctggaaatggagatcattcttacgttgagtcaaggcctgaaaaagtactatgggaagatcctaagactcctgaggcttacactggaagaggacaccgaaggattgctcgagtggtgcaaacggaatctgggcttagattgtgacgatactttctttcagaagcgcattgaggagttctttatcaccggtgaagggcacttcaacgaagtgctgcagtttaaaacaccaggaaccctcagcactacagagtccacgccggcggaacttcccaccgcagagcctttcaagtcttactttgccaaaggcttcctgtcgatagacagcggctattactccgctaagtgctactcagggacaagtaattctggattgcagctaattaacatcactagacatagcaccaggattgtagatacaccaggtcccaagatcactaatctgaaaaccatcaactgtattaatctcaaggcctccatatttaaagagcaccgggaagttgagatcaacgtgctgcttcctcaaattgcagtcaacctgtcaaattgccacgtggtgatcaagagccatgtctgtgactattctttggacatagatggcacggttcgcctcccacacatttaccatgaaggggtgttcatccccggaacctataaaatcgtaattgacaagaaaaacaagctgaatgatcgatgcacattatttactaactgtgtgatcaagggcagagaggtcaggaaaggtcagtccgtgctgcggcagtacaagaccgaaattcgtatagggaaagctagtacaggcagccgcagactactctctgaggagccgtccgacgattgcatctcaaggactcaactgcttcggaccgaaacggccgagattcacggagacaattatggcgggcctggagataagatcacaatctgtaacggtagtaccattgttgaccagcgattgggcagcgaactggggtgctacactataaatcgcgtgaaatcgttcaagctctgcgagaactccgcgacaggaaagtcttgtgagatcgatagcgtcccagtgaaatgcagacagggctattgtctgaggattacccaggaaggtcgggggcatgtaaaactttcacgcggcagtgaggttgtgctggacgcctgcgatacttcctgtgaaatcatgattcccaaaggaaccggcgacatcttggtcgactgctctgggggacaacagcactttctcaaggataatctgatagacttaggttgtcctaaaatccccctgctaggcaagatggcaatttacatctgcagaatgagcaaccacccaaagacaacgatggctttcctcttctggttttccttcgggtacgtgattacctgtatcctgtgcaaagccatattttatcttttgattatcattggaactctgggcaagaggttcaaacagtaccgtgagctcaagcctcagacatgtaccatctgcgaaacaactcccgtcaatgctatagatgccgagatgcatgacctgaactgctcatataatatctgtccatactgcgcaagccggttaaccagtgatggtctggcccgacacgtgacgcaatgtccgaaaagaaaggagaaggttgaagagacagaactttatttgaacctcgagaggattccttgggtggtacgcaaactgctacaggtctctgaatccaccggggtggctctgaagcggagctcgtggctcatcgttctgcttgtgttgtttactgtctcactgtctcccgtgcagagtgcgccaattggccatggaaaaaccatcgaggcatacagagccagggagggctatacatccatatgcttattcgtactcgggagcattctgtttgtggtttcttgtcttatgaagggactggtcgacagcgtgggcaattccttctttcccggtttgtcaatctgcaaaacttgtagtatcgggagcattaacggattcgaaatcgagtctcacaagtgctactgttccctcttttgctgtccttactgccgccactgctcagctgataaagaaattcataagctgcacctaagtatatgtaagaaacgaaagaccggcagcaacgtgatgctggccgtctgcaaacggatgtgtttccgtgcaacaatggaggtttccaatagagccctctttatcaggtctattatcaacacgaccttcgtgctgtgcattcttatcttggctgtgtgtgtagtctcgactagcgccgtggaaatggagaatctgccagcaggtacatgggagcgcgaagaggacttaaccaacttctgccatcaggaatgtcaagttactgagacagagtgcctctgtccctatgaagcgctggtgcttcggagacctctgtttctagattcaatagtcaagggcatgaaaaatctcctgaactccaccagtttggagacgtctctgagcatcgaagctccgtggggagccattaatgtgcagtccacttacaagccaaccgtttcaacagcaaacatcgccttatcttggagcagtgtggagcacagggggaataagattctcgtatccggccgaagcgaatctatcatgaaactggaggagcgcaccgggatatcatgggaccttggagtcgaagatgcttccgagagtaagctgttgactgtgagcgtgatggacctctcgcagatgtattctcccgtcttcgaatacctgtccggcgatcggcaggttgaggaatggcctaaagccacatgcaccggtgactgtccagagagatgcgggtgcacaagctcaacttgtctacataaggagtggccccacagtaggaactggcgttgcaatcctacctggtgttggggagtgggcacgggttgcacatgttgcggcctggacgtaaaagatctttttaccgactatatgttcgtgaagtggaaggtcgaatacattaaaactgaggcaatcgtgtgtgttgaactcacctctcaagagcgccagtgctccctgatcgaagctgggacacggtttaacttgggaccggtgactattaccctgagcgagcccagaaatatacagcaaaagttaccacctgagatcattacgctccaccccaggatcgaagagggcttctttgatctgatgcatgtccagaaagtgctttcagccagtacagtttgtaagctgcagagctgcacccacggggtgccaggagacttgcaggtctatcatattggcaacctcctgaaaggtgataaggtaaatgggcacctaatccataagatagaacctcacttcaacacttcctggatgtcttgggacggatgtgatctggactactactgcaacatgggcgattggcccagctgcacatataccggtgtgactcaacacaatcatgcgtcctttgttaaccttctcaatatcgagacagactacaccaaaaacttccactttcattcaaagcgagtgacggcccacggcgatactccacagctggacttgaaagctcggccgacctatggggcaggagagattacagtcttagtggaagtagccgatatggagctgcacaccaagaaaatcgaaatttctggcctcaagttcgctagtctgacatgtactgggtgctacgcctgttcgagcggaatctcctgcaaagtgcgcatacatgtcgacgagcctgacgaacttaccgttcacgtgaagtctgatgaccccgatgtggtcgcagcgtcaagctccctgatggccagaaagttggagtttggcacggacagtattttcaaggctttctctgccatgccaaagacaagcctatgtttttatatcgtggagagggaacattgcaaatcatgttccgaggaagatactaagaaatgcgttaataccaagctggagcagccccagagtatcctcattgaacacaagggtacaatcatagggaaacaaaacagcacctgtactgcaaagacctcttgctggctggagtccgtaaaatcattcttttacggacttaagaatatgttaagcggcattttcggcaacgtgtttatcgggattttcctgtttctcgctcctttcatcttgctgatactctttttcatgtttggatggcggattctgttctgtttcaaatgctgccgaagaacacgcggtctttttaagtataggcatctgaaggacgatgaggaaacgggctaccgtcggatcatcgagagattgaataacaaaaaggggaaaaataagctactggacggagaaaggctcgccgatcgccgaattgcagagttattctcgactaaaacccacatcggctga

SEQ ID NO: 10347 - RNA, 5055 nt, synthetic construct
  misc_feature 1..5055: note = derived and/or modified CDS sequence (opt3) from CCHFV(SPU 48/90)__KJ682813.1__GP
  source 1..5055: mol_type = other RNA
atgcacatcagcctgatgtacgccgtgctctgccttcagctgtgtggcttgggggagacccatagatcccacaacgaaacaggacataataagactgacgtcgctacgacccccggtgataacttatcttcagagcaactggttagtacagcactaagcattactcctgacccatccaccgtgacaccgaccacttctgcctcgggcctcgaagggtcaggagaggtatatacaagcagtctgataaccacggaatccctttctctgttggagactacccccaaactccctacaactaccggcatcgatacaagctccgcgtcagacgtggatagtagcacccaggctgccggtgacacgtctgcactgactgtcaggacatccccaccctcaaatcctagcaccccaagtactccccaggatacacaccatcctatgcggaacctgctctctgtgacctccccagggccggaggaaacgagcaccccctcgggatctggcaaggagtcccctgccacatcaagtccacaccccgttagcaatcgctcccagactcctccagctaccgcacaaggccccacagaagacaactcttacaatgccactgagcacccggagcatttaacccagagcgctacatcagggctgatgaccagtcctactcagattgtgcacccccagtccgccacgagcatcacagtccaagatacctatccatctcctactaaccgatcaaaacgtaatcttgaaatggagattatcttgaccctgagtcagggactaaagaaatactatggtaagatactcagactgcttaggctgacattggaagaggacaccgaaggcctcctggagtggtgcaagcggaacttagggctggattgtgacgatactttctttcagaaacgcatcgaggagttctttattacaggagagggccatttcaatgaagtgctccagtttaagacgcccggtacccttagcactacagagtccaccccagcggaaccccctacagcagagccattcaaatcttactttgccaaggggttcctgtcgatcgacagcggatattactccgctaaatgctactcaggcaccagtaactctggcttgcaactaattaatatcaccagacacagcacgaagatagccgacaccccggggcccaagattacaaacctgaaaactatcaattgtattaacctcaaggcatccatctttaaagagcacagggaagtagagatcaacgttctgcttcctcaggtggctgtcaatctgtcaaactgccatgtggtgattaagagccacgtctgtgattatccattggacatagatggaaccgttcggctcccccatatctaccacgaaggtgtgttcattcctggcacatataaaatcgtaatagacaagaaaactaagctgaatgatcgctgcaccttatttacggactgtgtgattaaggggcgagaggtcagaaaaggacagtctgtgctgaggcaatacaagacagaaatccggatcggcaaaacctccactggtagtcgtcgcctactcagcgaggagccatctgatgactgcatttccagaacacagctgcttaggaccgaaactgccgagatccatggggataactatggcggacccggcgacaagattaccatatgtaatgggtcaacaatcgttgatcagcggttgggaagtgaactgggttgctacacgattaaccgagtgaaatcgttcaagctctgcgagaatagcgcgaccggcaagtcctgtgtcatcgactctgtgccggtaaaatgccgccaggggtattgtctgagaatcactcaagagggaaggggccacgttaaacttagccggggttcagaagtggtcctggacgcctgcgatacaagttgtgagattatgatacctaaggggaccggcgacatcttggtggattgctccggaggccagcagcactttctcaaggacaacctgattgatttagggtgtccaaaaatccccctgctaggaaagatggcaatttacatctgccgcatgtctaatcatcctacaactaccatggctttcctcttctggtttagcttcggttacgtcataacgtgtatcctgtgcaaggccatcttttatcttttgattattatcggcacactggggaaaagattcaggcagtaccgtgaactcaagccccaaacctgtactatatgcgagaccacaccagtgaacgctattgacgccgaaatgcacgatctgaattgctcctataacatctgtccttactgcgcatcacggttaactagcgacggactggcccgacatgttacccagtgtcccaaaagaaaggagaaagtggaggaaacagagctttatttgaatctcgaaaggattccatgggtagtccgcaagctgctacaggtgagtgagtctacgggcgttgctctgaagcggtccagctggctcatcgtgctgcttgtcttgtttaccgtgtcgctgtcaccggtacagtctgcgcctataggtcacgggaaaactatcgaagcatacagagccagggagggctatacaagtatttgcttattcgtgctcggatccatcctgtttgttgtcagctgtcttatgaagcgcctggtggattctgtgggcaacagcttctttcccgggttgtccatttgcaaaacctgttcaatcagtagcataaatggattcgagattgaatctcacaagtgctactgttccctcttttgctgtccatactgccgacattgctcagctgacaaagagatccacaagctgcatctaagtatctgtaaaaagcggaagactggcagcaacgtcatgctggccgtttgcaaacgtatgtgtttcagagcaacaatggaagtgtccgatagggccctctttattcgctctatcattaacaccacgttcgtgctgtgcatacttatcttggctgtatgtgtcgtgtcgactagcgccgttgagatggaaaatctgcccgcaggtacctgggagcgggaggaagacttaacaaacttctgccaccaagagtgtcaggtgaccgaaactgagtgcctctgtccttatgaggcgctggtccttagaaagccactgtttagggattcaattgtgaaagggatgaagaatctactcaactccacaagtctggaaacctctttgagcatcgaggctccctggggagccattaatgttcagtccacatacaaacctactgtgtcaaccgcaaacatcgccctgtcttggagcagtgtagaacatcgaggcaataagatattagtctccggtcgcagcgagtctatcatgaagctcgaagaacggacgggcatttcatgggacctgggggtggaggacgcttccgaaagtaaacttctgacagtgagcgtcatggatttgtcgcagatgtattctccggttttcgagtacctctccggagacagacaagtggaagagtggccaaaggccacttgcactggcgattgtcccgaaaggtgcgggtgcaccagctcaacatgtctgcacaaagagtggcctcacagtcgtaactggcgctgcaatccaacttggtgttggggagtaggcaccggttgcacgtgttgcgggctagacgtgaaggatctgtttacagactatatgttcgtcaaatggaaggtggagtacatcaagaccgaagcaattgtttgtgtggagcttacttctcaggaacggcagtgctccctcatcgaggctggaacaagatttaacctgggccccgtcaccataactttgagcgaacctaggaatattcaacagaaactgccgcccgagatcatcacattacatccacgaattgaggaaggtttctttgatctcatgcacgtgcagaaggttctgtcagccagtaccgtgtgtaaacttcagagctgcacgcatggcgtccctggggacctgcaagtatatcacataggaaacttgctcaagggcgataaagtgaatgggcatctgatccacaagattgagccccacttcaacacttcctggatgtcttgggacggatgtgatctagactactactgcaatatgggcgattggccaagctgcacctatacaggtgttacccagcataaccgggcgtcctttgtgaacctgcttaatatcgaaacagactacactaagaacttccactttcattcaaaacgcgtcaccgcccacggggacacgcctcagctcgatctgaaggctagacccacatatggagcaggcgagattactgtgttggtagaggtggccgacatggaattacacaccaaaaagatcgagatatctggtctgaaattcgctagtctcacatgtaccggctgctacgcctgttcgagcgggatctcctgcaaggtcaggattcatgttgatgaaccagacgagctgactgtgcacgtgaaatctgatgacccggatgtcgtggcagcgtcaagctcccttatggcccggaagctggaatttggaaccgacagtacattcaaggctttctctgccatgcctaaaacgagcttgtgtttttatatcgttgagaaggagtactgcaaatcatgttccgaagaggatactaagaaatgcgtaaataccaagctagaacagccccaaagtattctgatcgagcataagggcacaataattgggaaacagaacagcacctgtactgcaaaggtgtcttgctggctcgaatccgctaaatcattcttttatggactgaaggacatgcttagcggcatcttcggtaatgtctttatcgggattttcttatttctggccccattcatcctcttgatactgtttttcatgtttggatggcgaatcctcctgtgtttcaaatgctgcagacgcacaaggggccttttcaagtaccgtcacctgaaggatgacgaggagaccggctaccggagaattattgaaaggttgaacaataaaaaggggaaaaacaagctactggacggagagcgcctcgcagatcgaagaatcgccgaattattttcgacgaaaactcatataggttga

SEQ ID NO: 10348 - RNA, 5055 nt, synthetic construct
  misc_feature 1..5055: note = derived and/or modified CDS sequence (opt3) from CCHFV(Sudan AB1-2009)__HQ378187.1__GP
  source 1..5055: mol_type = other RNA
atgcacatcagcctgatttacgccatactctgccttcagctgtgtggcttgggggagacccatggatcccacaacgaaacaagacataataagactgacacgatcaccacacccggtgataacttatcttcagagcctagtgtgagcactgctctgtccattaccccagacccgtctacagtcacccccactactcctgcatcgggcctagaagggtcaggagaggtttataccagcccacccatcacgactggcagtctccctctgccaggtaccacacccgaacttcctgccactaccgggacagatacctcctctgcgagcgacgtggattcctcaacgcaaactgctggaggcacattcaccctgactgtaaggacaagtttgccacggagcccgtctaccccctccacgcctcaggacacccaccatccagtgcgcaatctcctgtcagtcacaagccccggccctgatgagacaagtaccccatctgggacaggaaaagagtcccccgccactagctcgccgcaccctgtgtctaaccgacccccaacccctcccgcaacagcccagggtccaaccgaaaatgactcccacaacgctactgagcatcccgaatcactgacgcagagtgcaacaaccggccctatgactagcccaacccaaattgttcacccgcagtccgccacacccatcaccgtgcaggatactcatccttctccaacaaatcgtagcaagagaaacctcgagatggagataatcttaacgctgtcacaggggcttaaaaagtactatggaaaaattttgaggctgctacacctcaccctggaagaggacactgaaggccttctggagtggtgcaagcggaatttgggtctcgattgtgacgatacatttttccaaaagcgcatcgaagagtttttcattaccggggagggacactttaacgaagtcctgcagttcagaacacccggcactttaagtaccacggagtccacccctgctggcctgccaacagccgaaccctttaaaagctacttcgcgaaggggtttctctctatcgactcaggatattacagtgcaaaatgctatagcggtacttccaattctggccttcagctgataaacattaccaggcattcgacacggatcgtggacactccggggcctaagattaccaatttgaaaacgatcaactgtatcaatctaaaggccagcattttcaaggagcaccgcgaagtagagataaacgttctgctcccacaggtggctgtcaacctgtccaattgccatgtggtgatcaaatcacacgtctgtgattacagtcttgacattgatggagccgttcgactgccccatatctaccacgagggcgtgtttatacctggtacatataagattgtaatcgacaaaaagaacaaattgaatgatagatgcaccctcttcactaactgtgtgatcaaggggagggaagtccggaaaggccaatctgtgctgcgtcagtacaagacagaggttcgcattggaaaggcaagcaccggctccagaaggttactgtcagaagaacccagcgacgattgcatctctcggactcagctactccgaaccgaaacagctgagattcacggggacaattatggaggtccaggcgataaaataacgatctgtaacgggtccaccattgtggaccaacgcctgggaagtgagcttggctgctacactatcaatagagtcaagagctttaaattgtgcgaaaactctgccacaggtaagaattgtgagatcgattccgtgcctgtaaaatgcaggcaggggtattgtctgcggattacccaggaaggccgcggacatgttaagctctcaagaggcagtgaggtggtcctggacgcgtgcgacacaagctgtgagataatgatccccaaggggactggagatattcttgtggactgctcgggtggccagcaacacttcctgaaagataacttgatcgacctcgggtgtccaaagattccgctgttaggaaaaatggccatctacatatgcaggatgtccaatcatcctaagaccacgatggcattcctgttttggttctcttttggctatctaatcacatgtattctctgcaaagctatcttctacctgcttattatcataggtaccttggggaagcgtctgaagcagtaccgggaactcaaaccccagacttgtaccatttgcgagacaactccagtcaacgccatcgatgctgaaatgcacgacctgaattgcagctataacatttgtccctactgcgcctcacgattaaccagtgatggcctggcaagacacgtgatccagtgtcctaagaggaaagagaaggttgaagagacagagctttatttgaatctcgaacgcataccatgggtggtacggaaactgctacaagtctccgagtctacgggagtggccctgaagagaagctcctggctcatcgttctgcttgtgttgtttaccgtctcactgagccccgtgcagagtgctcctattggccaggggaagactatcgaagcgtacagggcacgcgagggatatacatctatttgcttattcgtactcggctccatcctgtttatagtgagctgtcttatgaaaggtctggttgactcggtcgggaactcattctttccgggattgtctatttgcaagacctgtagtatctccagcatcaacggcttcgaaattgagtctcataaatgctactgtagcctcttttgctgtccatattgccgacactgctccactgataaggagatccataaactgcacctatcaatttgtaagaaacggaagacaggtagtaatgtgatgctggccgtgtgcaagcgtatgtgtttcagagctaccatggaagtcagcaacagggccctctttatacgctctatcattaatacgactttcgttctgtgcatccttattttggcagtgtgtgtggtatccacctcagccgtcgagatggaaaacctgcccgctggcacatgggagcgggaagaggacttaaccaatttctgccatcaggagtgtcaagtgactgaaacagagtgcctctgtccttacgaagccctggttcttagaaaaccactgtttctagatagtatcgcaaaggggatgaaaaacctcctgaatagcacctccttggagacatctctgtcgatagaggcgccctggggagctatcaacgtgcagagcacttacaagcctaccgtctcaacggccaatattgcattatcctggagttctgtggaacacaggggcaacaaaatcctcgttagcgggcgatccgagtcaattatgaagctggaggagcgcacaggaatctcttgggaccttggcgtggaagatgccagcgagagtaagctgttgaccgtatccgtcatggacctcagccagatgtattctccggtgttcgagtacctgtcaggtgaccgacaggtggaagagtggcccaaagctacttgcaccggggattgtccagaaagatgcggatgcacatccagtacttgtctacacaaggagtggcctcatagcaggaattggcgttgcaaccccacctggtgttggggcgtcggtacgggctgcacatgttgcgggctggacgttaaagatctttttaccgactatatgttcgtgaagtggaaagtagaatacataaagactgaggccattgtgtgtgtcgagctcacatcgcaagaacgccagtgctctctgatcgaggcaggaacccggtttaatttgggcccagtgactatcacactgtccgaacctagaaacattcagcaaaagttacccccagagataatcaccctccacccgaggattgaagaggggttctttgatctgatgcatgttcagaaagtgcttagcgcttcaacggtctgtaagctgcagagttgcactcacggagtgcctggcgacttgcaggtttatcatatcggtaatctcctgaaaggggataaggtgaacggacacctaattcacaaaatcgagccccatttcaacacctcttggatgtcctgggacggctgtgatctggactactattgcaatatgggtgattggccaagctgcacatacaccggcgtcacacaacacaaccatgcctcatttgtaaatcttctcaacatagaaactgactacaccaagaatttccactttcacagtaagcgagtgacggcgcatggggatacaccccagctggacttgaaagcccggcctacttatggagctggcgagatcaccgttttagtggaagtcgcagacatggagctgcacacaaagaaaattgagatcagcgggctcaagttcgcctccctgacctgtactggatgctacgcttgttctagcggcatttcctgcaaagtgcgcatccatgtagatgaaccagacgagcttaccgtgcacgtcaagtcagatgaccccgatgttgtggccgcatctagttcgctgatggcgagaaaattggaatttggtacagacagcacgttcaaggccttctccgctatgcctaagacttctctatgtttttatatagtggagagggaacattgcaaatcatgtaacgaggaggataccaagaaatgcgtcaatacaaagctggaacagccgcagagcattctcatcgagcacaaagggaccatcattggaaagcaaaactccacttgtacagcccgggcaagttgctggctggaatctgttaagagcttcttttacggccttaaaaatatgttatcaggcatcttcgggaacgtgtttatgggaatattcctgtttctcgctccattcattttgctgatcctctttttcatgtttggttggcggattctgttctgtttcaagtgctgcagacgcaccaggggcctttttaaatatcgtcacctgaaggacgatgaggaaacggggtaccggagaatcatagagaggttgaataacaaaaagggaaagaataaactactggacggcgagcgcctcgccgatcgaagaattgcagaattattctccactaagacacatatcggttga

SEQ ID NO: 10349 - RNA, 5055 nt, synthetic construct
  misc_feature 1..5055: note = derived and/or modified CDS sequence (opt3) from CCHFV(Sudan Al-Fulah 9-2008)__HQ378185.1__GP
  source 1..5055: mol_type = other RNA
atgcacatcagcctgatgtacgccgtgctctgccttcagctgtgtggcttgggggagacccatagatcccacaacgaaacagtccataataagactgacattgttacgaccccctctgatgacttatcaagtgagcaactggtgagcacagctctatccataactcctgatccatctaccgtaacaccgaccacttcggcatcaggactcgaaggtagcggcgaggtgtatacaagttcccccatcaccacggaatctctgagccagcctgagactaccccaaaacttcccgccacaactgggattgacacctcctcagcgagtgatgtcgacagctctacacaggctgccggagatacctccacgctgactgtgaggacatcacctccaaacagccccagtaccccttctactccacaggacacacaccatccgatgcggaatttgctctccgttaccagccccggccctgaggaaacgtcgaccccatctggttccgggaaggagtcaagtgcaacaagctctccccaccctgtgtccaaccgcccacaaactcccccggccaccgctcagggacctacagaagataatagccacaacgcaactgagcatcccgagcacctgacccagtcagccacaagtggcccaatgacctcccctactcagatcgtccatccccaaagcgctacgacaattaccgtgcaggacacttacccatctcccaccaatcgatcaaaacgtaacctggaaatggagatcatactcacattaagtcagggcctgaagaaatattacgggaagatccttagattgctgaggctaaccctcgaagaggatactgaaggactgcttgagtggtgcaagcggaatctgggtttggactgtgatgacacattctttcagaaacgcattgaggagttctttatcacgggcgaggggcacttcaacgacgtactccaatttaagacccctggaactctgagcacaaccgaatccacaccagccaaaccgcccactgcggagcctttcaagtcttattttgcaaaaggcttcttaaccattgattcgggttactatagcgccaagtgctactccgggacgtcaaatagtggactgcagctcatcaacataaccagacactctacaaggattgttgacactccaggccccaagatcaccaatcttaaaacaattaactgtatcaatctgaaggctagcatctttaaagaacatcgggaggtggagattaacgtcttgctacctcaggtggccgtgaacctgtccaattgccacgtcgttataaagtcacatgtgtgtgattacccactcgacatcgatggcactgtacgcctgccccacatttatcatgaaggggtgttcatcccgggaacctacaaaatagtcattgacaagaaaaacaaacttaatgatcgatgcacgctgtttacagactgtgtgatcaagggtagagaggttaggaagggccaaagcgtgttgcggcagtataagaccgaaatccgtattgggaaagcatctactggatcccgcagactcctgagtgaggaacctagcgatgactgcatctctaggacacagttactgcggaccgagactgctgagattcacggcgataactacggtgggccaggcgacaagataaccatctgtaatggatccacaattgtcgaccagcgactaggctcagaactcgggtgctatacgatcaaccgcgtgaaaagtttcaagctgtgcgagaatagcgccaccggaaagtcgtgtgtaatcgattccgttcccgtgaaatgcagacaaggttactgtcttaggattactcaggaaggccgggggcacgtcaagttgtctcgcggaagcgaggtggtcctggacgcgtgcgatacatcatgtgagataatgatccctaaaggcaccggtgacattctcgtggattgcagtgggggccagcagcattttctgaaggacaaccttgttgatctgggatgtcccaaaatcccattgctcggcaagatggccatttatatctgcagaatgtccaatcaccctaagacaactatggcattcctgttctggttttctttcgggtacgtgataacctgtatcttatgcaaagctatcttttacctgctaattattatcggaacgctcggtaagaggttccgtcaatatcgggaactgaaaccccagacatgtaccatatgcgagactaccccagtaaacgccattgacgctgaaatgcatgatcttaattgcagctacaacatctgtccgtattgcgcctcccgattgacatcagacggcctggcaagacacgtcactcagtgtcctaagaggaaagagaaggtggaagagaccgagctctacctgaatttagaacgcattccctgggttgtgcggaagctgcttcaggtcagcgagagtacaggggtggccttgaaaagatcttcctggctcatcgtactgctagtgctgtttacggttagcctctcgccagtccaatcagctcccataggacacggcaagaccatcgaagcgtatagggcacgcgagggttacacttctatttgcctgttcgtgcttgggagtatcttgtttattgtgtcctgtctgatgaaaggcttagtcgatagcgttggaaactctttctttcctggcctcagcatctgcaagacatgttccatatcaagtattaatgggttcgaaatcgagagccataaatgctattgttctctgttttgctgtccatactgccgacactgctccgccgacaaggagatccataaacttcacctgtcaatttgtaagaagcggaaaaccggaagtaacgtgatgttggctgtgtgcaagcgtatgtgtttcagagccactatggaagtaagcaacagggcactctttatccgctccattataaatacaaccttcgtcctgtgcatcctaattctggccgtgtgtgttgtgtctacgtcggctgtcgagatggaaaacctccccgccggcacttgggagcgggaagaggatctgaccaatttctgccatcaggagtgtcaggtgacagaaaccgagtgcctttgtccttacgaagcattggttctgagaaggccgttatttctcgacagcatcgtgaaaggtatgaagaacctgcttaattcaacttccctggagacaagtctatctattgaggcgccatggggagctatcaacgtacagagcacctataaacccacagtctccactgccaatatagcactctcatggtctagcgtggaacaccgagggaacaagatcctggtgagtggccgctccgagagcattatgaagttggaagaacggaccggtatctcttgggacctgggcgtcgaagatgcctcagagtccaaattactcacggttagtgtgatggacctgagccaaatgtactcgcctgtattcgagtatctttctggggatagacaggtggaagagtggccaaaggctacatgcaccggagactgtcccgaaaggtgcggctgcacttccagcacctgtctgcacaaagagtggcctcattcacgtaattggcgctgcaacccgacatggtgttggggagtcgggactggctgcacctgttgcggtttggatgtgaaggacctctttacggattacatgttcgttaaatggaaggtggaatatattaagacagaggccatcgtctgtgtggagctgaccagtcaggaacggcaatgctctctaatagaggcagggactagatttaatctgggacccgttacaattaccctttccgaaccaaggaacatccagcagaaactccctcccgagatcattactctgcacccacgaatagaagagggcttctttgacttgatgcatgtgcagaaggtcctgagcgcttcaacagtatgtaaattacaaagttgcacccacggtgtgcctggcgatctccaggtttaccatatcgggaatctgcttaagggagacaaagtgaacggccacctgattcacaagatcgagccccatttcaatacgagctggatgtcctgggatgggtgtgacttggattattactgcaacatgggagactggccatcttgcacttacaccggcgtcacacagcacaaccatgccagctttgtgaatctcctgaacattgaaaccgactatacaaagaatttccactttcactccaaacgggtaactgcgcatggtgataccccgcagctagacctgaaggcccgccctacgtacggggctggagagatcacagtgcttgtcgaagttgcagatatggagctccacactaaaaagatagagatctcaggcctgaaattcgcctctttgacctgtacaggttgctatgcttgtagttcgggcattagctgcaaggtgagaatccatgtggacgaacccgatgagttaaccgtccacgtgaaatccgacgatccagacgttgtagccgcatcttcaagcctgatggcgaggaagctcgaatttgggactgattccaccttcaaggccttcagtgctatgcccaaaacatctctgtgtttttacattgtggagaaggaatattgcaaaagctgttcagaggaggacacgaagaaatgcgtcaacactaaacttgaacaacctcagtccatcctgatagagcataagggaaccattatcggcaagcagaatagtacatgtaccgccaaggtgagctgctggttggaatctgcaaaatccttcttttacgggctaaaggatatgctgtcaggaatcttcggcaacgtttttattggtatcttcctctttctggctccattcgtgcttttagtcctgtttttcatgtttgggtggcggatactcttgtgtttccgatgctgcagacgcactaggggactgttcaaatatcgtcacctcaaggacgacgaggaaacaggctaccggagaattatcgagaggctgaataacaagaaaggcaagaataaacttctggatggggagcgcttggccgaccgaaagattgcagaactatttagcaccaaaacgcacatcggatga

SEQ ID NO: 10350 - RNA, 5055 nt, synthetic construct
  misc_feature 1..5055: note = derived and/or modified CDS sequence (opt3) from CCHFV(SPU4/81)__DQ157175.1__GP
  source 1..5055: mol_type = other RNA
atgcacatcagcctgatgtacgccgtgctctgccttcagctgtgtggcttgggggagacccatggatcctataacgaaacaggtcacaataagactgacgtcatgacgacccccggcgataacttatcttcagagcaacctgttagtacagctctgagcattactccagacccgtccaccgtgacacccaccactcctgcaaatgggctagaaggatctggcgaggtatacacatcgtcaccaataaccacggaaagcctcagtctgcccgagactacccctgagcttccagccacagcgggtatcgatacttcctctgctagcgacgtggattcctcaacccaggccgcagggggaacaagtgcccccaccgtcagaacgagcctgcctaactctccatccactccgtcaacaccccaggaaacccatcaccctgtgaggaatttgctcagcgttaccagtctgggcccagaggaaacatctaccccctccggccctgggaaagagagctcggctacgtcttccccacatcccgtgtcaaacaagccgcctactcccccagcacgggcccagggacctacagagaataacagtcacaatgctactgaacaccccgagccactgacccaaagcgccacacccggtctcatgacttcccctacccaggtcgtgcatccacagtctgcgacaagcattaccgtacaggacacttatccgtcacccacgaaccgcagtaaacgaaatttagaaacagagatcattctgaccctttcccaaggcttgaagaaatactatgggaagatcctgcgtctactcagactgactcttgaagaggataccgagggactgttggaatggtgcaagaggaacctcggcctggactgtgatgacacattctttcagaaacggatagaggagttctttatcaccggtgaagggcacttcaatgaagttttacagtttaagactcctggaacactgagcacgaccgagtctactccagcagagctccccacagccgaacctttcaaatcatactttgctaagggcttccttagtattgatagcggctattactccgccaaatgctactctgggacctcgaacagcggactgcagttgatcaatattacacgccattccactagaatcgtggacaccccaggtcccaagataacgaacctaaagaccattaactgtatcaatctgaaagcatcaatttttaaggagcacagggaagtcgagatcaacgtgctcctgccgcaagctgccgtgaatcttagtaactgccacgtcgttatcaaatctcatgtgtgtgattatagcctggacattgacggcacagtacggttgcctcacatataccatgaaggggtgttcatcccaggaacttataagattgtcatcgataaaaaggacaaactcaatgatcgctgcaccctgtttacagactgtgtgataaagggccgagaggttagaaagggtcagtccgtgttaaggcagtacaaaactgagattcggatcgggaaggcgtcaatcggcagccgtcgcctgctatctgaggaaccctccgatgactgcattagtagaacccaactcctgaggacggaaacagccgagatccacggagataactatggcgggcctggagacaaaattaccatatgtaatggtagcactatcgtcgatcagcggcttggctctgagttggggtgctacacaattaaccgagtgaagtccttcaaactgtgcgaaaattcagcaaccggaaagagttgtgagatcgaaagcgtacccgttaagtgccgccagggctattgtctcagaatcactcaggagggtagggggcatgtgaaactgtcgcggggctccgaagtcgtgcttgacgcttgcgatacctcttgtgagattatgataccaaagggaacaggcgacatcctggtcgactgcagcgggggacaacagcactttttgaaagataacctcattgacctgggttgtcctaagatccccttactgggcaaaatggccatttacatctgccgcatgtcaaatcacccaaagacgaccatggctttcctattctggtttagtttcgggtacgtgataacttgtatcctctgcaaggccatcttttatctgcttattattatcggaacattgggcaaaagattcaagcagtacagggagctgaaaccgcagacctgtacaatatgcgaaactacccctgttaacgcaattgatgccgagatgcatgacctcaattgctcctataacatctgtccctactgcgcttctcgtctgacgagcgatggtttagcgcggcacgtgacacaatgtccaaagcgaaaagaaaaggtagaggaaaccgagctgtatcttaatttggagaggattccctgggtcgtgagaaagctcctgcaggtttccgaatcaactggggtggcactaaaacgcagcagttggctgatcgtcctcctggtgctttttaccgtatctttgtcccctgtgcagagcgccccaataggccatggaaagacaatcgaggcttaccgggccagagaaggctatacttcgatttgcctgttcgttttagggtcaatcctctttattgtctcttgtctgatgaaaggacttgtggacagtgtgggcaactccttctttcccggtctgagcatctgcaagacctgttctataagctccattaacgggttcgagatcgaatcacacaaatgctactgtagtttgttttgctgtccttactgcaggcactgcagcgcagataaggagatccataaactccacctgtctatttgtaagaagcgcaaaacaggatccaatgtcatgctagccgtttgcaagcgaatgtgtttccgggctacgatggaggtgtcaaaccgtgccctgtttatcagaagtattataaataccactttcgtgctctgcatcctgattcttgcagtatgtgtcgtgagcacatccgcggttgaaatggagaacttgccggctggcacctgggaaagggaggaggacctgactaatttctgccatcaggaatgtcaagtgacagagaccgaatgcttatgtccatatgaggccctcgtcctgcgcaaacccctttttctggattctatcgtgaagggtatgaaaaacctactcaattcgacgagcctggaaacttcattgtccattgaggcaccttggggcgccatcaacgttcagagtacctacaagccaacagtgtctaccgctaatatagccctgagctggtcctcagtagagcaccgggggaacaagatcttagtctctggaagaagcgaaagtattatgaaactcgaggaaaggactggcatctcctgggacctgggggtggaggatgcaagcgaatctaaacttctgacagtgtcagtcatggacttgtcccagatgtatagtcccgttttcgagtacctcagcggagatcgacaggtggaggaatggcctaaggctacctgcacaggcgactgtccggagcgctgcggttgcacttcgtctacctgtctgcataaggaatggccccactcccggaattggagatgcaacccaacgtggtgttggggagtagggacaggctgcacctgttgcggtctagacgtgaaagatctgtttactgactatatgttcgtcaagtggaaggtggagtacattaaaaccgaagccatcgtttgtgtggagcttacaagccaagagaggcagtgctcactcatagaagcgggcactcgttttaatctggggcctgtcaccattacgttgagtgagccccgcaacatccagcaaaagctgccacctgaaatcattacattacacccccggatagaggagggattctttgatctcatgcatgtgcagaaagttctgtctgcctccaccgtgtgtaaacttcagagctgcactcacggcgtcccaggggacctgcaggtatatcatatcggaaatttgctcaagggcgataaggtgaacggtcacctgattcataagatcgaaccgcacttcaacacatcatggatgagttgggacgggtgtgatctagactactactgcaatatgggagattggcctagctgcacctatactggcgttacacaacacaaccatgcttcctttgtgaatctgcttaacattgagaccgactacacgaaaaatttccactttcattctaagagagtcactgcacacggtgatacaccccagctcgacctgaaagccaggccaacctatggcgctggggaaatcaccgtgttggtagaggtggccgatatggaattacacacaaagaaaatagagatcagcggactgaagttcgcatccctcacttgtaccggctgctacgcgtgttcatctgggattagttgcaaagtccgaatccatgttgacgagcccgacgaactgacggtgcacgtgaagtcggatgaccctgatgtcgtggccgctagctcctctcttatggcccggaagctggagtttggaacagactcaactttcaaagcattcagcgctatgccaaagacctccttgtgtttttatattgttgaacgcgagcattgcaaaagttgttctgaagaggatacaaagaaatgcgtaaacaccaagctagagcagccccagagcatcctgatagaacacaagggcactattatcggtaaacaaaattcaacctgtacagccaaggcatcctgctggctcgagagtgtgaaatctttcttttacgggctgaagaacatgcttagcggaatcttcggcaatgtctttattggcatcttcttatttctggggcctttcatactcttgattctgtttttcatgtttggatggagaatcctcttctgtttcaaatgctgcaggcggacgcgaggtctgcttaagtatagacatctgaaggaagacgaggaaactggctaccgcaggattatcgagcgtttgaacaataaaaaggggaaaaacaagctactggatggagagcggctcgccgacagaaggatagctgaattattttccaccaaaacacacattggctga

SEQ ID NO: 10351 - RNA, 5055 nt, synthetic construct
  misc_feature 1..5055: note = derived and/or modified CDS sequence (opt3) from CCHFV(NIV 11703)__JN572086.1__GP
  source 1..5055: mol_type = other RNA
atgcacaccagcctgatctacgtggtcctctgccttcagctgtgttccttgggcaagacacatgggtctcacaacggaactgagcataataaaacggacgttatgaccacacccggtgataaccaatcacctgaaccattagtgagtactgccctgccggtaacccccgaccctagcacagtgaccccaactgctcccgcatccggcctagaggggtctggagaagtctatacatcgtcaagcattaccacgaagggcctcagtctgcctaaagccacttccgagcttctggcgaccacaggtatggtgacttctagcgcttccgatatagacccatcaacccaggccgcaggggatacacccacccctacggttagaacaagtttgccaaatagcccgtctacaccctccacctcacaggacactcaccatcctgtgaggaacctcctgagcgtcacaagtccaaagcccgaagagacccctacgccatctaaatccgataaggacagctcggccaccaattctccccacccggctgcatcccggctgtcaacacctcccactaccgatcagggaccaacagagaacaataaccacaatagtactgaacaactcgagagcttaacccgctccgccacatctagctcaatggtgagtctgacccagactgtacttcctcagtccgctacgagcatcgccacacaggacacccatccctctccaactaaccgatcaaagcgtaatttggaaatggagattatcctgaccctaccccaaggcctcaaaaagtactatggcaaaattctgaaacttctgcacttgacactcgaggaagataccgaggggctgttagaatggtgcaagagaaacctgggactcgactgtgatgacactttctttcagaagaggatcgaggagttctttataacaggtgagggccatttcaatgaggttcttcagtttcgggcgcctgggacgctgagtaccactgaaccaacacacgcaggaagcccgaccgccgagcccttcaagtcctactttgctaaaggcttcttgtctatcgactcgggttattttagcgccaagtgctactcccgcacatcaaacagtgggctacagctgattaatgtgactagacactctaccaggatcgcagatacgcctggaccaaaaattaccaacctcaagacaatcaactgtataaatctgaaagctagcgtcttcaaggaacatcgggaggtggaaattaacgtgcttctgccccaagtcgccgttaatttgtccaactgccacgtggcgatcaaatcacatgtatgtgactatagcctcgatactgacggcgccattcgcctgcctcacatccattacgagggcacctttatcccagggacatacaagattgtgatagataagaaaaataagttaaacgaccgatgcactctgttcaccaattgtgtcatcaaaggaagagaggtgaggaagggtcagtctgttctacggcagtataaaacggaaattcgtatcggccgcgcatccacagggagtagaaggctcctgagcgaggaatctggagatgactgcatatcccggacccaacttttgcgaactgagacagctgaagtgcacggcgataactacggtgggcccggcgacaagattaccatctgtaatggatcaactgtcgtggatcagcgcctgggcagtgagctcgggtgctataccatcaacagagtaaagagctttaaactgtgcgaaaattcggccacaggaaagtcctgtgaaattgactctatcccggttaaatgcaggcagggttactgtcttaagattacgcaggagggccgggggcacgtgaaactgagccgcggatcagaagtcgtgttggacgcttgcgatagttcctgtgaggtcatgatacctaagggcaccggtgacatcctcgtggattgctctgggggccaacagcatttcctgaaggacaacttaattgatctgggatgtccaaaaatccccctactcggcaagatggccatctatatttgcagaatgagcaatcaccctaaaactacaatggcattcctgttttggttctcctttgggtacgttataacctgtatcctttgcaaggtgattttctatttgctgatcatttttggaacactcggtaaaaggttcaagcagtaccgtgagctgaagccccagacttgtaccatctgcgaaacgacaccagtaaacgccatagacgctgagatgcatgatttaaattgctcatacaacatctgtccttattgcgcgagccggctgaccagtgacggccttgcacgacacgtcactcaatgtcccaaaagaaaggaaaaagtggaggaaaccgagttgtacctcaacctggagaggattccatgggttgtgcgcaagctactgcaggtctctgaatccacagggatcgccctcaaacggagctcgtggctgattgtgcttttggtactgtttactgtgtcaatcaccccggttcagtctgctcctataggacacggcaagacaattgaggcctatagagcaagggaagagtacacgagtatctgcttattcgtcctcggttccgtgctgtttgtggtcagctgtcttatgaaagggctggttgattctgtgggcaatattttctttcccggattgttcatctgcaagacctgtagcataggctccatcaacgggtttgaaattgagtcacataagtgctattgtagtctcttctgctgtccatactgccgccactgcagcgccgaccgagagatccatcagctgcacctatctatttgtaaaaagcggaaaactggatccaatgtgatgctggctgtatgcaagcgtatgtgtttcagaacaaccatggaagtctcaaacaaagccctctttgtgaggagtatcataaatactacattcgttgtgtgcattctgatccttgcagtctgtgtggttagcacctccgcggtggagatggaatctttgcccgctggcacgtgggagcgcgaagaggatctgactaacttttgccatcaagagtgtcaggtaaccgaaacagagtgcttatgtccttatgaagccctcgtcctgcggagaccacttttcctggactcgatcgtgaagggtatgaagaatctactcaacagcacctcactggagacttccttgagtattgaggcaccctggggagccatcaatgtgcagtctacatacaaacctaccgtcagcgctgccaacattgcactgtcctggtcatctgttgaacacagggggaataagatattagtgagcggccgaagtgagtccatcatgaaactcgaggaacgcacaggtattagctgggatctgggcgtagaagacgcttctgagtcaaaacttctgactgtgtccgtcatggacttgagtcagatgtacagcccggtgtttgagtatctctcgggggatcggcaagttgaagagtggccaaaggcaacctgcacgggagactgtcccgaaagatgcggctgcacatcttccacctgtctgcacaaggagtggcctcatagcaggaactggcgttgcaatccaacttggtgttggggagtggggaccggctgcacatgttgcggtctagatgtcaaggacctgttcactgattacatgtttgtgaaatggaaggttgaatatatcaaaaccgaggcgattgtgtgtgtcgagcttacgtcacaggaacgccagtgcagtctcatcgaggccgggacacggttcaacctgggatctgtaaccataactttgtccgaacccagaaatatccaacagaagctgcctccggagattatcacattacaccccaggattgaagagggctttttcgacctcatgcatgtgcagaaagttctgagcgcttcaaccgtgtgtaaacttcagagttgcactcacggtgtcccaggcgatctgcaagtgtaccatatcgggaacttgctcaagggagaccgagtaaacggccacctgatacacaagattgagcagcatctaaatacaagctggatgtcctgggatgggtgtgacctggattattactgcaacatgggagactggccttcttgcacctatacgggcgtgactcagcacaatcatgccagctttgtcaaccttctcaatatcgaaaccgattacacaaagaccttccactttcactccaaacgggttacagcccatggtgacactccccagctggacttgaaggctcgcccaacctacggggccggagagatcacggtgttagtggaagtcgcagatatggagctgcacactaaaaagattgagatatcaggcctcaaattcgcgtctctgagttgtactggttgctatgcctgttcgagcggcatctcctgcaaggtgaggattcatgttgacgaacctgatgagcttaccgtacacgtgaagtctgacgatcccgacgtcgtggctgcctcaagctccctgatggcaagaaaattggaaagtgggacagattctaccttcaaggcttttagcgccatgccaaaaacttcactatgtttctacatcgttgagcgggaatattgcaagggatgttccaaagaggacacccaaaagtgcgtgaacacaaagctggagcagccgcagagtattctcatcgaacataaaggcacgataatcgggaagcagaataacacttgtaccgcaaaagccagctgctggctggagtctgtcaagtcctttttctacggacttaaaaatatgttatcaggcatttttggtaacgtgttcctggggatctttagcttcctcgctccttttgtattgctgattctcttctttatgttcggatggcgaatcctgttctgttttaagtgctgcagacgcacaaggggccttttcaagtatcgtcacctgaaagatgacgaagagaccggctaccggaagataattgaaagattgaataacaaaaaggggaaaaataagctactggatggagagaggctcgcggaccgcaagatcgccgagttattttcgactaaaacacacatcggttga

SEQ ID NO: 10352 - RNA, 5055 nt, synthetic construct
  misc_feature 1..5055: note = derived and/or modified CDS sequence (opt3) from CCHFV(NIV 112143)__JN572085.1__GP
  source 1..5055: mol_type = other RNA
atgcacaccagcctgatctacgtggtcctctgccttcagctgtgttccttgggcaagacacatgggtctcacaacggaactgagcataataaaacggacgttatgaccacacccggtgataaccaatcacctgaaccattagtgagtactgccctgccggtaacccccgaccctagcacaattaccccaactgctcccgcatccggcctagaggggtctggagaagtgtatacatcgtcaagcataaccacgaagggcctcagtctgcctaaagccacttccgagcttctggcgaccacaggtatggtcacttctagcgcttccgatatcgacccatcaacccaggccgcaggggatacacccacccctacggtgagaacaagtttgccaaatagcccgtctactccctccacctcacaggacactcaccatcctgttaggaacctcctgagcgtgacaagtccaaagcccgaagagacccctacgccatctaaatccgataaggacagctcggccaccaattctccccacccggctgcatcccggctgtcaacacctcccactaccgatcagggaccaacagagaacaataaccacaatagtactgaacaactcgagagcttaacccgctccgccacatctagctcaatggtcagtctgacccagactgtgcttcctcagtccgctacgagcattgccacacaggacacccatccctctccaactaaccgatcaaagcgtaatttggaaatggagatcattctgaccctaccccaaggcctcaaaaagtactatggcaaaatcctgaagctgctgcacttgacactcgaggaagataccgaggggctgttagaatggtgcaaaagaaacctgggactcgactgtgatgacactttctttcagaagaggatagaggagttctttatcacaggtgagggccatttcaatgaggtacttcagtttcgggcgcctgggacgctgagtaccactgaaccaacacacgcaggaagcccgaccgccgagcccttcaagtcctactttgctaaaggcttcttgtctattgactcgggttattttagcgccaagtgctactcccgcacatcaaacagtgggctacagctgatcaatgttactagacactctaccaggattgcagatacgcctggaccaaaaatcaccaacctcaagacaataaactgtattaatctgaaagctagcgtgttcaaggaacatcgggaggtcgaaatcaacgtgcttctgccccaagtggccgtcaatttgtccaactgccacgttgcgattaaatcacatgtgtgtgactatagcctcgatactgacggcgccatccgcctgcctcacatccattacgagggcacctttattccagggacatacaagatagtaatcgataagaaaaataagttaaacgaccgatgcactctgttcaccaattgtgtgattaaaggaagagaggtcaggaagggtcagtctgtgctacggcagtataaaacggaaatccgtataggccgcgcatccacagggagtagaaggctcctgagcgaggaatctggagatgactgcatttcccggacccaacttttgcgaactgagacagctgaagttcacggcgataactacggtgggcccggcgacaagatcaccatctgtaatggatcaactgtggtcgatcagcgcctgggcagtgagctcgggtgctataccattaacagagtaaagagctttaaactgtgcgaaaattcggccacaggaaagtcctgtgaaatcgactctattccggtgaaatgcaggcagggttactgtcttaagataacgcaggagggccgggggcacgttaaactgagccgcggatcagaagtggtcttggacgcttgcgatagttcctgtgaggtgatgatccctaagggcaccggtgacattctcgtcgattgctctgggggccaacagcatttcctgaaggacaacttaatcgatctgggatgtccaaaaatccccctactcggcaagatggccatttatatatgcagaatgagcaatcaccctaaaactacaatggcattcctgttttggttctcctttgggtacgtgatcacctgtattctttgcaaggttatcttctatttgctgattatctttggaacactcggtaaaaggttcaagcagtaccgtgagctgaagccccagacttgtaccatatgcgaaacgacaccagtgaacgccatcgacgctgagatgcatgatttaaattgctcatacaacatttgtccttattgcgcgagccggctgaccagtgacggccttgcacgacacgtaactcaatgtcccaaaagaaaggaaaaagtcgaggaaaccgagttgtacctcaacctggagaggatcccatgggtggttcgcaagctacttcaggtgtctgaatccacagggattgccctcaaacggagctcgtggctgatcgtccttttggtgctgtttactgtatcaataaccccggtgcagtctgctcctattggacacggcaagacaatcgaggcctatagagcaagggaagagtacacgagtatttgcttattcgttctcggttccgtcctgtttgtggtgagctgtcttatgaaagggctggtcgattctgttggcaatatcttctttcccggattgttcatatgcaagacctgtagcatcggctccattaacgggtttgaaatcgagtcacataagtgctattgtagtctcttctgctgtccatactgccgccactgcagcgccgaccgagagattcatcagctgcacctatctatctgtaaaaagcggaaaactggatccaatgtgatgctggctgtgtgcaagcgtatgtgtttcagagccacaatggaagtatcaaacaaagcactctttgtcaggagtataattaataccactttcgtggtttgcatcctgatccttgcgatttgtgtggtcagcacatccgctgtggagatggaatctttgcccgccggcacctgggagcgcgaagaggatctgacgaacttttgccatcaagagtgtcaggttactgaaaccgagtgcttatgtccttatgaagcactcgtgctgcggagaccacttttcctggactcgatcgtaaagggtatgaagaatctactcaacagcacatcactggagacctccttgagtattgaggccccctggggagctataaatgtccagtctacttacaaacctacagtgagcgccgcaaacatcgctctgtcctggtcatctgtggaacacagggggaataagattttagtcagcggccgaagtgagtccatcatgaaactcgaggaacgcaccggtattagctgggatctgggcgttgaagacgcctctgagtcaaaacttctgacagtgtccgtaatggacttgagtcagatgtacagcccggtgtttgagtatctctcgggggatcggcaagtcgaagagtggccaaaggcgacttgcaccggagactgtcccgaaagatgcggctgcacgtcttccacatgtctgcacaaggagtggcctcatagcaggaactggcgttgcaatccaacctggtgttggggagtggggactggctgcacctgttgcggtctagatgttaaggacctgttcacagattacatgtttgtgaaatggaaggtcgaatatatcaaaactgaggccatagtgtgtgttgagcttacctcacaggaacgccagtgcagtctcatcgaggctgggacgcggttcaacctgggatctgtgacaattaccttgtccgaacccagaaatatccaacagaagctgcctccggagattatcactttacaccccaggatagaagagggctttttcgacctcatgcatgtccagaaagtactgagcgcatcaacagtgtgtaaacttcagagttgcacccacggtgttccaggcgatctgcaagtgtaccatattgggaacttgctcaagggagaccgagtcaacggccacctgatccacaagatcgagcagcatctaaatactagctggatgtcctgggatgggtgtgacctggattattactgcaacatgggagactggccttcttgcacatataccggcgtgacgcagcacaatcatgccagctttgtaaaccttctcaatattgaaactgattacaccaagacattccactttcactccaaacgggtgaccgctcatggtgacacaccccagctggacttgaaggcccgcccaacttacggggcaggagagataaccgtcttagttgaagtggcggatatggagctgcacacgaaaaagatcgagatttcaggcctcaaattcgcctctctgagttgtacaggttgctatgcttgttcgagcggcatctcctgcaaggtgaggattcatgtcgacgaacctgatgagcttactgtgcacgttaagtctgacgatcccgacgtagtggccgcatcaagctccctgatggctagaaaattggagttcgggaccgatagtacatttaaggccttctctgcaatgccaaaaaccagcctatgtttttacatcgtcgaacgggaatattgcaagggatgttcaaaagaggacactcaaaagtgcgtgaacaccaagctggagcagccgcagtccatactcatcgaacataaaggcacaattatcgggaagcagaataacacgtgtactgccaaagctagttgctggctggagagcgttaagtctttcttttacggacttaaaaatatgttatccggcattttcggtaacgtgtttctggggatcttctcatttctcgcgcctttcgtcttgctgatactctttttcatgttcggatggcgaatcctgttttgtttcaagtgctgcagacgcaccaggggcctttttaagtatcgtcacctgaaagatgacgaagagacaggctaccggaagattatcgaaagattgaataacaaaaaggggaaaaataagctactggatggagagaggctcgccgaccgcaagattgcagagttattcagcaccaaaactcacatcggttga

SEQ ID NO: 10353 - RNA, 5055 nt, synthetic construct
  misc_feature 1..5055: note = derived and/or modified CDS sequence (opt3) from CCHFV(NIVA 118594)__JN572084.1__GP
  source 1..5055: mol_type = other RNA
atgcacaccagcctgatctacgtggtcctctgccttcagctgtgttccttgggcaagacacatgggtctcacaacggaactgagcataataaaacggacgttatgaccacacccggtgataaccaatcacctgaaccattagtgagtactgccctgccggtaacccccgaccctagcacagtgaccccaactgctcccgcatccggcctagaggggtctggagaagtctatacatcgtcaagcattaccacgaagggcctcagtctgcctaaagccacttccgagcttctggcgaccacaggtatggtgacttctagcgcttccgatatagacccatcaacccaggccgcaggggatacacccacccctacggttagaacaagtttgccaaatagcccgtctacaccctccacctcacaggacactcaccatcctgtgaggaacctcctgagcgtcacaagtccaaagcccgaagagacccctacgccatctaaatccgataaggacagctcggccaccaattctccccacccggctgcatcccggctgtcaacacctcccactaccgatcagggaccaacagagaacaataaccacaatagtactgaacaactcgagagcttaacccgctccgccacatctagctcaatggtgagtctgacccagactgtacttcctcagtccgctacgagcatcgccacacaggacacccatccctctccaactaaccgatcaaagcgtaatttggaaatggagattatcctgaccctaccccaaggcctcaaaaagtactatggcaaaattctgaagctgctgcacttgacactcgaggaagataccgaggggctgttagaatggtgcaaaagaaacctgggactcgactgtgatgacactttctttcagaagaggatcgaggagttctttataacaggtgagggccatttcaatgaggttcttcagtttcgggcgcctgggacgctgagtaccactgaaccaacacacgcaggaagcccgaccgccgagcccttcaagtcctactttgctaaaggcttcttgtctatcgactcgggttattttagcgccaagtgctactcccgcacatcaaacagtgggctacagctgattaatgtgactagacactctaccaggatcgcagatacgcctggaccaaaaattaccaacctcaagacaatcaactgtataaatctgaaagctagcgtcttcaaggaacatcgggagtttgaaattaacgtgcttctgccccaagtggccgtcaatttgtccaactgccacgttgcgatcaaatcacatgtgtgtgactatagcctcgatactgacggcgccattcgcctgcctcacatccattacgagggcaccttcatcccagggacatacaagattgtaatagataagaaaaataagttaaacgaccgatgcactctgtttaccaattgtgtgatcaaaggaagagaggtcaggaagggtcagtctgtgctacggcagtataaaacggaaattcgtatcggccgcgcatccacagggagtagaaggctcctgagcgaggaatctggagatgactgcatatcccggacccaacttttgcgaactgagacagctgaagttcacggcgataactacggtgggcccggcgacaagattaccatctgtaatggatcaactgtggtcgatcagcgcctgggcagtgagctcgggtgctataccatcaacagagtaaagagcttcaaactgtgcgaaaattcggccacaggaaagtcctgtgaaattgactctatcccggtgaaatgcaggcagggttactgtcttaagattacgcaggagggccgggggcacgttaaactgagccgcggatcagaagtggtcttggacgcttgcgatagttcctgtgaggtgatgatacctaagggcaccggtgacatcctcgtcgattgctctgggggccaacagcatttcctgaaggacaacttaattgatctgggatgtccaaaaatccccctactcggcaagatggccatctatatttgcagaatgagcaatcaccctaaaactacaatggcatttctgttctggttttccttcgggtacgtgataacctgtatcctttgcaaggttatcttttatttgctgattattttcggaacactcggtaaaaggtttaagcagtaccgtgagctgaagccccagacttgtaccatctgcgaaacgacaccagtgaacgccatagacgctgagatgcatgatttaaattgctcatacaacatctgtccttattgcgcgagccggctgaccagtgacggccttgcacgacacgtaactcaatgtcccaaaagaaaggaaaaagtcgaggaaaccgagttgtacctcaacctggagaggattccatgggtggttcgcaagctacttcaggtgtctgaatccacagggatcgccctcaaacggagctcgtggctgattgtccttttggtgctgttcactgtatcaatcaccccggtgcagtctgctcctataggacacggcaagacaattgaggcctatagagcaagggaagagtacacgagtatctgcttatttgttctcggttccgtcctgttcgtggtgagctgtcttatgaaagggctggtcgattctgttggcaatatctttttccccggattgtttatttgcaagacctgtagcataggctccatcaacgggttcgaaattgagtcacataagtgctattgtagtctcttctgctgtccatactgccgccactgcagcgccgaccgagagatccatcagctgcacctatctatttgtaaaaagcggaaaactggatccaatgtgatgctggctgtgtgcaagcgtatgtgttttagaacaaccatggaagtatcaaacaaagccctcttcgtcaggagtatcataaatactacatttgtggtttgcattctgatccttgcagtgtgtgtcgtgagcacctccgcggttgagatggaatctttgcccgctggcacgtgggagcgcgaagaggatctgactaacttctgccatcaagagtgtcaggtgaccgaaacagagtgcttatgtccttatgaagccctcgtactgcggagaccactttttctggactcgatcgtcaagggtatgaagaatctactcaacagcacctcactggagacttccttgagtattgaggcaccctggggagccatcaatgtgcagtctacatacaaacctaccgtgagcgctgccaacattgcactgtcctggtcatctgtcgaacacagggggaataagatattagttagcggccgaagtgagtccatcatgaaactcgaggaacgcacaggtattagctgggatctgggcgtggaagacgcttctgagtcaaaacttctgactgtatccgtgatggacttgagtcagatgtacagcccggtcttcgagtatctctcgggggatcggcaagtggaagagtggccaaaggcaacctgcacgggagactgtcccgaaagatgcggctgcacatcttccacctgtctgcacaaggagtggcctcatagcaggaactggcgttgcaatccaacttggtgttggggagttgggaccggctgcacatgttgcggtctagatgtgaaggacctgtttactgattacatgttcgtcaaatggaaggtggaatatatcaaaaccgaggcgattgtttgtgtggagcttacgtcacaggaacgccagtgcagtctcatcgaggccgggacacggtttaacctgggatctgtcaccataactttgtccgaacccagaaatatccaacagaagctgcctccggagattatcacattacaccccaggattgaagagggcttctttgacctcatgcatgtacagaaagtgctgagcgcttcaaccgtttgtaaacttcagagttgcactcacggtgtgccaggcgatctgcaagtctaccatatcgggaacttgctcaagggagaccgagtgaacggccacctgatacacaagattgagcagcatctaaatacaagctggatgtcctgggatgggtgtgacctggattattactgcaacatgggagactggccttcttgcacctatacgggcgtaactcagcacaatcatgccagcttcgtgaaccttctcaatatcgaaaccgattacacaaagacctttcacttccactccaaacgggtcacagcccatggtgacactccccagctggacttgaaggctcgcccaacctacggggccggagagatcacggttttagtggaagtggcagatatggagctgcacactaaaaagattgagatatcaggcctcaaattcgcgtctctgagttgtactggttgctatgcctgttcgagcggcatctcctgcaaggtcaggattcatgtggacgaacctgatgagcttaccgttcacgtaaagtctgacgatcccgacgtggtcgctgcctcaagctccctgatggcaagaaaattggaaagtgggacagattctacctttaaggctttcagcgccatgccaaaaacttcactatgtttttacatcgtggagcgggaatattgcaagggatgttccaaagaggacacccaaaagtgcgttaacacaaagctggagcagccgcagagtattctcatcgaacataaaggcacgataatcgggaagcagaataacacttgtaccgcaaaagccagctgctggctggagtctgtgaagtccttcttttacggacttaaaaatatgttatcaggcattttcggtaacgtctttctggggatcttcagctttctcgctcctttcgtgttgctgattctctttttcatgttcggatggcgaatcctgttttgtttcaagtgctgcagacgcacaaggggcctttttaagtatcgtcacctgaaagatgacgaagagaccggctaccggaagataattgaaagattgaataacaaaaaggggaaaaataagctactggatggagagaggctcgcggaccgcaagatcgccgagttattctcgactaaaacacacatcggttga

SEQ ID NO: 10354 - RNA, 5055 nt, synthetic construct
  misc_feature 1..5055: note = derived and/or modified CDS sequence (opt3) from CCHFV(UCCR4448)__KY484042.1__GP
  source 1..5055: mol_type = other RNA
atgcacatcagcctgatgtacgccgtgctctgccttcagctgtgtggcttgggggagacccatggatcccacaacgaaacaggtcataataagactgacgtcatgacgacccccggcgataacttatcttcagagcaacctgttagtacagctctgagcattactccagacccgtccaccgtgacacccaccactcctgcatctgggctagaaggatcgggcgaggtatatacatcaccacccataatcaccgaaagcctcagtctgcctgagacgactccagagctttccgccaccgcgggtattgatacatctagcgcttccgacgtggattcaagtactcaggccgcaagagggaccagcgccctgacagtcaggacctctttgcccaattccccttcaacgccaagcactccgcaggaaacacaccatcccgtgcggaacctcctgagtgttacctctcctcgcccagaggaaacttccacacccagcggatcgggcaaagagtcttccgctacctcaggccctcacccagtgagtaataagcccccgacgcctcccgcaaaaacccaggggccaacagagaacaatagccacaacgccactgaacatcctgagcccctgacccaatccgctacactcggattaatgacttctccaacccagatcgtccacccccagagcgccacatcaattaccgtgcaggacacttaccctagtccaacgaatcgatccaagcgtaacctggaaatggagatcatacttacattgagccaaggtctgaaaaagtattacggcaagatcctaagactcctgaggcttaccctggaagaggatactgaggggttgctcgaatggtgcaaacggaatctgggattagactgtgatgacaccttctttcagaagcgcattgaggagttctttatcacaggcgaaggtcatttcaacgaagtactgcagtttaaaaccccggggactctctctacaacggagtcaacccccgcggagcttcctactgcagaaccattcaagagttattttgccaaaggattcctgagcattgattccggctactattctgctaagtgctactcgggcacaagcaattccgggttgcagctaatcaacataaccagacactcagccaggattgttgacacacccggacctaaggtgactaatctgaaaaccatcaactgtattaacctcaaggcaagtatctttaaagagcaccgggaagtcgagatcaatgtgctgcttccacaagtggctgtcaacctgtctaattgccatgttattataaagagccacgtgtgtgattactccttggacatcgacggtacggtacgcctcccccatatttatcacgaaggcgtgttcatcccggggacctacaaaatagtcattgataagaaagacaagctgaacgatcgatgcacattatttactgactgtgtgatcaagggaagagaggttaggaaaggccagtcagtgctgcggcagtataagaccgagatccgtattggtaaagccagcacagggtctcgcagactactctccgaagagacttctgatgactgcatcagcaggacccaactgcttcggacggaaacagcggagattcatggcgataattacggaggccctggggacaagataaccatctgtaacggatctactattgtcgatcagcgattgggttccgagctgggctgctatacaatcaatcgcgtgaaatcattcaagctctgcgaaaacagtgccaccggaaagagctgtgagatcgactcggtaccagttaaatgcagacaggggtactgtctgaggattactcaggaaggccggggtcacgtgaaactttcccgcgggtctgaggtcgtgctggatgcatgcgacaccagctgtgaaataatgatccccaagggcacaggagacattttggtcgattgctcaggcgggcaacagcactttctcaaggacaatctgatcgatttaggatgtcctaaaattcccctgctaggtaagatggctatctatatatgcagaatgagtaaccatccaaagacgaccatggccttcctcttctggttttccttcggctacgtgatcacttgtattctgtgcaaagctatcttttaccttttgattatcatagggacactgggaaagaggttcaaacagtatcgtgagctcaagcctcagacctgtacaatttgcgagactacccccgttaatgccatcgacgcagaaatgcacgatctgaactgctcttacaatatttgtccatattgcgccagccggttaacgtccgacggcctggctcgacatgtgacacaatgtccgaaaagaaaggagaaggtagaagagaccgaactttacttgaacctcgagaggatcccttgggtcgtgcgcaaactgctacaggtttcagagagcactggtgtggcgctgaagcggagttcttggctcatagtcctgcttgtgttgtttaccatctccctgagccccgtacagtcggcaccaatttcacacgggaaaacaatcgaagcctatagagctagggagggctacacttctatttgcttattcgtgctcggaagtatcctgtttatagtttcctatcttatgaagggcctggtcgatagcgtggggaatagtttctttcccggattgagcatttgtaaaacctgctccacatcaagtatcaacggcttcgaaatcgagagccacaagtgttactgctctctcttttgttgcccttactgtcgccattgctccgccgacaaagaaattcacaagctgcatctatcaatctgcaagaaacgaaagacgggtagtaacgtgatgctggcagtctgtaaacggatgtgcttccgtgccaccatggaggttagcaatagagctctctttattaggtccataatcaacactacattcgtgctgtgtattcttatcttggccgtgtgcgtagtctctacctcggcagtggagatggaaaatctgccagcggggacttgggagcgcgaagaggatttaacaaacttctgtcaccaggagtgccaagttaccgaaacggagtgtctctgcccctatgaagctctggtgcttcggaagcctctgtttctagacagcattgtcaaaggaatgaagaatctcctgaactcaacttccttggagaccagtctgtctatcgaagccccgtggggcgcaataaatgtgcagagcacatacaagccaaccgtttccactgccaacatcgctttatcatggtctagcgtggagcatagaggtaataaaattctcgtaagtggcaggtccgagagcatcatgaagctggaagagaaaacagggatttcttgggatcttggagtcgaagacgcctcagagtccaagctgttgaccgtgagtgtgatggatctcagccagatgtattcgcccgtcttcgaatacctgtctggcgaccgacaggttgaggagtggcctaaagcaacatgtactggggactgcccagaacgctgtggatgcacctccagcacgtgcctacacaaggagtggccccactcacggaactggagatgtaatcctacatggtgctggggcgtgggtaccgggtgtacttgctgtggactggatgtaaaggacctttttaccgattatatgttcgtgaaatggaaggtcgaatacatcaaaacagaggctatagtgtgcgttgaactcaccagtcaagagaggcagtgttctctgattgaggccggcactcgttttaacttgggtccggtgacgatcacactgtccgaaccccgcaatatccagcaaaagttaccacctgagattataaccctccatccccggatcgaagagggcttctttgacctgatgcacgtccagaaagtgcttagcgcgtcaactgtttgcaagctgcagagttgtacacatggggtgccaggagatttgcaggtctatcacattggcaacctcctgaagggggacaaagtaaatggacatctaatccacaagattgagcctcacttcaacaccagctggatgtcctgggatggctgcgacctggattactactgtaacatgggtgactggccctcttgcacttatacaggggtgacccaacataatcacgccagctttgttaaccttctcaatatcgaaacggattacactaaaaacttccattttcactccaagagagtgaccgctcacggagacacaccacagctggatttgaaagcaaggccgacctatggcgccggtgagataacagtcttagtggaagtagctgacatggagctgcatactaagaaaatcgaaatttcaggcctcaagttcgcctctctgacctgcacggggtgttacgcatgcagttcgggaatcagctgtaaggtgcggattcacgtcgacgagcctgatgagcttacagttcatgtgaaatccgacgatcccgacgtggtcgcggcctcttcaagcctgatggctcgaaagttggaatttggcactgattccaccttcaaagccttcagtgcaatgccaaagacatctctatgcttttatatcgtggagcgcgaacactgtaaaagctgctcagaggaagacaccaagaagtgtgttaatactaaactggagcagccccagtccatactcattgagcataaggggaccatcatcggaaaacaaaacagtacatgcacggctaaggccagctgttggctggaatctgtaaaatccttcttttacggccttaagaatatgttatcaggtattttcgggaacgtgtttatcggaatattcctgtttctcgcacctttcattttgctgatcctctttttcatgtttggctggaagattctgttctgcttcaaatgttgcagaaggactcggggcctttttaagtatcgacacctgaaagatgacgaggaaaccgggtacagacgcatcatagagaggttgaataacaagaaaggaaagaataagctactggatggtgaaattctcgccgaccgtcggatcgctgagttattcagcacaaaaacccacatcggctga

SEQ ID NO: 10355 - RNA, 5055 nt, synthetic construct
  misc_feature 1..5055: note = derived and/or modified CDS sequence (opt3) from CCHFV(UCCR4401)__KY484035.1__GP
  source 1..5055: mol_type = other RNA
atgcacatcagcctgatgtacgccattctctgccttcagctgtgtggcttgggggagacccatggatcccacaacgaaacaagacataataagactgacacgatgaccacacccggtgataacccttcttcagagccaccggtgagtactgctttaagcataaccctggacccctccacagtcacccctactacaccagcatctggcctagaagggtcgggagaggtttatacctcaccccctatcacgactggcagcctcccactgagtgaaaccacacccgagcttcctgtgactaccggtacagataccctgtccgccggggacgtagatccatctacgcaaactgcgggaggcacaagcgctccgaccgtgaggacttccttgcccaattcacctagtacaccaagcacgccccaggacacccaccatcctgtccggaacctcctgtctgtgacctccccaggccccgatgagacatcaactccgagcgggaccggaaaagaaagttctgccacatccagccctcaccccgtttcgaatcgcccacctactcccccagcaaccgcccagggtcccacagagaacgactctcacaattccaccgaacatcctgagtcactgactcagagtgctacgccaggcctcatgacaagcccgacccaaattgtgcacccccagtccgcaactcctatcaccgtccaggatacacatccatctcccaccaaccgaagcaagcgtaatttaaaaatggagattatcctgactctttcacaggggttgaagaaatactatggaaagatactgagactactccaactgacacttgaagaggacacggaaggcctgttggagtggtgcaagaggaacctcggtctggattgtgacgataccttctttcagaaacggatcgaagagttctttattactggggagggacacttcaatgaagtgttacagtttcgcacacctggcaccctgagtacaactgagtccaccccagccggcctccccacggctgaaccgttcaagagctactttgccaaagggttcctttctatcgactcaggatattacagtgcgaagtgctatagcggtacctccaactctggcctgcagttgattaatatcacaagacactcgactaggatagtagacacccctgggccaaaaattacaaacctaaagactatcaattgtattaacctgaaggcaagcatctttaaagagcatcgggaagttgagatcaacgtgctcctgccccaagtcgccgtgaatctttccaactgccacgtggtcattaagtcacatgtttgtgattacagtctggacatagatggagctgtgcgcttgcctcacatctaccatgagggcgtattcattcccggtacctataaaatcgtgatagacaagaaaaataagctcaacgatcgatgcacgctgtttacagactgtgtcattaaagggagagaagtgaggaagggccagtctgttttacggcagtacaagaccgagatccgtatcggaaaagccagcactggctcccgcagactgctatcagaggaaccaagcgatgactgcatttctaggacacaactcctgcggaccgaaactgcagagatccacggggataattatggaggtcctggcgacaagattaccatatgtaacgggtccacaatcgtggatcagcgacttggaagtgagttgggctgctacacgattaatcgcgtcaggagcttcaaactgtgcgaaaactctgctaccggtaagaattgtgagatcgactccgtgcccgtaaaatgcagacaggggtattgtctccggatcactcaggaaggccgcggacacgttaagctgtcaagaggcagtgaggtggtccttgacgcctgcgatacaagctgtgagattatgataccaaaggggaccggagacatcctggtggattgctcgggtggccaacagcattttcttaaagacaacctcattgatctggggtgtccgaagatccctttactgggaaaaatggcgatttacatctgcaggatgtccaatcaccccaagacaactatggccttcctattctggttttctttcggctatgtcataacctgtatcctctgcaaagcaatcttttacctgcttattattgtgggtacgttggggaagcgtctgaagcagtaccgggaactcaaaccacagacatgtaccatctgcgagactacccccgttaacgctatagacgccgaaatgcatgatctgaattgcagctataacatttgtccttactgcgcttcacgattaacaagtgacggcctggccagacacgtgatccaatgtccaaagaggaaagagaaggtagaagagactgagctttatttgaatctcgaacgcattccctgggtcgtgcggaaactgctacaggtttccgagtctaccggagtggcactgaagagaagctcctggctcatcgtcctgcttgtgttgttcacagtatcactgagccctgtgcagagtgccccgataggccaggggaagacgatcgaagcctacagggcgcgcgagggatatacctctatttgcttatttgttctcggctccatcctgttcattgtcagctgtcttatgaaaggtctggtggattcggtggggaactcatttttcccaggattgtctatctgcaagacttgtagtatatccagcattaacggctttgaaatcgagtctcacaaatgctactgtagcctcttctgctgtccctattgccgacattgctccacagacaaggagatccacaaactgcatctatcaatttgtaagaaacggaagaccggtagtaatgtcatgctggcagtttgcaagctcatgtgttttcgtgccactatggaagtgagcaacagagctctgttcatcaggtctattataaatacaacctttgtgctttgcatcttgattctggccgtatgtgtcgtgtccacgtcagcagttgagatggaaaacttacctgccggcacttgggagcgcgaagaggatctcaccaatttctgccaccaagagtgtcaggtgacagaaaccgagtgcctgtgtccatacgaagctcttgtcctgcggaaacccctattcctcgacagtactgccaaggggatgaaaaacctgttgaatagcacatccctggagacctctttatcgatcgaggcaccttggggagcgattaacgtgcagagcacatacaagccgactgtttcaaccgctaatatcgccctctcctggagttctgtggaacatagaggcaacaaaatactggtaagcgggaggtccgagtcaatcatgaaacttgaggaacgaacgggaatttcttgggatctgggcgtcgaagacgcaagcgagagtaagttgctcacagtgtccgtgatggacctgagccagatgtattctcccgtctttgagtacctatcaggtgatcgccaagttgaagagtggccaaaggctacctgcactggggactgtcctgaacggtgcggatgcacctccagtacatgtctgcacaaggagtggccccacagcagaaattggaggtgcaacccaacttggtgttggggcgtgggtaccggctgcacgtgttgcgggcttgatgtaaaagacctcttcacagattatatgtttgtgaagtggaaagtcgaatacatcaagaccgaggctattgtgtgtgttgagctgacttcgcaggaacgtcagtgctctttgatcgaggccggaacacgcttcaatctgggccctgtgaccataactttatccgaaccccggaacattcaacagaagctcccaccggagatcatcacactgcatcctagaattgaagaggggtttttcgaccttatgcacgtccagaaagtgctgagcgcatcaaccgtttgtaagttgcagagttgcacgcatggagtgcccggcgatctccaagtctatcacataggtaatctgctaaaaggggacaaggtaaacggacatctgatccacaaaattgagccacactttaacacttcttggatgtcctgggatggctgtgaccttgattactattgcaatatgggtgactggcccagctgcacctacacaggcgtgacccagcataaccacgcttcattcgttaatctcctgaacatcgaaacagattacactaagaattttcatttccacagtaagagggtgaccgcccacggggacacgcctcagttggacttaaaagcgcgaccaacatatggagccggcgagattactgtcctggtggaagtagctgatatggagctccataccaagaaaatcgagataagcgggctgaagtttgcatcccttgcctgtacaggatgctacgcttgttctagcggcatctcctgcaaagtgcggattcacgtcgacgaacccgatgagctgaccgttcatgtgaagtcagacgatcctgacgtggtcgccgcatctagttcgttgatggcgcgcaaactagagttcggtactgatagcacctttaaggccttctccgctatgccgaagacatctctgtgtttctatatcgtggaaagagaacactgcaaatcatgtagcgaggaggacacgaagaaatgcgttaacactaagctcgaacagccacaatccattctgatcgagcataaagggaccataattggaaagcagaatagtacatgtaccgccaaggcatcttgctggcttgaaagcgtaaaatcatttttctacggcttaaagaacatgctgtccggcatctttgggaatgtgttcatgggaatctttctcttcttggctccctttattctgctcatcctgttctttatgttcggttggaggatattgttttgtttcaaatgctgccggcgaactagaggcctgttcaagtatcgccacttgaaagatgacgaggaaacagggtacaggcgtattatcgagaagctaaacaataagaaaggaaagaacaaactgctcgatggcgagcggttagccgacagaaggattgcagaactgtttagtaccaagacgcacatcggttga

SEQ ID NO: 10356 - RNA, 5055 nt, synthetic construct
  misc_feature 1..5055: note = derived and/or modified CDS sequence (opt3) from CCHFV(IbAn7620)__KX013451.1__GP
  source 1..5055: mol_type = other RNA
atgcacatcagcctgatttacgccatactctgccttcagctgtgtggcttgggggagacctatggatcccataacgaaacaagacacaataagactgacacgatgaccacacccggtgataacttatcttcagagcctccagtgagtactgctctgttcatcaccccggaccccagcacagtcacccctactacaccagcatccggcctagaagggtctggagaggtttacacctcgccccctattacgactggctcactcccactgcccgaaaccacacctgagcttccagccactaccggtacagataccagcagtgcgtccgacgtggatttttctacgcaaactgctgggggaacaagcgccctgaccgtaaggactggcttgccggactccccctcaacacctagtaccccacaggatacgcatcaccccatgcggaatctcctgagcgtgacctctcctggcccagacgagacatccactccctcagggaccggacgcgaaagcagtgcaacatcttccccgcatcctgtcagcaaccgacccccaactcctcccgccaccgctcagggtccaacagagaatgattcgcacaacgcaaccgaacaccccgagtctctgactcagtccgccacgcctggcctcatgacatcaccaacccaaactatccatccgcagagtgctacccccattacagtgcaggacaaacagcctagcccaaccaatcgttccaagagaaacttagagatggaaatcatactgactctttctcaagggttgaaaaagtattacggaaaaatcctgaggctactccacctgacacttgaggaagatacggagggcctgttggaatggtgcaagcggaatctcggtctggactgtgatgacaacttctttcagaagcgcattgaggagttctttatcaccggggaaggacatttcaatgaggttttacagtttagaactcccggcacactgagcaccacagaatcaactcctgccggcctcccaaccgcggagcccttcaaaagttattttgcaaaggggttcctttccattgacagcggatactattctgccaaatgctactcaggtacgagtaacagcggcctgcagttgatcaatataaccaggcactccacacggattgtggatactccggggcctaagatcaccaacctaaaaacaattaattgtatcaacctgaaggcttctatctttaaggaacaccgcgaggtcgagattaacgtgctcctgccacaagtagccgttaatctttcgaactgccatgtggtcataaaaagccacgtgtgtgactactccctggatatcgacggagcagtgcgattgccccatatttatcacgaaggcgtcttcatccctggtacttacaagatagttattgataaaaagaataaactcaacgacagatgcaccctgtttacggattgtgtgatcaaggggagggaggtacggaaaggccagtcagtgttacgtcagtataagacagaaatccgcattggaaaggctagtaccggctctagaaggctgctaagcgaggaaccctccgacgattgcatctcacggactcaactcctgcgaacagagaccgccgagattcatggggacaattacggaggtccaggcgataaaataactatctgtaacgggagcaccattgtcgaccagcgccttggatctgaattgggctgctatacaatcaatagagtgaagtccttcaaactgtgcgagaacagtgcgacgggtaagaattgtgaaatcgacagcgttcctgtgaaatgcaggcaggggtactgtctccggattacccaggagggccgcggacacgtcaagctgtctagaggctccgagatagtgcttgatgcctgcgacacttcatgtgaaatcatgattcccaaggggacaggagatatcctggtagactgcagtggtggccaacagcacttcttgaaagataacctcattgacctggggtgtccaaagatcccgttactgggaaaaatggcaatatatatctgcaggatgagcaatcatcctaagaccacaatggcttttctattctggttttcgttcggctacgttattacttgtatcctctgcaaagccatcttttacctgcttattataattggtaccttggggaagcgtctgaagcagtatcgggagctcaaaccccagacgtgtacaatctgcgaaaccactccagtgaacgctattgatgccgagatgcacgacctgaattgctcctacaacatctgtccctattgcgcatctcgattaaccagcgatggcctggccagacatgtcatacaatgtcctaagaggaaagaaaaggtggaggagacagaactttacttgaatctcgagcgcatcccatgggtcgtgcggaaactgctacaggtttcagaaagtactggagtggctctgaagagatcctcttggctcattgtactgcttgtcttgttcaccgtgagcctgtcccccgttcagtcagcgcctatcggccaggggaagacaacggaggcatatagggcccgcgaaggatacaccagcatttgcttatttgtgctcggcagtatcctgttcatagtctcttgtcttatgaaaggtctggtggactccgtagggaacagctttttcccgggattgtcgatttgcaagacttgttcaatctctagtatcaacggctttgagattgagtcccacaaatgctattgtagcctcttctgctgtccatactgccgacactgctctacagataaggaaatccataaactgcacctaagcatttgtaagaaacggaagaccggttccaatgtgatgctggctgtttgcaagcgtatgtgttttagagccactatggaggtctcaaacagggcactcttcatacgcagtatcattaatacaaccttcgtgctgtgcatccttattttggccgtgtgtgtcgttagcacgtctgctgtggaaatggagaacctgcccgccggcacttgggaacgggaggaggacttaaccaatttttgccatcaagaatgtcaggtgacagagaccgaatgcctctgtccttacgaggcactggtacttagaaaaccactgttcctagattccatcgcgaaggggatgaaaaaccccctcaattcaacaagtctggagacaagcctttccatagaagctccttggggagccatcgacgtccagtctacctataagccgacagtgtcgactgcaaacattgccctgagctggtcatccgttgagcacaggggcaataaaatcttagtgagtgggcgatctgaaagcattatgaagctcgaggaacgcaccggaatctcctgggacctgggcgtcgaggatgcttcagagtctaagttgctgacggtgagcgttatggacttgagtcagatgtactcccccgtgtttgaatatctcagcggtgatcggcaagtagaggaatggccaaaagccacatgcaccggggactgtcctgagagatgcggatgcacttcttcaacctgtctgcataaggaatggccccactccaggaactggcgttgcaatccaacatggtgttggggcgtcggtactggctgcacctgttgcgggctagatgtgaaagacctgttcacggattacatgtttgtgaagtggaaagtcgagtatataaagacagaggcaattgtttgtgtggaacttaccagtcaggagcgccagtgcagcctcatcgaagctggaactcggttcaacctgggccctgtaacaatcaccttgtcggagcccagaaatattcaacagaagctgccaccggaaataatcactttacaccctaggattgaggaggggtttttcgacctcatgcatgtgcagaaagtcctgtctgcctccacagtgtgtaaacttcagagctgcacccacggagttcccggcgatctgcaagtgtaccatatcggtaacttgctcaaaggggacaaggtcaatggacacctgattcataaaatcgaaccacactttaacacgtcatggatgagttgggatggctgtgacctagattattactgcaacatgggtgactggccctcttgcacttacaccggcgtgacacagcacaatcatgcgtccttcgttaacctgcttaatatagagaccgactatacaaagaactttcacttccatagcaagcgagtgactgcccacggggatacccctcagctcgacctgaaagctcggccaacgtacggagcaggcgaaatcacagtcttggtagaggtggccaatatggagttacacactaagaaaattgaaatctcagggctgaagtttgctagtctcacctgtacaggatgctatgcctgtagctccggcatttcttgcaaagttcgcatccatgtggatgagcccgacgaactgaccgtccacgtaaagagcgatgaccctgatgtggtggcagcgtcctcatctcttatggccagaaaactggagttcggtactgacagtaccttcaaggctttttcggccatgccgaagactagcttgtgtttctacatagtcgaaagggagcattgcaaatcctgttctgaggaagatacgaagaaatgcgttaacactaagctagagcagccacaatcaattctgatcgaacacaaagggaccatcattggaaagcagaatagcacatgtaccgcaaaggcttcctgctggctcgagagtgtgaaatctttcttttatggcctgaagaacatgcttagcggcatctttgggaatgtgttcatgggaatatttttattcctggccccctttattctcttgatcctgttctttatgttcggttggcggattctcttctgttttaaatgctgccgaagaactcgcggcctgttcaagtacaggcatcttaaagacgatgaagagacagggtatcgtcggatcatagagagactgaacaataagaagggaaagaacaagttgctagacggcgaaaggctggcagaccgccgaattgccgagctcttttcaaccaaaacgcacatcggttga

SEQ ID NO: 10357 - RNA, 5055 nt, synthetic construct
  misc_feature 1..5055: note = derived and/or modified CDS sequence (opt3) from CCHFV(Zahedan 2007)__KC867273.1__GP
  source 1..5055: mol_type = other RNA
atgcacatcagcctgatgtacgccgtgttctgcctccagctttgtggcctggggaagaccaacggaccccataatggtacagagcacaacaatactcatgtcatgacgacccctgacgattcccaatctccagaaccgcccgtttcaacagctttgcctgtgactccagaccccagtaccgtaacacctagcaccccagcatccggcttagaggggtctggagaagtgcacacttcgtcacccattacaaccaaaggcctgagcctacctgaggccacgagtgaaccaccgtccactacctctgtcgtgacaagctccgcgtcagatactgacagtagcacccaggctgccggtgatacacccacccctacggttagaacttctctcccatcctcacccagcacacctagtacctctcaggggactcattatccagtgaggtccctgcttagcgtcacaggacccaagccggaggagacccctacgccctcgaaatctggcaaggacaacctggcaaccaattccccacaccctgccacatcacggcccactaccccaagtacaatagctcagaaacccactgaaaacaatagccacaacaccacagagcaattggaatccctcacccatctggcaactctgggctctaagatcagccctacgcagacagtgctcccacagtcagtaaccagtattgccatccaggatattcacacttccccgaccaatcgcagcaagcgaaacttagacatggagatcatactgacactttctcaagggttgaaaaagtactatggaaaaatcctgaagctactccgtctgacccttgaggaagatactgagggtctgttggaatggtgcaaaagaaatctcggcctggactgtgatgacacatttttccagaagaggattgaggaatttttcatcacgggggagggacattttaacgaggttttacagttccggaccctgggcactctctcaacaaccgaaagtacacacgctggtagccccactgtggagccttttaagtcctacttcgccaaagggtttctttctattgattcgggatatttcagcgcgaagtgctactcccgcacctcaaatagtggcctgcagttgatcaacgtcacgagacactctaccaggatagcagacacaccaggccccaaaattactaatctaaagaccatcaactgtattaacctgaaagccagcgtgtttaaggaacatcgggaggtggaaatcaatgtcctcctgcctcaagttgctgtgaacctttccaattgccacgtagccatcaaatcacatatttgtgactatagcctggatacagacggggcaatacgcttgccacagatccaccatgagggaactttcattcccggtacctacaagatcgtgatagataagaaatctaagctcaacgaccgatgcacgctgtttacaaattgtgtcattaaaggcagagaggtgaggaaggggcagtccgttttacggcaatacaaaaccgaaatccgtatcggacgcgctagtactggcagcagaaggctgctatctgaggaatccggtgatgactgcatttcacggacacagctcctgcgaaccgagactgccgaagtgcacggggataactatggcggaccgggcgacaagatcaccatttgtaatgggagtacagtcgtggatcagcgccttggaagcgagttgggttgctacacgataaacagagtaaggtcgttcaagctgtgcgaaaattccgcgaccggcaaatcttgtgaaatcgacagcattcctgttaagtgcaaacaggggttctgtctcaagatcactcaagagggacggggccacgtgaaactgtcacgcggtagtgaagtcgtgcttgatgtctgcgactcctcttgtgaggtgatgatcccaaaggggacaggcgacattctggttgattgcagcggaggccagcagcatttcttgaaggacaacctcgtggatctggggtgtcccaaaatacctttactgggaaagatggccatctatatttgcagaatgtccaatcaccccaaaaccacaatggcattcctattttggttctcatttggttacgtaatcacttgtattctctgcaaggctatcttctttctgcttataatcttcggcaccttggggaaaaggtttaagcagtatcgtgagctgaagccacaaacgtgtacaatttgcgaaaccactcctgtcaacgccatcgacgctgagatgcatgatctcaattgcagctacaacatttgtccctattgcgccagtcggctgacctctgacggattagcacgacacgtgacacagtgtccaagaaggaaagaaaaggttgaggaaactgagctgtaccttaatttggagcgcatcccgtgggtggtccggaaactcctacaggtgtccgaaagcaccggcacagtactgaagagatcgtcatggctgatagtgctcctggttcttttcacggtctctttgagtcctgtgcagtccgcccccattggtcacgggaaaaccatcgagacttacagggtgcgcgaagagtatacaagcatttgcctgtttgtcttaggctctatcctcttcatagttagctttctgatgaagggacttgtggatggcgtggggaacatcttcttcccaggactgtccgtatgtaaaacctgctcaattggcagtatcaacggttttgaaattgagagccatcgatgttactgctctttgttctgttgcccctattgtcggcactgctccgctgacggggagatccatcaactccacctgtcaatatgcaagaagcgtaaaactggaagtaatgtcatgctagcggtgtgtaagagaatgtgctttagggcaacaatggaagttagcaacaaagtgctgttcattcgctccatcatcaataccacgtttgtcgtgtgtattctcatcctggccgtttgcgtggtatctacttcggctgtcgagatggaaagccttcctgccggcacctgggagcgggaagaggatttgacaaacttctgtcatcaggagtgccaggtgaccgaaactgagtgtctgtgcccatacgaagcattagtgctcagaaggcccctgtttcttgactcaattgtcaaggatatgaaaaatctgctaaactccacaagtctcgagacctctctgagcatagaggccccttggggtgctatcaatgttcagtccacatataagccgactgtgtcaaccgccaacattgcattgtcttggagcagtgtagaacaccgaggcaataaggtgctggtctccgggcgcagcgagtctatcatgaaattagaggagcggacgggaatttcatgggacctcggcgtggaagatgcgtccgagagtaagctgcttacagttagcgtgatggacctgtcgcaaatgtactctccagtcttcgagtatttgtccggggacagacaggtggaagagtggcccaaagctacctgtactggagattgccctgaaaggtgtggctgcaccagctcaacatgcctccacaaggagtggccacatagtcgtaactggcgctgtaatcccacttggtgctggggtgttgggaccggatgtacgtgctgtggcctggacgtgaaagatctatttacagactacatgttcgtcaagtggaaggtagaatacatcaaaaccgaggccatagtgtgcgttgagctgacttctcaggaacggcaatgttcccttatcgaggcaggtacaagatttaacctcggcagcgtgaccattactctgtcagaacctaggaatatccagcagaagttgccgcccgagattatcacactgcacccaaaaatagaagaggggttctttgatttaatgcatgtccagaaggtgctcagtgccagcaccgtatgcaaactgcaatcctgtacgcacggagtgcctggcgaccttcaggtctatcatattgggaacctgttgaagggagatcgagttaatggccacctcatccacaagatcgagcagcatttcaacacttcttggatgagctgggacggttgcgatctggactactattgtaacatgggggattggccctcctgcacctacacaggagtgacccagcacaatcatgcttcattcgtgaacctactgaatattgaaacagactatactaaaacctttcacttccactctaagcgggtcacggcccatggcgatacaccacaacttgacctcaaagcacgccctacttacggtgctggcgagataaccgtgctggttgaagtagccgacatggagttgcacacaaagaaaatcgagattagtgggttaaagtttgcgggactgacctgcactggctgttatgcctgctcgagcgggatctcctgtaaagtgaggattcatgtcgatgaacccgacgagctcaccgtgcacgttaagtctgatgacccagatgtggtcgctgcatcaagctccctgatggccagaaaacttgaatttggaacagacagtacgtttaaggctttctctgccatgccgaagactagcctgtgcttttacatcgtggagcgggaatactgtaaatcatgctccaaggaggatacccagaaatgtgtaaacacaaagttggagcagcctcagagtatactaatcgaacataagggcaccattatcggtaaacaaaataacacttgcacagcaaaggcgagctgttggctggagtctgtcaaatccttcttttatgggctcaagaatatgctgggaggcattttcggcaacgtgtttatcgggatattcaccttccttacgccctttattttactgatcttctttttcatgtttggatggcgaatcctcttctgctttaaatgttgcagacgcactaggggtttgttcaagtaccgtcacctgaaggacgatgaagagacaggctatcggaaaattatcgaaagactcaataacaagaaagggaagaataggctgcttgacggagagcgcctggccgatcgaaaaatagctgagttgttttcaaccaagacccacattggctga

SEQ ID NO: 10358 - RNA, 5055 nt, synthetic construct
  misc_feature 1..5055: note = derived and/or modified CDS sequence (opt3) from CCHFV(Afg09-2990)__HM452306.1__GP
  source 1..5055: mol_type = other RNA
atgcacatcagcctgatgtacgccgtgttctgcctccagctttgtggcctggggaagaccaacggaccccataatggtacagagcacaacaatactcatgtcatgacgacccctgacgattcccaatctccagaaccgcccgtttcaacagctttgcctgtgactccagaccccagtaccgtaacacctagcaccccagcatccggcttagaggggtctggagaagtgtatacttcgtcacccattacaaccaaaggcctgagcctacctgaggccacgagtgaaccaccggcgactacctccgtcgtgacatctagcgcttccgatactgactcaagtacccaggccgccggtgatacacccacccctacggttagaactagcctcccatcttccccctcaacacctagcaccagtcaggggactcactacccagtgaggtctctgctttccgtcacaagccccaagccggaggagacccctacgccctcgaaatctggaaaggacaacctggcaaccaattccccacatcctgctacatcacggcccactaccccacccacaactgcacagaaacctaccgaaaacaatagtcacaacacaaccgagcaattggaaagcctcactcacctggccacgctgggctccatgatatctccaacacagaccgtgctcccgcagagcgtaacttcaatcgctattcaggatatccataatagtcccaccaaccgctccaagcgaaatttagacatggagattatcctgacacttagccaaggcttgaagaaatattacgggaagatactgaaactactccacctgacccttgaggaagatactgagggactgttggaatggtgcaagcgtaacctcggtctggactgtgatgacacatttttccagaaaagaatcgaggaatttttcattacgggcgaggggcattttaatgaggttttacagttcaggaccctgggaactctctctacaaccgaatcaacacacgccggcagtcctactgtggagccatttaagagctatttcgcgaagggttttctttccatcgattctgggtacttctcggcaaaatgctatagccggacctccaactcaggactgcagttgattaatgtcacgcgccacagtaccagaatcgccgacacacccggccctaagataactaacctaaaaaccattaactgtatgaatctgaaggcttctgtgtttaaagaacatagggaggtggaaatcaacgtcctcctgccacaagttgccgtgaatcttagcaactgccacgtagcaattaagtcccatatctgtgactactcactggatacagacggcgctatccggttgccccagattcaccatgaggggactttcataccgggaacctacaaaatcgtgattgataaaaagagcaagctcaatgaccgctgcacgctgtttacaaactgtgtcatcaagggtcgagaggtgagaaaaggccagtctgttttaaggcaatataagaccgaaatacggattgggcgtgcctccgcgggaagtcgcagactgctaagcgaggaatctggcgatgactgcatctccaggactcagctcctgcggacagagaccgccgaagtgcacggtgataattacgggggccctggagacaaaatcactatttgtaacggctcaaccgtcgtggatcagcgacttgggagtgagttgggatgctatacaatcaatcgcgtaaggagcttcaagctgtgcgagaactcggcaacgggtaagtcctgtgaaattgactctataccagttaaatgcaagcagggctactgtctcaaaatcacccaagaggggagaggacacgtgaagctgagccggggctcagaagtcgtgcttgatgtctgcgacagttcctgtgaggtgatgattcccaaaggtactggggacatcctggttgattgctctggcggacagcagcattatttgaaggacaatctcgtggatctgggctgtcctaagatccccttactggggaaaatggctatttacatatgccgcatgagcaaccacccaaagacaaccatggccttcctattttggttctcctttggatatgtaatcacatgtattctctgcaaagctatcttctttctgcttattatcttcggtactttgggcaagagatttaaacagtacagggagctgaagcctcaaacctgtacgatatgcgaaacaacccccgtcaatgccatcgacgcagagatgcatgatctcaactgctcatacaatatttgtccatattgcgccagccgtctgactagcgacgggttagctcggcacgtgacccagtgtccgcgaagaaaggaaaaagttgaggaaacagagctgtaccttaacttggagaggatcccttgggtggtccgcaagctccttcaggtgtctgaatccactggaaccgtactaaaacggagctcgtggctgattgtgctcctggttcttttcacagtctcattgtctcccgtgcagagtgcgccaatcggccacggtaagacgatagagacctatagagtgagggaagagtacacttccatttgcctgtttgtcttagggagcatcctcttcattgtttcttttctgatgaaaggccttgtggatggagtgggcaacatcttctttcccgggctgagcgtatgtaagacatgctccataggatcaatcaatggcttcgaaattgagagtcataaatgttattgcagcttgttctgttgcccttactgtcgccactgctctgcagacggtgagatccatcaactccacctgtccatttgcaagaagcgaaaaaccgggtcaaacgtcatgctagccgtgtgtaagcggatgtgctttcgtgctactatggaagttagtaataaagccctgttcatcagaagcataattaacacaacctttgtggtctgtatcctcatcctggcagtgtgcgttgtgtccacgtctgccgtagagatggaatcgcttccagctggaacttgggagagggaagaggatttgaccaatttctgtcatcaggagtgccaggtcacagaaaccgagtgtctgtgcccctatgaagccttagtgctccgccggcctctgtttcttgacagcattgtgaagggcatgaaaaacctgctaaattcaacttccctcgagacaagtctgtctatcgaggcaccgtggggtgcgattaacgtccagagcacctacaagccaacagtttccactgctaatatagccttgtcatggtctagcgtggaacacagaggcaacaaggtactggtgagtgggaggtccgagagcatcatgaaattagaagaacgaaccggaatttcttgggatctcggcgtcgaagacgcatcagagtccaagctgcttacggtgagtgttatggatctgagccaaatgtactcgcccgtgttcgagtatttgtctggggaccgccaggtcgaagagtggcctaaagccacatgtaccggagactgcccagaacggtgtggctgcacttccagtacctgcctccacaaggagtggccccattcaagaaattggaggtgtaaccctacatggtgctggggtgtggggactggatgtacctgctgtggcctggatgttaaagacctatttacggattacatgttcgtgaagtggaaggtcgaatatatcaaaacagaggctattgtatgcgtggagctgaccagtcaggaacgtcaatgttctcttatcgaggccggtactcgctttaatctcggctccgttacaataaccctgagcgaaccgcggaacatccagcagaagttgcccccagagattatcactctgcaccctaaaattgaagaggggttctttgacttaatgcatgtgcagaaggtcctctcagcaagtacagtgtgcaaactgcaaagctgtacccacggagtacccggcgatcttcaggtgtaccatatcgggaatctgttgaagggagacagagtcaacggccacctcatacacaagattgagcagcatttcaacacgtcctggatgtcttgggatggttgcgacctggattattactgtaatatgggggactggccaagctgcacttataccggagttacacagcacaaccatgcttcctttgtgaatctactgaacatcgaaaccgattacacaaaaactttccacttccactcaaagagggtgaccgcccatggcgacacgcctcaacttgatctcaaagcgcgacccacatacggtgccggcgagatcactgtcctggtggaagttgctgacatggagttgcacaccaagaaaattgagatatctgggttaaagtttgcaggactgacatgcaccggctgttatgcctgcagttcggggatcagctgtaaagtacggattcatgtggacgaaccagatgagctcactgtccacgtgaagtccgacgatccggacgttgtggctgcctcttcaagcctgatggcacgcaagctggagttcggaaccgattccacatttaaagcgttcagtgccatgcctaagacgtctctgtgcttttacatcgtcgagagagaatattgtaaaagctgctcaaaggaggacactcagaaatgtgtgaataccaagttggagcagccccagtccattctaatcgaacataagggcacaataatcggtaaacaaaacaatacctgcactgctaaggccagttgttggctggagagcgtaaaatctttcttttacgggctcaagaacatgctgggaggcattttcggcaatgtctttatcgggattttcacatttcttaccccattcatcttactgatactcttctttatgttcggatggaggattttgttttgcttcaaatgttgccggcgaacgagaggtctgtttaagtatcgccacctcaaggatgacgaagagactggctacaggaaaatcatcgaacgtctgaacaataagaaagggaagaaccggcttctggatggagagagattggcagacaggaaaattgctgagctattctccacaaagacccacatcggctga

SEQ ID NO: 10359 - RNA, 5055 nt, synthetic construct
  misc_feature 1..5055: note = derived and/or modified CDS sequence (opt3) from CCHFV(SPU41/84)__AY900142.1__GP
  source 1..5055: mol_type = other RNA
atgcacatcagcctgatgtacgccgtgctctgccttcagctgtgtggcttgggggagacccatggatcccacaacggtacaagatataataacactgacgctacgaccacacccggcgattctcaatcacctgaaccaccggtcagtactgcaagctccattacccataatccctctacagttacctcgactacacctacctcagggagcgagggaagtggcgaagtgtacacgtcctctccaataactaccgagggtttaagcccacctgggacaactccagaactgcccgccaccacaggaatcgacacctccggcgcgtcagatgctaaccctagtacgcaggccgcaaggggcactagcgccctaacagtacacacctctctcccatcctcaccgagcactccccctattagtcaggacacacatcacccagtgcggaatctgctttctgtcacctcccccatgcctgaggagacgaccgctccaagcgggtcgggaaaggaatcttccgcaacatcaagtccccacccggccagcgatcgccctcccactccccctgctaccgcccagggtctgacagagtccaactctcataatgcgactgaacacttggagagcctcacccaatcagcaacacccggcctggtgaccagtccagcccagactgttcatccccactccgctacgagcatcgccgcacctgacacacacccaaacccgaccaatcgatctaaacgtaacctggagatggaaattatcctcactttatcacaggggctgaagaaatattacggaaagatacttagattgctgcatctaaccctcgaggaagatacagagggcctgcttgaatggtgcaaaaggaatctgggtttggactgtgatgacaccttctttcagaagcggatcgaggagttctttattactggggaaggacacttcaacgaggtgctccaatttcgcacacccggcacggtcagtaccactgaaagcacacatgctggccctccaaccgccgagcccttcaagtcctattttgcgaaagggtctctgtcgatcgatagcggatactattccgccaagtgctactcaggtacaagtaattctggcttacagctgattaacatcactagacacagcaccaaaatagcagacacgcctgggccaaagattaccaatctcaaaacaatcaactgtattaaccttaaggctctgactttcaaggaacatagggaggtggagatcaatgtattgctaccccaggttgccgtgaacctgtccaattgccacgtcgtgatcaaatcacacgtgtgtgattacagcctcgacattgacggaaccgtccggctgccgcatatacaccatgaaggcatctttattcctggtacatataagatcgttatagataaaaagaacaaaatgaatgaccgctgcactcttttcaccaactgtgtgattaaggggcgagaggtaagaaaaggccagtctgtgctgaagcaatacaagacggaaatcaggatcggaaaggcttccacaggcagtcggcgtttgctcagcgaggaatcttccgatgactgcatttcacgcacccagctgttaagaactgagacagccgagatccacggggataattatggaggtccaggcgacaaaattaccatatgtaacgggagtactgtcgtggatcagaggctgggaagcgaactaggctgctacaccatcaatcgggttaaaacatttaagctctgcgagaactcggcaacgggtaaatcctgtgaaattgactctgtgcccgtcaagtgccgacaagggtattgtctgaagatcacccaggagggccgcggacacgtgaaacttagcagaggctcagaggtagttttggatgcctgcgacacaagttgtgaagtgatgatccctaaggggacaggagatattctggtcgactgctccggtggccagcagcatttcctcaaagacaatctgatagatcttgggtgtcccaagatcccactgttgggaaaaatggctatttacatctgcaggatgtctaaccaccctaagaccacaatggcgtttctcttctggttcagctttggctatgtgattacttgtatcatatgcaaggtcatcttctacctgttaattatcgtgggtaccctggggaaacggtttaagcaataccgcgagctaaaaccccagacgtgtacaatttgcgaaaccactccagttaatgcaatcgacgccgagatgcatgatctcaactgctcctataatatatgtccgtactgcgcttcaagactgaccagcgacggccttgccaggcacgtgacacagtgtcctaagcgtaaagaaaaggtagaggagactgaattgtatctgaacctcgagcggattccctgggtcgtgcgaaagctgttacaggttagtgaatctaccggagtggcactgaaaagatccagctggcttgtcgtgttgctcgtactgctaacagtgtcgctgtcaccagttcaatctgcccccatcagtcatggcaagacggtcgaggcttacagggcccgcgaagggtatacctccatgtgcctcttcgtgctgggaagcgtgttgtttcttgtctcttgtctgatgaaaggcttagttgatagcgtgggtaacactttctttcctgggctctccatttgcaagacatgttcaatcagtagcataaatggattcgagatcgagtctcaccggtgctactgttccctgttttgctgtccatattgcagacactgctcagcaaacaaagaaattcatcagcttcacctgagtatctgtaagaaaaggaaggcgggcagcaatgtgatgttggctgtatgcaagcgcatgtgtttccgagccaccatggaggtctccaaccgggcactctttattcgttctatcataaatactacattcgtgctgtgcattctaatcctggccgcttgtgttgtgtcgaccagcgccgtcgaaatggagtcactccccgcaggtacgtgggaaagagaggaggacctgactaacttttgccatcaggaatgtcaggtggctgataccgagtgcctttgtccttacgaagccttggttctgaggcgcccgttattcctcgactccatcgtgaaaggcatgaagaatctgcttaacagtacatctctggagaccagcctatccattgaggcgccatggggagccatcaatgtacaatcaacttacaaacccacagtctctaccgctaacattgcactcagctggagttccgtggaacaccggggaaataagatactggtgagcggcagatctgagtcaatcatgaaattggaagagaggacagggatttcctgggatctgggagtcgaagacgccagtgagagcaagttactcactgtttcggtgatggatctgtctcagatgtattcccctgtattcgagtaccttagcggcgaccgacaggtggaagagtggccaaaggctacctgcacgggtgattgtcccgaacgctgcgggtgcacatcaagtacctgtctgcataaagagtggcctcactctcggaactggagatgcaatccgacttggtgttggggagtcggcaccggttgcacatgttgcggcttggacgtgaaggacctctttactgattatatgttcgttaaatggaaggtggaatacatcaaaaccgaggccattgtctgtgtggagctgacgtcccaggaaaggcaatgcagcctaatcgaggcagggacacgttttaacctgggacccgttaccataactctttcagaaccacgcaatatccagcagaagctccctcccgagattatcacactgcacccacggattgaagagggcttctttgacttgatgcatgtgcaaaaggtcctgagtgcgagcaccgtatgtaaattacagtcctgcactcacggggtgcctggagatctccaggtttatcatatcggcaacctgcttaagggtgacaaagtgaacgggcacctggtccacaagatagagccccatttcaatacatcttggatgagctgggatggatgtgacttggattactattgcaacatgggcgactggccatcctgcacctacacgggtgtgactcagcacaatcatgcctcatttgtaaacatgctcaatattgaaaccgattacactaaaaacttccactttcattctaagagagtgaccgctcacggcgacacaccgcaactggatctaaaggccaggcctacttatggggcaggagagatcaccgtcctggttgaagtggctgacatggagcttcacacgaaaaagatcgagattagtggcctcaaattcacatcgctgacttgtaccgggtgctacgcctgtagctccggaatatcttgcaaggtgcgaatccatgtcgatgaacccgacgagttgacagtgcacgttaaatcagaagacccagatgtagtggcagccagctccagtttaatggctcggaagctggagtttggcaccgactctactttcaaagcgtttagcgccatgcccaagacctcactctgtttctatattgtcgaacgcgagtactgcaagtcctgtagtgaggaagatacacagaaatgcgtgaatacgaagctggagcagcctcagagcatccttattgaaagaaaaggtactatcatagggaagcaaaacaatacctgtaaagcaaaggctggatgctggctggagtctgttaagtccttcttttatggcttgaaaaacatgctatcaggcatcttcgggaatgtgtttattggaatcttcctgtttctcgccccattcattctgcttatcttatttttcatgtttggttggaggatactgttctgttttaagtgctgccggcgaacaagaggcctcttcaaataccgccatttgaaggacgatgaagagaccgggtataggaaaattatcgagcgtctgaacaataagaaggggaaaaacaagctcctggacggcgaacggcttgccgatagaaggatcgctgagctgttcagcactaaaacacacattggttga

SEQ ID NO: 10360 - RNA, 5055 nt, synthetic construct
  misc_feature 1..5055: note = derived and/or modified CDS sequence (opt3) from CCHFV(SPU103/87)__DQ211634.1__GP
  source 1..5055: mol_type = other RNA
atgcacatcagcctgatgtacgccgtgctctgccttcagctgtgtggcttagggggagctcatggttcccacaacggcaccagatataataacacaggggcattgactacgctgggagacggccaatcttcagagccccctgtcagtaccgccccaagcacaactcataatccgtccaccgttacatctaccactcccgcgtcgggttcagaagggagcggagaggtgtacacagctagtcctgtaaccacggaaggcctatccccacccggcactacccctgagctcccagccacaactgggattgatacctctggagcaagcgacgccgatccctccacacaggctgcaggggacacctcagccctgacggtgaggacaagtcttcctagctctccatccacactgccgacctcacaggatactcaccatcccgtccggaacttgctcagcgtgacaagtcctcgcccagaagagaccacggctccctctggctccgggatagagagctcggccacctcttcccctcacccagcgtcagaccgacccccgacacctcccgcagccgctcagggaccaactgaaagtaatagccacaacgccaccgagcatctggaatccctgacacaatctgcaactcctgatctcgttaccagccccgctcagacagtgcacccacagtcagccaccagtatcgcggcccccgacactcatccttccccaacgaatcgtagcaagagaaacttagaggtcgagattatcctgacactttctcagggcttgaaaaagtattacggtaaaattctgaggctactccacctgacccttgaagaggatactgaagggctgttggagtggtgcaagcggaatctcggactggactgtgatgacaccttctttcaaaaacgcatcgaagagttctttataacaggcgagggccacttcaacgaagtgttacagtttagaaccccggggactgtatcaacaacggagagtacccatgcaggaccccctactgctgaaccattcaagagctattttgccaagggtttcctgtccatcgattctggctactattcggctaaatgctacagcgggacatccaattcaggactccagcttattaacatcaccaggcacagtacacggattgccgacactcccggccctaagatcaccaatctgaaaacgataaactgtattaatttgaaggcactaacctttaaagagcatcgcgaagttgagatcaacgtgctgctcccacaggtcgccgtgaacctgtctaattgccacgtggtcattaagagccatgtttgtgactactcccttgatatcgacggtacagtgcgactgccccacatccaccatgaggggattttcataccgggcacttataagatcgtaattgataaaaagaacaaattgaatgacagatgcaccctctttacagattgtgtgatcaagggaagggaagtccggaaaggccaatcagtgctgaagcagtacaaaactgagatacgtattgggaaggctagcaccggatctcgcagattactgtccgaagagagtagcgacgattgcatctctaggacgcagctactccggacagaaaccgcggagatccacggtgacaactatggcgggcctggagataagattactatctgtaatggctccacaattgttgaccaacgactgggttcagagcttgggtgctacaccataaaccgcgtgaaaactttcaagttgtgcgaaaatagtgcaaccggcaaaagctgtgagatcgattcggtcccagtgaagtgcagacagggatattgtctgaaaattacacaggaaggcagggggcatgtaaagctctcccggggatctgaggttgtgctggacgcctgcgacacgagctgtgaggtcatgatccccaagggtaccggcgatatccttgtggactgctcagggggacagcaacactttctgaaagataacttgattgacctcggctgtcctaagatacccctgttaggtaaaatggctatctacatttgccgcatgagtaatcacccaaagactacaatggccttcctgttctggttttccttcgggtatgtcatcacctgtgtgctatgcaaagcaatcttttacctcctgattatagttggcacacttggaaagagattgaagcagtacagggaactgaaacctcagacttgtaccatctgcgagacgacacccgtgaacgccattgatgctgaaatgcatgacctcaattgctcttataacatctgtccatactgcgccagccgtctgacctccgatggcttagcacggcacgtaactcagtgtccgaagcgaaaagagaaggtcgaagagaccgagctgtatcttaatttggaaaggattccttgggtggttagacgcctcctgcaagtgtcagagagcacaggggtcgcgctaaaacggagttcttggctgatcgtgctcctggtacttttcactgtgtccttgagccccgttcagtcggctccaatatcacatggaaagaccgtcgaagcctaccaggcaagagagggctatacaggtatgtgcctgtttgtgttagggtctattctcttcctggtgagttgtcttatgaagggactggtcgactccgttggcaacacgtttttccccggtttgagcatctgcaaaacctgttctattagctccatcaatggctttgaaatagagtcacacaggtgctactgtagtctcttctgctgtccttattgccgccattgcagcgccaacaaggagatccaccagctgcacctatctatttgtaaaaagcgaaaaactgggtccaacgtgatgctggctgtgtgcaagcggatgtgttttcgtgccacaatggaagtatcaaatagagcactcttcatcaggagtattatcaacaccacttttgtcctgtgcatacttattttggctgtgtgtgttgtgagcacatccgccgtcgagatggaatctctgccagcgggaacctgggagcgcgaagaggatttaacgaatttctgccatcaagagtgtcaggtgactgacaccgaatgcctctgtccctacgaggccctggttcttcggagacctctgttcctagataacatcgtgaaaggcatgaagaatctcctgaactcgactagcttggaaacctcactgtccatcgaggctccgtggggtgcaattaatgtacagagtacttacaagccaacagtctctaccgccaacatcgctttaagctggtcctcagtggagcacaggggaaataaaattctcgtgtctggccgaagcgaaagtataatgaagctggaggaacgcacaggtatctcctgggaccttggggtcgaggatgccagcgaatctaaactgttgactgtttcagtgatggacctctcccagatgtatagtcccgtatttgagtacctgagcggagaccggcaagtggaggaatggcctaaggcaacctgcacgggcgattgtccagagagatgcggttgcacatcgtctacctgtctacataaagaatggccccactccaggaactggcgttgcaatcctacttggtgttggggcgtcgggaccggatgcacatgttgcggcctggacgtgaaggatcttttcactgactatatgtttgttaagtggaaaattgagtacatcaagaccgaagcgattgtgtgtgtcgagctcacgagccaggagcgccagtgctcactgatcgaagccgggacacggttcaacttgggaccggtgaccataactctgagtgagcccagaaatatccaacagaaattaccatctgaaattatcacactccatcctaggattgaggaaggctttttcgatctgatgcacgttcagaaggtgctttccgctagcaccgtctgtaaactgcagtcatgcactcacggtgtacccggggacttgcaagtgtatcatatcggaaacctcctgaagggcgataaggttaatggtcacctagtgcataaaatagagccacactttaacacaagttggatgagctgggacggctgtgatctggactactattgcaacatgggggattggccttcctgcacctacacgggagtcactcagcacaatcatgcctctttcgtgaaccttctcaatattgagaccgactacacaaagaactttcacttccatagcaaacgagtaaccgcacacggcgatacaccccagctggacttgaaggctcggccaacttatggggccggagaaatcaccgtgttagtcgaggttgcagacatggaactgcatacgaaaaagatcgagatttccggcctcaagtttacatcactgacttgtaccggttgctacgcctgttctagtgggatatcgtgcaaagtgcgcatccacgtggatgagccggacgaacttacagtccacgttaagagcgatgaccctgatgtggtagctgcgtcctcttcactgatggccagaaaattggagttcggaaccgacagcacttttaaggcattctccgctatgcccaaaaccagtctatgtttctatattgtggaaagggagtactgcaagtcttgtagcgaagaggatacacagaaatgcgtcaatacgaagctggagcaaccacagtcaatcctcattgaacataagggcactatcataggcaaacagaacaatacctgtaaggcccgggccgggtgctggctggagtccgtgaaaagtttcttttatggacttaagaacatgttaagcggtatctttggcaatgttttcattgggatctttctgttcctcgctccctttattttgctgatcctcttctttatgttcggatggcgaatactgttttgtttcaaatgctgcagacgcacaaggggccttttcaagtaccgtcacctgaaggacgatgaagagaccggttatcggaaaattatcgaaagattgaacaataagaaagggaagaacaaactactggacggagagaggctcgcagatcgccgaatcgccgagttattttctactaagacacatattggctga

SEQ ID NO: 10361 - RNA, 5055 nt, synthetic construct
  misc_feature 1..5055: note = derived and/or modified CDS sequence (opt3) from CCHFV(Iran-53)__DQ446216.1__GP
  source 1..5055: mol_type = other RNA
atgcacatcagcctgatgtacgccgtgttctgcctccagctttgtggcctggggaagaccaacggaccccataatggtacagagcacaacaatactcatgtcatgacgacccctgacgattcccaatctccagaaccgcccgtttcaacagctttgcctgtgactccagaccccagtaccgtaacacctagcaccccagcatccggcttagaggggtctggagaagtgtatacttcgtcacccattacaaccaaaggcctgagcctacctgaggccacgagtgaaccaccggcgactacctccgtcgtgacatctagcgcttccgatactgactcaagtacccaggccgccggtgggacacccacccctacggttagaactagcctcccatcttccccctcaacacctagcaccagtcagggaactcactacccagtgaggtctctgctttccgtcacaagccccaagccggaggagacccctacgccctcgaaatctggcaaggataacctggcaaccaattccccacatcctgctacatcacggcccactgcaccacccaccacagcccagaaacctactgaaaacaatagtcacaacaccacagagcaattggaaagcctcacccacctggctactctgggctccatgatatctccaacgcagacagtgctcccgcagagcgtaacctcaatcgccattcaggacatccatactagccccaccaatcgctccaagcgaaacttagatgttgagattatcctgacacttagccaagggttgaagaaatattacggaaagatactgaaactactccacctgacccttgaggaagacactgagggtctgttggaatggtgcaagcgtaatctcggcctggattgtgacgatacatttttccagaaaagaatcgaggaatttttcattacgggggagggacattttaacgaggtgttacagttcaggaccctgggcactctctctacaaccgaatcaacacacgcgggtagtcctactgtcgagccatttaagagctatttcgcaaaggggtttctttccatcgactctggatacttctcggccaaatgctatagccggacctccaattcaggcctgcagttgattaacgtgacgcgccacagtaccagaatcgctgatacacccggccctaagataactaatctaaaaaccattaactgtatcaacctgaaggcctctgtgtttaaagaacatagggaggtcgaaattaatgttctcctgccacaagtggcagtaaaccttagcaattgccacgtggctatcaagtcccatatctgtgactactcactggacacagatggggccattcggttgccccagatacaccatgagggaactttcatcccgggtacctacaaaattgtcatcgacaaaaagagcaagctcaacgatcgctgcacgctgtttacaaattgtgtgataaagggccgagaggttagaaaagggcagtctgtgttaaggcaatataagaccgaaattcggatcggacgtgcgtccactggcagtcgcagactgctaagcgaggaatctggtgacgattgcatctccaggacacagctcctgcggaccgagactgccgaagtccacggggacaactacggcggacctggcgataaaattaccatctgtaatgggtcaacagtggtagaccagcgacttggaagtgagttgggttgctatacgattaaccgcgttagaagtttcaagctgtgcgaaaattcggcaaccggcaagtcctgtgaaatagattctatcccagtgaaatgcaagcaggggtactgtctcaaaattactcaagagggaaggggccacgtcaagctgagccggggttcagaagtggtccttgacgtgtgcgatagttcctgtgaggttatgatccccaaagggacaggcgacatcctggtggactgctctggaggccagcagcatttcttgaaggataacctcgtagacctggggtgtcctaagattcccttactgggaaaaatggctatatatatctgccgcatgagcaatcacccaaagaccacaatggcctttctattctggttttccttcggttacgtcattacttgtatcctctgcaaagctatctttttcctgcttattatatttggcaccttggggaagagattcaaacagtatagggagctgaagcctcaaacgtgtacaatctgcgaaaccactcccgtgaacgccattgatgcagagatgcatgacctcaattgctcatacaacatctgtccatactgcgccagccgtctgaccagtgatggattagctcggcacgttacacagtgtccgcgaagaaaggaaaaagtggaggaaactgagctgtatcttaatttggagaggattccttgggtcgtgcgcaagctcctgcaggtatctgaatccaccggcacagtgctaaaacggagctcgtggctgatcgttctcctggtcctttttacggtgtcattgtctcccgtgcagagtgcgccaataggtcacgggaagaccattgagacttacagagtcagggaagagtatacatccatctgcctgttcgttttaggcagcattctctttatcgtgtctttcctgatgaaaggacttgtggacggcgtagggaacatatttttccccggactgagcgtctgtaagacctgctccatcggctcaattaacggtttcgaaatcgagagtcataaatgttactgcagcttgttttgttgcccttattgtcgccactgctctgcagatggggagattcatcaactccacctgtccatctgcaagaagcgaaaaactggatcaaatgtgatgctagccgtttgtaagcggatgtgcttccgtgctacaatggaagtgagtaacaaagccctgtttataagaagcattatcaataccacgttcgtcgtgtgtatcctcattctggcagtttgcgtggtatccacttctgccgtcgagatggaatcgcttccagctggcacctgggagagggaagaggacttgacaaacttttgtcatcaggagtgccaggtgaccgaaactgagtgtctgtgcccctacgaagccttagtgctccgccggcctctgttccttgatagcatcgtcaagggtatgaaaaatctgctaaactcaacatccctcgagaccagtctgtctattgaggcaccgtggggcgcgataaatgttcagagcacatataagccaactgtgtccaccgctaacatcgccttgtcatggtctagcgtagaacacagagggaataaggtgctggtcagtggaaggtccgagagcattatgaaattagaggagcgaacgggcatctcttgggacctcggggtggaagatgcatcagagtccaagctgcttacagttagtgtgatggacctgagccaaatgtactcgcccgtctttgagtacttgtctggagatcgccaggtggaagagtggcctaaagccacctgtactggcgactgcccagaacggtgtggttgcacctccagcacatgcctccacaaggagtggccccattcaagaaactggaggtgtaatcctacttggtgctggggagttgggaccggctgtacgtgctgtggtctggacgtgaaagatctattcacagactatatgtttgtcaagtggaaggtagaatacattaaaaccgaggctatcgtgtgcgttgagctgacaagtcaggaacgtcaatgttctcttatagaggccggcactcgcttcaacctcgggtccgtgaccatcactctgagcgaaccgcggaatattcagcagaagttgcccccagagatcattacactgcaccctaaaatcgaagagggatttttcgatttaatgcatgtccagaaggtgctctcagcaagtaccgtatgcaaactgcaaagctgtacgcacggcgtgcccggggaccttcaggtctatcatataggaaacctgttgaagggcgatagagttaatggtcacctcattcacaagatcgagcagcattttaacacttcctggatgtcttgggacgggtgcgatctggactactattgtaacatgggagattggccaagctgcacctacacaggcgtgacccagcacaatcatgcttccttcgtgaacctactgaatatcgaaacagactatactaaaaccttccactttcactcaaagagggtcacggcccatggtgatacacctcaacttgacctcaaagcgcgacccacttacggcgccggggaggtgaccgttctggtagaagtggctgatatggagttgcacacaaagaaaattgagatatctggattaaagttcgcaggcctgacctgcactgggtgttacgcctgcagttcgggaatcagctgtaaagtccggattcatgtggacgaaccagacgagctcaccgttcacgtgaagtccgatgacccggatgtcgtggctgcctcttcaagcctgatggcacgcaaacttgaatttggcacagactccacgttcaaggcgtttagtgccatgcctaagacttctctgtgcttctatatcgtagagagagaatactgtaaaagctgctcaaaggaggatacccagaaatgtgtcaacacaaagttggagcagccccagtccattctaatcgaacataagggtaccataatcgggaaacaaaataacacttgcacagctaaggccagttgttggctggagagcgtgaaatcctttttctatggactcaagaatatgctgggcggcatttttgggaacgttttcatcggaatttttaccttccttacgccattcatcttactgatactctttttcatgtttggttggaggattttgttctgctttaaatgttgccggcgaactagaggcctgttcaagtaccgccacctcaaggacgatgaagagacagggtataggaaaatcatcgaacgtctgaataacaagaaaggaaagaatcggcttctggacggcgagagattggcagataggaaaattgctgagctattttctaccaagacccacatcggttga

SEQ ID NO: 10362 - RNA, 5055 nt, synthetic construct
  misc_feature 1..5055: note = derived and/or modified CDS sequence (opt3) from CCHFV(Iran-52)__DQ446215.1__GP
  source 1..5055: mol_type = other RNA
atgcacatcagcctgatgtacgccgtgttctgcctccagctttgtggcctggggaagaccaacggaccccataatggtacagagcacaacaatactcatgtcatgacgacccctgacgattcccaatctccagaaccgcccgtttcaacagctttgcctgtgactccagaccccagtaccgtaacacctagcaccccagcatccggcttagaggggtctggagaagtgtatacttcgtcacccattacaaccaaaggcctgagcctacctgaggccacgagtgaaccaccggcgactacctccgtcgtgacatctagcgcttccgatactgactcaagtacccaggccgccggtgatacacccacccctacggttagaactagcctcccatcttccccctcaacacctagcaccagtcaggggactcactacccagtgaggtctctgctttccgtcacaagccccaagccggaggagacccctacgccctcgaaatctggaaaggacgatctggcaaccaactccccacatcctgctacatcacggcccactaccccacccacaactgcacagaaacctaccgaaaataacagtcacaatacaaccgagcaattggaaagcctcactcacctggccacgctgggcctcatgatatccccaacacagaccgtgttaccgcagtctgtaactagcatcgctattcaggacatccataactcacccaccaatcgcagtaagcgaaacctggatatggagattatccttacattgtcccaaggcctgaagaaatattacgggaagatactaaaactcctgcaccttaccctggaggaagacactgagggattgctcgaatggtgcaagcgtaatctgggtttagattgtgacgatacatttttccagaaaagaatcgaggaatttttcattacgggcgaggggcattttaacgaggttctgcagttcaggaccctcggaactcttagcacaaccgaatctacacacgccggctcacctactgtggagccatttaagagttatttcgcgaagggttttctgagcatcgactccgggtacttctctgcaaaatgctattcgcggaccagcaattccggattgcagctaattaacgtcacgcgccactcaaccagaatcgccgacacacccggccctaagataactaatctgaaaaccattaactgtatgaacctcaaggctagtgtgtttaaagaacatagggaggtggaaatcaatgtcctgcttccacaagttgccgtgaacctgtctaattgccacgtagcaattaagagccatatctgtgattactccttggacacagatggcgctatccggctcccccagattcaccatgaggggactttcataccgggaacctacaaaatcgtgattgacaagaagtcaaaactgaacgatcgctgcacgttatttacaaattgtgtcatcaagggtcgagaggtgagaaaaggccagagcgttctgaggcaatataagaccgaaatacggattgggcgtgcctctactggatcccgcagactactcagtgaggaaagcggcgacgattgcatctctaggacacagctgcttcggaccgagactgcggaagtgcacggtgacaactacgggggccctggagataaaatcaccatttgtaatggctccacagtcgtggaccagcgattggggtcagagctgggatgctatacgatcaaccgcgtaagaagtttcaagctctgcgagaatagcgccaccggtaagtcgtgtgaaattgattccataccagttaaatgcaagcagggctactgtctgaaaatcactcaagaggggaggggacacgtgaagctctctcggggcagcgaagtcgtgctggacgtctgcgactcaagttgtgaggtgatgattcccaaaggtacaggggatatcttggttgactgctccggcggacagcagcatttcctcaaggataacctggtggacttaggctgtcctaagatccccctgctagggaaaatggcaatttatatatgccgcatgtctaatcacccaaagaccacaatggcttttctcttctggtttagcttcggatacgtaatcacttgtattctgtgcaaagccatctttttccttttgattatctttggtaccctgggcaagagattcaaacagtatagggagctcaagcctcaaacgtgtacaatatgcgaaaccactcccgtcaacgctatcgatgccgagatgcatgacctgaattgctcctacaacatttgtccatactgcgcatcacgtttaaccagcgatgggctggcccggcacgtgacacagtgtccgcgaagaaaggaaaaagttgaggaaactgagctttatttgaatctcgagaggatcccttgggtggtccgcaagctgctacaggtgagtgaatctaccggaacagtactgaaacggtccagctggctcattgtgctgcttgttttgtttacggtctcgctgtcacccgtgcagtctgctccaatcggccacggtaagaccatagagacttacagagtgagggaagagtatacaagtatttgcttattcgtcctcgggtccatcctgtttattgttagcttccttatgaaaggcctggtggacggagtgggcaacatctttttccccgggttgtctgtatgtaagacctgcagcataggatccatcaacggcttcgaaattgagtcacataaatgttactgcagtctcttttgttgcccttattgtcgccactgcagcgcggatggtgagatccatcaactgcacctatctatttgcaagaagcgaaaaactgggtccaatgtcatgctggcagtgtgtaagcggatgtgcttccgtgccacaatggaagtttcaaacaaagctctctttatcagaagtataattaataccacgttcgtggtctgtatcctgatccttgccgtgtgcgttgtgagcacttccgcagtagagatggaatctttgccagccggaacctgggagagggaagaggacctgacaaacttttgtcatcaggagtgccaggtcaccgaaactgagtgtttatgcccctacgaagctctcgtgctgcgccggcctcttttcctggattcgattgtgaagggcatgaaaaatctactcaacagcacatcactggagacctccttgagtatcgaggccccgtggggtgcaattaatgtccagtctacatataagccaactgttagcaccgcgaacatagctctgtcctggtcatctgtggaacacagaggcaataaggtattagtgagcgggaggagtgagtccatcatgaaactcgaagaacgaacgggaattagctgggacctgggcgtcgaagatgcctctgagtcaaagctgctgacagtgtccgttatggacttgagtcaaatgtacagccccgtgtttgagtacctctcgggggaccgccaggtcgaagagtggcctaaagcaacctgtactggagattgcccagaacggtgtggctgcacctcttccacatgcctgcacaaggagtggccccatagcagaaactggaggtgtaatcctacttggtgctggggtgtggggaccggatgtacgtgctgtggcctagacgttaaagatctgttcacagactatatgtttgtgaagtggaaggtcgaatacatcaaaaccgaggccattgtatgcgtggagcttacttcacaggaacgtcaatgtagtctcatcgaggctggtacacgcttcaacctgggctctgttaccataactttgtccgaaccgcggaatatccagcagaagctgcccccagagattatcacattacaccctaaaattgaagaggggtttttcgatctcatgcatgtgcagaaggtcctgagcgcctcaaccgtgtgcaaacttcaaagttgtacgcacggagtacccggcgaccttcaggtgtatcatatcgggaacttgctcaagggagatagagtcaatggccacctgatacacaagattgagcagcattttaacactagctggatgtcctgggacggttgcgatctagactactattgtaacatgggggattggccatcttgcacctacacaggagttacccagcacaatcatgcaagtttcgtgaacctgcttaatatcgaaacagactatactaaaaccttccactttcactccaagagggtgacggctcatggcgatacacctcaactcgacctgaaagcccgacccacttacggtgcgggcgagatcaccgtcttggtggaagttgccgacatggagttacacacaaagaaaattgagatatcagggctgaagttcgctggacttacctgcactggctgttacgcatgctctagtgggatctcgtgtaaagtacggattcatgtggaggagccagatgaactgaccgtccacgtgaaaagcgacgatccggacgttgtggccgcttcctcttcacttatggcccgcaagctggagtttggaacagatagcacgttcaaagcattttccgcgatgcctaagactagcttgtgcttctatatcgtcgaaagagagtactgtaaatcttgcagcaaggaggacacccagaaatgtgtgaacacaaagctagaacagccccagtcaattctgatcgagcataagggcaccataatcggtaaacaaaataacacttgcacagccaaggcttcctgttggctcgaaagtgtaaagagctttttctatgggctgaagaatatgcttggaggcatttttggcaacgtcttcatcgggatttttaccttcttaacgccattcatcctgctcatattgtttttcatgtttggatggaggattctgttctgctttaaatgttgccggcgaactagaggtctcttcaagtaccgccacctgaaggatgacgaggaaacaggctataggaaaatcatcgagcgtcttaataacaagaaagggaagaatcggctgttggatggagagagactagccgacaggaaaattgcagaactgttttctaccaagacccacatcggctga

SEQ ID NO: 10363 - RNA, 5055 nt, synthetic construct
  misc_feature 1..5055: note = derived and/or modified CDS sequence (opt3) from CCHFV(75024)__AB069671.1__GP
  source 1..5055: mol_type = other RNA
atgcacatcagcctgatgtgcgccgtgctctgtcttcagctgtacggcttgggggagacccatggatcctctaacgaaacagagcacaataagactaacgtcgttacgacccccggtgactcacaaagtcctgaaccattagtgagcacaactctgccggtaaccctagattcctctacagtgacccccactacccctgcttcgggcccagaggggtcaggagaagtctataccagcccgcctattacgactgagggcctcagtccatccgaggcaacctctgaactgcccgccacaactggtatagggatcagctccgcgtcagacgtggatagtagcacccaggctgccggagacacatctacccctacggttagaacttccccacccaattcaagcagtacaccccctacctctcaggatactcatcacccaatgaggaaccttctgtccgtgaccagcttgaaacccgaggaaacatcggcaccttctaagtccggcaaagagtcaccagccgctagtagcccccatccggtcgcatcccggcctcccacgccacctaccacagcccagggccccattgagaataactctcacaatactaccgggcaactcgaaagcgtgacacagtcagctactctgggaccaatggccagtcccacccagacagtactgtcccagaacgttaccagcatcgcgattcaagacactcacccttctccaacgaatcgctcaaagcgaaacctcgagatggaaatcatattaacactgccgcagggtcttaaaaagtactatggcaaggtgttgcgtctgctacagctcaccctggaggaagatactgaggggcttctggagtggtgcaaaagaaatttgggactcgactgtgatgacaccttctttcagaagaggatcgaagagttctttattacaggcgaaggtcatttcaacgaggtcctgcaatttcggacccccgggactttaagtacaacggaaagcacccacgcagagtcccctactgccgagccattcaaatcttactttgctaagggattcctgtcgatcgatagcggctatttttccgccaaatgctactcacgcacaagtaattctggcctccagcttattaacgtgaccagacatagcacaaggatcgcagacactcccgggcctaagataaccaatctgaagacgatttcctgtatcaacttgaaggcttcagtgttcaaagaacaccgggaggtcgaaattaacgttctactgccacaggtggccgtaaatctcagcaactgccacgtgaccatcaaatctcatgtctgtgattattccctggacatcgacggaacagtgcgccttccccacattcatcacgagggtacttttataccgggcacctacaagatcgttattgataaaaagaataaactgaacgaccgatgcacattgttcactaattgtgtgatcaaggggagagaagtcaggaagggacaaagtgtgctccggcagtacaaaaccgagatacgtattggcaaggcgagcacgggttctcgcagactgttatccgaggaatcaggggatgactgcatcagtaggacacagctgctacggaccgagactgccgaaatccatggcgataactatggaggccctggggacaaaattacaatctgtaatggaagcaccattgtagatcagcgactcggttcggagatgggctgctacactataaaccgcgttaagtcctttaaactgtgcgaaaattctgcaaccggaaagagctgtgaaatcgactcaattccagtgaagtgcagacaagggtattgtcttaaaatcacacaggagggcaggggtcacgtcaagttgagtcgggggtccgaagtggtcctggatgcttgcgactctagctgtgaggtgatgatccccaaaggcacgggagatattctcgttgactgctccggcgggcagcagcacttcctgaaggacaaccttatagatctgggatgtccttcaatccccttgctcggtaaaatggccatttacatctgccgcatgagcaatcatccaaagaccactatggctttcctgttttggttcagttttggctatgtgattacatgtatcttatgcaaggccatattctacctgctaatcattgtagggaccctcggaaaaagatttaagcaatatagggaactgaaacctcagacatgtactatctgcgagaccacgcccgcaaacgccattgacgctgagatgcacgatcttaattgctcttacaacatctgtccatactgcgcgtcccgtttgacaagcgacggcctggcacggcatgtcacccagtgtccgaagcgaaaagaaaaggtggaggaaactgagctctatctgaatttagaaagaataccttgggttgtgaggaagctgcttcaggtctcggagtcaaccggtgtggccttgaaacgctctagttggctcattgtactgctagtgctgttcgctatctccctcagccccgttcaatctgccccaattgggcacggcaagacaatcgagacttaccaggcacgggaagagtataccagcatatgcctgtttgtccttggatccatcttgttcattgtgtcatgtctgatgaaaggcttagtggatagtatcgggaacatctttttccccggactcagcatttgcaagacatgttctataggctccattaacggttttgaaatcgagtcacacaaatgctactgtagtctgctttgctgtccttattgcagacattgcagcgccgacagggaaatccaccagctgcatttgtccatttgtaagaaacgcaagacggggtctaatgtcatgctcgctgtttgcaagcgaatgtgtttccgggccaccatggaggtgtcgaacaaagcactgctaatccgtagcattataaatactacatttgtggtatgcatcctgattctcgcggtctgtgtggtttcaacctccgctgtggagatggaaagtctgccagccggaacttgggagagagaagaggatcttacaaacttctgccaccaggagtgtcaagtcaccgaaacggagtgcttgtgtccctacgaagcactggtgttaaggcgccctctcttcctggactctatcgttcggggcatgaagaatcagcttaacagcacttccctggagacctcactatctattgaagccccgtggggtgctatcaatgtgcagagcacatataaaccaaccgtaagtactgccaacatagcactctcctggagctctgtcgagcatagaggcaataagatcctggtgtcagggaggtccgagagtattatgaaattggaggagcgaacaggaatcagctgggatctgggcgtggaagacgcttcggagtctaagttactcaccgtctccgttatggatctgagccaaatgtactcacccgtgtttgaataccttagtggggaccgccaggtagaggagtggcctaaggccacatgcactggagattgtccagaacggtgcggctgcaccacgtctacatgtctgcacaaagagtggccccactccagaaactggaggtgcaatcctacctggtgttggggtgtggggactggatgcacctgttgcggcttggacgtcaaggacctcttcacagattatatgattgtgaaatggaaggttgaatacatcaaaactgaggcgatagtgtgtgtcgaactgaccagccaggagcgtcagtgctcactaattgaggccggtacgcgctttaacctgggcagtgtgacaatcacccttagcgaaccgcggaatatccaacagaagctacccccagagattataactctgcatcctagaatcgaagaggggttctttgacttgatgcacgttcagaaggtgctgtccgcttctacagtctgtaaattacagagctgcacccatggagtacccggcgatctccaagtgtatcacgttgggaacctgcttaagggagacaaagtgaatggccatctgattcacaagatcgagccacacttgaacacttcctggatgtcatgggatggttgtgacctcgattactattgcaacatgggggactggccttcttgcacatacaccggagtcacgcagcataatcacgcaagtttcgtgaacctgctaaatattgaaactgattataccaaatcgtttcatttccacagcaagagggtaacagcccacggcgacacaccccagctggatcttaaggctcgaccaacatacggtgccggcgagatcactgtgctcgtcgaagttgcagacatggagtttaccccgaaaaagatagaaatctccgggctgaaattcgcgtctttgacgtgtacaggatgctacgcctgttcaagcggcatttcctgcaaggtgcggatccatgtggatgagcctgacgagttaactgtccacgtgaaaagtgacgatcccgacgttgtagctgcctctagctcactgatggcacgcaagctcgaatttgggaccgattccacattcaaggcttttagtgccatgccaaaaaccagcctgtgtttctatattgtggagagagaatactgcaagtcttgttccaaagaggacactcagaagtgcgtcaacaccaaacttgaacaaccccagtcaatcctgatagagcataagggaacaattatcggcaaacagaataacacgtgtactgcaaaggccagctgctggttggagtcggtgaagtctttcttttatggtctcaaaaatatgctgagtgggatcttcggaaacctctttatgggcattttcctgtttcttgctcctttcatcttactgatactctttttcatgtttggctggaggattttgttctgttttaagtgctgccggcgaaccagagggctgttcaaataccgccacctcaaggatgacgaagagacaggatataggcgtatcattgaacggctgaataacaaaaagggtaagaataaacttctggatggcgagagattggcggacaggcgcatcgccgaactattctccaccaagactcatatagggtga

SEQ ID NO: 10364 - RNA, 5055 nt, synthetic construct
  misc_feature 1..5055: note = derived and/or modified CDS sequence (opt3) from CCHFV(7803)__AB069672.1__GP
  source 1..5055: mol_type = other RNA
atgcacatcagcctgatgtgcgccgtgctctgtcttcagctgtacggcttgggggagacccatggatcctctaacgaaacagagcacaataagactaacgtcgttacgacccccggtgactcacaaagtcctgaaccattagtgagcacaactctgccggtaaccctagattcctctacagtgacccccactacccctgcttcggagccagaaggctcaggggaggtctataccagcccgcctattacgactgagggactcagtccatccgaagcaacctctgagctgcccgtgacaactggcataggtatcagctccgcctcagacgttgatagtagcacccaggcggctggggacacatctacccctacggtgagaacttccccacccaattcacccagcacacctccaaccagtcaggatactcatcaccccatgaggaaccttctgtctgtcacatccttgaaaagcgaagagacctcggccccttctaagtccggaaaagagtcaccagcagccagtagcccccatccggtggcttcccggcctcccacgcacccaattaccgcacagggccctacagaaaataactctcacaatactaccggccaactcgagagcgtaacacagtcagccactctggggcccatggctagtccaacccagacagttctgtcccagaacgtgaccagcatcgccattcaagacactcatccctctcctacgaatcgctcaaagcgaaacctcgaaatggagatcatattaacactgccacagggacttaaaaagtactatggtaaggtcttgcgtctgctacagctcaccctggaagaggatactgagggccttctggaatggtgcaaaagaaatttggggctcgactgtgatgacaccttctttcagaagaggatcgaggagttctttattacaggagaaggccacttcaacgaagtgctgcaatttcggaccccgggtactttaagtacaacggagagcacccatgcggagtcccccactgcagaacctttcaaatcttactttgccaaggggttcctgtcgatcgatagcggatatttttccgctaaatgctactcacgcacaagtgactctggcctccagcttattaatgtgaccagacacagcacaaggatcgccgatactccaggccccaagataaccaacctgaagacgatttcctgtatcaatttgaaagcatcagtcttcaaggagcaccgggaagttgagattaacgtgctactgcctcaggtagctgtgaacctcagcaattgccatgtcaccatcaaatctcacgtgtgtgactattccctggacatcgatgggacagttcgccttccacatattcaccatgaaggaacttttatacccggtacctacaagatcgtgattgacaaaaagaacaaactgaatgatcgatgcacattgttcactaactgtgtcatcaagggcagagaggtgaggaaggggcaaagtgtactccggcagtacaaaaccgagatacgtattggaaaggccagcacgggctctcgcagactgttatccgaagagtcaggtgacgattgcatcagtaggacacagctgctacggaccgaaactgcggagatccacggggacaattatggcggaccgggcgataaaattacaatctgtaacgggagcaccattgttgaccagcgactcggatcggagatgggttgctacactataaatcgcgtgaagtcctttaaactgtgcgaaaactctgccaccggcaagagctgtgagatcgattcaattcctgtcaagtgcagacaagggtattgtcttaaaatcacacaggaaggaaggggccacgtgaagttgagtcggggttccgaggtcatcctggacgcatgcgattctagctgtgaagtgatgattccaaaagggacgggcgacatactcgttgactgctccggaggccagcagcatttcctgaaggataatcttatcgacctggggtgtccctcaattcctttgctcggaaaaatggctatctacatttgccgcatgagcaaccaccccaagaccactatggccttcctgttttggttcagttttggttatgtgatcacatgtatattatgcaaggctatcttctacctgctaattatcgtaggcaccctcgggaaaagatttaagcaatatagggagctgaaaccacagacatgtactatttgcgagaccacgcctgccaatgcaatcgatgccgaaatgcatgaccttaactgctcttacaatatatgtccctactgcgcttcccgtttgacaagcgatggactggcgcggcacgtcacccagtgtccaaagcgaaaagagaaggtggaagagactgaactctatctgaacttagagaggattccgtgggttgtgagaaagctgcttcaggtctcggagtcaaccggcgtggcattgaaacgctctagttggctcatcgtactgctagtgctgttcgccatttccctcagccctgttcaatctgctcccatcagccacggtaagacaatagaaacttaccaggcccgggaggaatatacctccatctgcctgtttgtccttgggtcaattttgttcatcgtgagttgtctgatgaaaggcttagtggacagcattggaaatatctttttcccaggcctctctatatgcaagacatgttccattgggtcaatcaacggatttgagatcgaaagtcataaatgctactgtagcctgctttgctgtccctattgcagacactgctccgcagatagggagattcatcagctgcacttgtctatctgtaagaaacgcaagacgggctcgaacgtcatgctcgccgcttgcaagcgaatgtgtttccgggccaccatggaggttagcaataaagcactgctaattcgttcaataatcaacactacatttgtggtgtacattctgatcctcgcggtatgcgtcgtgtccaccagtgctgttgaaatggagtctctgcctgccggtacttgggaaagagaggaggaccttacaaatttctgtcatcaggaatgccaagtgaccgagacggaatgtttgtgcccatatgaggcactggtcttaaggcgccccctcttcctggatagcattgtgcgggggatgaagaaccctcttaattccacttcactggaaacctctctaagcatcgaggccccgtggggagctataaacgttcagagtacatacaaaccaaccgtgtccactgccaatatcgcactcagctggtcttcagtagagcacagaggcaacaagattctggtctccggtaggagtgaaagcatcatgaaattggaggaacgaacaggcatttcgtgggacctgggggtggaggatgcttctgaatccaagttactcaccgtgagcgtcatggacctgtcacagatgtacagtcccgtttttgagtatctttctggagatcgccaagtggaggaatggcctaaggccacatgtactggcgactgcccagagcggtgtgggtgcaccacgtccacatgcctgcacaaagaatggccccatagcagaaattggaggtgtaaccctacctggtgctggggagtaggcactggttgtacctgctgtgggttggacgtgaaggatctcttcacagactacatgatcgtcaaatggaaggtggagtatataaaaactcgtggaattgtttgcgtggaactgacctcacaggagcgccagtgtagtctaatcgaggcgggcacgcggtttaatctgggtagcgtcacaatcaccctttccgaaccgagaaacattcagcaaaagctacccccagagataatcactctgcaccctaggattgaagagggcttctttgatttgatgcatgtgcagaaggttctgtctgccagcacagtgtgcaaattacagtcctgtacccacggggtccccggagacctccaggtataccatgtgggcaatctgcttaagggggataaagttaacggacacctgatccacaagattgagccacatttgaatacttcatggatgtcttgggacggctgcgatctcgactattactgtaacatgggtgattggcctagttgcacatataccggggtgacgcaacacaaccatgcttcgttcgtcaatctgctaaacatcgaaactgactacaccaagagctttcacttccactccaaacgagtgacagcacatggagatacaccccagctggaccttaaggcccggccaacatacggcgctggtgagataactgtactcgtggaagtcgccgatatggagtttaccccgaaaaagatcgaaatttctggcctgaaattcgcatcattgacgtgcacagggtgttatgcgtgcagctccggaatcagttgtaaggttcgcattcacgtggacgagcctgacgagttaactgtgcatgtcaaatctgatgaccccgatgtggttgccgctagctcatccctgatggccagaaagctcgaatttggcaccgacagtacattcaaagcatttagcgctatgccaaagacctctctgtgcttctacatcgtagagagggaatattgtaagtcctgctcaaaagaggatactcagaagtgtgtgaataccaaacttgaacagccccaaagcatactgattgagcacaaggggacaatcatcggaaaacagaacaatacgtgcactgccaaggcatcgtgttggttggagtctgtcaagagtttcttttacggcctcaaaaacatgctgtccggtattttcgggaactttttcatgggaatctttctcttcctggccccttttatacttttaattctgttctttatgttcggctggcggatcctcttttgcttcaagtgttgccgaagaacccgcggcttgttcaaatataggcatctgaaggacgatgaagagacagggtaccgtcggattatcgaaagactcaataataaaaagggaaagaacaaactgcttgacggtgagaggctggctgatcgccgaatagcggaattgtttagcaccaagactcacattggctga

SEQ ID NO: 10365 - RNA, 5055 nt, synthetic construct
  misc_feature 1..5055: note = derived and/or modified CDS sequence (opt3) from CCHFV(Hodzha)__AY223476.1__GP
  source 1..5055: mol_type = other RNA
atgcacatcctgctcatgtgcgccgtgctttgtctgcagcaatacggcttgggggagacccatagacccaacaatggaacagaacacaacaagactaatgtcttaacgacccctggtgacaaactgagcccagagctaccggtttccacagctctctctgtgactcccgattcaagtaccgtaacacctaccactccagtgagcggcctggaagggtccggagacgtctatacatctccccctgtgaccacgaagggcctttcgccatcaaaagcaactagcgagctgcccgccagttccggtattgatacctctagcgcgtccgacgttgattcaagtacacaggctgccagggacactagcaccttgacagtgcggacctctcctccatcctcaccgagcacgccccctactagccaggatacataccatctcgtccgcaacctgctgtctgtgacctccccatggcccgaagagactacagcacctagcaagtcggggaaagagtctccagtagccaatagcccccacccggttacctcacgacctagtagtcccccaataacggtgcagggacctaccgaaaactcctctcataatacaactggccaactcgagagcatggctcagtcaaccacattagtccccatggcaagtccaactcagaccgtgctgtcccagagcgtgacatctcttgccgtccaagacgctcacccctcacctaccaaccgtagtaagagaaatttggaaatggttatcattctgactctaccacagggcctcaagaaatattacgggaaggtgctgaggcttctgcagttgacgctcgaggaggatacagaaggactgttagagtggtgcaaacggaacctgggtctcgactgtgatgacaccttctttcagaagcgcatcgaagagttctttattactggcgaagggcacttcaatgaggtacttcaatttaaaaccccgagcacactgtccaccactgagtctacacatgccgtgtcgcccacggcggaacctttcaagagctattttgcaaagggattcttgtccatcgattcaggctactttagtgccaaatgctattctaagaccagcaactccggtctacagctgataaatgtcactagacactcaacaaggatcgctgacaccccagggcccaaaattacaaacctcaagactatcagctgtattaatctgaaagcctctgtgttcaaggagcatcgggaagttgagatcaacgtgcttctgcctcaggtcgcagtgaacttgtccaattgccacgtaaccataaaaagtcacgtttgtgactacagcctcgatgtggacggaacggtccgcctgccacatattcaccatggcggcacctttatccccgggacatacaagattgtgatcgataagaaaaacaagttaaatgaccgatgcactctgtataccaactgtgtcatcaaaggaagagaagtgaggaagggtcaatctattctacggcagtacaaaacagagatacgtatcggcaaggcttccactgggtcacgcagactcctgagtgaggaaagcggagatgactgcatttcgaggacccagcttttgcggacggagacagccgaaatccacggcgatgactatggtgggccgggcgataagataaccatttgtaatggatccactatcgttgaccagcgactgggctctgagctcgggtgctacacaatcaaccgcgtgaaatccttcaagctgtgcaaaaattcagcgaccggaaagagttgtgaaattgattccactcctgtaaaatgcagacaaggttattgtcttaagatcacccaggagggcagggggcatgtcaagctgtctcggggaagcgaggtggttttggacgcctgcgactcctcatgtgaagtgatgattccaaaaggcacaggtgatatactcgtcgactgcagcgggggccagcagcactttctgaaggataacttaatcgacctgggatgtccccgcattcctctactcggcaaaatggcaatctacatctgcagaatgagtaatcaccccaagacgaccatggctttcctgttctggttttctttcgggtatgtgattacttgtatactttgcaaagccatcttttacttgctgattatcgtaggaacactcggtaagaggttcaagcaataccgtgagctgaaaccacagacctgtacaatttgcgaaactacccctgctaacgccatcgatgcagagatgcatgacttaaattgctcctataacatatgtccctactgcgccagccggctgacgtcggatggccttgctcgacacgtgacacagtgtccaaagagaaaagagaaggttgaagagaccgaattgtatctcaatctggagaggatcccgtggattgtccgcaaactacttcaggtgtcagaatctactggggtggcgctcaagcggagttcctggctgatcgtccttttggttctgtttgcagtgagcttatctcctgtgcaaagcgcccccattggacatggcaaaaccatcgagacataccaggctagagaggactatacttccatatgcctcttcgtactgggttcaattctttttatcgtcagttgtctgatgaaggggttggtggatagcattggcaacatcttctttccaggactcaccatatgcaagacatgttctatcggctccattaatgggttcgaaatcgagtcacacaaatgctactgtagtctgctatgctgtccctattgcaggcactgcagcgccgaccgcgaaattcatcagctgcacctctccatctgtaagaaacgaaagacgggatctaacgttatgctggcagtgtgcaaacggatgtgttttcgtgccaccatggaggtctcgaacaaggctcttttgataagaagcattatcaatactacattcgtggtttgcatcctgattttagccgtgtgtgtagtctcaacctccgcagtggaaatggagagtctccctgcgggcacttgggagagggaagaggatctgacaaacttttgccatcaggaatgtcaagtgaccgagacggaatgcctttgtccatacgaggctctggtcctacgccggcccctcttcctggactctatcgttaagggtactaaaaatttgctgaacagcacctccttagagacatcactctctattgaagccccttggggagcaataaatgtgcagagcacctacaagccgactgtaagtacagccaacatcgctctgtcctggagctctgtggagcacagagggaataaaattcttgtctcaggcaggtccgaaagtatcatgaagctggaggagcgaaccggtattagctgggatttgggcgtggaagacgcctcggagtctaaactcctgacagtttccgtgatggacctaagccagatgtattcaccagtcttcgaatacctgagtggggatcgccaagtggaggaatggcccaaggcaacttgcaccggagactgtcctgagcggtgcggctgcacgtcttccacatgtcttcataaggagtggccacacagcagaaactggaggtgcaatcccacctggtgttggggagttgggactggctgcacctgttgcggtctcgatgtgaaagacctgtttacagattatatgttcgtcaagtggaaagtagactacatcaagactgaagctatagtgtgtgttgagttgacctcacaggaacgtcagtgcagtctggtggaggccgggacgcgctttaacttaggacctgtcacaatcaccctcagcgaaccgcggaatattcagcaaaaactgcccccagagatcattactcttcaccctagaatcgaggaaggcttctttgatctgatgcatgtgcagaaggtattgtccgcgtctacagtgtgtaagctccagagctgcacccacggtgtccccggcgacctgcaggtttatcatatagggaacctactgaaaggagataaggtgaatggccaccttattcataaaatcgagccacacttcaacacttcctggatgtcatgggacgggtgtgatctcgactactattgcaatatgggagattggccttcttgcacatacaccggcgtgacgcaacacaaccatgccagttttgtcaacctgttgaatatcgaaactgactacaccaagtcgttccactttcatagcaaaagggtgacagctcacggtgacactccccagttagatctgaaggcacgaccaacatatggggccggagagattactgttctcgtagaagtggctgacatggagctgcacaccaaaaagatagagatcacgggccttaagttcgcctccctgacatgtactggttgctacgcatgttcttcaggcattagctgcaaagtccggatccatgtggatgaaccggacgagttgaccgttcacgtgaagtccgatgaccctgatgtcgtggcggccagttctagcctaatggctcgcaaactggaatttgggacagactcaaccttcaaggccttttccgcaatgcccaaaaccagtctctgtttctatattgtagagagagagtactgcaagagctgttctaaggaagatacccagaaatgcgtcaacacaaagctggagcagccacaatccatccttatagaaaggaaaggaacgatcattggcaagcagaataacacttgtaccgctaaagcctcatgctggttagagagcgtgaagtcgttcttttatgggctgaagaatatgctctctggaatcttcggcaacgtttttgtgggtattttcttgtttctggcacccttcatcctcctgatactgtttttcatgtttgggtggcggattctgttctgttttaaatgctgccgaagaacacgcggattgttcaagtacaaacatctaaaggacgatgaagagaccggctataggcgtatcatcgagcggctgaataacaaaaagggcaagaataaactcttagacggggaaagactggccgacaggcgcattgctgagcttttcagtactaagacacacatcggatga

SEQ ID NO: 10366 - RNA, 5055 nt, synthetic construct
  misc_feature 1..5055: note = derived and/or modified CDS sequence (opt3) from CCHFV(Hodzha)__KX013448.1__GP
  source 1..5055: mol_type = other RNA
atgcacatcctgctcatgtgcgccgtgctttgtctgcagcaatacggcttgggggagacccatagacccaacaatggaacagaacacaacaagactaatgtcttaacgacccctagcgacaaactgtccccagagccgcccgtttctacagctctatcagtgactcctgatagtagcaccgtaacaccaaccactcccgtgtccggtctcgaaggctctggggaggtctatacatcgcctccagtgaccacgaagggactgtcacccagcaaagcaaccagtgaacttcctgccactacaggcattgacacttcctctgcgagcgatgttgactcctcaacccaggctgccagggatacaagtaccctgacggtgcggactagcccaccgtcttccccctcaacacctccaaccagccaggacacttaccatttggtccgcaacctcctgagtgtgacatctccccgacctgaggagaccacggcaccatccaagagcggtaaagaatcgcccgtagccaattctccgcaccctgttacctcccgtccctcaagtccacctataacagtgcaggggcccactgagaacagctcccataataccacaggacaactggaatctatggctcagagcactaccctcgtcccaatggcatcacccacacagaccgtgttaagtcagtccgtgactagcctggccgtccaagatgctcacccttctccaacgaacagatcaaagaggaatcttgagatggagatcattttgacactgccgcagggcctaaagaaatattacggcaaggttctccggctgcttcagctgaccttggaagaggacactgaagggctcctggagtggtgcaaacgcaacttaggactggattgtgacgataccttctttcagaagagaatcgaagagttctttattacaggtgagggccacttcaatgaagtgctccaatttaaaacccccagtactcttagcacaacggagtccacccatgccgtatctcctactgcggaaccattcaagtcgtattttgcaaaggggttcctgagcatcgactccggatacttttcagccaaatgctatagtaagacatctaacagcggcttgcagctaataaatgtgaccaggcactccacacggatcgctgatactcccggtcctaaaattaccaacctgaagacgatctcatgtattaatctcaaagccagcgtcttcaaggagcatcgcgaagtggagatcaacgttctgcttccacaggtggcagtcaacctgtctaattgccacgtgaccataaaatcccacgtatgtgactacagtttggacgttgatgggacagtgcgactcccccatattcaccatggaggcacttttatcccgggcacctacaagattgtcatcgacaagaaaaacaagctgaatgatagatgcacattatatactaactgtgtgatcaaagggagggaggtccggaagggacaaagcattctgcgtcagtacaaaaccgaaatacgcatcggtaaggcttctacgggctccagaaggctactctcagaggaaagtggggacgattgcattagccggacacagctgcttcgaaccgagactgccgaaatccacggagacgattatggcggtcctggggacaagataacaatttgtaatggctcgaccatcgtggatcagcgcttgggatccgagctgggctgctacactatcaacagagttaaatctttcaagctctgcgagaatagcgcgaccgggaaatcatgtgaaattgacagtacaccagtgaagtgcaggcaaggatattgtctgaaaatcacgcaggagggtcggggccatgtaaaactttcccgcgggtctgaagtcgtgctggatgcctgcgacagctcctgtgaggttatgattcccaagggaaccggcgacatattggtggattgctcaggtgggcagcagcactttctcaaagacaacctgatcgatttaggctgtcctaggattcccctgctaggaaagatggcaatctacatctgcagaatgagcaatcacccagagactacaatggctttcctcttctggtttagtttcggctatgtcattacctgtatactgtgcaaagccatcttttaccttttgattatcgtggggacactgggaaagcgtttcaaacaataccgggaactcaagcctcagacttgtaccatttgcgagacgacacccgctaacgccatcgacgcagaaatgcatgatctgaattgctcttataacatatgtccatactgcgcctcccgattaaccagcgacggtctggctagacacgtaactcagtgtccgaagaggaaagagaaggtggaagagaccgagctttatttgaatctcgaacgcatcccttggattgttcggaaactgctacaggtctcggagtcaacaggcgtggcgctgaagagatctagttggctcatcgtgctgcttgtcttgtttgcagtttccctgagccccgtgcaatctgccccaattgggcatggaaaaactatcgaaacctaccaggctagggaggaatatacaagcatatgcttattcgtgctcggctccattctgtttatcgtatcatgtcttatgaagggtctggtcgatagtattgggaacatcttctttcccggcttgacgatatgcaaaacctgtagcatcggatctattaatggcttcgagatcgagtcccacaagtgctactgttcactcctgtgctgtccttattgccgccactgcccagccgaccgagaaattcatcagctacacctgagtatctgtaagaaacggaagactgggagcaacgtgatgctcgcagtttgcaaacgtatgtgttttagagccacaatggaggtgtccaacaaggctctgcttataaggtctattatcaataccactttcgtcgtgtgcatcttgattctggccgtttgtgtggtatcgacaagcgcagtcgaaatggagtcattacccgcgggaacctgggaacgcgaggaggatctcacgaacttttgccatcaggaatgtcaagtgactgagaccgaatgcctgtgtccttacgaggctcttgtgctgcggagaccgctattcctcgactccatcgtcaaaggcaagaagaatctgttgaacagtacatctctggagaccagcttatccattgaagccccatggggtgcaataaatgttcagtcaacttacaaacccacagtgtctaccgccaacatcgctctcagctggagttccgtagagcacagggggaataagattctggtgagcggacgatctgaatcaatcatgaaacttgaggaacgcacaggcatttcctgggatctgggtgtcgaggacgccagtgagagcaagttgctcactgtgtcggttatggatctgtctcagatgtattcccctgtgttcgaatacctaagcggcgaccggcaagtcgaggaatggccaaaagcaacctgcacgggggactgttcagagagatgcggatgcacaagttctacctgtctgcataaggaatggccccactccaggaactggcgttgcaatcctacttggtgttggggcgtggggaccggatgcacatgttgcggccttgatgttaaggacctctttactgattatatgttcgtgaaatggaaggtcgactacatcaaaaccgaggctatagtatgtgtggagctgacgagccaggaacgccagtgctcattggttgaggccggtacacggtttaacctggggccggtgaccatcactttaagtgaacccagaaatattcagcaaaagctcccacctgagatcattacactgcaccccaggatcgaagagggattctttgatcttatgcatgtccagaaagtgctgagcgcgtccaccgtatgtaagttgcagtcttgcactcacggcgtgccaggtgacctccaggtctatcatataggcaacctgctaaagggggataaagttaatggacacctgattcataagatcgagcctcacttcaacacaagctggatgtcctgggacggctgtgatcttgactactattgcaatatgggggattggccctcatgcacctacacgggagtgactcaacacaaccatgcctcttttgtgaacctcctgaatatcgaaaccgactacacaaaaagtttccactttcattcgaagcgagtcaccgctcacggcgatacaccacagttggacttaaaagcacggccgacttatggtgccggggagattaccgtgctggttgaagtagctgacatggagctccacacgaagaaaatagagatcacaggactgaagttcgccagccttacttgtaccggctgctacgcatgttcctctggtatttcatgcaaggtgcgcatccatgtcgatgaacctgacgagctgacagtgcacgttaaaagcgatgaccccgatgtggtcgcggcctccagttctttgatggctagaaagctagaatttggcaccgacagcactttcaaagccttttcagcaatgccaaagacctccctgtgtttctatattgtggagagggaatactgcaaaagttgtagcaaggaggatacacagaagtgcgtaaacacgaaactcgagcagccccaatctatcctgatagaacagaaggggactatcattggaaaacagaataacacctgtacagctaaggcctcctgctggcttgagtcagtcaagagcttcttttatggcttaaagaatatgctgtcggggatcttcggaaacgtgtttgttggcattttcctctttttggcacctttcatcctgctcatactgtttttcatgtttggttggcggattcttttctgttttaagtgctgccgaagaacccgcgggctgttcaaatacaagcatttgaaagacgatgaagagactggatataggcgtatcatcgaacggctaaataacaagaaaggcaagaataagctgctcgacggcgagagattagccgataggcgcattgctgagctgttctctacaaaaacccacatcgggtga

SEQ ID NO: 10367 - RNA, 5055 nt, synthetic construct
  misc_feature 1..5055: note = derived and/or modified CDS sequence (opt3) from CCHFV(Baghdad 12)__AJ538197.2__GP
  source 1..5055: mol_type = other RNA
atgcacatcagcctgatttacgccgtgctctgccttcagctgtatggcttgggggagacccatggatcctcttcaggtacagaacacaacagaactaatgtcgttgctacgcccggcgggagtcaaagccctgagccattagtgtccaccacactgccggtaactctagactcttcgaccgtgacacccgcaacccaggcctcaggacctgaaggcagcggtgaggtctacacaagtccacccactaccacggaagggctctccccttctgatgcgactagcgagctgccaaccacaactggaataggcatctcctcaagtagcgacgtgaactcttccacccaggctgccggcgatacatcaacccccacggcaaggactagccttcctgacagtccatctacaccgcccacctcccaggatactcatcaccctatgcggaatctgttgagcgttacatcgctcaagccagaggaaacccccgccccttctaaatccgggaaggagtcaccagctgcaagtagcccccatccggtggcctcccgccctcccacgccatctaccacagctcaaggacctactgaaaacaatagccgaaacaccacagtccagctgaaatcagtgactcagagtgccaccctgggtcccatggcgtccccaacacagaccgtactcttacaaagcgttacttctattgcaatccaggacacgcacccctcacctacaaatcgtagtagaaggaacctggagatggagattatccttaccttgccacagggcctgaagaaatattacgggaaggtgctacggctcctgcagcttactctggaagaggataccgaaggattgctcgagtggtgtaagcgcaatctgggcttagactgcgatgacacattctttcagaaaagaatagaagagttctttatcaccggtgaggggcacttcaacgaagtcctgcagtttaggactccgggaacactcagcacgaccgagtccactcatgccggctctcccacagtggaacctttcaagtcgtattttgctaaaggcttccttctgattgatagcgggtacttttccgccaagtgttattcacggaccagtaattctggattgcagctaatcaacgtgacacgccacagcactaaaattgcagacaccccaggtcccaagatcacgaatctgaagaccatatcctgcattaacctcaaagctagcatcttcaaggagcatcgagaaattgagatcaatgtcctgcttcctcaagttgccgtgaacctgagcaactgtcacgtaacaatcaaatctcacgtgtgcgattactccttgaatattgacggcactgtcaagctcccacatatacaccatgaggggatctttattcccggaacctacaaaatcgtgatagacaagaaaaacaagctgaatgatagatgtacattattcactaactgcgttattaagggcagggaagtgcggaaaggtcagagtgtcctgcgtcagtataagaccgagatccgcatcgggaaagcgagcacgggctctagaaggctactctccgaagagtcaggagacgattgtattagtcggacacgactgcttcgcaccgaaactgccgagatccacggcgacagctacgggggaccgggtgataagattacaatatgcaatggctcgaccatcgtggaccagagattggggtccgagatgggatgttatactattaacagggtaaaatcttttaagctgtgcgaaaatagcgcaaccggcaagtcatgcaaaatcgatagtatccctgttaagtgtcggcaaggttactgcctcaaaattacacaggaggggcgcggccatgtgaagctgtccagaggatctgaagtcgtgcttgacgcttgtgatagctcctgcgaggtcatgataccaaaaggcacgggggacatcctggtggattgttcaggaggtcagcagcacttcttgaaggacaacctcattgacctgggctgccccaatatccctttactggggaagatggccatttatatctgtaggatgagcaaccaccccaaaaccactatggctttcctattttggttcagttttggatacgttataacatgcatcctctgtaaggccattttctatctgcttatcattgtgggcaccttgggtaaacgttttaagcaataccgggagctgaaaccacagacatgcactatctgtgaaaccacgcctgtaaatgcaatagatgccgagatgcatgacctcaactgctcttacaatatttgcccctattgtgcttcccgactgacaagcgatgggttagcgagacacgtcacccagtgcccaaagaggaaggaaaaagtggaggaaactgagctgtaccttaacttggagcgcatcccgtgggttgtgcggaagctcctgcaggtctcggaatcaaccggcgtggcactaaaaagatctagttggctgattgtactcctggtgcttttggccgtttccagctctcctgtccaaagcgctcccatcggatatggcaagacaatagagacttaccaggccagggaagggtatacctccatctgtctgttcgtgttaggatcaattctctttatcgtgagttgcctgacaaaaggccttgtcgacagcattggtaatatcttctttccagggctgtctatatgtaagacgtgctccattggatcaatcaacggcttcgaggttgaaagtcataaatgttactgcagcttgctctgttgcccctattgtcgccactgctccgcagatcgagagatccaccagctgcatctatctatttgcaagaagcggaaaaccggttcgagcgtgatgctggccgtgtgtaagcgtatgtgctttagagctactatggaggtatcaaacaaagccctcctgatcaggtccattataaatacaaccttcgtcgtgtgtatccttactttggcagtttgcgtggtcagtacatctgcggtggaaatggagagcctgcctgctggcacctgggaacgcgaggaagacttaacgaacttttgtcaccaggagtgccaagttactgagaccgaatgtctctgcccatacgaggccctggtgcttcggaagcccctgttcctagattccattgtaaaagggacaaagaatctcctgaactcaacctctttggaaactagcctgagtatcgaggcaccttggggagccattaatgtccagtccacatacaagccgaccgtgagcacagctaacatcgccttatcttggtcatccgtggagcatagaggcaataaaatactcgtcagtgggaggagcgaatcgatcatgaagctggaggaacgaactggaatttcttgggaccttggcgttgaggatgcatccgaaagcaaactgttgaccgtgtcagtaatggacctcagtcagatgtattctccagtgttcgagtacctgtccggtgatcgccaagtcgaggaatggcccaaggctacgtgtacaggggactgccctgagcggtgtggatgcaccacttcaacctgcctacacaaagaatggccacattcaagaaactggaggtgtaatcccacatggtgctggggcgtgggtactggctgtacctgctgtgggctggatgttaaggacctttttacggactatatgttcgtgaagtggaaagtcgagtacatcaagacagatgccattgtgtgcgttgaactcaccagtcaggagcgtcagtgtagcctgatcgaggcgggaactcgctttaacttgggctccgtgacaataaccctgtctgaacctcggaatattcagcaaaaattaccgcccgagatcatcactctccacccaagaattgaagaggggttctttgacctgatgcacgtccagaaggtacttagcgcctccacagtgtgcaaactgcagtcatgtacccatggagttcctggcgatttgcaagtgtatcacataggtaacctcctgaagggggacaaggtcaatggacatctaatccacaaaattgaaccccatttcaacacgtcttggatgagttgggatggctgcgacctggattactattgtaatatgggtgactggccatcgtgcacttacaccggcgtgacacaacacaaccacgctagctttgtaaaccttctcaatatcgagaccgattacacaaagtccttccattttcactctaaaagggtgactgcacatggggacacccctcagctggatttgaaggtccgacccacgtatggagccggcgagattacagttttagtggaagtggctgacatggagctgcacactaaaaagatcgaaatatcagggctcaaattcgccagcctgacctgcacaggatgttacgcatgctccagtggcatctcttgtaaggtccggattcacgtggatgagccagacgagcttaccgttcatgtaaagagcgacgatccggacgtggtcgcggcctcatccagtctgatggctcgcaaattggaatttggtactgatagcaccttcaaggccttttctgcaatgcctaaaacatccctatgcttctatatcgtggagagagaatactgtaagtcatgcagcaaagaggacacgcagaagtgtgttaacactaagctggaacagccccaatcgattctcatcgagcacaaagggaccataattggaaagcagaataacacatgcaccgctaaaacttcttgttggctggagagtgtgaagtccttcttttatggccttaaaaatatgttaagcggcatcttcgggaactttttcatgggaatctttctgttcctcgccccatttattttgctgatcctcttctttatgttcggttggaggatactgttttgcttcaagtgttgccggcgaacaagaggccttttcaagtaccgccatctgaaagatgacgaagagaccgggtataggcgtattatcgaacggttgaataacaagaaaggaaagaataaactactggatggcgagagactcgcagacaggcgcattgccgaattattttcaacgaagactcacatcggttga

SEQ ID NO: 10368 - RNA, 5055 nt, synthetic construct
  misc_feature 1..5055: note = derived and/or modified CDS sequence (opt3) from CCHFV(TADJ/HU8966 )__AY179962.1__GP
  source 1..5055: mol_type = other RNA
atgcacatgctgctcatgtgcgccgtgctttgtctgcagttgtacggcttagggggaaccctgagaagcaacaatggtacagagcataacaagactaatgtcctaacgacccccggcgacaaactctcccctgaaccaccggtttctacagctctgcccgtgactcctgattcaagtaccgtaacaccaaccactcccgcaagcgggcttgagggatccggcgaagtgtatacatctcctccaatcaccacgaagggtctgtcgccctcagaggccactagcgaacctccagcgaccacagggatgggaattagttccgcttctggcgtcgacttcagcactcaagccgcaagggatacctccacattgaccgtgctcacgtcaccgcccaacagtcctaatactccacccacaagccaggacacccaccatcctgttcggtctctgctgtccgtgacttcaccacgccccgaggagacaaccgccccgagcaaaagtggcaaggaatctcctgctgcaaactccagccaccccgtcacgtcgcgaccatcttcccctctcataaccgtgcgtgggcccacagaaaattcaagtcataacactaccggacagttagaaagcatgacacagtccactaccctggtaccaatggcctctcccacacaaaccgttcttagccagtcagtgacttccatcgctgtccaggatgcccacccttccagcacgaatagatctaaaaggaacttggagatggagattatcctgacactaccacagggtctcaagaagtactatggcaaagtgctgcggcttctgcaattgaccctcgaagaggacactgaagggctgttagagtggtgcaagcgcaatctgggactcgattgtgacgatacctttttccagaaaagaattgaagagtttttcatcacaggcgagggtcactttaacgaagtgcttcagttcaggaccccggggactctgtcaacaacggagagtacccatgcgggaagccccactgcagaaccttttaagtcctacttcgccaaaggctttttgtctatagactcgggctatttcagcgctaagtgctactcccggacatcaaatagtgggctacgcctgatcaacgtcacccgacactctacaagaattgccgatactccaggacccaagatcaccaatctcaaaacgattagctgtatcaacctgagggcatccatatttaaggagcatcgggaagttgagattaacgtgcttctgcctcaggtagctgtgaatttgtcaaactgccacgtcgccatcaaaagccacgtgtgtgactattctctcgatgttgacggtaccgtgcgtctgccacatattcaccatggcgggacattcatccccggaacttacaagatcgtcattgacaaaaagaataaattaaacgatcgctgcaccctgtttacaaattgtgtgataaagggcagagaggtaaggaagggtcaatccatcctacggcagtacaaaactgaaattcgaatcgggaaggcgagtaccggcagccgcagactcctgtctgaggaatccggagacgattgcatatcaaggacgcagcttttgcggacagagaccgccgaaattcacggcgacgattatgggggaccgggtgacaaaatcactatctgtaacggcagtacaattgttgatcaacgcctggggagcgagctcggatgctacaccatcaatagagtgaagtcgttcaaactgtgcgagaactccgcaactggcaagaattgtgaaattgactctgtccctgtgaagtgcaggcagggttattgtcttaaaataacccaggaggggcgtggccatgtcaagctgagccggggatcagaagtggttttggatgcttgcgacagttcctgtgaggtgatgatcccaaaaggcacaggggatatttctgtagactgcagcggaggtcagcaacacttcctcaaggacaacctgatcgatttaggctgtcccaaaatccctctgctagggaagatggccatttacatatgccgaatgtccaatcaccccaagacgaccatggcttttctcttctggttttcattcggatatgtcatcactagaattttatgtaaagccatcttttaccttttgattatcgtgggcacactgggtaagaggttcaaacagtatcgcgagctcaagccacagacctgcacaatatgtgaaactacccctgcaaacgccatcgacgctgagatgcatgatctgaattgcagctacaacatttgcccctactgtgcgagtcggttaacgtctgacgggctggcaagacacgttacacagtgcccaaaaaggaaggaacgcgtggaggaaaccgagctttatttgaatctcgagcgaatcccgtggattgtccggaagctgctacaagtgtccgaaagcactggcgtagccctgaaacgttcgtcatggctcatcgtgctgcttgttttgtttaccgtctctctgagtcctgtgcagtccgctcccataggatacggcaacacaattgagacttatcaggccagagaagagtacaccagcatctgtttattcgtgctcgggtctattctgtttatcgtcagctgccttatgaagggactggttgattccataggcaacatcttctttccaggtttgacaatttgtaaaacgtgctcaatcgggagtattaatggattcgaaatcgagagccataagtgttattgctctctcctgtgttgcccctactgtaggcactgctccgcagaccgcgagatacaccagctacatctgtcaatttgcaaaaagcggaaaaccggcagtaacgtgatgctcgccgtgtgtaagagaatgtgctttagggctactatggaagtaagcaataaggccctgcttatccgatccatcattaacacaaccttcgtcgtgtgtatcttgattctggcagtttgcatagtgtctacttcggcggtcgagatggaaagcctgcctgctggtacatgggagcgcgaagaggatctcaccaatttctgtcaccaagagtgccaggtgacggaaactgagtgtctgtgcccatatgaagcccttgttctgcggagacccctatttctcgactcaatcgtgaaaggcatgaagaaccctctgaatagtaccagtttggagacatctctgagcattgaggcaccgtggggagccatcaacgtacagtccacctacaaaccaactgtctcaacagctaatattgccttatcttggagcagtatcgaacatagggggaacaatatactcgtgtccggccgtagcgagtctatcatgaagctggaggagcgcaccgggatttcaggagatcttggcgtggaagacgcatccgagagtaaactgttgacagtcagcgttatggatctctcgcagatgtactctcccgtgttcgagtatctgtccggtgaccggcaagtagaagagtggcctaaggctacttgtaccggggattgcccagaaagatgtggatgcacgagctcaacatgcctacacaaggagtggccccatagtaggaactggcgatgtaatcctacctggtgctggggcgtgggtactggctgtacctgctgtgggctggacgtcaaagacctttttatcgattacatgttcgtgaagtggaaagttgactatattaagacagaagccatcgtgtgcgtcgagctcacttctcaggagcggcagtgttccctggtggaagcgggaacccgctttaacttgggcccggttacgataacactgagcgagcccagaaatattcaacagaaattaccacctgaaatcatcaccctccaccccaggattgaggaagggttctttgatctgatgcacgtgcagaaggtcctttcagccagtactgtatgcaagctgcagagctgtacacatggagtgccaggcgacttgcaagtttaccacataggtaacctcctgaaaggggataaggagaacggacatctaatccacaaaattgagcctcatttcaatacctcctggatgtcttgggacggctgcgatctggactattactgtaacatgggtgattggcccagctgcacttatacaggcgtgacccagcacaatcacgcttcctttgtcaaccttctcaatatcgaaacggactacactaagtcattccattttcactctaaacgggtgaccgcacatggggatacaccacagctggacttgaaggcccgaccgacctacggagctggcgagattacagtattagtggaagtcgccgatatggagctgcacactaagaaaatcgagataaccgggctcaagttcgcaagtctgacgtgcacaggatgttatgcgtgctcgagcggcatctcctgtaaagttcgcattcacgtggacgaacctgacgagcttactgtgcatgtcaagtctgatgaccccgatgtggttgccgcttcaagctccctgatggccagaaaattggaatttggtaccgacagtacattcaaggcattctctgctatgccaaaaaccagcctatgcttttacatcgtagagagggaatatcgtaagtcatgttccaaggaggatactcagaaatgcgtgaacaccaagctggagcaaccccagagtattctcatcgaacacaaagggacaataattggaaagcagaataacacgtgtactgccaaagcaagctgctggctggagtctgtcaagtccttcttttacggccttaagaatatgttatcaggcatcttcgggaacgtgtttgttggaatcttcctgtttctcgcccctttcattttgctgatcctctttttcatgtttggttggcggatactgagctgtttcaaatgctgtagaaggacccgcggccttctgaagcatcgacacttgaaagacgatgaagagacagggtatagacggattatcgaaaggctaaataacaagaaaggaaagaataagctgctcgacggcgagcgcttagctgatcgtagaattgcggagctgttctcgaccaaaactcatatcggttga

SEQ ID NO: 10369 - RNA, 5055 nt, synthetic construct
  misc_feature 1..5055: note = derived and/or modified CDS sequence (opt3) from CCHFV(K168_40)__KX013457.1__GP
  source 1..5055: mol_type = other RNA
atgcacatcagcctgatgtgcgccgtgctctgtcttcagctgtacggcctcgggggaacccatggtttacacaacggcacagagcataataagactaacgctgtcacgacctcctctaattcacaaagtagcgaatcccccgcaagaacagcccctccagttactccggactctcccaccgtgacacctaccactccagcgtcggctcccgaggggtcaggagaagcccacagcagtcctccaaacaatacagagggcccctccctgcctgaatctaccagcgagccaccggcagccacgtccactggtattccctcagctagtgatgtaaacagctctacccaggcagccagggacacatccactcctaccgtgcggacatcaccacccaatagccctagtaccccacccacgccgcaggagactcatcaccctgtccgcaacctactctctgtgacatcccacaaacccgaagagaccagcgctccatcggaatctgggaaggagtcccctgccgcaaattcaccccatccagttgcgagtcgaccccctactccaagcacaaccgcccagggaccgacggagaacaataactataataccacaggccaactggaatcccttactcagtctaccacactgggccccatgactagcttgacccagacagatctccctcagtcagtgaccagtatagctgtccaagacactcacccatcccccacgaaccgtagcaaaagaaatctggagatggaaatcattctgacactccctcaggggttaaagaaatactatggaaaggtgctgaggcttttgcagctgaccctagaggaagatactgagggtctcctggagtggtgcaagcggaaccttggcctggactgtgatgacaccttctttcagaaacgcatcgaagagttctttattacaggggaaggacatttcaacgaggtattgcaatttagaaccccaggcactctctctacaacggaatcaacccacgccggtctgcccactgcagagccgttcaagagttactttgctaaagggttcttaagcatcgattccggatatttttctgccaagtgctactcgaggacaagcaattccggcctgcagctcataaacgttacccggcactcaacacgcatcgcggacactcctggcccaaaaattaccaatcttaagacgatcagttgtattaacctgaaggcctctgtgttcaaagagcatcgagaagtcgagatcaatgtgttgctaccccaggtggcagtcaacctgagcaattgccacgttaccataaagtcccatgtgtgtgattattcactcgacattgatgggacagtaagactgcctcacatccatcacgacggaacttttattcccggtacctacaaaatcgtgatcgacaggaagaacaaacttaatgatcggtgcacactgttcactaactgtgtcattaagggccgtgaagtgcgcaaagggcaaagcgttttgagacagtacaagaccgagataaggatcggaaaggcttctacgggctcccggcgactcctgagtgacgaaagcggtgatgactgcatttctcgcacacagttactgagaaccgagactgccgagatccacggggataattatggcggaccaggcgacaaaataacaatttgtaacgggtccaccatcgtggatcagaggctaggatcagaactcggttgctacactatcaatcgggtcaagagttttaaactgtgcgagaacagcgctaccggcaagtcgtgtgaagtggactccattcctgtaaaatgccgccaagggtattgtcttaagatcacacaggagggaagaggccatgttaagttgtctaggggtagcgaggtggtcctggatgcctgcgactcaagttgtgaagtgatgattcccaaagggacgggcgatatactcgtcgactgctccggaggccagcagcacttcctgaaggacaatcttatcgatctggggtgtccaaaaattccgttgctcggaaagatggcaatctacatctgccgtatgtctaaccatcctaaaaccactatggccttcctgttttggttcagctttggttatgtgattacatgtatagtttgcaaggctatcttctacttactgattatcgtgggcaccctagggaagcggtttaaacaatatcgagagctcaagccccagacatgtactatttgcgaaaccacgccaacaaacgcgatcgacgcagagatgcacgatctgaattgctcctacaacatatgtccctactgcgcctcaagacttaccagcgacggattggctaggcacgtaactcattgtcctaaacgcaaggaaaaagtcgaggagaccgaactgtatctcaatctggagcggatcccatgggtggttagaaagttacttcaggtgagtgaatctacaggcgtcgcccttaagaggtccagctggttgattgtgctcctggtactattcgcagtgtcgctgtcacccgttcagtctgcccctatcggtcacgggaaaactattgagacctaccaagtccgcgaagagtatacaagtatctgcctctttgtgctgggctccatacttttcattgtgagctgtttgatgaagggactggtcaactctgttggcaatatctttttcccggggttaagcatttgcaaaacgtgttccatcggatcaataaacggctttgagatcgaaagtcataagtgctactgtagcctcctgtgctgtccatattgccgacactgctctgctgatcgggagattcatcagcttcacctgtccatctgtaaaaagcgtaaaaccggttcaaatgtgatgttggccgtgtgcaagagaatgtgtttcagggcaactgtagaagtcagtaacaaggcgctcagcattcgctccatcataaatacaacctttgtggtttgcattctgatcctagctgtgtgtgtcgtgtctacttcggccgttgagatggaaagcctgcccgcagggacatgggagcgggaggaagacctcaccaacttctgccaccaggagtgtcaggtgacggaaactgagtgcctgtgtccttacgaggcccttgtattgagaaggccactgttcttagatggaatcgtcaaaggcatgaagaatctcctgaactcaacctcccttgaaacaagtctgtctattgaggctccctggggtgccatcaatgtgcaaagcacctataaacctactgtgtccgcagctaacattgccctatcatggtctagcgtcgaacatcgaggcaataagatactcgttagtgggcgctccgagagcatcatgaaactggaggaacggacaggaatttcttgggacttgggcgtggaggatgcgtcagaatccaagctgttaaccgtaagtgtgatggacctcagccagatgtactcgccggtctttgagtacctgtctggggatagacaggtggaagagtggcccaaggccacatgcactggagactgtccagaaaggtgcggctgcacctccagcacgtgtcttcacaaagagtggcctcattcacgtaactggcgctgcaaccccacatggtgttggggtgttgggaccggatgcacttgttgcggcctggatgtgaaggacttgttcaccgactatatgtttgtcaaatggaaggtggagtacatcaaaacagaagctattgtttgtgtggagctcacaagtcaagaacggcagtgctctctgatcgaggcaggtaccagattcaatctaggcccagtcacgataacactgtccgaacctaggaacatccagcagaagctgcccccagagattatcaccctccacccgcgaattgaggaagggtttttcgatctgatgcatgtacaaaaggtgttgagcgcctcaactgtttgtaaactgcagagttgcacacacggagtgcctggcgacttacaggtctatcacatcgggaatctcctgaagggagataaagtgaacggccatcttatacacaagattgagccccattttaataccagctggatgtcctgggacggttgtgatctggactactattgcaacatgggggattggccatcttgcacttacacaggagtaacccagcacaatcacgctagcttcatcaacttgctcaatatcgaaacggactatactaaatcctttcatttccactcaaagcgggtgaccgcccatggcgatacaccccaactggacctaaaggcacgccctaactacggtgcgggcgagattaccgtcctggttgaggtggccgatatggaacttcacactaaaaagatagagatctctgggctcaaatttgctagtctgacttgtaccggatgctacgcctgttcgagcggcatttcctgcaaggtgagaatccatgtcgacgaaccagatgagttgacggtgcacgttaaatctgacgaccccgatgtagtggcagcttcaagctccttaatggccaggaagctggagttcgggacagacagtacttttaaagcattctctgccatgcctaagaccagcctctgtttctatattgtcgaacgggagtactgcaagtcatgttccaaagaagatacacagaagtgcgtgaataccaaactggagcacccgcagagtatccttatagaacataagggaactatcattggcaaacagaacaatacctgtacagctaagacgagctgctggctggagtctgttaagtcctttttctatggtttgaaaaacatgctatcagggatctttggaaatgtgttcgtcggcatttttctgttcctcgcgccatttatcctgcttatattattctttatgttcggctggcgaatcctgttttgtttcaagtgctgcagacgcactagggggttgttccgttacaaacacttggaagacgatgaggagaccggatatcggagaattatcgaaaggctgaacaacaagaaaggtaagaataagctcctggacggcgagcgccttgccgatcgaagaattgcagaactgtttagcacaaaaacccatatcgggtga

SEQ ID NO: 10370 - RNA, 5055 nt, synthetic construct
  misc_feature 1..5055: note = derived and/or modified CDS sequence (opt3) from CCHFV(K128_76)__KX013454.1__GP
  source 1..5055: mol_type = other RNA
atgcacatcagcctgatgtgcgccgtgctctgtcttcagctgtacggcctagggggaacccatggttcccacaacgagacagaacataataagactaacgctgtcacgacctcttcagacagtcaaagccccgagcctccaacaagaactaccttaccggttacacccgattcccctaccgtgactccaacaacccccgcatctgcccctgaaggctcgggggaggtacacacgtcaccacccaatactaccgaaggacctagcctgccagagagtacaccggagccccctactgcgacctccacaggcattccatctgctagcgacgtgaactcctcaacccaggccgcaagggatacgagtactcccacagtccataccagccctccaaattctccctccactccgcctacactacaggaaacccaccaccccatgcggaacctcctgtcagtgacgagccataaaccagaggaaaccagtgccccttctgagtccggtaaggagagccccgctgcaaattcgccacaccccgttgccgaccgcccttctacatcctcaactaccgctcaggggccaacagaaaacaatagttataacactaccgagcaacttgaaagcctgacacagtccaccactttgggaccgatgacgtctctcacacagaccgtgctgagccagtcagtcacaagtatagccgtgcaagatacccatctgtcccccacaaatcgaagcaaacgtaacctcgagatggaaatcattttaaccctgcctcagggccttaagaaatactatggcaaggtattgagactgctacagctcactctggaggaggacacagaagggcttctggagtggtgcaagaggaatttggatctcgactgtgatgacacgttctttcagaaacggatcgaagagttctttattaccggagaaggttacttcaacgaggttctgcaatttcgcactccaggcacattatctaccacagagtcaactcacgcggggctgcccaccgcagaacctttcaagagttattttgccaaaggattcctcagcatcgattccggctacttttctgctaagtgctattcgagaacgagcaattccggtcttcagctgataaacgtgaccaggcactcaacacggatcgccgacactccagggcccaaaattaccaacttgaagacaatcagttgtattaatctaaaggcatctgtcttcaaagagcatcgcgaagtggagatcaacgtgctgctcccgcaggtcgctgttaatctgagcaactgccacgtgactataaagtcccatgtatgtgattactcacttgacattgacggaaccgtgaaactgcctcacatccatcacgatggcacgtttattccaggcacatacaagatcgtcatcgaccgaaagaataagttgaacgatagatgcaccctcttcactaattgtgtgattaaagggagggaagttcggaagggacaaagcgtgctgcgtcagtataagacagagatacgcatcggtaaagcctctaccggctccagaaggttactgagtgacgagagcggggatgactgcatttctcggactcagctactccgaaccgaaacagcggagatccacggagataactacggcggtcccggggacaagataacgatttgtaatggctccaccatcgtcgatcagcgcctgggatcagaacttggctgctatactatcaacagagtgaaaagttttaagttgtgcgagaatagcgccacagggaaatcgtgtgagattgactccatccctgtaaagtgcaggcaaggatactgtctgaagattacccaggaaggtcggggccatgttaaactctctcgcgggagcgaggtggtcctggatgcatgcgactcaagttgtgaagtgatgatacccaagggaacaggcgacatccttgtcgattgctccggtgggcagcagcacttcctgaaagacaacttgattgatctcggctgtccaaagatccctctgttaggaaaaatggctatctatatttgcagaatgtctaatcatcccaagactaccatggccttcctgttttggttcagctttggctacgtgataacgtgtatcgtttgcaaggctattttctatctactcatcattgtggggacactgggaaaaaggtttaagcaataccgtgagcttaaaccacagacctgtactatctgcgaaaccacaccgactaacgccatagacgcagagatgcacgatttgaattgctcctacaacatctgtccttattgcgcctcacggctgaccagcgacggtctcgctcgacacgtaacacattgtcccaagagaaaagagaaggtcgaagagacggaactgtacttaaacctggagaggattccatgggtggttcgcaaacttctccaggtgagtgaatctaccggcgtcgcgctcaaacggtccagctggctgatcgtgctactggtactcttcgcagtgtcgctgtcacccgttcagtctgcccctattagtcacgggaagactatcgagacatatcaagtcagagaggaatacacctccatatgcctttttgtgttgggaagcattctgttcatcgtgtcttgtttaatgaaaggcctcgtcaatagcgttggtaacatctttttcccagggctgtccatttgcaagacttgttcaataggcagtatcaatggatttgagattgaaagccataaatgctattgttctcttctgtgctgtccctactgcaggcactgctccgctgatcgcgagatccatcagttgcacctctcaatttgtaagaaacgaaagacaggcagtaacgtgatgctggccgtgtgcaagcggatgtgtttccgtgcaaccatggaagtaagcaataaagccctatttatcagatccataattaacacgactttcgtcgtgtgcatcctgatcctcgctgtttgtgtggtctctacctcggccgtggagatggagagcctgcctgcagggacatgggaaagggaggaagaccttaccaatttctgccaccaggagtgtcaggttactgagacagaatgcttgtgtccgtatgaggcgctggtgttacgccggccactctttcaagattcaattgtaaagggaatgaaaaacctgcttaattccaccagtctggaaacatctctaagcatcgaggctccctggggcgccattaacgtccagtccacttacaagcctgcagtgtcagccgctaatatagccctctcttggagcagtgtggaacatagaggttccaaaatcctggtcagcgggaggtctgagtcaattatgaagttggaggaacgaaccggaatctcctgggacctgggcgttgaggatgcaagtgaaagcaagttactcacggtgtcggtaatggacctgtctcagatgtactccccagtgttcgagtatcttagcggtgatcgccaagtcgaagagtggcccaaagctacatgcaccggcgactgtcctgagcggtgcgggtgcacttcaagtacctgtctgcacaaggaatggccgcattctagaaactggaggtgcaatcccacatggtgttggggagtgggcactgggtgcacctgttgcggattggacgttaaagatctctttacggactacatgttcgtgaagtggaaagtcgagtatattaagacagaagccatcgtgtgtgttgagctgacctcccaggaacgtcagtgcagcctaatagaggcgggcactcgctttaacctgggtccagtgacaatcaccctttcagagcctcggaatattcagcaaaagttgcccccagaaatcattactctgcaccctagaatcgaggaagggttctttgatttgatgcatgtccagaaagtactgagtgccagcacagtgtgtaagttacagtcctgcacccacggagttcccggcgacctccaggtgtaccacataggtaacctgcttaaaggcgatagggtcaacgggcatctgattcacaagatcgagccacatttcaatacgtcttggatgagctgggacggatgtgatttggactattactgcaacatgggcgattggccgtcctgcacttataccggggtgacacaacacaatcacgcttcatttgtaaacctcctgaatatcgagaccgactacacaaaatctttccattttcacagtaagcgagtgactgcacatggagatacccctcagctagacctgaaggcccggcccaactacggcgctggtgaaattacggtccttgttgaggtggccgatatggaactccacactaaaaagatagagatctcggggctgaaattcgcgagcttgacttgtaccggatgctatgcatgttcctctggcatttcatgcaaggtgcgcatccatgtcgacgaaccagacgagttaacagtgcacgttaaaagcgatgaccccgatgtagtggccgcttccagttctctgatggccagaaagctcgagtttggtaccgacagcactttcaaagcattctcagctatgcctaagacctccctgtgtttttacattgtcgaaagggagtattgcaagagttgtagcaaagaagatacacagaagtgcgtgaatacgaaacttgagcagccacaatctatcctgatagaacacaagggcactatcattgggaaacagaacaatacctgtacagccaagacctcctgctggttggagtcagttaagagcttcttttacggattgaaaaacatgctgtcgggcatcttcgggaatgtgtttgtcggaattttcctctttctggcacccttcatccttttaatactgtttttcatgtttggctggcggattctcttctgtttcaagtgctgccgaagaactcgcggtttgtttaggtataaacatctggagaacgacgaagagacagggtaccgtcggatcatcgaaagactcaataacaagaaaggaaagaataagctgcttgatggcgagaggctggccgaccgccgaattgctgaattgttctctaccaaaacgcacatcggctga

SEQ ID NO: 10371 - RNA, 5055 nt, synthetic construct
  misc_feature 1..5055: note = derived and/or modified CDS sequence (opt3) from CCHFV(K168_125)__KX013460.1__GP
  source 1..5055: mol_type = other RNA
atgcacatcagcctgatgtgcgccgtgctctgtcttcagctgtacggccttgggggaacccatggtttacacaacggcacagagcataataagactaacgctgtcacgacctcctctaattcacaaagtagcgaatcccccgcaagaacagcccctccagttactccggactctcccaccgtgacacctaccactccagcgtcggctcccgaggggtcaggagaagcccacagcagtcctccaaacaatacagagggcccctccctgcctgaatctaccagcgagccaccggcagccacgtccactggtattccctcagctagtgatgtaaacagctctacccaggcagccagggacacatccactcctaccgtgcggacatcaccacccaatagccctagtaccccacccacgccgcaggagactcatcaccctgtccgcaacctactctctgtgacatcccacaaacccgaagagaccagcgctccatcggaatctgggaaggagtcccctgccgcaaattcaccccatccagttgcgagtcgaccccctactccaagcacaaccgcccagggaccgacggagaacaataactataataccacaggccaactggaatcccttactcagtctaccacactgggccccatgactagcttgacccagacagatctccctcagtcagtgaccagtatagctgtccaagacactcacccatcccccacgaaccgtagcaaaagaaatctggagatggaaatcattctgacactccctcaggggttaaagaaatactatggaaaggtgctgaggcttttgcagctgaccctagaggaagatactgagggtctcctggagtggtgcaagcggaaccttggcctggactgtgatgacaccttctttcagaaacgcatcgaagagttctttattacaggggaaggacatttcaacgaggtattgcaatttagaaccccaggcactctctctacaacggaatcaacccacgccggtctgcccactgcagagccgttcaagagttactttgctaaagggttcttaagcatcgattccggatatttttctgccaagtgctactcgaggacaagcaattccggcctgcagctcataaacgttacccggcactcaacacgcatcgcggacactcctggccttaaaattaccaatctgaagacgatcagttgtattaacttgaaggcctctgtgttcaaagagcatcgagaagtcgagatcaatgtgctactgccacaggtggcagtcaacctcagcaattgccacgttaccataaagtcccatgtgtgtgattattcactggacattgatgggacagtaagacttccccacatccatcacgacggaacttttattcctggtacctacaaaatcgtgatcgacaggaagaacaaactgaatgatcggtgcacattgttcactaactgtgtcattaagggccgtgaagtgcgcaaagggcaaagcgttctcagacagtacaagaccgagataaggatcggaaaggcttctacgggctcccggcgactgttaagtgacgaaagcggtgatgactgcatttctcgcacacagctgctaagaaccgagactgccgagatccacggggataattatggcggacccggcgacaaaataacaatttgtaacgggtccaccatcgtggatcagaggctcggatcagaactgggttgctacactatcaatcgggtcaagagttttaaactttgcgagaacagcgctaccggcaagtcgtgtgaagtggactccattccagtaaaatgccgccaagggtattgtttgaagatcacacaggagggaagaggccatgttaagctgtctaggggtagcgaggtggtcctcgatgcctgcgactcaagttgtgaagtgatgattcctaaagggacgggcgatatactggtcgactgctccggaggccagcagcacttccttaaggacaatctgatcgatttggggtgtcccaaagtgccactcctgggaaagatggcaatttacatctgccgtatgtctaaccatccgaaaaccactatggccttcttattttggttcagctttggttatgttatcacatgtattgtgtgcaaggctatattctacctgctaatcattgtaggcaccctcgggaagcggtttaaacaatatcgagagctgaagcctcagacatgtactatctgcgaaaccacgcccacaaacgcgattgacgcagagatgcacgatcttaattgctcctacaacatctgtccatactgcgcctcaagattgaccagcgacggactggctaggcacgtcactcattgtcccaaacgcaaggaaaaagtggaggagaccgaactctatctgaatttagagcggataccttgggttgtgagaaagctgcttcaggtcagtgaatctacaggcgtggccttgaagaggtccagctggctcatcgtactgctagtgctgttcgcagtttcgctctcaccagtccagtctgcccccattggtcacgggaaaactatcgagacctaccaagtgcgcgaagagtatacaagtatttgcctgtttgtgcttggctccatcttgttcatagtcagctgtctgatgaagggattagttaactctgtgggcaatattttcttccctgggctcagcatctgcaaaacgtgttccattggatcaatcaacggctttgagatagaaagtcataagtgctactgtagcctgctttgctgtccgtattgccgacactgctctgctgatcgggagatccatcagctgcacttgtccatttgtaaaaagcgtaaaaccggttcaaatgtgatgctcgccgtatgcaagagaatgtgtttcagggcaactgtcgaagtgagtaacaaggcgctgagcatccgctccattatcaatacaacctttgttgtgtgcatactaattctggctgtctgtgtggtttctacttcggccgtggagatggaaagcctcccagcagggacatgggagcgggaggaagacctgaccaacttctgccaccaggagtgtcaggtaacggaaactgagtgcctttgtccctacgaggccttggtcctgagaaggcctttattcctcgattcaatcgtgaaaggaaagaaaaatctgcttaactccaccagtctggaaacatctctaagcatcgaggctccatggggcgccattaatgtgcaatccacctataagcccactgtctcagcagctaacatcgccctctcttggagcagtgttgaacatcgaggtaataaaattctggtgtccggccgcagcgagtctataatgaagttggaggaacggacagggatctcatgggacctgggagtagaggatgcgtccgaaagtaagttactcaccgtgagcgtcatggacctgtcgcagatgtactctcctgtgtttgagtacctttccggcgatagacaggttgaagagtggccgaaagccacatgcactggggactgtcccgaaaggtgcggatgcaccagctcaacgtgtctgcacaaggagtggccacatagtcgtaactggcgctgcaaccctacatggtgttggggcgtgggtaccgggtgcacttgttgcggattggatgtcaaagacctcttcaccgactatatgtttgtgaagtggaaagttgagtacattaagacagaagctatcgtgtgtgtcgagctgacttctcaagaacggcagtgctccctaattgaggcaggcaccagattcaatctgggtcccgtaacgatcacacttagcgaaccaaggaacatacagcagaagctccctcccgagatcattaccctgcacccacgaatcgaggaaggctttttcgatttgatgcatgtgcaaaaagttctgtcagccagtactgtgtgtaagttacagagctgcacacacggggtcccgggagacctccaggtgtatcacattggcaatctgcttaaaggggataaggtaaacggacatctgatccacaaaatagagcctcattttaatacctcctggatgtcttgggacggctgtgatttggactactattgcaacatgggtgattggcccagctgcacttacacaggggtgacccagcacaatcacgcttccttcattaacctcctgaatatcgaaacggactatactaagtcatttcatttccactctaagcgggtcaccgcccatggagatacaccacaactagacctgaaagcacgccccaactacggcgcgggtgagatcaccgttcttgtggaggtggccgatatggaactccacacaaagaaaattgagataagtggcctgaagtttgcttcgttgacttgtaccgggtgctacgcctgtagctccggaatctcttgcaaagtcaggattcatgtggacgaacctgatgagttaacggttcacgtaaagtcagacgacccagatgtggtcgcagctagctccagtctgatggccagaaaactcgaatttggcacagactctacttttaaggcattcagcgccatgcccaagacctcactgtgtttctatatcgtggagcgggagtactgcaaatcctgtagtaaggaagatacacagaaatgcgttaataccaagttggagcaccctcagagcattctgatcgaacataaagggactataatcggaaagcagaacaatacctgtacagctaagacgtcttgctggttggagtccgtgaaatcatttttctatggcctaaagaacatgctgagcggtatttttgggaatgtcttcgtgggaatctttctcttcctggcgccgtttattcttttaatcctgttctttatgttcggctggcgaatactcttttgtttcaaatgctgcagacgcactaggggcttgttccgttacaagcacctggaagacgatgaggagaccgggtatcggagaattatcgaaaggctcaacaacaaaaagggaaagaataaactgcttgacggtgagcgcctggccgatcgaagaatcgcagaattgttttcgacaaagacccatattggctga

SEQ ID NO: 10372 - RNA, 5052 nt, synthetic construct
  misc_feature 1..5052: note = derived and/or modified CDS sequence (opt3) from CCHFV(Kosova Hoti)__EU037902.1__GP
  source 1..5052: mol_type = other RNA
atgcacaccctgctcgtgtgcttcatcctttacctgcagttgttaggcctagggggagcccatggtcaaagcaacgctacagagcacaatggcactaacacgaccacagcacccgggacttcccagtctcctaagccaccggcctcaaccacacccagtcatgcgcctgaaccaagcaccattaaactgactacacccacctccgagacggaaggatctggcgagactacccctccaacaaatactacccaggactcgccccctctcgaaacaaccccagagagatcagctacgactgccacaagcaccagtggtactgataacatgaactccacaacccagatgacggacaataccccgacatctactgtcagcacctccctgtcaagtagcccctctacaccttccacttcacaagggatgcaccatccagttaggagccttctgagtgtgtcttcccccaagaccgcaacaacccctactccaatgagccccggagagatgtcgtctgaaacgtcctcacagcacagtgccatgagccggacaccgacccctcacactgctacccaggtatccacagagaatgcaaaccgctctaccagccgacagtcagaaagttccgcccaacccgctactcagagcccagtgacatctcctgcccagtcaatattgctcatgagtgcgacgcccaccactatccagaatattcatccaagccccacaaaccgttccaaaagaaatctggagatggagatcattctgaccctctctcaaggcttaaagaaatattacggcaagatcctgaaacttttgcacctgacactagaagaggatactgaagggctcctggagtggtgtaaaaggaaccttggatcgaattgcgacgatgactttttccagaagcggatagaagagtttttcatcaccggtgagggctattttaacgaagtcctgcagttcaaaacgttgagcaccccttcctcaacagagccaagtcatgcacgcctcccgactgccgaaccctttaagtcttacttcgctaaagggtttctgagcattgattccggatatttctcagccaagtgttaccctagaagctctacctccggcttacaactgatcaatgtgacacagcacccagcaaggattgctgagactcccggtcctaagaccacgagtctcaaaacaatcaactgcataaaccttcgggccagcgtttttaaggaacaccgcgaggtggagattaatgtcctgttgccacagatcgcggtgaacctatctaattgtcatgtagttattaactcccacgtgtgcgactattcactggataccgacgggcccgtccgactcccgagaatctaccatgaaggaactttcatgcctggcacatacaaaatcgtgattgataggaagaataaactgaacgaccggtgtacccttgtgactaattgcgtcataaagggccgtgaggttcgcaaagggcagagtgtgctgagacaatataagaccgaaatcaagattggaaaagccccaacaggtagcaggaagttgctctcggaggaacccggcgatgactgtatctcccggacgcagctgttacgaaccgagactgcagagatacacgacgataactacgggggacctggcgacaaaattacaatctgcaatggttctaccatcgtagatcagcgcctggggagcgaactaggctgttatacaattaacagagtgaagtcatttaaactctgcgagaatagtgctactggaaagacctgcgaaatcgactccacgcccgtcaagtgtaggcagggcttctgcctgaaaattacacaaaaggggcggggacatgtgaaactttctcgcggtagcgaggttgtgttggatgcctgtgactccaactgcgaggtcatgataccaaagggcaccggggatatcctggtggactgttcaggaggccagcagcacttcctcaaagataatctgattgaccttggttgccctcacatccccctgttggggaagatggctatctacatttgtagaatgagcaaccatccaaagactaccatggcctttctcttctggtttagtttcggctatgtaataacatgcatcttttgtaaagcactgttctactctttaattatcattggaactctgggcaagaaaatcaagcagtatagggaactaaaaccgcaaacctgcacaatatgtgagacggcccctgttaatgctatcgatgcggaaatgcacgacctcaactgctcctacaacatttgcccctactgtgcaagccgtctgacctcggacgggcttgcccggcatgtgaagcagtgcccaaagcgaaaagagaaggtcgaagagactgagttgtatctgaatctcgaaagaatcccctgggtggtcaggaaactgttacaggtgtcagagtctacaggagttgctctgaagcgcagttcctggcttattgtgttgctcgtactgctaaccgtcagcctgtctcctgtgcagagcgccccagttggtcacggcaaaactatcgaaacataccaaacccgggaggggtttacgtccatatgtctcttcatgctgggatcaattctttttatcgtgagttgcttggtcaagggcctggtggatagcgtatctgactccttctttcccggtttatcagtgtgtaaaacttgcagtattgggagcatcaacggcttcgaaatagagtcccacaagtgttattgctctctcttttgttgcccttactgtagacattgctcggcagatagggagatccaccagctgcatcttaatatttgcaagaaacgcaagaccggaagcaacgttatgctggccgtctgtaaacgaatgtgcttccgggctacaatcgaagcctcacgtagagcattgctcattaggtccatcataaataccactttcgtgatttgtatcctgacactaaccatctgcgtggtcagtacatctgcggttgagatggaaaacctgccggctggcacttgggagcgcgaagaggacctcaccaatttttgtcaccaggagtgccaagtgacggaaacagagtgtctgtgcccatatgaagcccttgtgttgcggaagcccctgttcttagatagcattgtaaaagggatgaagaacctccttaattccacctcactggagacttctctgagcatcgaggcaccttggggagccattaacgtccagagtacctttaagccaacagtgtccactgctaatatagccctaagctggtcttcagttgaacatagaggcaacaaaatcctcgtgaccggtaggtccgagagtattatgaagctggaggaacgaacggggatcagctgggacttgggagtcgaagatgcatcggagtctaaactgttaacagtgtccattatggacctcagccagatgtactcacccgttttcgagtatctgagtggcgatcgccaggtggaagagtggcctaaggctacctgtactggtgactgcccgcaacggtgtggctgcacatcttccacatgccttcacaaagaatggccccacagcagaaattggaggtgtaacccaacttggtgctggggagtaggaacaggctgtacctgctgtggggtcgatgtgaaggacctgtttacggatcatatgttcgtgaagtggaaagtcgagtacatcaagactgaagccatagtttgcgtggagttgacctcacaggagcgtcagtgtagtctcatcgaagcgggaacacgctttaatctgggccctgtaaccattacactaagcgagccccggaacatccagcaaaaactgccacctgaaattatcactcttcaccccaagatagaggaaggtttctttgacctcatgcatgtgcagaaagtcctgtccgcctctaccgtgtgcaagttgcagagctgtacgcacgggattccaggagacctgcaggtttaccatatcggcaacttactcaagggtgatagagtgaatggccacctgatccacaaaattgagccgcatttcaacacatcctggatgtcatgggacgggtgcgatcttgactattactgtaatatgggagattggccttcttgcacttataccggcgtcacacaacacaaccatgctgcatttgtgaatctgttgaacatagagaccgactacactaagaccttccactttcacagtaaaagggttacagcccatggggatacgccccagctcgacctgaaggctcgaccaacttatggagccggcgaaatcaccgtgctagtcgaggtagcagatatggaactgcacaccaaaaaggtggagatttcgggtcttaaattcgcgagcctcgcctgcaccgggtgttacgcttgctcctctggaatctcatgtaaggttcggattcatgtggacgagcccgatgaactgactgtccacgtaaagagctccgaccctgatgtggtggccgcaggcacaagtttgatggctcgcaaattagagttcggtaccgactctacgtttaaggccttcagcgcaatgccaaaaacttcactgtgcttttatatcgtcgaaaaggagtactgtaaatcctgcagtgaagacgatacaaagaagtgtgttgacaccaaactcgagcagccccaaagcatactgatcgagcatagaggcaccattatcgggaagcagaatgatacttgcacagccaaggcttcttgttggcttgaatccgtgaagtcattcttttacggactgaaaaacatgttgggcagcgtgttcgggaactttttcattggaatcctactgtttctcgcgcctttcgtcctgcttgtgttatttttcatgttcggctggaagatactgttttgcttcaagtgttgcaggcggacccgaggtctctttaaatatagacacttgaaggacgatgaggaaacagggtaccgcaggattatcgagcgtctgaataataaaaaggggaaaaaccggctcctggacggcgaaagacttgccgataggaagatcgcagagctgttctcgactaagacgcacattggctga

SEQ ID NO: 10373 - RNA, 5049 nt, synthetic construct
  misc_feature 1..5049: note = derived and/or modified CDS sequence (opt3) from CCHFV(Oman)__DQ211632.1__GP
  source 1..5049: mol_type = other RNA
atgcacaccctgctcgtgtacgccgtcttctgccttcagctgtggagccccggcgggacaagaggattgtccaacgagactcaacataatgaaacgggtatcaccagggctcctgagggctctcaggggccatcattaccggttagtacagcaagccccattatgtccgacccttctataactaccccatcggcctcaacaagcggactggaaggcagtggtgataccactccccctgcgatcacacaggggccaacgccccctgagaccactccagaaccgtccaccacaactggaaccaacgctttttctacagccattgcaaatgtgagcacccagacggtaaaggacactcccacacctaccgtgcaaacttccccaccctcaacacctgatgccagtaccatcccacagggcacgcaccataccgctcggggcctactcagcgtcacagtgactaaacccgaggaggttccgacccctacagggcccgaacaggcatctattgagactaactccccacgcctggccacctcaaagacacctagccccagtccaaccgctcaggtgactacggaaaattctaaccccaatacatcccgacaacttgtcctgagcacccagcctgccacttcgtctccagtgacctccccggcgcagttgatcttcgtacagtcagcaacaaccgttgccgtgcaagacgctcaccccagtcctactaaccgtagcaaaagaaatctcgagatggaggtcatactgacactgtcccagggactcaggaagtattacggtcggatcttaaaactgcttgatttgacgctggaagaggacaccgaaggcctactcgagtggtgtaagcgcaacctggggcttacttgcgatgacaatttcttccagaagagaattgaagagtttttcctgacaggagagggccattttaacgaagtgttgcaattcaaaaccccatctacactcagctcaactgagagtgcctccgtgggtctgcccaccgtcgaaccttttaagagctatttcgcaaaagggtttttatctatcgattcaggatacttcagtgctaagtgttatccaagggccagcaattccggcctgcagctcattaacgttacgcagcactctgcgcggatcgccgacacccccggcccgaaaataacaaatcttaagactattaactgcatcaacctgaaggcattggtgtttaaagagcaccgcgaaattgagatcaatgtactactgcctcaggtggctgtcaacctctcgaattgtcatgtgcacatcaagagccatgtttgcgattactccctggacattgatgggaccgtgcgacttccaagaatacaccacgagggaacattcatccccggtacttataaaattgtcatcgacaagaaaaacaagcaaaatgacaggtgtaacctggtgaccaattgcgtaataaaaggccgggaagttcgtaaggggcagtcagtgttgcgccagtacagaacggagattaggatcggaaaggccagttctggcagccggcgactcctgtccgaagagtcaggtgaagattgtatcagccgcacacagttactgagaaccgagactgctgagattcatggggacaactacggcggacctggcgataaaatcacaatttgcaatgggtctaccatagtcgaccaaaggctaggatccgaactcggttgttatactatcaaccgggtgaagagtttcaaactgtgcgagaatagcgccaccggcaagtcttgcgaaattgataacacacccgtcaaatgtaagcaggggttttgccttaagatcacgcaggagggacgcggccacgtgaaattgtccagagactcagaggttgtgctggatgcatgtgacagtagctgcgaaatcatgattccaaagggtaccggggatatactcgtagactgttcgggcggacagcaacatttcctgaaagataatcttatcgacctgggctgccctaacattcccttgctcgggaagatggccatctacatttgtaggatgtccaatcacccaaaaactacaatggcttttctgttctggttttctttcggatatgtcataacctgcatcttatgtaaggtgatcttttacctgctaattgttgtgggtacactcggcaagaaattcaagcagtatcgtgagctgaaaccgcagacttgcaccatctgtgaaacgacacctgtcaacgcgattgacgcagagatgcatgatcttaactgcagctacaatatctgcccctattgtgcctcacggttgaccagtgacgggctggctcgacacgtgatgcagtgcccaaagagaaaagaaaagatagaggagactgaactctacctgaacttagagaggattccctgggtagtgcgcaagctgcttcaagtttccgaatctaccggagtcgccttgaaacggagctcctggctcatcgtgctgctagtgctgctcacagtctcactgagccctgttcagagtgcaccaattggccacggtaagactatcgagacctaccagacaagagaagggtatacgtctatatgtctttttgtgttgggctccatcctgttcattgtgagccatttaatgaaaggactcgtagattcggtcggcaattcatttttccccgggctgtctatctgcaagacctgtagtattggatccatcaacggctttgagatagagagccacaaatgcttctgttctcttttctgctgtccttactgcaggcattgtagcgccgacaaggaaattcacaaactgcacttgtccatctgcaagaagcgcaaagctggttcaaatgtgatgctcgccgtttgcaagcgaatgtgttttcgggcaactatggaggtgagtaacaaagcgctgctaatccgtagcgtcattaatacaaccttcgtggtttgcatcctgattctcgctgtgtgtgtagtctctacttccgccgtggaaatggagtcactgccggcagggacatgggaaagagaggaggatcttaccaacttttgccatcaagaatgtcaggtgacggagactgaatgcttgtgtccatatgaggccctggtcttaaggaagcccctcttcctggacagtatagctaaaggaatgaagaatcttctgaacagcacctccctagagacatctctctcgatcgaagccccttggggcgcaattaatgttcagagcacctttaagccaactgtgtcaacagctaacatcgccctgtcctggagttctgtagagcaccgcggtaataaaattttggtgagcggccggtccgaatcaatcatgaagctggaggaaagaaccgggatatcttgggatttaggagtcgaggacgcgagcgagagtaaactcctgacagtgtccgttatggatcttagccagatgtactctcccgtgttcgaatatctgtcaggcgacaggcaagtcgaggaatggcctaaggccacttgcaccggggattgtccggagcgatgcggatgtacgtccagtacatgcttgcataaagaatggccccacagccgcaactggcggtgcaatccaacctggtgttggggcgtgggtactgggtgcacctgttgcggactcgacgttaaggatctgtttacagactacatgttcgtgaagtggaaagtcgagtatatcaagactgaggctattgtatgtgtggaactaacctcgcaggagagacagtgctctctgatcgaagcaggcacgaggtttaaccttggtcctgttacaattaccctctccgagccccgtaacatccagcaaaaactgccacctgaaatagtgactttgcatccccgcattgaggagggcttctttgacctgatgcacgtccagaaggtgttaagcgcctcaacagtatgtaaactccagagttgcacccacggggtgccaggagatctgcaggtctaccatatcggcaatcttctgaagggggacaaggttaacggacacttgatccataaagtggaaccgcacttcaatacttcttggatgtcctgggatggctgtgacctcgattactattgcaacatgggtgactggcctagctgtacatacaccggggtgacgcaacataatcacgctgcctttgtcaacctgctaaatattgagactgattataccaagaacttccacttccattcaaaacgggtgacagcacacggagacacaccccagctggatcttaaggcgagaccaaattacggcgccggtgaagttaccgtactcgtggaggtcgctgacatggagctgcatactaaaaagatagaaatcagtggcttgaaatttgccagcttaacctgcacggggtgctatgcatgttcctctggaattagctgcaaggtgaggatccacgttgatgagcccgacgaactgacagtgcacgtcaagtccgaggatcctgacattgtggctgcctcatctagtctcatggcacgaaaactggaatttggcactgactcgacctttaaggccttcagcgctatgccaaaaacatccctttgtttttacatcgtagagcgggagtattgcaagtcttgttcaaaagaagatacccagaagtgcgtcaacgcgaagctggagcgcccccaaagcatattgatcgaacataaagggactattatcggaaagcagaatgacacctgtacagccaaagcatcctgctggctagagagtgtgaagtctttcttttacggcctgaaaaacatgctcagcggtattttcgggaatgtttttatcggaatattcctgtttcttgctcctttcattttactgatcctcttctttatgttcggctggagaatcttgttttgtttcaagtgctgtaggcggacgcgaggcctgtttaagtacagacacctcaaagatgacgaagagactgggtatcgcaagattatcgagaggctgaacaataaaaagggaaagaacaaacttctggatggtgaacgtttggccgaccggaagatagccgagctattctcaaccaaaacacatattggctga

SEQ ID NO: 10374 - RNA, 5049 nt, synthetic construct
  misc_feature 1..5049: note = derived and/or modified CDS sequence (opt3) from CCHFV(Oman_812956)__KY362518.1__GP
  source 1..5049: mol_type = other RNA
atgcacaccctgctcgtgtacgccgtcttctgccttcagctgtggagccccggcgggacaagaggattgtccaacgagactcaacataatgaaacgggtatcaccagggctcctgagggctctcaggggccatcattaccggttagtacagcaagccccattatgtccgacccttctataactaccctgtcggcctcaacaagcggactagaaggcagtggtgataccactccacccgcgatcacacaggggcctaccctcccagagacgactcccgaaccttccaccacaactggaaccaacgctttttctacagccattgcaaatgtgagcacccagacggtaaaggacactccaacaccgaccgtgcaaacttcacccccttccacaccagatgccagtaccatcccccagggcacgcaccataccgctcggggcctgcttagcgtcacagtgactaaacctgaggaggttccaacccccacagggccggaacaggcatctattgagactaactcccctcgcctggccacctcaaagacacccagcccaagtcctaccgctcaggtgactacggaaaattctaaccccaatacatcccgacaattggtcctcagcacccagccagccacttcgtctcccgtgacctcccctgcgcagctgaacttcgtacagtcagcaacaaccatcgccgttcaagacgctcacccaagtccgactaatcgtagcaaaagaaacctggagatggaggtgatactcacattatcccagggactgaggaagtattacggtcggatccttaaattgctggatctaacgctcgaagaggacaccgaaggcctgcttgagtggtgtaagcgcaatctggggttgacttgcgatgacaactttttccagaagagaattgaagagtttttcctcacaggagagggccattttaatgaagtcctgcaattcaaaaccccctctacattaagccctactgagtcagccagtgtgggtctgccaaccgtggaaccctttaagtcctatttcgcaaaagggtttctcagcatcgattctggatacttctcagctaagtgttatcctagggccagtaacagcggccttcagctgattaatgtcacgcagcactccgcgcggatcgccgacaccccaggccccaaaataacaaacttgaagactattaactgcatcaatctaaaggcactggtttttaaagagcaccgcgaaattgagatcaacgtgctcctgccgcaggtagctgtgaatctttctaactgtcatgtccacatcaagtcgcatgtgtgcgattacagcctggacattgatgggaccgttcgattgcctagaatacaccacgagggaacattcatcccaggtacttataaaattgtgatcgacaagaaaaataagcaaaacgacaggtgtaatctcgtcaccaactgcgtgataaaaggccgggaagtacgtaaggggcagtccgttctgcgccagtacagaacggagattaggatcggaaaggcctcaagtggctctcggcgattactgagcgaagagtccggtgaagattgtatctcacgcacacagctactcagaaccgagactgctgagattcatggggacaattacggcggacccggcgataaaatcacaatttgcaacgggagcaccatagtggaccaaaggctgggatctgaacttggttgttatactatcaatcgggtcaagtccttcaaattgtgcgagaacagtgccaccggcaagagctgcgaaattgataatacacctgtgaaatgtaagcaggggttttgcctgaagatcacgcaggagggacgcggccacgtcaaactctctagagactccgaggtggttctggatgcatgtgactcaagttgcgaaatcatgattcccaagggtaccggggatatacttgtggactgtagcggcggacagcaacatttcctgaaagataacttgatcgacctcggctgcccaaatattcctctgttagggaagatggccatctacatttgtaggatgtcgaaccaccccaaaactacaatggcttttctgttctggttttccttcggatatgtaataacctgcatcctatgtaaggtcatcttttacctcctgattgtggttggtacacttggcaagaaattcaagcagtatcgtgagttgaaaccacagacttgcaccatctgtgaaacgacaccggtgaacgcgattgacgcagagatgcatgatctgaattgctcttacaacatctgcccttattgtgccagccggctcacctcagacgggctggctcgacacgtcatgcagtgccccaagagaaaagaaaagatagaggagactgaattatacctgaatcttgagaggattccatgggtggtacgcaagttgctccaagtgagtgaatccaccggagttgccctgaaacggtctagctggctaatcgtcctgctcgtgctgcttacagtgtccttgtcacccgtccagagcgcacctattggccacggtaagactatcgagacctaccagacaagagaagggtatacgagtatatgtctgtttgttttaggctctatcctcttcattgtgtcccatctgatgaaaggacttgtggatagcgtaggcaactcgtttttcccagggctgtcaatctgcaagacctgttctattggaagtatcaatggctttgagatagagtcccacaaatgctactgtagcttgttctgctgtccctattgcaggcattgttctgccgacaaggaaattcacaaactccacctgagcatctgcaagaagcgcaaagctggttccaacgtcatgctagccgtgtgcaagcgaatgtgtttccgggcaactatggaggtttcaaataaagcgctgctcatccgtagtgtgattaacacaacctttgtcgtgtgcatcctgattcttgctgtttgtgtggtaagcacttctgccgtcgaaatggagtccttgcctgcagggacatgggaaagagaggaggatctgaccaatttctgccatcaagaatgtcaggtgacggagactgaatgcttatgtccgtacgaggccctcgtgctgaggaagccactgtttttcgactcaatagctaaaggaatgaagaaccttctaaatagtaccagcctcgagacatccctgtctatcgaagccccctggggcgcaattaacgtccagtcgacctttaagcctactgttagcacagctaatatcgccttgtcatggtccagtgtggagcaccgcggtaacaaaattctggtatctggccggagcgaatccatcatgaagttagaggaaagaaccgggatatcatgggatctcggagtggaggacgcgtctgagagcaaactgcttacagtcagtgtgatggatctgtcccagatgtatagcccagttttcgaatacttgtctggcgacaggcaagtggaggaatggcccaaggccacttgcaccggggattgtcctgagcgatgcggatgtacgtcatccacatgcctccataaagaatggccgcacagtcgcaattggcggtgcaaccccacctggtgttggggcgtcggtactgggtgcacctgttgcggactggacgtgaaggatctatttacagactatatgttcgttaagtggaaagtggagtacatcaagactgaggctattgtctgtgtagaactgaccagccaggagagacagtgctcgcttatcgaagcaggcacgaggtttaacctcggtccagtgacaattaccctgtctgagcctcgtaatatccagcaaaaattgcccccagaaatagttactctgcatcctcgcattgaggagggcttctttgacttaatgcacgtgcagaaggtcctctccgccagcacagtgtgtaaactgcagtcatgcacccacggggtacccggagatcttcaggtgtaccatatcggcaacctgttgaagggggacaaggtcaatggacacctcatccataaagttgaaccacacttcaacacaagttggatgtcttgggatggctgtgacctggattattactgcaatatgggtgactggccgtcctgtacttataccggggtgacgcaacataaccacgctgcctttgtgaatctactgaacattgagactgattacaccaagaatttccacttccatagcaaacgggtcacagcacacggagacacccctcagcttgatctcaaggcgagacccaactatggcgccggtgaaataacagtgctggttgaggtagctgacatggagttgcatactaaaaagatcgaaatttcaggcttaaaatttgccagtctgacctgcacggggtgctacgcatgtagctccggaatctcttgcaaggtgaggattcacgtcgatgagccagacgaactcacagtgcacgttaagagcgaggatcccgacatcgtggctgcctcctcatctctgatggcacgaaaacttgagttcggcactgacagtacctttaaggccttctcggctatgcctaaaacaagcctgtgtttttatatagtcgaacgggagtactgcaagtcctgttctaaagaagatacccagaagtgcgtgaatgcgaagttggagcgcccacaatcaatcctaattgaacataaagggactatcattggaaagcagaacgacacctgtacagccaaagcaagctgctggctggagtccgtaaagagtttcttttacggcctcaaaaatatgctgtctggtatcttcgggaacgtctttataggaattttcttatttcttgctcccttcatcctgctcatcttgttctttatgttcggctggaggattctgttttgtttcaagtgctgtagacggacgcgaggcctctttaagtatagacacctgaaagatgacgaagagactgggtaccgcaagatcatagagaggcttaataacaaaaagggtaaaaacaagctgttggatggagaacgtctagccgaccggaagattgccgagctgttcagcaccaaaacacatatcggctga

SEQ ID NO: 10375 - RNA, 5049 nt, synthetic construct
  misc_feature 1..5049: note = derived and/or modified CDS sequence (opt3) from CCHFV(Oman-199809166)__KR864901.1__GP
  source 1..5049: mol_type = other RNA
atgcacaccctgctcgtgtacgccgtcttctgccttcagctgtggagccccggcgggacaagaggattgtccaacgagactcaacataatgaaacgggtatcaccagggctcctgagggctctcaggggccatcattaccggttagtacagcaagccccattatgtccgacccttctataactaccctgtcggcctcaacaagcggactagaaggcagtggtgataccactccacccgcgatcacacaggggcctaccctcccagagacgactcccgaaccttccaccacaactggaaccaacgctttttctacagccattgcaaatgtgagcacccagacggtaaaggacactccaacaccgaccgtgcaaacttctcccccttcaacaccagatgccagtaccatcccccagggcacgcaccataccgctcggggcctgcttagcgtcacagtgactaaacctgaggaggttccaacccccacagggccggaacaggcatctattgagactaactcctcacgcctggccaccagcaagacacctagtccctctccaaccgctcaggtgactacggaaaattccaaccctaatacaagccgacaattggtcctctcgacccagcccgccacttcttccccagtgacctcacccgcgcagctgaacttcgtacagagtgcaacaaccatcgccgttcaagacgctcaccctagcccaactaatcgttccaaaagaaacctggagatggaggtgatactcacattatctcagggactgaggaagtattacggtcggatccttaaattgctggatctaacgctcgaagaggacaccgaaggcctgcttgagtggtgtaagcgcaatctggggttgacttgcgatgacaactttttccagaagagaattgaagagtttttcctcacaggagagggccattttaatgaagtcctgcaattcaaaaccccgagcacattatcacccactgagagtgcctccgtgggtctgcctaccgtggaaccatttaagagctatttcgcaaaagggtttctctctatcgattcaggatacttcagtgctaagtgttatcccagggccagcaactccggccttcagctgattaatgtcacgcagcactctgcgcggatcgccgacacccctggcccaaaaataacaaacttgaagactattaactgcatcaatctaaaggcactggtttttaaagagcaccgcgaaattgagatcaacgtgctcctgccccaggtagctgtgaatctttcgaactgtcatgtccacatcaagagccatgtgtgcgattactccctggacattgatgggaccgttcgattgccgagaatacaccacgagggaacattcatccctggtacttataaaattgtgatcgacaagaaaaataagcaaaacgacaggtgtaatctcgtcaccaactgcgtgataaaaggccgggaagtacgtaaggggcagtcagttctgcgccagtacagaacggagattaggatcggaaaggccagttctggcagccggcgattactgtccgaagagtcaggtgaagattgtatcagccgcacacagctactcagaaccgagactgctgagattcatggggacaattacggcggaccaggcgataaaatcacaatttgcaacgggtctaccatagtggaccaaaggctgggatccgaacttggttgttatactatcaatcgggtcaagagtttcaaattgtgcgagaacagcgccaccggcaagtcttgcgaaattgataatacacccgtgaaatgtaagcaggggttttgcctgaagatcacgcaggagggacgcggccacgtcaaactctccagagactcagaggtggttctggatgcatgtgacagtagctgcgaaatcatgattcctaagggtaccggggatatacttgtggactgttcgggcggacagcaacatttcctgaaagataacttgatcgacctcggctgccccaatattccactgttagggaagatggccatctacatttgtaggatgtccaaccaccctaaaactacaatggcttttctgttctggttttctttcggatatgtaattacctgcatactatgtaaggtcatcttttacctcctgattgtggttggtacacttggcaagaaattcaagcagtatcgtgagttgaaaccccagacttgcaccatctgtgaaacgacaccagtgaacgcgattgacgcagagatgcatgatctgaattgcagctacaacatctgcccgtattgtgcctcacggctcaccagtgacgggctggctcgacacgtcatgcagtgccctaagagaaaagaaaagatagaggagactgaattatacctgaatcttgagaggattccctgggtggtacgcaagttgctccaagtgtccgaatctaccggagttgccctgaaacggagctcctggctaatcgtcctgctcgtgctgcttacagtgtcattgagcccagtccagagtgcacccattggccacggtaagactatcgagacctaccagacaagagaagggtatacgtctatatgtctgtttgttttaggctccatcctcttcattgtgagccatctgatgaaaggacttgtggattcggtaggcaactcatttttccctgggctgtctatctgcaagacctgtagtattggatccatcaatggctttgagatagagagccacaaatgctactgttctttgttctgctgtccatattgcaggcattgtagcgccgacaaggaaattcacaaactccacctgtccatctgcaagaagcgcaaagctggttcaaacgtcatgctagccgtgtgcaagcgaatgtgtttccgggcaactatggaggttagtaataaagcgctgctcatccgtagcgtgattaacacaacctttgtcgtgtgcatcctgattcttgctgtttgtgtggtatctacttccgccgtcgaaatggagtcattgcccgcagggacatgggaaagagaggaggatctgaccaatttctgccatcaagaatgtcaggtgacggagactgaatgcttatgtccttacgaggccctcgtgctgaggaagccgctttttctggacagtatagctaaaggaatgaagaacctactcaatagcacctccctggagacatctttgtcgatcgaagccccatggggcgcaattaacgtccagagcaccttcaagcccactgtttcaacagctaatatcgccctgtcctggagttctgtggagcaccgcggtaacaaaattttagtaagcggccggtccgaatcaatcatgaagctcgaggaaagaaccgggatatcttgggatctgggagtggaggacgcgagcgagagtaaacttctgacagtctccgtgatggatttgagccagatgtattctcctgtttttgaatacctctcaggcgacaggcaagtggaggaatggccaaaggccacttgcaccggggattgtcccgagcgatgcggatgtacgtccagtacatgcctgcataaagaatggcctcacagccgcaattggcggtgcaacccgacctggtgttggggcgtcggtactgggtgcacctgttgcggactagacgtgaaggatctgttcacagactatatgtttgttaagtggaaagtggagtacatcaagactgaggctattgtctgtgtagaacttacctcgcaggagagacagtgctctctcatcgaagcaggcacgaggttcaacctgggtcccgtgacaattaccttgtccgagccacgtaatatccagcaaaaactgcctcccgaaatagttactttacatccacgcattgaggagggctttttcgacctcatgcacgtgcagaaggtcctgagcgcctcaacagtgtgtaaacttcagagttgcacccacggggtacctggagatctccaggtgtaccatatcggcaacttgctcaagggggacaaggtcaatggacacctgatccataaagttgaaccccactttaacacttcttggatgtcctgggatggctgtgacctagattattactgcaatatgggtgactggccaagctgtacatataccggggtgacgcaacataaccacgctgccttcgtgaatctgcttaacattgagactgattacaccaagaattttcacttccattcaaaacgggtcacagcacacggagacaccccgcagctcgatctgaaggcgagacctaactatggcgccggtgaaataacagtgttggttgaggtagctgacatggagttacatactaaaaagatcgaaattagtggcctgaaattcgccagcctgacctgcacggggtgctacgcatgttcctctggaatcagctgcaaggtgaggattcacgtcgatgagcccgacgaactgacagtgcacgttaagtccgaggatccagacatcgtggctgcctcatctagtcttatggcacgaaaactggaatttggcactgactcgaccttcaaggcctttagcgctatgcccaaaacatccttgtgtttctatatagtcgagcgggagtactgcaagtcttgttcaaaagaagatacccagaagtgcgtgaatgcgaagctagagcgccctcaaagcatcctgattgaacataaagggactatcattggaaagcagaacgacacctgtacagccaaagcatcctgctggctcgagagtgtaaagtcctttttctacggcctgaaaaatatgcttagcggtatctttgggaacgtcttcataggaatctttttattcctggctccatttatcctcttgatcctgttcttcatgtttggctggaggattctcttctgttttaagtgctgtagacggacgcgaggcctgttcaagtatagacaccttaaagatgacgaagagactgggtaccgcaagatcatagagaggctgaataacaaaaagggtaaaaacaagttgctagatggagaacgtctggccgaccggaagattgccgagctcttttcaaccaaaacacatatcggctga

SEQ ID NO: 10376 - RNA, 5055 nt, synthetic construct
  misc_feature 1..5055: note = derived and/or modified CDS sequence (opt3) from CCHFV(BA66019)__AF350448.1__GP
  source 1..5055: mol_type = other RNA
atgtacaccctgctcgtgtgcgccgtcctttgtccccagctgtggagcttggagggcacacacgttcctcataacgaaactaagcacaatgggacgggaatcaccgctgcaccaggtgagtcccaaggcccgatgtctcccgcctcaacagcggtgcctttaactccagaaccccctaacaccaaaccagctgccagtgcaagcgagctggaatcctctggggagggacatacatcgctactcgccaccactcagggcctgacatcacccgaggctacccctgaacttccaacgactaccgacacaggtgtaagcagtacttccgtggtcgatattgggacccagatggcaaaggacacaccgacctctacggcccacactagcctgccctccaatccttcagctccaagtacagcccagggaacccatcacactataagaggcttgctcagcgtgacatctaccaaacccgaggaagcgtccacgcctaccgatccaggcaaggcaggggccgagacaggatcacccaggccggctatcagccggaaacctactctgagtcccaccgccgaggcaccaacagaaattaacaattcttccactcctaagcaacccgagccaagcatccagcccgctaccccttcgctggttatttctccagcccagccggcgttcccccagtccgccacatcaaccgcagctcaagacatctatagtagccctactaaccgctccaagcgaaatctcaaaatggaaataatcttaacgctgtctcagggtcttaagaaatactatggcaagattcagaaaacattggggctgaccctagaggaagatactgagggactcctggagtggtgcaagcgtaaccttggcctgacctgtgacgataactttttccagaagagaatcgaagagtttttcttgacaggtgaagggtactttaatgaggtgctccaattcaaaaccccaagcactcccggatcaacagaacctacgcacgccgaggctccaaccgtcaagccctttaaaagttatttcgccaggggctttctgactattaattccggctacttcagcgcaaagtgctattcttggacatcaaacagtgggttacagctgatcaatgtgacccagcatccggcccggatagctgacacacctggaccaaaaattactaacctcaagaccatcaattgtattaaccttaaagcgagcgtatttaaggagcaccgcgaaatcgagatcaacgttctgttgccccaagtggcagtcaatctatccaactgccatgtgctgattaagtctcacgtgtgtgattactcgctcgacatagatggtacgatcagactgcctaggatttaccacgaaggcaccttcatccccgggacatataaaatagtcattgacaagcgggataaacagaatgaccgctgcactcttgttaccaactgtgtgatcaagggacgagaggtaagaaaaggccagagcgccctgaggcagtaccggacagaaatccgtattggtaaggcttccgccgggtcacgcagattgctcagtgaggagtctggcgacgattgcatcagcaggactcaactgttacggaccgaaacggcagaggtgcatggagacaattatggcgggccaggagataagattacaatatgtaacggttccaccatcgtcgaccagcgactgggctcagaactagggtgctacactattaatcgcgtgaaatcctttaagctctgcgagaactctggaacaggcaaatcctgtaagatcgataaacaccctgttaagtgcagacagggtttctgtctgaagatcacccaggaggggaggggccatgtgaaacttagtcggggaagcgaagtcgtgttggacgcctgcgattcttcctgtgagattatgatacccaagggcactggggacatcctggtagattgctcaggaggtcaacagcacttcctcaaagacaatctggttgatcttggctgtccaaacattccgctgttggggaagatggctatctatatttgccgcatgagtaatcatcctaaaaccacaatggcctttctcttctggtttagcttcggatacgtgatcacgtgtatattttgcaagatcattttctatctgttaatcgtcgtgggcaccctgggtaagaaatttaagcagtacagagaactaaaaccccagacttgtacaatttgcgagaccacaccaactaacgcaatcgacgcggaaatgcacgacctcaagtgctcgtacaatatatgtccctattgcgcttccaggctgacctctgatgggcttgcccgtcacgtcacgcaatgtcctaaacggaaggagaaagtggaggaaacagagttgtacctgaacctcgaacgaatcccatggattgttagaaagctgttacaggtgagcgagtcaaccggcgtagcactgaagaggagttcctggcttattgtcttgctcgtgctgctaactgtttctctgagccccgtgcagtccgcccctatcggacatggcaaaaccatagaagcatatcagacacgcgaggggtacacttcagtctgcctcttcatgctgggaggcatcctttttgtggtaagctgtttgatgaagggtctggtggacagtgtttctaattccttctttccggggttaagcatttgcaaaacctgttcgatcggatcagtcaacggcttcgagattgaatctcacaagtgctattgtagtctcctgtgctgtctttactgccggcattgctccgccgatagagagatccaccaactgcacttgagcatatgtaaaaagaggcgcgctggtggcaacgtgatgctcgctgtgtgcaagcgaatgtgtctgcgggccacaatggaagtctctaataaagttctatttattcgtagcatcatcaacacgaccttcgtgatttgcatcctggtgctcgcggtatgtattgtctccacttcagccgtggagatggaaagtctgccagctgggacatgggagagagaggaagaccttaccaatttctgccatcaggagtgtcaggttactgaaacagagtgcttgtgtccctatgaggcactggtgttaaggaagcctctctttagcgattctatagtcaaaggaatgaagaacctgcttaattccacctcactggaaacgagtctaagcatcgaggccccatggggcgctattaacgtgcaatccactttcaaacccaccgtttctacagccaatatcgcactctcgtggagctcagtggaacaccgcgggaacaagattctggtatccggacggagtgagtctatcatgaagttggaagagagaaccggcataagctgggacctgggtgtcgaggatgcgtccgaatcaaaattactcactgtgtctgtgatggacctgagccagatgtacagtcctgtctttgagtacctttccggggataggcaggttgaagagtggccgaaggccacatgcaccggagactgtcccgatcgatgcggctgcacaagctctacttgtctgcataaagaatggccacactcacgcaattggcggtgcaaccctacctggtgttggggtgtgggcacggggtgcacatgttgcggattggacgtaaaggatctcttcaccgactatatgtttgtgaaatggaaggtcgagtacatcaagactgaggctattgtgtgtgttgaactgaatagccaggagagacaatgcagtctaatcgaagccggcaccaggttcaacctggggcccgtgacaattactcttagcgagccacgtaatatccagcagaaactccctcccgaaataattaccctgcatccacgcatcgaggagggatttttcgacttgatgcacgtccagaaggtgctgtcggcatctacggtttgtaaattacaatcctgcacacacggcgtgccgggtgatctccagatctatcatattgggaacctgcttaagggagaccgggtcaatggccacctgatacataaaatcgaacctcactttaacaccagctggatgtcatgggatggttgtgacttggattactattgcaacatgggcgactggcccagttgcacttacacaggggtaacccagcataatcacgctgccttcgtgaacctcctgaatattgagactgattatacaaagaactttcacttccattctaaaagagttaccgcacacggagacacgccacagctagatctgaaggccaggcccacttacggcgctggggaaatcaccgtgcttgtcgaggtggcggacatggagctccatacaaagaaaattgccatctccggactgaagtttgcaagcctaacctgtacaggctgctacgcttgttcaagtggtataagctgcaaagtacgaatccacgtggatgaacctgacgagttaactgtccacgttaagtccgaagatccagacattgtggccgcctctagctccctgatggctcggaaactcgagttcgggaccgactcaacgttcaaggcattttctgccatgcccaagacaagtctgtgtttctatatcgtggaacgcgagtactgcgagtcgtgtagcaaagaagatactcaaaagtgcgtcaataccaaacttgagcagcctcagtccattctgatcgaacataagggaacaataattggcaaacaaaacgacacctgtactgcgaaggcttcttgctggttggagtcagttaagagctttttctatggcttgaaaaatatgctgtccgggatctttggaaacgtgttcatcggtatttttctcttcctggccccgtttatccttttaatactgttctttatgttcggctggaggattctcttctgttttaagtgctgcagacggacccgagggttgttcaaatacagatatctgaaggatgacgaagagagtggataccgcaggatcattgagcgtctcaataacaaaaagggcaagaataaactgcttgatggtgaacggctggcagacagaaggatcgccgagttgttttctacaaagacgcacatagggtga

SEQ ID NO: 10377 - RNA, 5055 nt, synthetic construct
  misc_feature 1..5055: note = derived and/or modified CDS sequence (opt3) from CCHFV(SPU 18/88)__KJ682810.1__GP
  source 1..5055: mol_type = other RNA
atgtacacccccttactctgcgccatcctttgtctgcagttgtggagcttagagggcatttatgggctgtccaacaagacacaacacaatgacacttctacgataaaagtgcctgaagagtcacagaagaccagtctaccagctaacacagcaagcccgatcacttccgatccctcttcggccacctcaacagcgctcgctagcggacctgaaggtagtggcgacacctccacttctccaagcgtcacaacccaggggcccacgctgcttgagactacccctgaaccacatacaactattgatatcgacgagtcctcaaccgccattgcagatatcagtacacagaccgttaaagacatacccacgcctactacacacaccagcctgccatctactccgtccgcccccacaatccctcaagaggctcatcacaccgcaagaggattgctctcagtgacgagcaccaagccaggcgaaacaagtactcccacctctcctggtgaggcctccacagaagctagctcgccacagcccactatttctgagaccccgtcccctcccccaacaacccaggcccctactgagatcaataaccccaatacgtcaaggcagccaatgcccagtacacaacctgcggcaccaaacagcgtaaccccgcccgtgcagcctactttctcccagtctgatgtcagcaccgtggcccaggacattcatccatcacccacaaatcggagtaaacgcaacctggaaatggagatcatactgaccctctcccaagggttaaagaagtactatggaaaagttctgaaacttttggatctgactctagaagaggacacagaaggcctcctggagtggtgcaaacgaaatcttggcctgacgtgtgatgacaactttttccagaagcgtattgaggaatttttcttgaccggggagggacactttaatgaagtgctccagttcaaaactcctagcacactgtctccaaccgagcccgctagagtcgaatcaccgacagtggagccttttaagagttacttcgccaagggttttctgagcatggattccggctatttctctgcaaaatgctacccaaagtcgagcaactccgggctgcaactcatcaatgtaactcagcactcaattaggatcaccgacacgcccggacctaaaatcaccagtcttaagacaattaactgtataaatctgaaggctttggtttttaaggagcatcgggaaatcgagattaacgtgctactgccccaggtcgccgtgaacctctctaattgccacgtgctgatcaaaagccatgcgtgtgactattcccttgatatagacggcccagtccgcctgcctaggattcaccacgaaggtactttcatccccgggacctacaagatcgttattgataagaaaaacaagcagaatgacagatgcacattggtgactaactgtgtaatcaaaggacgggagattcgcaagggccaatcagtgctccgacagtacagaaccgaaataaaaatcggcaaggccagctctgggtccaggcggctgttaagtgaggagagcaatgatgactgcctgtctcgtacgcagctactccgcacagaaaacgcagagattcattccgataattatggaggtccaggcgacaagatcaccatctgtaacgggtcaactattgtcgatcagagactgggaagtgaacttggctgctacacaataaatagggtgaaatcgtttaagttgtgcgagaacagcgctaccggtaaatcctgtgagatcgactctactccggttcggtgccgacaagggttctgtctgaagattacccaggaaggccgcggacacgtgaaactcagcagaggctcagaggtcgtgctggatgcctgcgacagttcctgtgaaatcatgattcctaaggggacaggagacatccttgtagattgctctggtggccagcagcatttcctgaaggacaatttggttgatctcgggtgtcccaacataccactgttaggaaaaatggctatctatatttgcaggatgagcaatcaccccaagacgaccatgggctttctgttctggttttccttcggttacgtgatcacttgtattctatgcaaagtcatcttttatctcctgatagtggtcgggacacttggcaagaaattcaagcaataccgggagttgaagcctcagacctgtacaatttgcgaaactaacccagtgaatgccatcgacgcagagatgcatgatctgaactgctcatataacatttgtccctactgcgccagccgcctcaccagtgacggactggctagacacgttatgcagtgtcctaaaaggaaggagaaaatcgaagagacggaattatacctgaatcttgagcgtataccgtgggtggtacggaagttgctccaggtctctgaatccacaggcgtggcgctgaaacgaagctcgtggctagttatcctgctcgtgctgcttaccgtctcattgtctccagtgcaaagtgcacccatttcccacggggagactgtagaggtgtatcagaccagagaaggatacacaagcatctgcctgtttgttttaggttctattctcttcctggtcagctgtcttatgaagggcctggtggattccgtggggaactcatttagtcctggattgagcatctgcaaaacttgttctataggctccattaatggtttcgagatcgaatcacataagtgctattgtagtctcttttgctgtccatactgcaggcactgcagcgccgacatcgagattcataagctgcacctatccatctgtaaaaagcgcaaaaccgggtctaacgtcatgctggctgtttgcaagcggatgtgtttcagagccacagtggaagtgtcgaataaagcactcctgattaggaacataatcaatacgacctttgtagtctgcattcttatcttggccgtgtgtgttgtgagcacttcagctgtcgagatggagaacctgcccgccggcacatgggaaaaggaggaagatttaaccaatttctgccaccaggagtgtcaagtgactgagacagaatgcctctgtccttatgaggcactggttcttcgcaagccgctgttcctagactccattgtgaaaggaaagaaaaacctcctgaatagtacctctttggaaacgagcctgtccatcgaggcgccctggggcgctataaacgtacagtcaacttttaagccaaccgtctctgccgcaaatatcgccttaagctggagttccgtggaacatcgagggaacaaaattctcgtgagcggacggtctgagtcaatcatgaagctggaggaacgtacaggcatttcctgggatcttggtgtcgaggacgctagtgaaagcaagctgttgaccgtttcggtgatggatctctctcagatgtactcccctgtattcgagtatctgagcggggacagacaggtggaagagtggcccaaagccacttgcacaggagactgtccagagaggtgcggctgcacctcaagtacatgtctacacaaggaatggcctcattctcgcaattggcggtgcaaccccacttggtgttggggtgtcggcaccgggtgcacgtgttgcggactggatgtgaaagacctttttacagattacatgttcgttaagtggaaagtggactacatcaagaccgaggcaatagtctgtgtggaactcacttcccaagagagacagtgcagcctgattgaagctggcaccaggtttaacttggggccagttacaatcactctgtcagagccgcgaaatatccagcagaagttacctcccgagattgtgaccctccacccacgcatagaagagggattctttgatctgatgcatatccaaaaagtccttagtgccagcacggtatgtaagctgcagtcctgcacacacggcgtgcccggtgacttgcagatttatcacatcgggaacctcctgaaaggagataaggttaatggccatctaattcacaaaatcgaacctcatttcaacacctcttggatgagctgggacggttgtgatctggactactattgcaatatgggcgattggccatcctgctcatacactggggtgacacagcacaaccatgcggcctttgtcaatatgcttaacatagagaccgactatactaagaatttccactttcactctaaacgggtgacagctcatggagatacgccccaactcgacctgaaggcaagacctacctacggcgccggggagatcactgtattggtggaagtcgctgacatggagttacacaccaagaaaattgaaatcagtggactgaagttcgcctcgctcacatgtaccggctgctatgcatgtagctccggtatttcttgcaaagttaggatccatgtggatgagccggacgaactgacagtgcacgtcaagtcagaggatccagacatagtggcggccagctccagtcttatggctcgtaaactggagtttgggactgattctaccttcaaggccttcagcgcaatgcccaagacgtcattgtgtttttacattgttgaacgcgagtactgcaaatcctgtagtaaggaagacacacagaaatgcgtaaacactaagctagagcagcctcaaagcatcctgatcgaacacaaaggaaccattatcggcaagcagaatgatacatgtaccggtaaggctggctgctggctcgagtctataaaatccttcttttatgggctgaagaacatgctttcaggaattttcggcaatgtgtttatcgggattttcttatttctggcccccttcatcatgctcatattgtttttcatgtttggatggcggattctgttctgtttcaaatgctgcagaaggactcgaggcctctttaagtaccggcatctgaaagacgatgaggaaatcggttatcgcaagatcattgagagacttaagaacaaaaaggggaaaaataagctgttggacggagaaaggctagcagatcggaaaatcgccgagctgttcagcaccaagacacacattggctga

SEQ ID NO: 10378 - RNA, 5055 nt, synthetic construct
  misc_feature 1..5055: note = derived and/or modified CDS sequence (opt3) from CCHFV(66019)__AB069669.1__GP
  source 1..5055: mol_type = other RNA
atgtacaccctgctcgtgtgcgccgtcctttgtccccagctgtggagcttggagggcacacacgttcctcataacgaaactaagcacaatgggacgggaatcaccgctgcaccaggtgagtcccaaggcccgatgtctcccgcctcaacagcggtgcctttaactccagaaccccctaacaccaaaccagctgccagtgcaagcgagctggaatcctctggggagggacatacatcgctactcgccaccactcagggcctgacatcacccgaggctacccctgaacttccaacgactaccgacacaggtgtaagcagtacttccgtggtcgatattgggacccagatggcaaaggacacaccgacctctacggcccacactagcctgccctccaatccttcagctccaagtacagcccagggaacccatcacactataagaggcttgctcagcgtgacatctaccaaacccgaggaagcgtccacgcctaccgatccaggcaaggcaggggccgagacaggatcacccaggccggctatcagccggaaacctactctgagtcccaccgccgaggcaccaacagaaattaacaattcttccactcctaagcaacccgagccaagcatccagcccgctaccccttcgctggttatttctccagcccagccggcgttcccccagtccgccacatcaaccgcagctcaagacatctatagtagccctactaaccgctccaagcgaaatctcaaaatggaaataatcttaacgctgtctcagggtcttaagaaatactatggcaagattcagaaaacattggggctgaccctagaggaagatactgagggactcctggagtggtgcaagcgtaaccttggcctgacctgtgacgataactttttccagaagagaatcgaagagtttttcttgacaggtgaagggtactttaatgaggtgctccaattcaaaaccccaagcactcccggatcaacagaacctacgcacaccgaggccccaactgtcaagccctttaaaagttatttcgctaggggctttctgacaattgactccggctacttcagcgccaagtgctattctcggacctcaaatagtgggttacagctgatcaacgtgacacagcatccggcacgcatagccgatactcctggaccaaaaattaccaatctcaagacgatcaactgtattaatcttaaagctagcgtatttaaggagcacagagaaatcgagatcaacgttctgttgccccaagtggcggtcaacctatccaattgccatgtgctgattaagtctcacgtgtgtgactactcgctcgatatagacggtaccatcaggctgcctcggatttaccacgaaggcacattcatccccgggacttataaaatagtcattgataagcgcgacaaacagaacgaccgatgcacccttgttacaaattgtgtgatcaagggaagagaggtaaggcggggccagagcgcactgcgtcagtaccgcactgaaatcagaattggtaaagcctccgctgggtcaaggcggttgctcagtgaggagtctggcgatgactgcatcagccgaacccaactgttacgcacggaaacagccgaggtgcatggagataactatggcgggccaggagacaagattaccatatgtaatggttccactatcgtcgatcagagactgggctcagaactagggtgctacacaattaacagggttaagagctttaaactctgcgaaaattctggaaccggcaagtcctgtaaaatcgacaacactcctgtgaagtgccggcagggtttctgtctgaaaatcacccaggaggggcgcggccacgtgaaacttagtagaggaagcgaagtcgtgttggatgcatgcgactcttcctgtgagattatgatacccaagggcacaggggatatcctggtagactgctcaggaggtcaacagcatttcctcaaggataatctggttgaccttggctgtccaaacattccgctgttggggaagatggccatctatatttgcaggatgagtaatcaccctaaaacgaccatggcttttctcttctggtttagcttcggatacgtgatcacttgtatattttgcaagatcattttctatctgttaatcgtcgtgggcacactgggtaaaaagtttaagcagtaccgtgaactaaaaccccagacctgtacaatttgcgagactaccccaacgaacgccatcgacgcagaaatgcatgatctcaagtgctcgtacaatatatgtccctattgcgcgtcccggctgacatctgacgggcttgctcgacacgtcacccaatgtcctaaaagaaaggagaaagtggaggaaactgagttgtacctgaacctcgaaaggattccatggatcgttcgcaagctgttacaggtgagcgagtcaaccggcgtagccctgaaacggagttcctggcttattgtcttgctcgtgctgctaacagtttctctgagccccgtgcagtccgcacctatcggacacggcaagactatagaagcctatcagaccagagaggggtacacatcagtctgcctcttcatgctgggaggcatcctttttgtggtaagctgtttgatgaagggtctggtggatagtgtttctaattccttctttccggggttaagcatttgcaaaacgtgttcgatcggatcagtcaacggcttcgagattgaatctcataagtgctattgtagtctcctgtgctgtctttactgcaggcactgctccgctgaccgcgagatccatcaactgcacttgagcatatgtaaaaagcgacgggccggtggcaacgtgatgctcgcagtgtgcaaacgtatgtgtctgagagctaccatggaagtctctaataaggttctatttattaggagcatcatcaacactacattcgtgatttgcatcctggtgctcgccgtatgtattgtctccacctcagcggtggagatggaaagtctgccagccgggacttgggagcgcgaggaagatcttacaaatttctgccaccaggagtgtcaggttaccgaaacggagtgcttgtgtccctatgaggctctggtgttacggaagcctctctttagcgactctatagtcaaaggaatgaagaacctgcttaattccacttcactggaaaccagtctaagcatcgaggcaccatggggcgccattaacgtgcaatccacattcaaacccaccgtttctactgctaatatcgccctctcgtggagctcagtggaacatagagggaacaagattctggtatccggaaggagtgagtctatcatgaaattggaggagcgaacaggcataagctgggatctgggtgtcgaggacgcatccgaatcaaagttactcaccgtgtctgtgatggatctgagccagatgtacagtcctgtctttgagtacctttccggggaccgccaggttgaagagtggccgaaggcgacatgcactggaaattgtcccgatcggtgcggctgcaccagctctacgtgtctgcacaaagaatggccacattcaagaaactggaggtgcaatcctacatggtgttggggtgtgggcaccgggtgcacttgttgcggattggacgtaaaggatctcttcaccgactatatgtttgtgaaatggaaggtcgagtacatcaaaacagaggccattgtgtgtgttgaactgaactcccaggagcgtcaatgcagtctaatcgaagctggcactcgcttcaatctggggcccgtgaccattacgcttagcgagccacggaacatccagcagaagctcccttcggaaataattacactgcaccccagaatcgaggagggatttttcgacttgatgcatgtccagaaggtgctgtctgcctccaccgtttgtaaattacaaagctgcactcacggcgtgccaggtgatctccagatctatcacattgggaatctgcttaagggagacagggtcaacggccatctgatacacaaaatcgaaccgcattttaacacatcatggatgagttgggatggttgtgacttggattactattgcaatatgggcgactggccttcttgcacctacactggggtaacacagcacaaccatgcagctttcgtgaatctcctgaacattgagaccgattatacgaagaattttcacttccactccaaacgagttactgcccatggagacacaccccagctagatctgaaggcacggccaacatacggcgccggggaaatcaccgtgcttgtcgaggtggctgacatggagctccacaccaaaaagattgcgatcagcggactgaagtttgcctcattgacttgtaccggctgctacgcatgtagtagcggtatatcctgcaaagtacgcatccatgtggatgaacccgacgagttaacggtccacgttaagtctgaagatcctgacattgtggctgccagctcctcactgatggccagaaaactcgagttcgggacagactctactttcaaggcttttagtgcaatgccaaaaacctcgctgtgtttctatatcgtggaaagggagtactgcgagagctgttccaaggaagatacacaaaagtgcgtcaacaccaaacttgagcagccccagtctattctgatcgaacacaagggaactataattggcaaacaaaatgacacctgtacagccaaggcgtcatgctggttggagagcgtgaaatcctttttctatggcctaaagaacatgctgagtgggatctttggaaatgttttcatcggtatttttctcttcctggctccttttatccttttaatactgttctttatgttcggctggcggattctcttctgttttaagtgctgccgaagaacgcgcgggttgttcaaatacaggtatctgaaggatgacgaagagtctggataccgtcggatcattgagagactcaacaataaaaagggcaaaaacaagctgcttgatggtgaaaggctggccgaccgccgaatcgcagagttgtttagcactaagacccatatagggtga

SEQ ID NO: 10379 - RNA, 5052 nt, synthetic construct
  misc_feature 1..5052: note = derived and/or modified CDS sequence (opt3) from CCHFV(Gaib)__KX013445.1__GP
  source 1..5052: mol_type = other RNA
atgtacatccccctggtgtatgccgtcatttacctccagctttatggccttgggggagctcacggtttgttaaacaagaccgagcaaaatgaaacaggcataactgcaacgcatgggagagttcagggacctccaagcgcctccatcaccctgccggtgacacccgaccctctatctgcgacttcagctgccagtaccagcggcccagagggttccggggaagtacccacatctccttcgaccattactcagggactcacatcaagcgagaacaccccacagctgcccacggcaactgataccggcatcagttccacatctattatcgacgtgagcactcaaaccgccggcgatacatccacccctacggctcacacttcacttccaaatagtccgagcgcacccttcacatctcaggacaccaggcatactgtccgggggctgttgacagtgacctccacgaaatcagatgaagccagcaccctcacagaccctaaggaggctagtactgaggcccgctctccatcccccagcatatcgcgaacccctacaccatctcccactgttcaggcgtccaccgaaaacaatacaccgtcaacccctcgtcagcccgagccaactacgagacctgcactgcccagtccaacaaccagccccactcaaccttccctgtctcagagcgccacctcagctgccatccaggatatgcacccaagtccgacaaacaggtcccggcgcaatctcgaaatggagattatcttaaccctgagccagggacttaaaaagtactatggtaaaattttgaagctgctagacctcactctggaggaagatacagagggccttctggaatggtgcaagagaaacttggacctcacgtgtgatgagaactttttcctgaaaaggatcgaagagtttttcttatctggggagggacattttaatgaagtgctgcaattcaaggcaccctcaaccatgagtagcactgagcctacacacgctggcccacccaccgtcgaaccttttaaatcctacttcgccaagggttttctctctatagactcggggtatttcagcgcgaaatgctacccacggacatccaattcaggacttcagctgattaacgtgactcagcacaccgcccgcatcgcagatacgcccggcccgaagattaccaatgtaaagacaatcaactgtatcaatttgaaagctagtgtttttaagaaacatcgagaggtggaaattaacgtcctactgcctcaaatagccgtgaacctctctaattgccacgtgctgatcaagagccatgtctgtgactactcccttaacttcgacggcatggttagactgccaaggattcaccacgaggggacttttatccccggaacctataaaatagtgattgatcggaagaataaacagaacgaccgttgcacattggtaactaattgtgtgatcaagggtcgcgaggtcagaaagggccagtcagctctcaggcagtaccggaccgaaatcaaaattggggaggccagcatcggatctcgacgcctgttatccgaagagagtagcgatgactgcatttctagaacgcaactgctaaggacagaaaccgcagagatacataacgataattatggcggtcctggggacaagatcactatttgtaacggctccacaatcgtggatcagcggctcggatcagagctgggctgctacaccatcaatcgcgttaaaagtttcaagctgtgtgaaaacagcgccactgggaaatcgtgcgagattgactccatacccgtgaagtgcagacagggattctgtttgaagatcacccaggaaggtaggggccacgtcaaactgtctcgtgggagcgaggtggtactcgatgcttgcgactcaagttgtgagattatgatcccaaagggaacaggcgatattctggttgactgctccggtgggcaacagcattttcttaaagacaatctgatcgatttgggctgtcctaacatacccctcctgggaaagatggcgatctatatttgccggatgtctaatcacccaaaaacgaccatggcattcttattttggttcagctttggctacgtgatcacttgtattttctgcaaggccatcttttatctgctaataattgtcgggacactcggaaagaaattcaagcagtaccgagaactgaaaccgcagacctgtacaatctgcgagactacccctgtgaacgctattgacgccgaaatgcatgatcttaattgttcctacaacatctgcccctattgcgcatcaagattgacgagcgacggtctggccaggcacgtcgtgcactgtccaaagcgcaaagagaagatagaagagacagagctctacctgaacttagaacgggttccctgggtggtaagaaagctgcttcaagtcagtgagtctaccggcgtggctttgaaaaggtccagctggctcatcgttctgctagtgctgctcactgtctcgctgtcacctgtgcagtctgccccaattgggcatggaaagaccatcgaaacatatcagactcgcgagggctacaccagtatttgcctttttgtattgggtgggatcctgttcatagtgtcctgtttaatgaaaggcctcgttgatagcgtcggaaataactttttccccggcctgacaatttgcaagacgtgttctatcagctccatcaatgggtttgaaattgagtcacacaaatgctattgtagtcttctgtgctgtccttactgccgacattgtagcgcagaccgggagatccaccagttgcacctctctatttgcaagaaacgtaagaccggatccaacgtgatgctggcggtgtgcaagagaatgtgtctaagggtcactacagaagtttcaaatcgcgctctgttcatacggagtatcattaacaccactttcgtgatctgcattctcatcctggccgtgtgtgtaataagcacatccgcagtcgagatggaaaatcttccggccggcacctgggagagagaagaggatttgacgaacttttgccatcaagagtgtcaggtgactgaaaccgagtgcctgtgtccatatgaagccttagttctcaggaaacccctgttctctgactcgatcgtgaagggtatgaaaaatcttctgaacagcacatcactagagacctccctcagtattgaggccccttggggagcaatcaatgtccagtctacttttaagccaacagtgagcaccgctaacattgccctgtcctggtcatctatcgaacaccgagggaataaaatattggttagcggccgcagtgagtccattatgaagctggaggaacggacaggtatcagctgggatttaggcgtggaagacgcgtctgagtcaagactcctgactgtatccgtcatggatcttagtcaaatgtacagccccgtgttcgagtacctgtcgggggaccgtcaggtggaagagtggcctaaggctacctgcacgggagattgtccggaaaggtgcggctgtacatcttccacatgcttgcataaagagtggccccacagccgcaactggcggtgcaatccaacttggtgttggggagtcgggaccggctgcacatgttgcggtctcgacgttaaggacctgtttactgattatatgttcgtgaaatggaaggtagaatacatcaaaaccgaggctattgtgtgtgtcgagctaacgtcacaggaaagacagtgcagtctgatagaggcagggacaaggtttaaccttggacctgtgaccatcactctctctgaaccccgaaacattcaacagaagctgccacctgagatcattacattgcatccccggatcgaagagggcttctttgacctgatgcacgttcagaaggtgttatccgccagcaccgtctgtaaactccagtcatgcactcacggtgtgccaggcgatctgcaagtttatcatatagggaatcttctgaagggagacaaagtgaacggccacttgatccataagattgagccgcacttcaatacaagttggatgagctgggatgggtgtgacctcgattactattgcaacatgggagactggccttcctgtacctacacgggcgtcactcagcataatcacgctgcctttgtaaacctgctaaatatcgaaaccgattataccaaaaacttccactttcattctaagcgcgtgaccgcacacggtgacacaccccagctggatcttaaggcgagaccaacttacggggccggagagattaccgttctcgtggaagtcgctgacatggagctgcatacgaaaaagatcgagataagcggcttgaaattcgcctccttaacatgcactggttgctacgcatgttcatctggcattagttgcaaggtgaggatccacgtagatgaacccgacgagctgaccgtgcacgtcaaatcggaagaccctgatatcgttgctgccagctcctctctcatggcacggaagctggagttcgggacagactcaacctttaaagccttcagcgctatgccaaagacttccctttgtttttatattgtggaacgagagtactgcaagagttgttctagagaggatacccagaaatgcgtgagcacaaagctggaacaaccccagtcaatcttgatagagcataaaggaacgattatcggcaagcagaataacacttgtaccacaaaaaccacttgctggctagaatccgtcaagagtttcttttatgggctgaagaatatgctcagctctattttcggaaacgtgtttgttggcatcttctcctttctggcgcctttcatacttttaattctgtttttcatgttcggttggcgcatcctcttttgtttcaaatgctgtaggcgtacacgggggttgtttaagtacagacacctgaaagacgatgaggaaaccggatataggcgcatcattgagcgactcaataacaagaaaggcaagtcaaagctgcttgacggcgagagactggccgatcggaaaatcgcagaattgttcagcacgaagactcatattgggtga

SEQ ID NO: 10380 - RNA, 5055 nt, synthetic construct
  misc_feature 1..5055: note = derived and/or modified CDS sequence (opt3) from CCHFV(SPU415/85)__DQ211635.1__GP
  source 1..5055: mol_type = other RNA
atgtacactcccctggtgtgcgccgtcatctgtctccagctttggaacctgggcgggacattggttttcattaatagaactcaacacaacgagacgggaaccgtggctacacctgaaggtactttaaggccacggctgccggtaagcaccgcactacccacaaagtccgaccgcccttctgtgggcccagccgcgtcaagtagcgggctcgagggatccggcgaacccaatacctctccttcgataactacaaaaggtctgaccccacccgagacgactcctgcccttccaaccgctacagatactgacgcatcaagcaccggggtcgtggatgttagtacacagatgaccaaggacatcccgatgtccacggcctatactaatcccccttctacaccaagcgctccctccacccctcagggaactcatcacacagcacgaggcctgttgtcagtggccagtaccaaaagcgaagaggtctctatgtccacgtcaccagctaagaccagcacagagaccagttctcccccgcctgccacctccgaaacacccactccaagccctaccacacaggtgcccaccggcaacaacaatccaaacacttcgcgtcaacccacgccttctgcgcagccagcaatgtccaatccggccacatcacccgctcagcctaacctcagtcagagcgccccacccaccgcagatcaaggggtacatccttccccaactaatagatctaaaaggaacctggagattgaaatcattctgaccctcagccagggattacggaagtactatggtaagatcctgaaacttttggacctgacactagaggaggataccgaaggcctcctggagtggtgcaagcgcaatcttgggctgacttgtgacgataactttttccagaaaagaatagaagagtttttcttgacaggagaaggctactttaatgaggttctccagttcaaggtgccctcaacgctgagttccaccgagccgactcacacaaggcctccaaccgtcgaaccctttaaaagctatttcgctaagggttttctttctatgaactcagggtacttcagtgccaagtgctatcctcggacaagcaactccggactgcaactcatcaatgtgactaaacattctgcgaagattgccgacacccccggcccaaaaatcacgaaccttaagaccattaattgtatcaacctgcgcgcatcggtgtttaaagagcaccgagaagtcgagataaatgttttgctacctcaggtggctgtaaacctgagcaattgccacgcccagattaagtcccatgtgtgtgattactcactcgctacagacggcatggtcagactgccccacatccatcacgaagggactttcattccaggaacctacaaaatcgtgatcgataagaagaacaaacaaaatgacaggtgcacacttgttactaactgtgtgattaagggtcgggaggtccgtaaaggccagagtgccctgcgccagtataagaccgagataagaatcgggaaagcatctagcggatccaggcggttgctctcagaagagagcgacggcgattgcatttctcgaacgcagctgttacgcacagaaaccactgagatccactccgacaattacggtgggccgggcgataagataacaatttgtaacggaagtaccatcgtggaccaaagactgggcagcgaactagggtgctatactatcaatagggtaaagtcttttaaactctgcgagaactccgccaccggaaagtcatgtgagattgatagtacacctgttaaatgccggcagggtttctgtctgaagatcacgcaggaaggccgcgggcatgtgaaacttagcagaggatcggagattgtcttggacgcttgcgattccaattgtgaaataatgatccccaagggcaccggtgacattctggtggattgctctgggggccagcaacacttcctcaaggacaacctgatcgatcttggatgtccaaacatccccctgttgggcaaaatggcgatttacatatgcaggatgagcaatcatcctaagactacaatggcatttctcttctggttttcattcgggtatgtcatcacctgtattctgtgcaaagtgatcttttacttactgattgttgccggaacagtgggtaagaaattcaagcagtatcgtgagctacggccacagacttgtaccatctgcgagacgatacccgtaaacgctatcgacgccgaaatgcacgacctcaattgcagttacaacatttgtccttactgcgcatcccgactgacatctgatggccttgccagacatgtcatgcagtgtccgaagaggaaagagaaggtggaagagaccgaattgtatctgaatctcgagcgcatcccatgggttgtgcggaaactgttacaagtcagcgagtccactggggtggctctgaagagatcaagctggcttaccgtattgctcgtgctgctaattgttagtctgtctcccgtccagtccgcccctatcggacacggcaaaacaatagaaacttaccaggcaagggagggttataccagcttttgcctcttcattctggggtcgatcctttttgtggtgtcatgtttggtcaagggcctgattgactctgttggaaacagtttctttccaggcttatccatctgcaaaacatgtagcatagggtctatcaatggattcgaaattgagagccacaagtgctactgttccctcttttgctgtccctattgccgccattgctcagcggatcgagaaatccacaagctgcatcttagtatttgtaaaaagcggaaaacgggcagcaacgtgatgctggctgtgtgcaagcgtatgtgtttcagagccaccatcgaggtatctaatagggcattgctcatacgcaacattatcaatactacattcgtcgtgtgcatcctgaccctagccgtttgtgtggtctccacttcagctgtggagatggaaagtctgcctgccggtacatgggagaaagaagaggacctcaccaacttttgccaccaggaatgtcaagttacggagactgagtgcctgtgtccgtacgaagcacttgtgttgcggaagcccctgttcttagatagcattgtaaaggggatgaaaaatctcctgaactccacctctcttgagacatcgctgagcatcgaagctccatggggagccattaatgtccagtcaacctttaagcctactgtgtccgcggccaacatagctctaagttggtctagcgtggagcacagaggcaacaaaatcctcgtctccggtaggtcagagtctattatgaagctggaggaacgaacaggcatcagctgggacttgggggttgaagatgcaagtgagtccaaactgttaaccgtgagcgtaatggacctctctcagatgtattcacccgtgttcgaatacctgtccggagatcgccaagtcgaggagtggccaaaggccacatgcactggcgactgtcctgaacggtgcgggtgcaccagtagcacgtgtcttcataaggagtggccccactcgagaaattggaggtgcaacccaacatggtgttggggagtgggcaccggttgcacttgttgcgggctggatgttaaagacttgtttaccgattacatgttcgtgaagtggaaagtcgaatatattaagacagaggctatcgtgtgtgttgaactcacttctcaggagcgtcagtgctccctgatagaggccggaacccgctttaatctaggcccggtgacgatcacactgagcgaacctcggaacattcagcaaaaacttcccccagagatcattaccctccatcccagaatcgaagagggtttctttgacctgatgcacgtccagagggtattgtcagcaagtactgtgtgtaagctgcagtcttgcacacatggcgttcctggggacttacaggtgtaccacataggaaatctcctgaagggcgataaagtcaacgggcaccttattcataagatcgaaccacacttcaatacctcctggatgagctgggacggatgtgatctggactattactgcaacatgggcgattggccctcatgcacttatacaggtgtgacccaacataatcacgcggcctttgtaaacttgctcaatatcgagacggactacactaaaaacttccattttcacagtaagcgagtgaccgctcacggggatacacctcagctggacctaaaagcccggccgacctatggagcaggcgaggtcacagttctggtggaagtggctgatatggagcttcatactaagaaaattgaaataagcggtctcaagttcgcctccctgacctgtacgggctgctacgcatgttctagcgggatctcctgcaaggtcaaaattcacgtggacgagccagatgagttgacagttcatgtaaagtcagaagaccccgatatcgtggccgctggatctagtttaatggcgcgcaaactggagttcggcgccgactcgacttttaaggcattcagcgctatgcctaaaacctccctctgtttttacattgtcgaaagagagtattgcaagtcttgttcaagggaagacacacggaagtgcgtgaataccaaactggatcgaccccagagcatccttatagagcacaaggggactatcattggaaaacagaacaatacctgtacagccaaggcctcctgctggctggagagtgttaaatctttcttttacggcttgaagaacatgctaagcggtatcttcgggaacgtgtttattggaatcttcctgtttatagctccattcgtcctcctgattttatttttcatgttcggctggagaatcttattttgtttcaagtgctgccgcaggacgcgtggcctgtttaaatatcggcacctcaaggacgatgaagagactgggtacagaaaaatcattgaaaggttgaataacaagaaaggaaagaataagctgctcgacggtgagcgcctggcagatcgaaaaatcgccgaacttttctcaaccaagtcccatataggctga

SEQ ID NO: 10381 - RNA, 5055 nt, synthetic construct
  misc_feature 1..5055: note = derived and/or modified CDS sequence (opt3) from CCHFV(SPU 431/85)__KJ682812.1__GP
  source 1..5055: mol_type = other RNA
atgtacacaccccttgtgtgcgccgtcatctgtctccagctttggaacctgggcgggaccttggttagcactaatagaacgcaacacaacgagaccggaacagtggctactcctgaaggtaccttaaggccacggctgccggtatccacagcactacccaccaagtctgaccgcccttcagtgggcccagccgcgagtagctccgggctcgagggatctggcgaacccaatacttcgccttcaattacaaccaaaggtctgacgccacccgagactacccctgcccttccaacagctactgataccgacgcaagcagtacaggggtcgtggatgtttccacccagatgacgaaggacataccgatgtctactgcctatacaaatccccctagcaccccatccgctccctcaactcctcagggaacacatcacaccgcacgaggcctgttgagtgtggccagcacgaaatctgaagaggtctccatgtcaaccagcccagctaagacaagtactgagacctcttctcccccgcctgccacaagcgaaactcccaccccatcgcctacaacccaggtgcccactggcaacaacaatccaaacacgtctcgtcaacccacaccttccgcgcagccagcaatgtcaaatccggccaccagtcccgctcagcctaacctcagccagtccgccccacccactgcagatcaaggggtacatccttctccaaccaatagaagcaaaaggaacctggagatcgaaattatcctgacactctcacagggattacggaagtactatggtaagattctgaaacttttggacctgaccctagaggaggatactgaaggcctcctggagtggtgcaagcgcaatcttgggctgacatgtgacgataacttctttcagaaaagaatcgaagagttctttttgacgggagaaggctacttcaatgaggttctccagtttaaggtgcccagtaccctgtccagcactgagccgacacacaccaggcctccaacagtcgaacccttcaaatcttattttgctaagggtttcttatcaatgaacagtgggtactttagcgccaagtgctatcctcggacttccaactctggactgcaactcataaatgtgaccaaacattcggcgaagatcgccgacacgcccggcccaaaaattaccaaccttaagacaatcaattgtattaacctgcgcgcaagcgtgttcaaagagcaccgagaagtcgagatcaatgttttgctacctcaggtggctgtaaacctgtccaattgccacgcccagataaagtcacatgtgtgtgattacagtctcgctactgacggcatggtcagactgccccacattcatcacgaagggacctttatcccaggaacatacaaaattgtgatcgataagaagaacaaacaaaatgacaggtgcactcttgttaccaactgtgtgatcaagggtcgggaggtccgtaaaggccagtctgccctgcgccagtataagacggagattagaatagggaaagcaagctccggatcaaggcggttgctcagcgaagagtctgacggcgattgcatctcccgaacacagctgttacgcaccgaaactacagagattcacagtgacaattacggtgggccgggcgataagatcaccatatgtaacggaagcactattgtggaccaaagactgggctctgaactagggtgctataccatcaatagggtaaagtccttcaaactctgcgagaactcagccacaggaaagagttgtgagatcgatagcacgcctgttaaatgccggcagggtttttgtctgaagattacccaggaaggccgcgggcatgtgaaactttcgagaggatccgagatcgtcttggacgcttgcgattctaattgtgaaattatgatacccaagggcactggtgacatcctggtggattgcagcgggggccagcaacacttcctcaaggacaacctgattgatcttggatgtccaaacatccccctgttgggcaaaatggcgatctacatttgcaggatgtcaaatcatcctaagacaaccatggcattcctcttttggttcagttttgggtatgtcataacatgtatcctgtgcaaagtgattttctacttactgatcgttgccggaactgtgggtaagaaatttaagcagtatcgtgagctacggccacagacctgtacgatttgcgagacaatccccgtaaacgctatagacgccgaaatgcacgacctcaattgctcctacaacatctgtccttactgcgcatctcgactgaccagcgatggccttgccagacatgtcatgcagtgtccgaagaggaaagagaaggtggaagagactgaattgtatctgaatctcgagcgcattccatgggttgtgcggaaactgttacaagtctccgagtcaaccggggtggctctgaagagaagcagttggcttacagtattgctcgtgctgctaatcgtttctctgtcccccgtccagagcgcccctattggacacggcaaaactatcgaaacctaccaggcaagggagggttatacatcgttctgcctctttatactggggtcaattcttttcgtggtgtcttgtttggtcaagggcctgatcgacagtgttggaaactcctttttcccaggcttaagcatttgcaaaacgtgttctatcgggagcataaatggatttgaaatcgagtcccacaagtgctactgttcactcttctgctgtccctattgccgccattgccctgcggatcgagaaattcacaagctgcatcttagtatctgtaaaaagcggaaaaccggcagcaacgtgatgctggctgtgtgcaagcgtatgtgttttagagccactattgaggtatctaatagggcattgctcatccgcaacataattaatacaaccttcgtcgtgtgcatcctgactctagccgtttgtgtggtctccacatcagctgtggagatggaaagtctgccggccggtacctgggagaaagaagaggacctcacgaacttctgccaccaggaatgtcaagttactgagaccgagtgcctgtgtccctacgaagcacttgtgttgcggaagccactgtttttagatagcatcgtaaaggggaggaaaaatctcctgaactccacatctcttgagacctcgctgagcattgaagctccttggggagccatcaatgtccagtcaactttcaagcccacagtgtccgcggccaacattgctctaagttggtctagcgtggagcacagaggcaacaaaatactcgtctccggtcgatcagagtctatcatgaagctggaggaacgcaccggcattagctgggacttgggggttgaagatgcaagtgagtccaaactgttaacagtgagcgtaatggacctctctcagatgtattcaccagtgtttgaatacctgtccggagatcggcaagtcgaggagtggcctaaggccacttgcaccggcgactgtcccgaaagatgcgggtgcacgagtagcacatgtcttcataaggagtggccacactcgaggaattggcgttgcaacccgacctggtgttggggagtgggcactggttgcacctgttgcgggctggatgttaaagacttgttcacagattacatgtttgtgaagtggaaagtcgaatatatcaagactgaggctattgtgtgtgttgaactcacctctcaggagcgccagtgctccctgatcgaggccggaacgcggttcaatctaggccctgtgacaataaccctgagcgaacccagaaacatccagcaaaaacttccacccgagattatcactctccatcctaggattgaagagggctttttcgacctgatgcacgtccagcgagtattgtcagcaagtacagtgtgtaagctgcagtcttgcacccatggtgttccaggggacttacaggtgtaccacatcggaaatctcctgaagggcgataaagtcaacgggcaccttatacataagattgaaccccactttaatacttcctggatgagctgggacggatgtgatctggactattactgcaacatgggcgattggccttcatgcacatataccggtgtgacgcaacataatcacgcggccttcgtaaacttgctcaatatcgagactgactacaccaaaaactttcatttccacagtaagcgggtgacagctcacggggataccccgcagctggacctaaaagcccgcccaacatatggagcaggcgaggtcactgttctggtggaagtggctgatatggagcttcataccaagaaaatcgaaattagcggtctcaagtttgcctccctgacgtgtacaggctgctacgcatgttctagcgggatatcctgcaaggtcaaaatccacgtggacgagcccgatgagttgactgttcatgtaaagtcagaagaccctgatattgtggccgctggatctagtttaatggcgagaaaactggagttcggcgccgactcgaccttcaaggcatttagcgctatgcccaaaacatccctctgtttctacatcgtcgaaagggagtattgcaagtcttgttcacgggaagacacccgaaagtgcgtgaatactaaactggatagaccacagagcattcttatcgagcacaaggggaccataatcggaaaacagaacaatacatgtacggccaaggcctcctgctggctggagagtgttaaatcctttttctacggcttgaagaacatgctaagcggtatttttgggaacgtgttcatcggaatttttctgttcatcgctccttttgtcctcctgatacttttctttatgttcggctggcgcattttattctgttttaagtgctgcaggcgtactcggggcctgttcaaatatagacacctcaaggacgatgaagagaccgggtacaggaaaatcatcgaacgcttgaataacaagaaaggaaagaataagctgctcgacggtgagcgactggcagatagaaaaattgccgaactgttttcaacaaagtcccatatcggctga

SEQ ID NO: 10382 - RNA, 5055 nt, synthetic construct
  misc_feature 1..5055: note = derived and/or modified CDS sequence (opt3) from CCHFV(8402)__AB069674.1__GP
  source 1..5055: mol_type = other RNA
atgtacactcccctgctctgcgccgtgctttgtctgcagttgtggagcttagagggctcccacgggctgtctaacaagacacaacattcaaataccagtacgaccaaagctcctgaagtcagccaggagctaggactcccagtttccacagtgtctactatcacctcggacccgccctcaattacaagcgcagtaagtgtgtccggttctgaaggcagcggggataccaacacttccccttcagtcacaacccagggaccaacgctgcccgagactacccttgaacctctgacaactaccgacacagatgccagtagcaccgtggttgtggacgtctctacgcagactgtgaaggatacaccaatatccaccacttatacatcattgcccagcacccctagtgagccaacgaccccgcaaggcacacaccatactgcgagaggtctcctgtctgtaacctccacaaaacccgaggaagctagcactcaggccaatcctgggaagatctcgatggagaccaacggaccaaggctggcaatttctgaaacaccctccttctcacctaccactcaggccccaacggagaatagtaaccccatcacaagcaaacagctcatgttatccgctcaaccggttacccctaatcccatgacttctccagtgcagcctgcactgagccagtcagacaccagtacagccattcaggatgtccacccctccccaaccggccggagcaagcgcaaccttgagatggaaatcatattgactctgtctcaaggcctaaagaaatactatgggaagatcctcaaactgcttgacctgacattggaggaagatacggagggactcctggaatggtgcaagcgaaatttaggtctggtgtgtgacgataactttttccagaaacgtattgaggagtttttcctcaccggcaaggggcattttaatgaagtgcttcagttcaagactccctcaacactgagtcctaccggaccagctagaacaggcagcccgactgtcgagccctttaaatcctacttcgccaaggggtttttgtctatggactcgggttatttcagcgcgaaatgctaccctagggcatccaactcaggactacaactgatcaatgttacccagcacagtacgcggattaccgatacaccaggccccaagatcactaacctcaaaaccataaattgtattaacctgaaggcctctgtgtttaaagaacaccgcgagatcgaaattaacgtacttctgcctcaggtggctgtcaatttgagctcctgccatgtgctcatcaagtcacacgtttgtgactatagcctggacatcgatggcccagtgagattacccaggattcatcacgaggggacattcataccgggaacttacaagatcgtcattgacaaaaagaacaaacagaatgatcggtgcaccctggtgacgaactgtgtaatcaagggtcgcgagatacgaaaaggccaatctgttctaagacagtacaggacagaaattaagatcgggaaggcctccagtggaagccggcgtctcctgtctgaggaatccggcgacgattgcatctcacgcacccagcttttgagaactgagacagcagaaattcacaatgacaactatggtgggcctggcgataaaatcaccatttgtaatggaagtactgtggtcgaccagaggctgggcagcgagctcgggtgctacaccataaaccgggtgaagtcgtttaaactgtgcgaaaattccgctacaggaaagtcttgtgaaatcgatagcacgccagtcaaatgccgacaaggtttctgtcttaagattacccaggagggccgcgggcatgtgaagctgtcaagaggaagtgaagttgtgttggacgcctgcgattcctcttgtgagatcatgatccccaaaggcactggtgacattctcgtagactgcagcgggggccagcagcacttcctgaaggataacttaatagacctgggatgtcctaatatccccctactcggcaaaatggcgatttatatctgcaggatgtccaaccatccaaagacaaccatggcctttctgttctggttttcattcgggtacgtcgtgacatgtattctttgcaaagttatcttttatttgctgatagtggtcggaactctcggtaagaagttcaaacaataccgggagctgaagcctcagacctgtacgatctgcgaaacaacccccgtgaatgcaattgatgctgagatgcacgacttaaactgcagctataatatctgtccatactgcgccagtcgcctgacttctgatggccttgctagacatgtaatgcagtgtccgaaaaggaaggagaaaattgaggaaaccgagttgtacctcaacctggagcgtatcccttgggtggttcggaagctactgcaggtctccgaaagcacaggggtggccctcaaacgatcgtcatggctggtggtccttttggttctgttaactgtgtctctcagtcccgtgcaatccgcaccaataggacacggcaagaccgtagagacatatcagacgagagaaggttacaccagcatttgcctgtttgtccttgggtctatcctgttcattgtgagctgtttgatgaagggcctcgttgactccgtgggaaactcatttttccccggcctgagtatctgcaaaacttgtagcatagggtctgtcaatggatttgagatcgaatcccacaagtgctattgttcactattctgctgtccttactgcaggcattgcagtgccgatcgcgagattcaccggctgcatctcagcatctgtaaaaagagaaaaacaggctccaacgtgatgctggctgtttgcaagaggatgtgttttcgcgcgaccgtggaggtatctaataaggcacttttgattcgaaacatcataaatactacattcgtcctgtgcattttaatcctcgccgtgtgtgtggtctcgaccagcgctgttgaaatggagtcactgccagccggtacgtgggaacgggaggaagaccttactaacttctgccaccaggagtgtcaagtgaccgagacagaatgcctgtgtccctatgaggccctagtactccgtaaacctctgttttccgatagtatcgtgaaggggatgaaaaatttgctgaactctaccagcttagaaacttccctctcaattgaggccccgtggggagctatcaatgtccagtctacattcaagccaaccgtgagcgccgcaaacattgcgctgagttggtccagcgttgagcacagaggcaataaaatacttgtgtctggtaggtcagaatccatcatgaagctggaggaacgcacaggcattagttgggacttgggggtcgaggatgctagcgaatcgaagctcctgactgtgtctgttatggacctatcccagatgtacagccccgtgtttgagtatctgtcaggagatcggcaggtcgaggaatggcctaaagcaacctgcacgggcgactgtccagagagatgcgggtgcacaagttctacctgtcttcataaggaatggccccactccaggaactggcgatgcaatcctacttggtgttggggagtaggcaccggttgcacatgttgcgggctcgacgtgaaagatctgttcactgactacatgtttatcaagtggaaagttgagtacattaagaccgaagcaatcgtgtgtgtcgagttgacgagccaagagcgccagtgcacactgatagaagccggaacccggttcaacttaggcccggtgactatcacactctcagagcccagaaatattcagcagaagctgccacctgaaatcgtaacccttcatcccaggattgaggaaggctttttcgatctgatgcacgtgcaaaaagtcttgagtgctagcactgtttgtaagctccagtcctgcacacatggtgtgccaggggacctacaggtgtatcacatcggaaacctgctgaaaggcgataaggtcaacgggcaccttatacataaaattgagcctcactttaatacctcttggatgagctgggacggatgtgatctcgactactattgcaacatgggcgattggccctcctgcacgtacactggtgtgacccagcataatcacgccgcattcgttaacatgctgaatatcgagacagactataccaagaactttcatttccactcaaaacgtgtaacagctcacggggatactccacaattggacttaaaggcccgcccgacctacggagcgggcgaaatcacggtgctggtcgaggtggccgatatggaactccatacaaagaaaattgagatatctggtctgaagtttgctagtcttacttgtaccggctgctatgcatgttcgagcgggatctcctgcaaagttcggattcacgtggacgagcctgacgaactgacagtccatgtgaagtctgaggatcccgacatcgtagccgcttcaagctccttgatggccagaaaactagagttcggaaccgatagtactttcaaggcattttctgcgatgccaaagaccagcctgtgtttctacattgtcgaaagggaatactgcaaatcatgttccaaggaggacacacagaaatgcgtgaatacgaagctcgagcagccccaaagtatcctgatagaacacaaaggcactatcattgggaagcagagcaacacctgtacagccaaggcttcttgctggcttgagtccgttaaatcatttttctatggattaaagaatatgctgagcggcatctttggtaacgtgttcattggggtctttctcttctttgcccctttcatcttgctgatactctttttcatgttcggatggcggattctgttttgtttcaaatgctgccgacgcaccagaggcctttttaagtacaggcacctgaaagatgacgaagagactggctatcggaagatcatcgaacgattgaataacaagaaagggaagaataaactactggatggagagagactcgcagaccgcaagattgctgagttattctcgacaaaaacccatatcggttga

SEQ ID NO: 10383 - RNA, 5055 nt, synthetic construct
  misc_feature 1..5055: note = derived and/or modified CDS sequence (opt3) from CCHFV(SPU 383/87)__KJ682806.1__GP
  source 1..5055: mol_type = other RNA
atgtacactcccctgctctgcgccatcctttgtctgcagttgtggagcttagagggcatttatgggctgtccaacagaacacaacacaatgacacttctacgataaaggtgcctgaagagtcacagaaaaccagtctaccagctaacacagcaagcccgatcacttccgatcccccttctaccacatcgaccgcctcagcgagcggaccagaaggtagtggcgacacttccacatctccccctgtcaccacgcaggggccaactccccctgagaccacaccagaaccgcatactaccattgatatcgacaagagctccacagctattgccgatatctcaacccagacggttaaagacatacccactcctacaacccacaccagtctcccaagcacactgtctgcacccaccatccctcaagaggcccatcacacggctaggggacttctgtccattacctcaacaaagccaggcgaggcaagcactcccatcagtccgggtgaagcctctaccgaggcttccagccctcagcccacaatttcggaaactccatctcctcccccaaccgcccaggcgcccacagagatcaattcccctaacacctcacggcagccaatgccgagtactcaacccgcagcccctaatagcgtgacgcatccagctcagcccacaccttcccagtctgatgtaccaaccgccgcacaggacatacaccccaacccgattaatcgcagcaaacgaaacttggagatggaaatcattctcactctgtcacaagggctgaagaagtactatggaaaagtgctcaagttactggatcttaccttggaggaagacacagagggcctgctagaaagttgcaaacgtaatctcggcctgacctgtgatgacaacttctttcagaagagaatcgaggagttctttcttactggggaaggacacttcaatgaggtcctgcagtttaaaacaccttccacgttgagcccaaccgaacccgctagggtggagtctcctactgttgaacccttcaagtcatactttgccaagggtttcctcagtatggatagcggctatttttccgcgaaatgctactctaagtcgagcaactccgggctgcaattaatcaatgtgacacagcatctgattcggataaccgacacaccaggacctaaaatcactaacctcaagaccattaattgtatcaaccttaaagccctggtcttcaaggagcaccgcgagatagaaattaacgtgttgctaccccaggtagcagttaatctgtcaaactgccatgtgctcatcaaaagtcacgtctgtgactattctctggatatcgacggcccagtgagacttccgaggattcaccatgagggtacgtttatccctgggacctacaagattgtgatagataagaataacaaacagaatgaccggtgcacactggtcactaactgtgttatcaagggacgcgaaattcgaaaaggccaaagcgtgttgagacagtacaggaccgagatcaagatcggcaaggcttcctcagggagccggcgtctcctgtctgaagagtccaatgatgactgcttaagtcgcacacagctgctaagaactgagaacgccgaaattcacagcgataattatggaggtcccggcgacaagataaccatctgtaacgggtctacgattgtagatcagaggctcggatccgagctgggctgctacacaatcaatcgggtgaagtcattcaaactttgcgaaaacagtgctaccggtaagagctgtgagattgactcgactccagtccgatgccgccaagggttttgtttgaaaatcacacaggagggcagaggacatgtgaagctgtccaggggctctgaagttgtgctcgatgcctgcgacagctcatgtgagataatgatccccaaagggaccggagacattctggtcgattgcagtggtggccagcagcacttccttaaggacaatctggtggatttggggtgtcctaacatcccactcctgggaaagatggcaatttatatctgccggatgtccaatcatcccaaaactaccatggccttcttattttggttctcttttggctacgtaataacatgtattctgtgcaaggttatcttctatctactcgtggtcgtgggtacgctggggaaaaagtttaaacaataccgcgaacttaagcctcagacctgtactatttgcgagacaaacccggtcaacgctatcgacgcggaaatgcacgatttgaattgcagctataacatatgtccatactgcgcatccagactgacctcagacggcctcgccaggcacgtgatccagtgtcccaagcgtaaagagaagattgaggaaacagagctgtacttaaatctggaacggatcccttgggttgtgcgaaaacttttgcaggtaagcgagagtactggagtcgctctcaagagatcttcctggctggtgattctactggttctcctgaccgtgagcctttcgccagtccaatcagcccccatctctcatggcgaaacggtggaggtatatcagacaagggaggggtacaccagtatatgcttgttcgtgctgggatccattttatttctcgttagctgtctgatgaaaggtcttgtcgattctgtgggcaacagcttctttcctgggctgtccatctgcaagacttgttcaatcggaagtattaatggcttcgaaatcgagagccacaaatgctattgttctttgttttgctgtccgtactgccgccattgctccgcagacattgaaatacaccggctccacctgtcaatctgtaagaagagaaaaaccggtagtaacgtgatgctagccgtctgcaagaggatgtgtttccgcgctacagttgaggtgagcaataaagccctgctcattcgaaacatcattaatactacctttgtggtatgcatcctgatacttgcagtctgtgtggtttccacatctgcggtggaaatggagaacttgcccgctgggacgtgggagaaggaagaggatctgaccaatttctgccatcaggaatgtcaagtcactgagacagagtgcttatgtccatatgaagccctcgtgctgcggaaacctcttttcctggactcgatcgttaagggcatgaagaacctactcaatagcacctcactggagacttccttgagtattgaagcaccctggggagccatcaacgtgcagtctacatttaaaccaaccgtaagcgctgccaatattgcactgtcctggtcatctgtcgagcaccgtggcaacaagatcttagtgagcgggagaagtgaatccataatgaaactcgaggagaggacgggaattagctgggatctgggcgtggaagacgcttctgagtcaaaacttctgactgtctccgttatggatttgagtcagatgtacagccctgtgttcgaatatctctcgggtgaccgccaggtagaggaatggcccaaagcgacctgcacaggggactgtccagagcggtgcggatgcacctcttccacttgtctgcataaggagtggccgcacagcagaaactggaggtgcaatcctacatggtgttggggcgtgggtaccggctgcacatgttgcgggctagatgtcaaggacctgtttactgattacatgttcgtgaaatggaaggttgactacatcaaaaccgaagccatcgtgtgtgtcgagcttacgtcacaagaacgacagtgcagtctcattgaggccggaacacgctttaacctgggccccgtgaccataactttgtctgaaccacggaatatccagcagaagctgccccctgagattgttaccttacatccaagaatcgaggaagggttctttgatctcatgcacattcaaaaagtgctgtccgctagcacagtctgtaaacttcagtcatgcactcacggagtacccggcgacctgcagatctatcatataggtaacttgctcaagggggataaagtgaatggacacctgatccataagattgagcctcacttcaacaccagttggatgagctgggacggctgtgatctagactactattgcaatatgggtgattggccgtcctgctcttacacgggcgttacacagcataaccacgcagcctttgtgaatatgctgaacatcgaaaccgactatactaaaaatttccactttcatagcaagagggtcacagctcacggggataccccacaacttgacctcaaagcccgtcccacttacggagcaggcgagattacagtgctggtagaggtggcggacatggaattgcataccaagaaaatcgagatatccgggttaaagttcgcctcactgacgtgtactggatgctatgcttgttctagtggcatttcgtgcaaggtccgcatccacgttgatgaacctgacgagctcaccgtgcacgtgaaaagcgaagatcccgacatcgtcgccgcatcctcttcactgatggctcggaaacttgagtttggtacagatagcaccttcaaggccttctccgcaatgccaaagacaagtctgtgtttttacattgtggagagagaatactgcaaatcttgtagcaaggaggacactcagaagtgcgttaacaccaaattggaacagcctcaatcaatcctaatagagcataaggggacgattttcggaaaacagaatgatacatgtactgccaaggcttcctgctggctggaaagtgtaaagagctttttctatggcctcaagaacatgctgtctggtatctttggcaatgtgttcattggggtctttcttttcttagcgccctttatcatgctgatactcttctttatgttcggatggaggattttgttctgttttaagtgctgccgacggacccgcggcctgttcaaatacagacacctcaaggacgatgaggagatcgggtataggaaaatcattgaacggctgaacaacaagaaaggaaagaataaacttctggacggcgagcgattggccgatagaaagatcgcagaactattttccacaaagacccatattggttga

SEQ ID NO: 10384 - RNA, 5055 nt, synthetic construct
  misc_feature 1..5055: note = derived and/or modified CDS sequence (opt3) from CCHFV(SPU 497/88)__KJ682808.1__GP
  source 1..5055: mol_type = other RNA
atgtacactcccctgctctgcgccatcctttgtctgcagttgtggagcttagagggcatttatgggctgtccaacaagacacaacacaatgacacttctacgataaaagtgcctgaagagtcacagaagaccagtctaccagctaacatcgcaagcccgacaacttccgatcccccttctgccacctcgacagcgtcagctagcggaccagaaggtagtggcgacacctccacttctcccagcgtcacaacccaggggcctacgccactcgagattactcccgaacctcataccacaatcgatattgacaaatcctcaaccagtatcgccgatataagcaccagaacagttaaggacatcccaaccccgacgactcacacatctctgccctccaccccttcagcaccaactattccccaggaggtgcatcacacagccaggggacttctgagcgtaaccagtacgaaacctgaggaagctagcaccttgacatccccaggcgaggcaagcactgaagcctcgtctccccaaccgaccatctccgagacaccttcacccccacctactacccaggctcccacagagattaataacccaaataccagtcggcagcccatgcctagcactcagccagccgcgccgaactccgtgacgccccctgtccaaccaacattctctcagagcgatgtgtcaaccgcagcccaggacatccatcccagtcctactaatcgctccaagcgaaacctcgaaatggagataattctgaccctgagccagggtctcaagaaatactatgggaaggttttaaaactgcttgatttgacactggaagaggacaccgaaggactactcgagtggtgcaagcgtaatctgggccttacttgtgatgacaactttttccaaaagagaatcgaggaatttttcctgacaggcgaggggcactttaatgaagtgttgcagttcaagacgccatctaccctctcacccactgagccggctagggtcgaaagtcctacagtggagccatttaagagctacttcgccaaaggatttctgtccatggattctggttatttctcggcaaagtgctaccccaaaagctccaactcaggcttacagctgattaatgtaacccaacacctcatccggatcacagacactcctgggcccaagattaccaaccttaaaacgataaattgtatcaacctgaaggctttggtttttaaagagcatcgcgaaattgagatcaacgtgctactgccacaggtcgccgtgaatctcagtaactgccacgtgctgataaagtctcatgtctgtgactatagccttgatattgacggacctgttagactgcccaggatccaccacgaaggcaccttcatcccaggtacatacaagattgtgatcgataaaaagactaaacagaatgaccggtgcaccttggtaacaaactgtgtgattaaggggcgcgagatacgaaaaggacagtccgtcctcagacaatacaggactgaaatcaagattggcaaggcgtcaagcggctctcggcgtctgttatccgaggagagtaatgatgactgcctgagccgcacccagctactcagaacggaaaacgccgagatccattctgataattatgggggaccgggtgacaaaatcacaatttgtaacggctccaccatagtggatcagaggctggggtcagaacttggatgctacactatcaatcgggttaagagttttaaattgtgcgagaacagcgcaacaggcaagtcgtgtgagattgactccacccctgtgcgatgccgccagggtttctgtctgaaaatcactcaagaagggaagggccacgtcaagctctctagaggaagcgaggtggtactggatgcttgcgactcaagttgtgaaattatgatccccaaaggcaccggggacatacttgttgattgctccggaggtcagcagcatttcctgaaggacaatttggtggatctcggctgtccaaacatccccctgttagggaaaatggccatttatatctgcaggatgtctaatcaccctaagacaacgatggtctttctgttctggtttagcttcggatacgtgattacctgtatcctatgcaaagtcatattttatctcctgattgtggttggcactcttggtaagaagttcaaacagtaccgggagttgaagccacaaacatgtaccatctgcgaaacaaaccccgtgaatgctattgacgccgagatgcatgatctgaactgctcctataacatctgtccttactgcgcatcacgcctcactagcgacgggctggccagacacgtaatgcagtgtccgaaaaggaaggagaaaatagaagagaccgaattatacctgaatcttgagcgtatcccatgggtcgtgcggaagttgctccaggttagtgaatctacgggcgtggctctgaaacgatccagctggctagtcattctgctcgtgctgcttacagtatcgttgtcacccgtgcagtctgcgcctatcagtcacggagagaccgttgaggtctatcaaactagagaaggctacacctccatttgcctgtttgtgttagggggaatcctcttcctggtgagctgtcttatgaagggtctggtcgattctgttggcaacagctttttcccagggttgtccatatgcaagacatgttcaattggaagtatcaatggctttgagatcgaaagccataaatgctattgttctctcttctgctgtccctactgcaggcactgctccgcagacattgagatccataagctgcacctatcaatttgtaaaaagcgcaaaacttggagtaacgtgatgctggccgtgtgcaagcggatgtgttttagagctaccgtagaagtcagcaataaggccctcctgataaggaacatcattaatacaacgttcgtggtttgcatccttattttggcaatctgtgtggtctccacctctgccgtggagatggagaacctgcctgctggtacttgggaaaaagaggaagatttaacaaatttctgccaccaggagtgtcaggttaccgagactgaatgcctctgtccgtatgaggccctggtgcttcgcaagcccctgtttctagactcgatagtaaaagggatgcgaaacctcctgaatagcacatcattggaaacctccctgagtatcgaggcaccatggggcgcgattaacgtccaatctacgttcaagcctactgtgagcgctgccaatatcgcattatcctggtcatctgtggaacatcggggaaacaaaattctcgtcagcggccgtagtgagtccatcatgaagctggaggaaagaaccgggataagctgggatcttggagttgaggacgcctctgaatcaaagctgttgacagtgtccgtaatggatctcagtcagatgtacagccccgtgtttgagtatctgtcgggcgacaggcaggtcgaagagtggccaaaagctacctgcactggtgactgtcctgagcgctgcgggtgcacatcttccacctgtctacacaaggaatggccccatagccggaattggagatgcaacccaacatggtgttggggagtgggcactggttgcacctgttgcggcctggatgttaaagaccttttcacggattacatgtttgtgaagtggaaagtcgactacattaagacagaggccatcgtgtgtgttgaactcacctcacaggagaggcaatgcagtctgatcgaagcagggactcgattcaacttgggaccggtgaccattacactgtctgagcctcgcaatatacagcagaagttacccccagagatcgtcactctccacccccggattgaagagggctttttcgatctgatgcatatccagaaagtactttccgctagcaccgtgtgtaagctgcaatcatgcacgcacggggttcctggagacttgcagatttatcacatcggcaacctcctgaaaggtgataaggtgaatgggcatctaatacacaaaatcgaaccacattttaacacaagttggatgagctgggacggatgtgatctggactactattgcaatatgggcgattggccctcctgctcttacaccggtgtcactcagcacaaccatgccgcgttcgtgaatatgcttaacattgagacagactataccaagaattttcacttccacagcaaaagagtaactgcccatggcgatacacctcagctcgacctgaaggctaggccgacctacggggcaggagagatcacggtgttggtcgaagttgccgacatggagttacacactaagaaaattgaaatctccggcctgaagtttgcttcactcacctgtacagggtgctatgcctgttctagtggaatatcgtgcaaagtgcgtattcatgtggatgagccagacgaactgaccgtccacgtgaagtctgaggatcccgacatcgttgcagcgtcctcttcacttatggcccgcaaactggagttcggcacagatagcactttcaaggctttttccgccatgcctaagaccagtttgtgtttctacatcgtagaacgggagtactgcaaatcttgtagcaaggaagacacgcaaaaatgcgtgaacacaaagctagagcagccccagtcaattctgatcgaacacaaaggtactataattgggaagcaaaatgatacctgtacagcaagagcttcctgctggctcgagagtatcaagagctttttctatggactgaaaaacatgctttctggcatttttggtaatgtcttcatcggcatatttttattctttgccccattcattatgctgatcctctttttcatgttcgggtggaggatcttgttttgtttcaagtgctgccgacggacccgcggactgtttaaatacagacatctcaaggacgatgaggaagtgggctataggaaaattatcgagcggctgaacaataagaaggggaaaaacaaacttctggacggagaacgattggcagatagaaaaattgccgagctattctccactaagacccacataggctga

SEQ ID NO: 10385 - RNA, 5055 nt, synthetic construct
  misc_feature 1..5055: note = derived and/or modified CDS sequence (opt3) from CCHFV(88166)__AB069675.1__GP
  source 1..5055: mol_type = other RNA
atgtacactcccctgctctgcgccgtgctttgtctgcagttgtggagcttagagggctcccacgggctgtctaacaagacacaacattcaaataccagtacgaccaaagctcctgaagtcagccaggagctaggactcccagtttccacagtgtctactatcacctcggacccgccctcaattacaagcgcagtaagtgtgtccggttctgaaggcagcggggataccaacacttccccttcagtcacaacccagggaccaacgctgcccgagactacccttgaacctctgacaactaccgacacagatgccagtagcaccgtggttgtggacgtctctacgcagactgtgaaggatacaccaatatccaccacttatacatcattgcccagcacccctagtgagccaacgaccccgcaaggcacacaccatactgcgagaggtctcctgtctgtaacctccacaaaacccgaggaagctagcactcaggccaatcctgggaagatctcgatggagaccaactctccaaggctggcaatttccgaaacaccctcattcagtcctaccactcaggccccaacggagaatagcaaccccatcacatccaaacagctcatgttatctgctcaaccggttacccctaatcccatgactagcccagtgcagcctgcactgtcacagagtgacacctccacagccattcaggatatccaccccagcccaaccggacggtctaagcgcaaccttgagatggaaataatcttgactctgtcacaaggcctaaagaaatactatggcaagattctcaaactgcttgacctgacattggaggaagatacggaggggctcctggaatggtgcaagcgaaatttaggactggtctgtgacgataactttttccagaaacgtatcgaggagtttttcctcaccggtaagggccattttaatgaagtgcttcagttcaagactcccagtacactgagccctaccgggccagctagaacaggatccccgactgtggagccctttaaatcttacttcgccaagggctttttgtcgatggacagcggttatttctccgcgaaatgctaccctagggcatcaaacagtgggctacaactgattaatgtcacccagcactctacgcggatcaccgatacaccaggacccaagataactaacctcaaaaccattaattgtatcaacctgaaggccagcgtttttaaagaacaccgcgagattgaaatcaacgtgcttctgcctcaggtagctgtgaatttgtcctcatgccatgtcctcatcaagagccacgtgtgtgactattctctggacattgatggcccagttagattacccaggatacatcacgagggcacattcatcccggggacttacaagattgtgatcgacaaaaagaacaaacagaatgatcggtgcaccctggtcacgaactgtgtgataaagggacgcgagattcgaaaaggtcaatccgtactaagacagtacaggacagaaatcaagatcggcaaggccagtagcgggtctcggcgtctcctgtccgaggaatcaggagacgattgcattagtcgcacccagcttttgagaactgagacagcagaaatccacagcgacaattatggcggtcctggggataaaattaccatatgtaacggctcgactgttgtggaccagaggctgggatccgagctcggctgctacaccatcaatcgggtcaagtcttttaaactgtgcgagaacagcgctacagggaagtcatgtgaaattgatagtacgccagtgaaatgccgacaaggattctgtcttaagatcacccaggagggtcgcggccatgtcaagctgtccagagggtctgaagtggttttggacgcctgcgatagctcctgtgagatcatgattcccaaaggaactggcgacatactcgtggactgctcaggtgggcagcagcacttcctgaaggataatttaatcgacctgggctgtcctaacattcccctactcggaaaaatggcgatctatatttgcaggatgagcaatcatccaaagacaaccatgggctttctgttctggtttagtttcgggtacgtagtcacatgtatcctttgcaaagtgatattttatttgctgatcgttgtgggaactctcggtaagaagttcaaacaataccgggagctgaagcctcagacctgtacgatttgcgaaacaacccccgtcaacgccatcgatgcagagatgcacgacttaaattgctcttataacatttgtccatactgcgcttcccgcctgactagcgatggccttgccagacatgtgatgcagtgtccgaaaaggaaggagaaaatcgaagaaaccgagttgtacctcaatctggagcgtataccttgggtagtgcggaagctactgcaggtttcggaatcaacaggggtcgctctcaaacgatctagttggctggtggtgcttttggtcctgttaactgtttccctcagccccgtgcaatctgccccaattggacacggcaagaccgtggagacatatcagacgagagaaggttacaccagcatctgcctgtttgtacttgggtccattctgttcatcgtctcatgtttgatgaagggcctcgtggacagtgttggaaacagctttttccccggcctgtctatatgcaaaacttgttccatcgggtcagtgaacggatttgagattgaaagtcacaagtgctattgtagcctattctgctgtccttactgcaggcattgctccgcagatcgcgagatccaccggctgcatctctctatttgtaaaaagagaaaaacatggtcgaatgtcatgctggccgtgtgcaagaggatgtgttttcgcgctaccgttgaggtgagcaacaaggcgcttttgatccgaaatataattaacactacattcgtactgtgcatcttaatcctcgcagtctgtgtggtgtcaacctccgccgtcgaaatggagagtctgccagctggcacgtgggaacgggaggaagaccttactaatttctgccaccaggagtgtcaagttaccgagacagaatgcctgtgtccctatgaggccctagtgctccgtaaacctctgttttctgatagcattgtaaagggtatgaaaaacttgctgaatagcacctcattagaaacttctctcagcatcgaggcaccgtggggagccattaacgtgcagagtacattcaagccaaccatgtccgctgccaatatagcactgagctggtcttcagtcgagcacagagggaacaaaatccttgtgtccggcaggagtgaaagcattatgaagctggaggaacgcacaggtatctcgtggaatttgggcgttgaggacgcgtctgaatccaagctcctgactgtgagcgtcatggatctatcacagatgtacagtcccgtgtttgagtatctgtctggggaccggcaggttgaggaatggcctaaagctacctgcacgggagattgtccagagagatgcggctgcacatccagcacctgtcttcataaggaatggccccactcaaggaactggcgatgcaatcctacttggtgttggggagtggggaccggctgcacatgttgcggtctcgacgtcaaagacctgttcactgattacatgtttattaagtggaaagtagagtacatcaagaccgaagccatagtgtgtgttgagttgacgagtcaagagcgccagtgcacactgatcgaagcagggacccggttcaacttaggaccggtgactattacactcagcgagcccagaaatatccagcagaagctgccacctgaaattgtcacccttcatcccaggatcgaggaaggctttttcgacctgatgcacgtgcaaaaagtattgtccgcctctactgtgtgtaagctccagagctgcacacatggtgtcccaggcgatctgcaggtttatcacatagggaacctactgaaaggagacaaggtgaacggccaccttattcataaaatcgagcctcactttaatacctcctggatgtcatgggatgggtgtgacctcgattactattgcaacatgggagactggccctcttgcacgtacactggcgtgacccagcataatcacgctgccttcgtcaacatgctgaatatcgagacagattataccaagaactttcatttccacagtaaacgtgtgacagcacacggtgacactccacaattggatttaaaggctcgcccgacctacggggccggagaaattacggttctggtagaggtggcggacatggaactccatacaaagaaaatagagatctcgggcctgaagtttgccagccttacttgtaccggttgctatgcttgttcctctggcatttcatgcaaagtccggatccacgtggatgagcctgacgaactgacagttcatgttaagagcgaggaccccgatttggtcgcagcctccagttctctaatggctagaaaactggagttcgggaccgacagcactttcaaggccttttcagcaatgccaaagacctccctctgtttctacattgtggaaagggaatactgcaaaagttgtagcaaggaggatacacagaaatgcgtaaatacgaagctggagcagccccaatctatccttatagaacacaaaggaactatcattggcaagcagaacaatacctgtacagcgaaggcctcctgctggttagagtcagtcaaatcctttttctatgggctgaagaacatgctctcgggaatctttggcaatgtgttcattggtgtgtttcttttctttgctcctttcatcctgctcatactgtttttcatgttcgggtggcgaattttgttttgtttcaaatgctgccggcgcaccagaggactgtttaagtacaggcacttgaaagacgatgaagagactggctatcggaagatcatcgaacgactaaacaataagaaaggcaagaacaaactgctcgacggggagagattagccgatcgcaagattgcagagctgttctctacaaaaacccatatcggatga

SEQ ID NO: 10386 - RNA, 5055 nt, synthetic construct
  misc_feature 1..5055: note = derived and/or modified CDS sequence (opt3) from CCHFV(strain BA88166)__AF338470.1__GP
  source 1..5055: mol_type = other RNA
atgtacactcccctgctctgcgccgtgctttgtctgcagttgtggagcttagagggctcccacgggctgtctaacaagacacaacattcaaataccagtacgaccaaagctcctgaagtcagccaggagctaggactcccagtttccacagtgtctactatcacctcggacccgccctcaattacaagcgcagtaagtgtgtccggttctgaaggcagcggggataccaacacttccccttcagtcacaacccagggaccaacgctgcccgagactacccttgaacctctgacaactaccgacacagatgccagtagcaccgtggttgtggacgtctctacgcagactgtgaaggatacaccaatatccaccacttatacatcattgcccagcacccctagtgagccaacgaccccgcaaggcacacaccatactgcgagaggtctcctgtctgtaacctccacaaaacccgaggaagctagcactcaggccaatcctgggaagatctcgatggagaccaactctccaaggctggcaatttccgaaacaccctcattcagtcctaccactcaggccccaacggagaatagcaaccccatcacatccaaacagctcatgttatctgctcaaccggttacccctaatcccatgactagcccagtgcagcctgcactgtcacagagtgacacctccacagccattcaggatatccaccccagcccaaccggacggtctaagcgcaaccttgagatggaaataatcttgactctgtcacaaggcctaaagaaatactatggcaagattctcaaactgcttgacctgacattggaggaagatacggaggggctcctggaatggtgcaagcgaaatttaggactggtctgtgacgataactttttccagaaacgtatcgaggagtttttcctcaccggtaagggccattttaatgaagtgcttcagttcaagactcccagtacactgagccctaccgggccagctagaacaggatccccgactgtggagccctttaaatcttacttcgccaagggctttttgtcgatggacagcggttatttctccgcgaaatgctaccctagggcatcaaacagtgggctacaactgattaatgtcacccagcactctacgcggatcaccgatacaccaggacccaagataactaacctcaaaaccattaattgtatcaacctgaaggccagcgtttttaaagaacaccgcgagattgaaatcaacgtgcttctgcctcaggtagctgtgaatttgtcctcatgccatgtcctcatcaagagccacgtgtgtgactattctctggacattgatggcccagttagattacccaggatacatcacgagggcacattcatcccggggacttacaagattgtgatcgacaaaaagaacaaacagaatgatcggtgcaccctggtcacgaactgtgtgataaagggacgcgagattcgaaaaggtcaatccgtactaagacagtacaggacagaaatcaagatcggcaaggccagtagcgggtctcggcgtctcctgtccgaggaatcaggagacgattgcattagtcgcacccagcttttgagaactgagacagcagaaatccacagcgacaattatggcggtcctggggataaaattaccatatgtaacggctcgactgttgtggaccagaggctgggatccgagctcggctgctacaccatcaatcgggtcaagtcttttaaactgtgcgagaacagcgctacagggaagtcatgtgaaattgatagtacgccagtgaaatgccgacaaggattctgtcttaagatcacccaggagggtcgcggccatgtcaagctgtccagagggtctgaagtggttttggacgcctgcgatagctcctgtgagatcatgattcccaaaggaactggcgacatactcgtggactgctcaggtgggcagcagcacttcctgaaggataatttaatcgacctgggctgtcctaacattcccctactcggaaaaatggcgatctatatttgcaggatgagcaatcatccaaagacaaccatgggctttctgttctggtttagtttcgggtacgtagtcacatgtatcctttgcaaaggaatattttatttgctgatcgtggttggtactctcggcaagaagttcaaacaataccgggagctgaagcctcagacctgtacgatttgcgaaacaacccccgtgaacgccatcgatgcagagatgcacgacttaaattgctcttataacatttgtccatactgcgcttcccgcctgactagcgatgggcttgccagacatgtcatgcagtgtccgaaaaggaaggaaaagatcgaggaaaccgagttgtacctcaatctggagcgtataccttgggtggtacggaagctactccaggtgtcggaatcaacaggagttgctctgaaacgatctagttggctggtcgtgcttttggtgctgttaactgtctccctcagccccgttcaatctgccccaattggccacggtaagaccgtggagacatatcagacgagagaagggtacaccagcatctgcctgtttgtgcttggctccattctgttcatcgtatcatgtttgatgaagggactcgtcgacagtgtgggcaacagctttttccccgggctgtctatatgcaaaacttgttccatcggatcagttaacggctttgagattgaaagtcacaagtgctattgtagcctattctgctgtccttactgcaggcattgctccgcagatcgcgagatccaccggctgcatctctctatttgtaaaaagagaaaaacatggtcgaatgtgatgctggccgtctgcaagaggatgtgttttcgcgctaccgtggaggttagcaacaaggcgcttttgatccgaaatataattaacactacattcgtgctgtgcatcttaatcctcgcagtatgtgtcgtgtcaacctccgccgtggaaatggagagtctgccagctggtacgtgggaacgggaggaagaccttactaatttctgccaccaggagtgtcaagtcaccgagacagaatgcctgtgtccctatgaggccctagttctccgtaaacctctgtacttggattctattgtgaaggggatgaaaaacctgttaaatagcacctccctcgaaacttcactgtctatcgaggcaccgtggggagccattaacgtacagagcacatttaagccaaccatgagtgctgccaatatagcactttcctggagctctgtggagcacagaggcaacaaaatcctggtctcaggtaggtccgaaagtattatgaagttggaggaacgcacaggcatcagctggaatctcggggtggaggacgcgtcggaatctaagctgctaactgtttccgtgatggatctgagccagatgtattcacccgtcttcgagtaccttagtggagacagacaggtggaggaatggcctaaagctacctgcacgggcgattgtccagagcggtgcgggtgcacatcttccacctgtctccataaggaatggccccacagcaggaactggcgatgcaatcctacttggtgttggggagttggcaccggttgcacatgttgcgggctggacgtgaaagacttgtttactgattacatgttcattaagtggaaagtcgagtatatcaagaccgaagccatagtatgtgtggagctgacgtcacaagagcgccagtgcacattaatcgaagcaggaacccggtttaacctcggcccggttattatcactctgagtgagcccagaaatattcagcagaaacttccacctgaaatcgtgacactgcatcccaggatagaggaaggtttctttgacttgatgcacgtccaaaaagtgctcagcgcctccaccgtatgtaagctgcagtcttgcactcatggcgtgccaggggatctacaggtctaccacattggaaacctgcttaaaggcgacaaggttaacgggcacctcatccataaaatcgagcctcacttcaatacaagctggatgtcctgggatggatgtgacctggattattactgcaacatgggcgactggccctcatgcacctatacgggtgtgactcagcataatcacgctgcctttgtgaacatgttgaatattgagaccgattacacaaagaacttccattttcactctaaacgtgtcaccgcacacggggacacaccacaattagatctgaaggctcgcccgacttatggagccggcgaaataaccgtgctcgttgaggtagcggacatggaactgcatacgaagaaaatcgagattagtggtcttaagttcgcctcgctgacatgtactggctgctacgcttgtagctccgggatctcttgcaaagtgcggattcacgtcgatgagcctgacgaattgaccgtgcatgttaagtcagaggaccccgatatcgtggcagccagctccagtctaatggctagaaaactggaatttggaacagactctaccttcaaggccttcagcgcaatgccaaagacttcactctgtttttacatagtcgagagggaatattgcaaatcctgtagtaaggaggatacccagaaatgcgtgaatacaaagctggagcagccccaaagcatccttattgaacacaaaggcacgatcattgggaagcagaacaatacttgtaccgcgaaggcctcttgctggttagagtccgtaaaatcattcttttacggactgaagaacatgctcagcggcatcttcggtaatgtctttataggggtgttcttgtttttcgctccttttattctgctcatcctgttctttatgttcggatggcgaatccttttctgttttaaatgctgccggcgcacaagaggcctgttcaagtataggcacttgaaagacgatgaagagaccggctaccggaagattatcgaacgactaaacaataagaaagggaagaacaaactgctcgacggagagagattagccgatcgcaagatagcagagctgttttcgactaaaacacatattggttga

SEQ ID NO: 10387 - RNA, 5055 nt, synthetic construct
  misc_feature 1..5055: note = derived and/or modified CDS sequence (opt3) from CCHFV(SPU 130/89)__KJ682807.1__GP
  source 1..5055: mol_type = other RNA
atgtacactcccctgctctgcgccatcctttgtctgcagttgtggagcttagagggcatttatgggctgtccaacaagacacaacacaatgacaactctactacgaaagctcctgaagagtcacataagaccagtctaccagcaaatacagccagcccgataacttccgatcccccttctaccacatcgaccacttcagcgagcggaccagaaggtagtggcgacacatccacctctccccctgtgacgactcaggggccagctagccccgagaccacacctgaaccacacactaccatcgatattgacaaatcctcaacagccatcgcagatattagtacccagacggtcaaggacatcccgactcccacaacccatactagcctcccttctacactgtccgccccaaccataccccaggaggctcaccatacggcaagaggacttctgtcagttaccaggcacaaacctggcgaggccagcaagccaacaagtcccggtgaggcttctactgaagcctccagctcgcaaccgaccatctctgaaacaccttctcccccacctactacccaggcgcccacagagattaacaatccaaacacctcacggcagcccatgcctagtactcagccagcagccccgagctccgtgacgcaccccgctcaacctacaccatctcagagcgatgtacccaccgccgcacaggacatccatccttcaccaactaatcgcagtaagcgaaacttggagatggaaattatcctcaccctgtcccaggggctgaaaaagtactatggaaaagtgctcaagttactggatcttacattggaggaagacaccgagggcctgctagaatggtgcaaacgtaatctcggcctgacttgtgatgacaacttctttcaaaagagaatagaggagttctttcttacaggggaaggacacttcaatgaggtcctgcagtttaagacgcccagcaccttgtctccgactgaacctgctagggtggagtcaccaacagttgaacccttcaaaagttactttgccaagggtttcctcagcatggattccggctatttttctgcgaaatgctaccctaagtcgagcaactccgggctgcagttaattaatgtgacccaacatctgatccggattacagacactcccggaccaaaaatcaccaacctcaagacgatcaattgtattaaccttaaagccctggtcttcaaggagcaccgcgagatagaaatcaacgtgttgctacctcaggtagcagttaatctgtcaaactgccacgtgctcattaagagtcatgtctgtgactattctctggatatcgacggccccgtgagacttccaagcatacaccatgagggtacctttattccggggacatacaaaatcgtgatcgataagaaaaataagcagaacgacaggtgcactctggtcaccaattgtgttattaaaggacgggaaatccgcaagggccagtccgtgttgcgacaatacagaacagagattaagataggcaaggcttcaagcgggtctaggcggctcctgtccgaggaacctaactatgattgcttaagtcgtactcagctgctacgcaccgagaatgccgaaatccacagcgacaactacggaggtcccggcgataagattacgatctgtaatgggtctacaatcgtagaccagagactcggatccgagctgggctgctataccattaacagggtgaaatcattcaaactttgcgaaaatagtgctactggtaaaagctgtgagatagattcgacaccagtccggtgccgacaggggttttgtttgaagatcacccaagagggccgcggacatgtgaagctgtccagaggctctgaagttgtgctcgacgcctgcgatagctcatgtgagattatgatccccaaagggactggagacattctggtcgactgcagtggtggccagcagcacttccttaaggataacctggtggacttggggtgtcctaatatcccactcctgggaaaaatggcaatatacatctgcaggatgtccaaccaccccaagaccacaatggccttcttattttggttctcttttggctatgtaattacgtgtatcctgtgcaaagttattttctacctactcatcgtggtcggtaccctggggaagaagtttaaacagtatcgggaacttaagcctcaaacttgtacaatatgcgagaccaatccggtgaacgctattgatgcggaaatgcatgacttgaactgcagctacaatatctgtccatactgcgcatcccgcctgacatcagatggcctcgccagacacgtcatgcagtgtcccaaaaggaaggagaaaattgaggaaactgagctgtatttaaacctggaacgtatcccttgggtggttcggaaacttctccaggtgagcgagagtaccggagtagctttgaaacgatcttcctggctggtcgtgctactggttctcctgacggtgagcctttcgccagtccagtcagcccccatatctcatggcgaaacagtggaggtataccaaaccagagaggggtataccagtatctgcttgttcgtgctgggatccattttatttctcgttagctgtctgatgaagggtcttgtcgactctgtgggcaatagcttctttcctgggctgtccatctgcaagacctgttcaattggaagtatcaacggcttcgaaatagagagccacaaatgctactgttctttgttttgctgtccgtattgcaggcactgctccgcagatattgaaatccataagctccacctgtcaatctgtaaaaagcgcaaaacaggtagtaatgtgatgctagccgtctgcaagcggatgtgtttcagagctactgttgaggtgagcaacaaggccctgctcattaggaatatcattaacaccacatttgtggtatgcatactgatccttgcagtctgtgtggtttccacgtctgcggtggaaatggagaatttgcccgctgggacctgggagaaagaagaggacctgactaacttctgccatcaggaatgtcaggtcacagagaccgagtgcttatgtccatacgaagccctcgtgctgcgcaagcctctttcgctggatagcattgttaaaggcatgaagaatctactcaactcaacttccctggagacaagtttgtctatcgaagcaccctggggagccattaatgtgcaaagcaccttcaaaccaacggtatccgctgccaacatcgcactgtcatggtctagcgtcgagcaccgaggcaataagatattagtgagtgggcggtccgaaagcatcatgaagctcgaggagcgtactggaatttcttgggacctgggcgtggaagatgcttcagagtccaaacttctgaccgtcagtgttatggacttgagccagatgtattcgcctgtgtttgaatacctctctggtgatagacaggtagaggaatggcccaaggccacatgcaccggggactgtccagagaggtgcggatgcacttccagcacatgtctgcataaagagtggccgcactcacgcaactggcggtgcaaccctacctggtgttggggcgtgggtacaggctgcacttgttgcgggctagacgtcaaggatctgttcaccgactacatgtttgtgaaatggaaggttgattatatcaagacggaagcgattgtgtgtgtcgagcttacaagtcaggaaagacaatgctctctcatcgaggccggaaccaggttcaatctgggccccgtgactataaccttgtccgaaccacgaaacattcagcagaaactgccccctgagatcgttacattacacccacgcatcgaggaagggtttttcgacctcatgcatattcagaaggtgctgagcgcttcaactgtctgtaaacttcaaagttgcacccacggagtacccggcgatctgcagatataccatatcggtaatttgctcaagggggacaaagtgaacggacacctgattcataagatcgagcctcactttaatacgagctggatgtcctgggatggctgtgacctagattattactgcaacatgggtgactggccgtcttgcagctatacaggcgttacccagcacaatcatgcagccttcgtgaacatgctgaatattgaaactgattacacaaagaactttcacttccattccaagcgggtcaccgctcacggggacactccacagcttgatctcaaggccagacccacatatggagcaggcgagatcaccgtgctggtagaggtggcggacatggaattgcacacgaaaaaggtcgagatatcagggttaaaatttgcctctctgacttgtaccggatgctacgcttgtagttcgggcatcagctgcaaggttaggattcatgtggacgaacctgatgagctcacagtgcacgtcaaatccgaagaccccgatatcgtggccgcatcttcaagcctgatggctcgtaaacttgagttcggtaccgactccacatttaaggccttcagtgcaatgccaaagacttctctgtgtttctacattgttgagcgcgaacattgcaagagctgttcaaaagaggatacccaacggtgcgtaaatacgaagttggaacagcctcagtccatcctaatagagcacaaagggacaattatcggaaagcaaaacgacacttgtaccgccaaggctagttgctggctggaaagcatcaaatcctttttctatggcctcaagaatatgctgtccggtatttttggcaacgtgttcatcggggtctttcttttcttagcgccctttataattctgatcctcttctttatgttcggatggagaattttgttttgtttcaaatgctgcaggcgaacacggggcctgctcaagtaccgccatctgaaagatgacgaggagatcgggtatagaaagataattgaaaggcttaataacaagaaaggaaagaacaaactgttggatggcgagcggctagccgaccgaaagatcgcagaactgttctcaaccaaaactcacatcggttga

SEQ ID NO: 10388 - RNA, 5052 nt, synthetic construct
  misc_feature 1..5052: note = derived and/or modified CDS sequence (opt3) from CCHFV(4701-ST-2009)__KR814872.1__GP
  source 1..5052: mol_type = other RNA
atgcacaccctgctcgtgtgcttcatcctttacctgcagttgagcggcttagggggagcccatggtcaatccaacgctacagagcacaatggcactaacacgaccacagcacccgggacttctcagtcacctaagccaccggccagtaccacactgccccatacccctgaaagctccactgtcaaactaacaaccccaacgtctgagactgaaggatcgggcgagaccacaccccctccaaatactacccagggtctccccctgacagggaccacgcctgaaagatcagcgactacagctaccagcaccagttccacagacaacatgaactctaccacgcaggttaccgataatacaccaactagcaccgtgtccatttcaccgagttctagctcctcaatgcccagcacacctcaaggaactcaccatccagtaaggagtcttctgtctgtgtccagccccaagaccgtcacaacccctactccaatgtcgcccggcgagatgtctccggagacgtcctcacagcacagtgccatgagccgggtgcctacattgtataccgcaactcaggtttccaccgaaaatacagaccgctctactccccgacagagcgagtcaagtgtgcaaccagccactcagtcccctataacaagccccgctcagacgatcctcctgatgtctgcagccccaaaagctattcaggatatgcacccctcacctaccaaccgtagtaagagaaatctggaagtcgagatcattctcactttaagccaaggcctgaaaaagtactatgggaagatccttaaattgctgcatctaacactcgaggaagacaccgagggactgcttgaatggtgtaagaggaacctgggttccaattgcgatgacgactttttccagaaacggatagaggaatttttcatcacaggcgaggggtactttaacgaggtgttgcagttcaagactctctctaccctgtcgccaacggaaccgagccacgtacgcttacccaccgccgagccttttaaatcctatttcgcgaagggatttctgtcaattgatagtggctacttctctgcaaagtgttatccaagaagctccacatcaggtctccaacttatcaatgttactcagcatcccgccaggattgctgaaacccctgggccaaaaacaactagcctgaagaccatcaactgcataaatttgcgggcctctgtgtttaaagagcaccgcgaagtcgagattaacgtgctactgccccagatcgcagtgaacctctccaattgtcacgtcgttattaacagtcatgtgtgcgattacagcctggacacggatggaccggtacgacttcctagaatccaccatgagggcacattcatcccaggcacctacaagattgtgatagacaggaaaaataagctgaacgatcggtgttctttggtcactaattgcgtgatcaaagggcgtgaagttcgcaagggacagtccgtgctcagacaatataagacagagattaaaatcggtaaggcttcaaccggcagtaggaaactgttaagcgaggaacccggggacgactgtatatcgcggactcagctgctaaagaccgaaacagccgagattcacgatgacaactacggaggccctggtgataaaatcacgatctgcaatgggtccaccgtcgtggaccagcgactcggctctgagctgggatgttatactattaaccgcgtaaagagctttaaactttgcgaaaattcagcgacaggcaaaacctgcgagatcgatagtacacccgttaagtgtagacaggggttctgcttgaaaattactcaagaaggaaggggtcatgtgaagctgtcccggggctctgaggtcgtgctcgacgcctgtgatagctcctgcgagataatgatcccaaaagggaccggagacattctggtcgattgttcaggcggtcagcagcacttccttaaggacaacctgatcgatttggggtgccctcacatccccctcctgggcaagatggcaatttacatatgtcgcatgagcaatcatccaagaacgacaatggcttttcttttctggtttagtttcggatatgtgattacctgcatcttttgtaaagccctgttctactctctaatcattatcggcactctcgggaagaaaataaagcagtatagggaactgaaaccgcaaacctgcacaatctgtgagactgctcctgttaacgccattgacgcagaaatgcacgaccttaattgctcctacaacatctgcccctactgtgccagccgtttgacctcggatggactggctcggcatgtgacacagtgcccaaagcgaaaggagaaagtagaagagacggagctctatctgaatttagaaaggattccctggatcgtcagaaagctgcttcaggtgtcagagtctaccggtgttgcgttgaaacgcagttcctggctcatagtgctgctagtcctgctcactgtgagcctgtctcctgtacagagcgcaccagtgggccacgggaagacaattgaaacctaccaaactcgggagggatttacatccatctgtcttttcatgttgggctcaattctgtttatcgttagttgcttagtcaaaggtctcgtggacagcgtgtctgattccttctttcccgggctgtcagtctgtaagacctgcagtataggcagcatcaacggattcgaaattgagtcccacaaatgttattgctctttattttgttgcccttactgtagacattgctcggccgacagggagatccaccagctgcatttgagcatttgcaagaagcgcaaaacgggctcaaacgttatgctcgctgtgtgtaagcgaatgtgcttcaaagccactatcgaagcatcccggcgtgccctgctaataagaagtattatcaataccacattcgtgatgtgtatcctgaccctcgctatttgcgtagtctctactagcgccgtggagatggaagatctgccggcagggacatgggagagggaagaggaccttaccaacttttgtcaccaggagtgccaagttacagaaactgagtgtttgtgcccatatgaagcgctggtgttacgcaagcccctcttcctggattccatcgtcaaaggaatgaagaatcttctgaactcaacctctctagagacgagcctcagtattgaggctccttggggcgccataaatgtgcagtccacatttaagccaaccgttagcactgcaaacatcgccctgtcttggtcatccgtggaacatcggggtaataaaattttggtaaccgggagaagtgagagcatcatgaagctggaagagaggacaggagtctcgtgggacttaggcgtggaagatgcttctgagtccaaactcctgactgtgagcattatggacctttcacagatgtacagtcccgtcttcgagtatctgtctggtgatcgacaggttgaagagtggcctaaggccacctgtacgggcgactgcccggaacgctgtgggtgcacatcctcaacctgcttgcacaaagagtggccccacagccggaactggagatgtaatccaacttggtgctggggagtgggcacagggtgtacctgctgtggagtagatgtgaaggacctctttactgaccatatgttcatcaagtggaaagtcgaatacataaagacagaggcaatcgtgtgcgttgagctgaccagtcaagaaaggcagtgtagcctaattgaggctggcacgcgttttaacctgggtcctgtgactatcaccctttccgaaccccgcaatattcagcagaaactcccacctgagatcataacactgcaccccaagattgaagaggggttctttgatttgatgcatgtccaaaaagtgctgtctgccagcaccgtttgcaagttacagtcctgtacacacggaatcccaggcgacctccagatctaccatattggtaacctgcttaagggcgatcgggtgaatgggcacctgatacacaaaatcgagccgcatttcaacacttcatggatgtcttgggacggatgcgatttggactattactgtaatatgggcgattggcctagttgcacctatacgggggtcacacagcacaaccatgcggcctttgtaaacctcctgaatattgaaactgactacaccaagacattccactttcactcgaaaagagtgaccgctcatggagatactccccaactagacctgaaggcaaggccaacctatggcgccggtgagatcacagttcttgtggaagtcgctgatatggagctccacacgaaaaaggtggagattagcgggctgaaattcgcctccttgacttgcaccggatgttacgcatgttcttcaggcatcagctgcaaggtacgaatacatgtggacgaacccgatgagttaacagtccacgttaagtccagtgaccctgacgtggtggcggcctctaccagcctgatggctcggaaactcgagttcggtactgattcaacatttaaggccttctccgcaatgccaaaaaccagtctgtgcttttatatcgtcgaacgcgaatactgtaagagctgctctgaggacgatacgaaaaagtgtgtggacactaaacttgagcagccccagtccattctgatcgaacataagggcacaattatcgggaagcaaaacgatacctgcaccgctaaagcctcatgttggttggagagcgttaagtcgttcttttacggactaaagaatatgctgggctctgtattcgggggatttttcgtgggcatactcctgtttcttgcacctttcgtcttactggtgctctttttcatgttcggttggaagattttgttttgcttcaagtgttgcagaaggactcgggggctgtttaaatatcgacacctcaaggacgatgaagagacaggatacagacgcatcatcgaaaggctgaacagtaaaaagggcaaaaatcgtcttctggacggcgagcggttggccgatagaaagattgctgagctattctccaccaagacacacatcgggtga

SEQ ID NO: 10389 - RNA, 5052 nt, synthetic construct
  misc_feature 1..5052: note = derived and/or modified CDS sequence (opt3) from CCHFV(36-ST-2014)__KR814857.1__GP
  source 1..5052: mol_type = other RNA
atgcacaccctgctcgtgtgcttcatcctttacctgcagttgagcggcttagggggagcccatggtcaatccaacgctacagagcacaatggcactaacacgaccacagtccccgggacttctcagtcacctaagccaccggcaagtaccacactgccccatacccctgaaagctccactgttaaactaacaaccccaacgtctgagactgaaggatcgggcgagaccacaccccctccaaatactacccagggtttaccccctccagggacaaccccggaaagacccgccacgactgcgacatcaatgagcagtaccgacaacatgaatagtactacacaggtgaccgataacacgcctacctctacagtaagcatttccccatcaagtagcccctctatgccttccacttcacaaggaatacactatccagtgaggagcctgcttagtgtctcttcccccaagaccgtgacaactccgacccctatgagccccggcgagatgtcgccagagacatcttcccagcattcagctatgagtcggatccctaccctgtacactgccacgcaggttagcacagaaaataccaaccgctccactccccgacagtctgagagctcagcacaaccagccacccagagtcccacaacctcccctactcagacaattttgctcatgagcgctgcaccaaaagccatccaggacatgcacccgtctcccacgaatcgttcaaagagaaacctggaagtggagattatcctgaccctcagtcaaggcctcaaaaagtattacgggaagatactgaaacttttgcacctgactctagaggaagatacagagggactcctggaatggtgtaagaggaatcttggtagcaactgcgacgatgactttttccagaaacggatcgaggaatttttcattaccggcgaggggtattttaatgaggtcctgcagttcaagacattgtccactctctctcctaccgaaccatcgcatgtgcgcctgcccacggctgagccttttaaaagctacttcgccaagggatttttatccatcgattcaggctatttcagtgcgaagtgttacccaagatctagcacctccggtctgcaactcattaacgtaacacagcaccccgcaaggatcgccgaaactccggggcctaaaaccacatcacttaagactataaattgcattaacctgcgggctagcgtttttaaagagcatcgcgaagtggagatcaacgtcttgctaccacagattgccgtgaatctgtctaactgtcacgtggtcatcaattcccacgtttgcgactacagtctcgataccgacggacccgtgcgactgcctagaatccatcacgagggcacgttcattcccggcacatataagatagtaatcgataaaaagaacaaacttaatgacaggtgtagcctggtgaccaactgcgtcattaaggggcgggaagtgcgtaagggacagtctgttttgcgccaatacaaaactgagatcaagataggtaaagcatccacaggctcaagaaagctcctgagtgaggaaccaggggatgactgtattagcaggacccagttactgaaaactgaaaccgctgagatccatgacgataattatggaggccctggtgacaagatcacaatttgcaacgggtcgacgatcgtggatcagcggctaggctccgagctcggatgttacaccattaatcgagtcaagtcttttaaactgtgcgaaaacagcgccactggcaagacatgcgagatagactcaacccccgtgaaatgtcgccaggggttctgccttaagatcacacaagaaggaagaggtcacgtaaaattgagtaggggctccgaggttgtgctggatgcgtgtgactctagctgcgagattatgatcccaaaggggactggagatatcctcgtcgactgttccggcggtcagcagcatttcctgaaggataatcttattgacctggggtgcccgcacatacctttgctcggcaaaatggccatctatatttgtcggatgtcaaaccacccccgcaccacgatggcatttctgttctggtttagcttcggatacgtgatcacatgcatcttttgtaaggctttattctatagtctgattataatcggcaccctagggaaaaagattaaacagtacagagaactcaagccacaaacttgcaccatctgtgagacagcccccgtcaatgctattgatgccgaaatgcatgacctgaactgctcttacaatatctgcccttattgtgcatccaggcttactagcgacggattggcccgtcacgtgacccagtgcccaaagcggaaagagaaggttgaagagacagagctgtacctcaacctggaacgaataccctggattgtgagaaaattactgcaggtatcggagtcaacgggtgtcgctcttaagaggtctagttggttgatcgtgctcctggttctactgaccgtgtccctcagccctgtccagtctgcgccggtgggccatgggaaaactattgaaacatatcaaacccgcgagggatttactaacatctgtctgttcatgcttggcagcatattgtttatcgtatcctgcctggtgaagggtttagttgattcagtcagtgacagcttctttccagggctctctgtgtgtaaaacatgctccattggctcaatcaatggattcgaaattgagagtcacaagtgttactgcagcctgttttgttgcccctattgtcggcactgctccgcagatagagagatccatcagcttcacctgggcatatgcaagaaaaggaagaccgggtctaacgtgatgttggccgtctgtaaacgcatgtgcttcaaggctacgattgaagcctcgcgacgggcactcctgatccgtagcatcattaatactaccttcgttatctgtattctaacactggccatatgcgtggtgtcaacctccgctgtagagatggaaaacctccctgccggaacttgggagagagaagaggacctgacaaatttttgtcatcaggagtgccaagtcagtgaaaccgagtgtctttgcccatacgaagcattggtgctgaggaaacccttattcctcgattctatcgttaagggcatgaagaacctgcttaatagcacatccctggagacttcactatctattgaggcgccttggggtgctatcaacgtgcagagcacctttaaaccgacggtcagtacagccaatattgcactctcctggagctctgtggaacaccgcgggaacaagatcctggttaccggacggtcagagtccataatgaaattggaagagagaactggcgtgagttgggacctgggtgtagaagatgccagcgagtcgaagttactcaccgtctctatcatggacctgtcccagatgtatagccccgtgttcgagtacctttcaggcgatcgacaggtggaagagtggccaaaagctacatgtactggggactgccctgaaaggtgtggatgcaccagttctacgtgcctgcataaggagtggccccactcccgcaattggcggtgtaacccaacatggtgctggggcgtcgggaccggatgtacttgctgtggcgttgatgtgaaggacttgtttacagatcacatgttcattaaatggaaggtagaatacatcaaaaccgaggccattgtgtgcgtcgagctcactagccaagaaagacagtgttcactgatcgaggcaggtacaaggtttaatctagggcctgtgaccataacgctgagtgaaccccgtaacattcagcagaaacttccaccggagatcatcactctccatcctaagattgaagagggattctttgacctgatgcacgttcaaaaggtgttgagcgcttccaccgtctgcaagctgcagtcttgtacacatggcatacccggtgacttacagatctatcacattggcaatctcctgaaaggggatcgccttaacggacatctgatccacaagattgagccacacttcaacaccagctggatgtcctgggacggctgcgatttggactactattgtaatatgggggattggccctcatgcacatacactggagtgacccagcataaccacgccgcgtttgttaatctcctgaacatcgaaacggactatacaaaaactttccattttcactctaagcgggtgaccgcccacggcgatacacctcaactagacctgaaagctagaccaacctacggtgcaggggagataactgtccttgtagaagtggccgatatggagctccataccaagaaagttgagatcagtggactgaagttcgcttcgttggcctgcacaggctgttatgcatgcagctccggtatttcttgtaaggtgaggatccacgtcgacgaacccgatgagttaacggtgcatgtaaaatcaagcgaccctgatgtggtcgcggcctccacttccctgatggctcgaaagctcgaatttggcaccgactctacatttaaagccttcagcgcaatgccgaagacctcactgtgcttttacattgttgagcgggaatactgtaaatcctgcagtgaggacgatactaagaagtgtgtggacacaaaacttgatcagccacagagcatcctgatagagcacaaggggaccattatcggaaaacaaaatgacacgtgcactgctaaggcctcttgttggttggaatccgtgaaatcattcttttatggcctaaagaacatgctggggagcgtcttcggaaatttcttcgtgggcatcctcctgtttcttgcacccttcgttttactggtactctttttcatgtgcggttggaagttcttgttttgtttcaaatgctgccgcagaacaagggggctgtttaagtaccggcatctcaaagatgacgaggaaaccggatatcgaagaattatcgagcgcctgaactcgaagaaaggcaagaataggcttctggatggcgaacgtttggccgaccggaagatagctgagctattctctaccaaaagtcacattgggtga

SEQ ID NO: 10390 - RNA, 5055 nt, synthetic construct
  misc_feature 1..5055: note = derived and/or modified CDS sequence (opt3) from CCHFV(Matin)__AF467769.2__GP
  source 1..5055: mol_type = other RNA
atgtacaccctgctcctttgcgccatcctgtgtagccagttgtggtcctctgagggcattcacgggttatcaaacgaaacacaacatggaaatgctagtactataaaggcacccgaggtgagccagggtctgggcctacctgtctccacggccccaccgatcacctctgacccaccttcgattacatcagcggctagcgttagtgggccagaaggatccggcgatactaacacctctccccctgtgacaacccagggtctcactctgccagagacaacccttgaactgttgacgactaccaatacaggggccagctccactgtaatcgtggacgtctcaacccagacagtgaaagatacccccgttagtacggcacacactagccctccaggaacaccgtctgcccccaccactcctcaaggcacacatcacaccgctagaggcctcctgtccgtgacgtcaaccaagagcgaggaggcaagtacacagactaaccccaaaaagacctctatggaaacaaattcccccgggcctgccactagcgagaccccatcgccctctccgacaacccaggctcctactgaaaacaataaccccaatacgccaaggcagcctacacccccaacccaacccgccactccttccccagtcacctcaccggcgctgctcgcaagtagccagggagacacatccaccgccgtgcaggatgtacatccctctcctactaaccggagcaaacgcaatttagagatggagattatcctgacactttcacagggtttgaagaagtattacggcaaaatactgaagctactcgacctgacgcttgaagaggataccgaagggctgttggagtggtgcaaacgaaacctcggactggtttgtgacgatagtttctttcaaaagcgtatcgaagagttctttttaactggcgagggtcacttcaatgaagtgctgcagtttaaaacaccatccaccctcagccccacagagcctgctagagccgggtctccaactgtcgaacccttcaagtcatattttgcaaggggacttctgagtatggacagcggctacttctccgctaagtgctatccgcgggcctctaactcgggcttgcagctaattaatatcacccaacacagcgcgcgcattacggatacccctgggccaaaaatcacaaacctgaagactataaactgtattaatctcaaagcctccacctttaaggagcatagagaaatcgagattaacgtgctgcttccccaggtggcagtcaatctgtcaagttgccacgttttgatcaaatctcatgtgtgtgactacagcctcgatatcgacggacctgtaaggctgccccggattcaccacgagggtacattcataccaggcacttataagatcgtgattgacaaaaagaacaagcagaatgatcgctgcaccatcgtcacgaactgtgtgataaaagggcgagaaattagaaagggacagtccgttttaaggcaatacaaaacagagatcaagatcggcaaagctagtagcggttctcggcgtctgctatccgaagagagtggggacgattgcattagccgcacccagctcctgagaactgaaacagccgagatccattctgactcctacggcggacctggcgataagattaccatatgtaatgggtcaactgtggtcgaccagaggcttggaagtgagttgggttgctataccatcaaccgggtaaagagctttaaactgtgcgaaaattcggctacaggcaagtcctgtgagattgattctacgcccgtgaaatgccgacaggggttctgtctcaagatcacccaagaaggacgcggccacgttaaactgagcagaggttcagaggtggtccttgacgcctgcgatagttcctgtgagatcatgattccaaaggggactggcgacatactggtggattgctctggaggccagcagcactttttgaaggacaacctcatcgacctggggtgtccgaatattcctttactgggaaaaatggcaatctacatttgcaggatgagcaaccatcccaagacaaccatggtcttcctattctggttttccttcggttatgtgatcacatgtatactctgcaaagttatcttttacctgcttattgtggtaggcactttggggaagaaattcaagcagtatcgggaactgaagccacaaacctgtacgatctgcgagacaacccccgtcaatgccattgatgctgaaatgcatgacctcaactgctcatacaatatctgtccttattgcgcgagccgcctgacttcagatggattagcaagacacgtgatgcagtgtccaaaaaggaaggagaaaatagaagagaccgagctgtaccttaacttggaacgtattccctgggttgtgcggaagctcctgcaggtctctgagtccacaggcgtggccctaaaacgaagctcgtggctggtagtgctcctggttcttttgactgtctcactgtctcctgtgcagagtgctccgatcggtcacgggaagaccgtggaaacataccaaattagagagggctatacgtccgtctgcttatttgttctcggaagcatcctgttcatagtgtcttgtcttatgaaaggcctggtggacagcgatgggaactcctttttcccaggattgtcaatctgcaagacctgtagtattggcagcatcaatggttttgaaattgagtctcataagtgctactgttccctcttctgctgtccctattgcaggcactgctcaactgaccgcgagatccataaactgcacctaagtatatgtaagaaacggaagacagggagcaacgtaatgctggccgtctgcaaaagaatgtgttttagggcaaccgtggaagtttccaataaggccctcctgattcgctctatcatcaacactacattcgtggtctgcattcttatcttggctgtgtgtgttgtgtcgaccagcgccgtagagatggaatcactgcctgcaggaacgtgggagcgagaagaggatttaattaatttttgccaccaggagtgtcaggtcactgaaaccgagtgcctctgtccatacgaagcgctggtgcttcggaagcccctgttcctagactccataatcaaaggcatgaagaacctcctgaatagtacatctttggagaccagcctgtccattgaggctccttggggtgccatcaacgtgcaatcaactttcaaaccgacaatgtctgcagccaatattgctttaagctggagttccgtcgaacatcgtggcaacaagatcctcgttagcgggagatctgagtcaataatgaaactggaagagaggaccggaatctcctgggatcttggcgtggaagacgccagtgagagcaagctgttgacagtatcggtgatggatctctctcagatgtattcccccgtctttgagtacctgagcggggaccgccaggtggaagagtggccaaaggcaacttgcaccggagattgtcctgaacggtgcggctgcacgtcaagtacatgtctacacaaagagtggccccattctagaaattggaggtgcaacccaacctggtgttggggtgttgggactggatgcacctgttgcggcctggacgtgaaggaccttttcacagattatatgtttgtcaaatggaaggtggaatacattaaaactgaggttatcgtgtgtgtcgagctcacctcccaggaacgacaatgcagcctgattgaggctggtacgcgcttcaatttgggccctgtaacaatcaccctgtcagaaccccggaacatacagcagaagttaccaccggagattgtgactctccaccctagaatcgaagaggggtttttcgacctgatgcatgttcagaaggtgcttagtgccagcacagtctgtaaactgcaatcctgcacccacggagtgcccggcgatttgcaggtataccacatcgggaatctcctgaagggagacaaagtgaacggccatctaattcacaagatagagccacattttaacacttcttggatgagctgggatggttgtgacctggattattactgcaatatgggggactggccctcctgctcatatacaggagtcacccagcacaaccatgcggccttcgttaatatgctttctatcgaaacggattacactaaaaactttcacttccacagtaagagggtgaccgctcatggcgacacacctcagctcgatctgaaagcacgtccaacctatggtgccggcgagattacagtgttggtcgaagtggctgacatggagttacacactaagaagatcgagatttcggggctgaaatttgccagcctcacctgtacgggatgctacgcatgttcctctggcatctcatgcaaggttcgcatacatgtagatgaacccgacgagctgacagtgcacgtcaaaagcgaagaccctgatatcgtggcggcctccagttctcttatggctcggaagctggagttcgggactgacagcacctttaaagccttctcagcaatgccgaagacatccttgtgtttctatattgttgaaagagagtactgcaagagttgtagcaaagaggatacccaaaagtgcgtgaatactaaactagaacagccacagtctatcctgattgagcacaagggaaccatcataggcaaacaaaacgacacatgtacggctaaggcctcctgctggctcgaatcagtcaagagctttttctacggtctgaaaaatatgctttcggggatttttggaaacgtgttcatcggcatctttttattcctggcaccctttgccctcttgattctgttctttatgttcggctggaggatcctcttttgtttcaagtgctgccgacggactcgcgggctgttcaaatatagacatcttaaggatgacgaggaaaccggatacaggaaaataattgagcggctgaataacaagaagggtaaaaataagttgctagatggcgagcgactggctgacagaaaaatcgcggaactcttttctacaaagacccacgtagggtga

SEQ ID NO: 10391 - RNA, 5052 nt, synthetic construct
  misc_feature 1..5052: note = derived and/or modified CDS sequence (opt3) from CCHFV(UCCR4405)__KY484029.1__GP
  source 1..5052: mol_type = other RNA
atgcacgccctgctcgtgtgcttcatcctttacctgcagttgagcggcttagggggagctcatagacaatccaacgcaaccgagcacaatggtacaaacactacgaccgcccccggcacatctcagtcacctaagccaccggtcagtactaccctgccccatacacctgaagcgagcaccattaaactaactacaccaacctccgagacggaagggtctggagagactacaccccctccaaatacaactcagggcctccccctgcctggtaccacaccagaaaggtcggctaccacggccacttcaacaagcagtaccgacgatatgaactccactacacagatgaccgacaatacgccgacctctacagttagcatagggctttcctcaagtcccagcatgccttctacttcccaaggaatccactatccagtgcggtcactgttgagcgtaagttctcccaagaccgcaacaactcctaccccaatgtcccccggcgaggtgagcccggagacatcgtctcagcattccgccatgtcacgcattcctaccctctacactgctacgcaggtcagtacagaaaacaccaatcgaagcatcccccgtcagtccgagtctagcgtgcaaccagcaactcagtcacctattaccagtcccgcccagacaatcctgctgatgtccgctgccccaaccgcgatacaggatatgcaccccagccctaaaaacagatctaagaggaatctcgaagttgagatcattttaactctgtcacaaggccttaaaaagtattacgggaagatcttgaaactgctacacctcacactggaggaagacacggagggacttctggaatggtgtaagcggaacttgggtagtaattgcgatgacgactttttccagaaacgcattgaggaatttttcatcaccggcgaggggtattttaacgaggtgctccagttcaagactccaagcacactgtccccgaccgaaccctctcatgtcagattacctacagcagagccatttaaatcgtacttcgccaagggatttctgagcatagattccggctatttctcagctaagtgttaccccaggagttctactagcggtctccaacttattaatgtgacccagcaccctgcccggatcgcagaaacgccagggcccaaaaccacatccctgaagactattaactgcatcaatttgcgcgcttcagtatttaaagagcatcgagaagttgagatcaacgtgctactgccgcagattgccgtcaacctcagcaattgtcacgtggtgataaactctcacgtctgcgattactccctggacaccgatggacctgttagacttccaaggatccatcacgagggcgcgttcattcccggcacatataagatcgtgatagacaaaaagaataaactgaacgatcggtgtagtttggtaactaattgcgtgattaaggggcgtgaagtccgcaagggacagagcgtgctcagacaatacaaaaccgagatcaagatcggtaaagcctctacgggctccaggaagctgttatcagaggaacctggggacgactgtattagtcggacacagctgctaaaaaccgaaactgcagagatccatgatgacaactatggaggccccggtgataagattacaatatgcaatgggagcaccatcgttgaccagcgactcggctcggagctgggatgttacactattaaccgcgtgaagtcctttaaactttgcgaaaattctgctaccggcaagacatgcgagatcgatagcacgccagtcaaatgtagacaggggttctgcttgaagatcacccaagaaggaaggggtcacgtgaaactgtcacggggcagtgaggtagttctcgacgcctgtgattcctcttgcgaggtgatgattcctaaggggactggagacatactggtcgattgtagcggcggtcagcagcatttccttaaggacaacctgatcgatttggggtgcccccacattccactcctgggcaaaatggctatctatatttgtcgcatgtccaatcacccgagaacaaccatggcctttttattctggttttcattcggatacgtgatcacatgcatattttgtaaggcactgttctatagcctaatcattatcggcactctcgggaaaaagattaaacagtacagggaactgaagcctcaaacctgcacgatctgtgagacagcccccgtcaacgctatagacgcggaaatgcatgaccttaagtgcagttacaatatttgcccatattgtgcatctcgtttgacctccgatggactggcccggcacgtgactcagtgccccaaacgaaaggagaaagttgaagagaccgagctctacctgaacttagaaagaatcccttggattgtgaggaagctgcttcaggtaagcgagtcgacaggtgtcgctttgaaacgctcatcttggctcatcgtgctgctagttctgctcactgtgagtctgtccccagtccagagcgcccccgtgggccatgggaagaccatagaaacatatcaaacgcgggagggatttacctctatctgtcttttcatgttgggcagcattctgtttatcgtatcctgcttagtgaaaggtctcgttgactcagtcagtgatagcttctttcctgggctgtctgtgtgtaagacttgctccattggctcaatcaatggattcgaaatagagagtcacaagtgttactgcagcctgttttgttgcccgtattgtagacactactccgcagacagggagattcatcagcttcacttgtctatctgcaaaaagcgcaaaacaggctcgaacgtgatgctcgccgtctgcaagcgaatgtgtttcaaagctaccatcgaagccagccggcgtgcactgctaattagatcaatcattaacactacattcgttatatgcatcctgattctcgcgatctgtgtggtgtccaccagtgctgtagagatggaaaatctgccagccgggacgtgggagagggaagaggatcttactaacttttgccatcaggagtgtcaagtcaccgaaacagagtgcttgtgtccctatgaagcactggtgttacgcaagcctctcttcctggactctaccgttaagggaatgaaaaatcttctgaacagcacttccctagagacatcactctctattgaggccccatggggcgctatcaatgtgcagagcacctttaagcccacagtcagtactgccaacatagcactgtcctggagctctgtggaacaccggggtaataaaatcttggttaccgggagatcagagtccattatgaagctggaagagaggacgggagtgagttgggatttaggcgtagaagacgctagcgagtcgaaactcctgacagtctctatcatggatctttcccagatgtacagccctgtgttcgagtacctgtcaggtgaccgacaggtggaagagtggccgaaggcaacctgcactggcgattgtcccgaacgctgcgggtgtaccagttctacatgcttgcataaggagtggccacactcccggaactggagatgcaatcctacttggtgttggggagtcggcaccgggtgcacgtgttgcggagttgacgtgaaagatctctttacagaccacatgttcgtaaagtggaaagtggaatatattaagaccgaggcgatcgtctgtgtggagctgactagccaagaaaggcagtgctcactaatagaggccggcacacgttttaacctgggtcccgttaccattactcttagtgaaccacgcaatatccagcagaaactccctcccgagatcattacactgcatccaaagatagaagaggggttctttgacttgatgcacgtgcaaaaggtcctgagcgcttccaccgtgtgtaaattacagtcttgcacgcatggaatcccgggcgatctccagatttaccacatcggtaacctgcttaagggcgaccgggttaatgggcatctgattcacaaaatcgagcctcacttcaacactagctggatgtcctgggatggatgtgacttggattattactgcaatatgggcaactggccctcatgtacctatacaggggtgacccagcataaccacgcagcctttgtcaatctcctgaacatagaaacagactacactaagaccttccattttcactctaaaagagtaacggctcacggagatacaccacaactagacctgaaggccaggcccacttatggcgccggtgagatcaccgtgcttgttgaagtggcggatatggagctccataccaaaaaggtcgagattagtgggctgaagttcgcctcgttggtgtgcaccggatgctacgcttgtagctccggcatctcttgcaaagtacggattcacgtggacgaacctgatgagttaactgtccatgttaagtcaagcgacccagatgtggtggccgcatccaccagtctgatggctcgaaaactcgagttcggtacagactctatctttaaggccttcagcgcaatgcccaaaacgtcactgtgtttttacatagtcgaacgcgaatattgcaagtcctgtagtgaggacgatactaagaaatgcgtggacaccaaacttgagcagcctcagagcattctgatcgaacacaaaggcacaatcattgggaagcaaaatgatacctgtactgccaaggcttcttgctggttggagtccgttaagtcattcttttacggactaaagaacatgctgggcagcgtattcgggaatttctttgtgggaatcctcctgtttcttgcgccgttcgtcttactggtgctctttttcatgttcggctggaaaatattgttttgtttcaagtgctgtagaaggacacggggtctgtttaaatatcgacatctcaaggacgatgaagagaccgggtacagacgcattatcgaaaggctgaactcgaaaaagggaaagaatcgtcttctggacggcgagcggttggccgatagaaaaattgcagagctattctctacgaagactcacatcggctga

SEQ ID NO: 10392 - RNA, 5052 nt, synthetic construct
  misc_feature 1..5052: note = derived and/or modified CDS sequence (opt3) from CCHFV(Drosdov)__DQ211630.1__GP
  source 1..5052: mol_type = other RNA
atgcacgccctgctcgtgtgcttcatcctttacctgcagttgagcggcttagggggagctcatagacaatccaacgcaaccgagcacaatggtacaaacactacgaccgcccccggcacatctcagtcacctaagccaccggtcagtactaccctgccccatacacctgaagcgagcaccattaaactaactacaccaacctccgagacggaagggtctggagagactacaccccctccaaatacaactcagggcctccccctgcctggtaccacaccagaaaggtcggctaccacggccacttcaacaagcagtaccgacgatatgaactccactacacagatgaccgacaatacgccgacctctacagttagcatagggctttcctcaagtcccagcatgccttctacttcccaaggaatccactatccagtgcggtcactgttgagcgtaagttctcccaagaccgcaacaactcctaccccaatgtcccccggcgaggtgagcccggagacatcgtctcagcattccgccatgtcacgcattcctaccctctacactgctacgcaggtcagtacagaaaacaccaatcgaagcatcccccgtcagtccgagtctagcgtgcaaccagcaactcagtcacctattaccagtcccgcccagacaatcctgctgatgtccgctgccccaaccgcgatacaggatatgcaccccagccctaaaaacagatctaagaggaatctcgaagttgagatcattttaactctgtcacaaggccttaaaaagtattacgggaagatcttgaaactgctacacctcacactggaggaagacacggagggacttctggaatggtgtaagcggaacttgggtagtaattgcgatgacgactttttccagaaacgcattgaggaatttttcatcaccggcgaggggtattttaacgaggtgctccagttcaagactccaagcacactgtccccgaccgaaccctctcatgtcagattacctacagcagagccatttaaatcgtacttcgccaagggatttctgagcatagattccggctatttctcagctaagtgttaccccaggagttctactagcggtctccaacttattaatgtgacccagcaccctgcccggatcgcagaaacgccagggcccaaaaccacatccctgaagactattaactgcatcaatttgcgcgcttcagtatttaaagagcatcgagaagttgagatcaacgtgctactgccgcagattgccgtcaacctcagcaattgtcacgtggtgataaactctcacgtctgcgattactccctggacaccgatggacctgttagacttccaaggatccatcacgagggcgcgttcattcccggcacatataagatcgtgatagacaaaaagaataaactgaacgatcggtgtagtttggtaactaattgcgtgattaaggggcgtgaagtccgcaagggacagagcgtgctcagacaatacaaaaccgagatcaagatcggtaaagcctctacgggctccaggaagctgttatcagaggaacctggggacgactgtattagtcggacacagctgctaaaaaccgaaactgcagagatccatgatgacaactatggaggccccggtgataagattacaatatgcaatgggagcaccatcgttgaccagcgactcggctcggagctgggatgttacactattaaccgcgtgaagtcctttaaactttgcgaaaattctgctaccggcaagacatgcgagatcgatagcacgccagtcaaatgtagacaggggttctgcttgaagatcacccaagaaggaaggggtcacgtgaaactgtcacggggcagtgaggtagttctcgacgcctgtgattcctcttgcgaggtgatgattcctaaggggactggagacatactggtcgattgtagcggcggtcagcagcatttccttaaggacaacctgatcgatttggggtgcccccacattccactcctgggcaaaatggctatctatatttgtcgcatgtccaatcacccgagaacaaccatggcctttttattctggttttcattcggatacgtgatcacatgcatattttgtaaggcactgttctatagcctaatcattatcggcactctcgggaaaaagattaaacagtacagggaactgaagcctcaaacctgcacgatctgtgagacagcccccgtcaacgctatagacgcggaaatgcatgaccttaagtgcagttacaatatttgcccatattgtgcatctcgtttgacctccgatggactggcccggcacgtgactcagtgccccaaacgaaaggagaaagttgaagagaccgagctctacctgaacttagaaagaatcccttggattgtgaggaagctgcttcaggtaagcgagtcgacaggtgtcgctttgaaacgctcatcttggctcatcgtgctgctagttctgctcactgtgagtctgtccccagtccagagcgcccccgtgggccatgggaagaccatagaaacatatcaaacgcgggagggatttacctctatctgtcttttcatgttgggcagcattctgtttatcgtatcctgcttagtgaaaggtctcgttgactcagtcagtgatagcttctttcctgggctgtctgtgtgtaagacttgctccattggctcaatcaatggattcgaaatagagagtcacaagtgttactgcagcctgttttgttgcccgtattgtagacactactccgcagacagggagattcatcagcttcacttgtctatctgcaaaaagcgcaaaacaggctcgaacgtgatgctcgccgtctgcaagcgaatgtgtttcaaagctaccatcgaagccagccggcgtgcactgctaattagatcaatcattaacactacattcgttatatgcatcctgattctcgcgatctgtgtggtgtccaccagtgctgtagagatggaaaatctgccagccgggacgtgggagagggaagaggatcttactaacttttgccatcaggagtgtcaagtcaccgaaacagagtgcttgtgtccctatgaagcactggtgttacgcaagcctctcttcctggactctaccgttaagggaatgaaaaatcttctgaacagcacttccctagagacatcactctctattgaggccccatggggcgctatcaatgtgcagagcacctttaagcccacagtcagtactgccaacatagcactgtcctggagctctgtggaacaccggggtaataaaatcttggttaccgggagatcagagtccattatgaagctggaagagaggacgggagtgagttgggatttaggcgtagaagacgctagcgagtcgaaactcctgacagtctctatcatggatctttcccagatgtacagccctgtgttcgagtacctgtcaggtgaccgacaggtggaagagtggccgaaggcaacctgcactggcgattgtcccgaacgctgcgggtgtaccagttctacatgcttgcataaggagtggccacactcccggaactggagatgcaatcctacttggtgttggggagtcggcaccgggtgcacgtgttgcggagttgacgtgaaagatctctttacagaccacatgttcgtaaagtggaaagtggaatatatgaagaccgaggcgattgtctgtgtggagctgactagccaagaaaggcagtgctcactaatcgaggccggcacacgttttaacctgggtcccgttaccataactcttagtgaaccacgcaatattcagcagaaactccctcccgagatcatcacactgcatccaaagattgaagaggggttctttgacttgatgcacgtgcaaaaggtcctgagcgcttccaccgtgtgtaaattacagtcttgcacgcatggaataccgggcgatctccagatctaccacattggtaacctgcttaagggcgaccgggttaatgggcatctgatccacaaaattgagcctcacttcaacactagctggatgtcctgggatggatgtgacttggattattactgcaatatgggcaactggccctcatgtacctatacaggggtgacccagcataaccacgcagcctttgtcaatctcctgaacatcgaaacagactacactaagaccttccattttcactctaaaagagtaacggctcacggagatacaccacaactagacctgaaggccaggcccacttatggcgccggtgagataaccgtgcttgttgaagtggcggatatggagctccataccaaaaaggtcgagatcagtgggctgaagttcgcctcgttggtgtgcaccggatgctacgcttgtagctccggcatttcttgcaaagtacgaatccacgtggacgaacctgatgagttaactgtccatgttaagtcaagcgacccagatgtggtggccgcatccaccagtctgatggctcggaaactcgaatttggtacagactctatttttaaggccttcagcgcaatgcccaaaacgtcactgtgtttttacatcgtcgagcgcgaatattgcaagtcctgtagtgaggacgatactaagaaatgcgtggacaccaaacttgagcagcctcagagcatactgattgaacacaaaggcacaatcatcgggaagcaaaatgatacctgtactgccaaggcttcttgctggttggagtccgttaagtcattcttttacggactaaagaacatgctgggcagcgtattcgggaatttcttcgtgggcattctcctgtttcttgcgccgttcgtcttactggtgctctttttcatgttcggatggaaaatcttgttttgtttcaagtgctgtagaaggacacggggtctgtttaaatatcgacatctcaaggacgatgaagagaccgggtacagacgcataattgaaaggctgaactcgaaaaagggaaagaatcgtcttctggacggcgagcggttggccgatagaaaaatcgcagagctattctctacgaagactcacattggctga

SEQ ID NO: 10393 - RNA, 5052 nt, synthetic construct
  misc_feature 1..5052: note = derived and/or modified CDS sequence (opt3) from CCHFV(44-ST-2010)__KR814859.1__GP
  source 1..5052: mol_type = other RNA
atgcacaccctgctcgtgtgcttcatcctttacctgcagttgagcggcttagggggagcccatggtcaatccaacgctacagagcacaatggcactaacacgaccacagtccccgggacttctcagtcacctaagccaccggcaagtaccacactgccccatacccctgaaagctccactgttaaactaacaaccccaacgtctgagactgaaggatcgggcgagaccacaccccctccaaatactacccagggtcttccccctccagggacaaccccggaaagacccgccacgactgcgacatcaatgagcagtaccgacaacatgaatagtactacacaggtgaccgataacacgcctacctctacagtaagcatttccccatcaagtagcccctctatgccttccacttcacaaggaatacactatccagtgaggagcctgcttagtgtctcttcccccaagaccgtgacaactccgacccctatgagccccggcgagatgtcgccagagacatcttcccagcattcagctatgagtcggatccctaccctgtacactgccacgcaggttagcacagaaaataccaaccgctccactccccgacagtctgagagctcagcacaaccagccacccagagtcccacaacctcccctactcagacaattttgctcatgagcgctgcaccaaaagccatccaggacatgcacccgtctcccacgaatcgttcaaagagaaacctggaagtggagattatcctgaccctcagtcaaggccttaaaaagtattacgggaagatactgaaacttttgcacctgactctagaggaagatacagagggactcctggaatggtgtaagaggaatcttggtagcaactgcgacgatgactttttccagaaacggatcgaggaatttttcattaccggcgaggggtattttaatgaggtcctgcagttcaagacattgtccactctctctcctaccgaaccatcgcatgtgcgcctgcccacggctgagccttttaaaagctacttcgccaagggatttttatccatcgattcaggctatttcagtgcgaagtgttacccaagatctagcacctccggtctgcaactcattaacgtaacacagcaccccgcaaggatcgccgaaactccggggcctaaaaccacatcacttaagactataaattgcattaacctgcgggctagcgtttttaaagagcatcgcgaagtggagatcaacgtcttgctaccacagattgccgtgaatctgtctaactgtcacgtggtcatcaattcccacgtttgcgactacagtctcgataccgacggacccgtgcgactgcctagaatccatcacgagggcacgttcattcccggcacatataagatagtaatcgataaaaagaacaaacttaatgacaggtgtagcctggtgaccaactgcgtcattaaggggcgggaagtgcgtaagggacagtctgttttgcgccaatacaaaactgagatcaagataggtaaagcatccacaggctcaagaaagctcctgagtgaggaaccaggggatgactgtattagcaggacccagttactgaaaactgaaaccgctgagatccatgacgataattatggaggccctggtgacaagatcacaatttgcaacgggtcgacgatcgtggatcagcggctaggctccgagctcggatgttacaccattaatcgagtcaagtcttttaaactgtgcgaaaacagcgccactggcaagacatgcgagatagactcaacccccgtgaaatgtcgccaggggttctgccttaagatcacacaagaaggaagaggtcacgtaaaattgagtaggggctccgaggttgtgctggatgcgtgtgactctagctgcgagattatgatcccaaaggggactggagatatcctcgtcgactgttccggcggtcagcagcatttcctgaaggataatcttattgacctggggtgcccgcacatacctttgctcggcaaaatggccatctatatttgtcggatgtcaaaccacccccgcaccacgatggcatttctgttatggttcagctttggatacgtgatcacatgcattttctgtaaggctctgttttatagtctaatcataatcggcaccctcgggaaaaagattaaacagtacagagaactgaagccacaaacttgcaccatctgtgagacagcccccgtcaatgctattgatgccgaaatgcatgaccttaactgctcttacaatatctgcccttattgtgcatccaggttgactagcgacggactggcccgtcacgtgacccagtgcccaaagcggaaagagaaggttgaagagacagagctctacctgaacttagaacgaataccctggattgtgagaaaactgcttcaggtatcggagtcaacgggtgtcgctttgaagaggtctagttggctcatcgtgctgctagttctgctcaccgtgtccctgagccctgtccagtctgcgccggtgggccatgggaaaactattgaaacatatcaaacccgcgagggattcactaacatctgtctttttatgttgggcagcatactgttcatcgtatcctgcttagtgaagggtctcgttgattcagtcagtgacagctttttcccagggctgtctgtgtgtaaaacatgctcctttggctcaattaatggattcgaaatcgagagtcacaagtgttactgcagcctcttttgttgcccctattgtcggcactgctccgcagatagagagattcatcagctgcacttgggcatctgcaagaaaaggaagaccgggtctaacgtgatgctcgccgtctgtaaacgcatgtgcttcaaggctacgatagaagcctcgcgacgggcactgctaattcgtagcatcatcaatactaccttcgttatttgtatcctgacactcgccatttgcgtggtgtcaacctccgctgtagagatggaaaacctgcctgccggaacttgggagagagaagaggaccttacaaatttttgtcatcaggagtgccaagtcagtgaaaccgagtgtttgtgcccatacgaagcactggtgttaaggaaacccctcttcctggattctatagttaagggcatgaagaaccttctgaatagcacatccctagagacttcactctctatcgaggcgccttggggtgctattaacgtgcagagcacctttaaaccgacggtcagtacagccaatatcgcactgtcctggagctctgtggaacaccgcgggaacaagattttggttaccggacggtcagagtccatcatgaaactggaagagagaactggcgtgagttgggacttaggtgtagaagatgccagcgagtcgaagctcctgaccgtctctataatggacctttcccagatgtatagccccgtgttcgagtacctgtcaggcgatcgacaggtggaagagtggccaaaagctacatgtactggggactgccctgaaaggtgtggatgcaccagttctacgtgcttgcataaggagtggccccactcccgcaattggcggtgtaacccaacatggtgctggggcgtcgggaccggatgtacttgctgtggcgttgatgtgaaggacctctttacagatcacatgttcatcaaatggaaggtagaatacattaaaaccgaggccatcgtgtgcgtcgagctgactagccaagaaagacagtgttcactaattgaggcaggtacaaggtttaatctggggcctgtgaccatcacgcttagtgaaccccgtaacatacagcagaagctcccaccggagattatcactctgcatcctaaaatcgaagagggattctttgacttgatgcacgttcaaaaggtgctgagcgcttccaccgtctgcaagttacagtcttgtacacatggcattcccggtgacctccagatatatcacatcggcaatctgcttaaaggggatcgcctgaacggacatttgattcacaagatcgagccacacttcaacaccagctggatgtcctgggacggctgcgatctcgactactattgtaatatgggggattggccctcatgcacatacactggagtgacccagcataaccacgccgcgtttgttaatctgctaaacattgaaacggactatacaaaaactttccattttcactctaagcgggtgaccgcccacggcgatacacctcaactggaccttaaagctagaccaacctacggtgcaggggagatcactgtcctcgtagaagtggccgatatggagctgcataccaagaaagttgagataagtggattgaagttcgcttcgttagcctgcacaggctgttatgcatgcagctccggtatctcttgtaaggtgaggattcacgtcgacgaacccgatgagctgacggtgcatgtaaaatcaagcgaccctgatgtggtcgcggcctccacttccctcatggctcgaaagctggagttcggcaccgactctacatttaaagccttcagcgcaatgccgaagacctcactttgcttttacatcgttgaacgggaatactgtaaatcctgcagtgaggacgatactaagaagtgtgtggacacaaaactggatcagccacagagcattttgatcgagcacaaggggaccataattggaaaacaaaatgacacgtgcactgctaaggcctcttgttggctagaatccgtgaaatcattcttttatggcctgaagaacatgctcgggagcgtcttcggaaactttttcgtgggcatcctgttatttttagcacccttcgttctgctcgtattgtttttcatgtgcggttggaagatcctgttctgttttaaatgctgccgcagaacaaggggactcttcaagtaccggcatctgaaagatgacgaggaaaccgggtatcgaagaattatcgagcgccttaattcgaagaaaggcaagaataggctgttggatggcgaacgtctagccgaccggaagatagctgagctgttttctaccaaaagtcacattgggtga

SEQ ID NO: 10394 - RNA, 5052 nt, synthetic construct
  misc_feature 1..5052: note = derived and/or modified CDS sequence (opt3) from CCHFV(3756-ST-2007)__KR814866.1__GP
  source 1..5052: mol_type = other RNA
atgcacaccctgctcgtgtgcttcatcctttacctgcagttgagcggcttagggggagcccatggtcaatccaacgctacagagcacaatagaactaacacgaccacagtccccggcacttctcagtcacctaagccaccggcaagtaccacactgccccatacccctgaaagctccactgttaaactaacaaccccaacgtctgagactgaagggtcgggagagaccacaccccctccaaatactacccagggcctccccctgcctggtacaaccccagaaaggtcagccacgactgcgacaagcaccagttccactgacaacatgaatacaaccacacaggtgaccgataacacaccgacttctaccgtaagcatttccccctcaagtagcccttctatgccatccacatcacaagggatacactatcccgtgcggagccttctgagtgtctcttcccctaagactgtgaccacaccaacccccatgagcccgggagagatgtcgcctgagacttcttcccagcattcagctatgagtcgcatccccacgttgtacacagccacccaggttagcactgaaaatattaaccgatccaccccacgtcagtctgagagctcagtgcaacctgcaacacagagtcccatcacctccccagcccagactattctcctgatgagcgctgcacccaaagccatccaggacatgcacccttctccaacaaatagatcaaagaggaacctggaagtcgagataatcctcacgttaagtcaaggcctgaaaaagtattacggcaagattcttaaattgctgcacctaaccctcgaggaagatactgaggggctgcttgaatggtgtaagcggaatctgggaagcaactgcgacgatgactttttccagaaacgcatcgaggaatttttcattacaggtgagggctattttaatgaggtgttgcagttcaagaccctctccacactgtctccgactgaaccctcgcatgtaagattacctaccgctgagccatttaaaagctacttcgccaaggggtttctgtccatcgattcaggatatttcagtgcgaagtgttaccccaggtctagcacgtccggcctccaacttataaacgttacccagcaccctgcacggattgccgaaacaccaggtcccaaaactacctcactgaagacaatcaattgcattaacttgcgcgctagcgtgtttaaagagcatcgagaagtcgagatcaacgtgctactgccgcagatcgccgtgaatctctctaactgtcacgtcgttattaattcccacgtgtgcgactacagtctggatactgacgggcctgtaagacttccaaggatacatcacgagggaaccttcatccccggcacgtataagattgtgatcgatcggaaaaacaagctgaatgaccgttgtagcttggtcacaaactgcgtgataaaaggccgcgaagttagaaaggggcagtctgtgctcaggcaatacaagaccgagattaaaatcggaaaggcatccactggttcacggaaactgttaagtgaggaacctggcgatgactgtatcagccgaacacagctgctaaagaccgaaactgctgagattcatgacgataattatgggggacccggcgacaaaatcaccatttgcaacggttcgacaatagtcgatcagcgcctcgggtccgagctgggctgttacacgatcaatagagtgaagtcttttaaactttgcgaaaacagcgccaccggaaaaacttgcgagattgactcaacaccagtaaagtgtaggcagggcttctgcttgaaaatcacccaagaagggcggggacacgttaagctgagtcgcggttccgaggtggtcctcgatgcgtgtgactctagctgcgagatcatgattcctaaaggcacaggggatatactggtggactgttccggaggccagcagcatttccttaaggataatctgatcgacttgggttgcccccacattccactcctggggaagatggccatctatatttgtagaatgtcaaaccacccgaggactaccatggcatttttattctggtttagcttcggctacgtcatcacgtgcatattttgtaaagctctgttctatagtctaatcattatcggaacactcggcaagaaaattaagcagtaccgtgaactgaaacctcaaacctgcactatctgtgagaccgcccccgtgaatgctatagatgccgaaatgcatgaccttaactgctcttacaatatttgcccatattgtgcatcccggttgacaagcgacgggctggcccgacacgttactcagtgccccaagagaaaggagaaagtggaagagaccgagctctacctgaacttagaaaggatcccttggattgtacgcaagctgcttcaggtctcggagtcaacaggagtggctttgaaacggtctagttggctcatcgttctgctagtgctgctcacggtctccctgagcccagtgcagtctgcgcccgtaggtcatggcaagaccatagaaacttatcaaacaagagaggggtttaccagcatctgtcttttcatgttgggatccattctgtttatcgtgtcatgcttagttaaaggcctcgtcgatagtgtgagcgactctttctttcctggtctgtccgtgtgtaagacttgctcaattgggagtatcaacggcttcgaaatagagagccacaaatgttactgctccctgttttgttgcccgtattgtaggcactgctctgcagatcgcgagattcatcagctgcacttgtcgatctgcaagaagcgaaaaacaggaagcaatgtcatgctcgccgtttgtaagcggatgtgcttcaaagctaccatcgaagcctcacgtagagcactgctaattaggtccatcattaacacgactttcgtgatatgtatcctgaccctcgccatttgcgtggtaagtacatctgctgtcgagatggaagacctgccagccggcacctgggagcgcgaagaggatcttactaatttttgtcatcaggagtgccaagtgacagaaaccgagtgtttgtgcccctacgaagcactggttttacggaagcctctcttcctggacagcatcgtgaaagggatgaagaaccttcttaattccacatcactagagacttctctcagcattgaggcgccatggggagctatcaacgtccagagtacctttaagcccacggtgtccacagccaatatagcactgagctggtcttcagttgaacacagaggcaacaaaatcttggtgaccggtaggtccgagagtattatgaagctggaggaacgaactggggtaagctgggatttaggagtcgaagacgcctcggagtctaaactcctgaccgtgtccatcatggatcttagccagatgtattcacctgtgttcgagtacctgagtggcgaccgccaggtcgaagagtggccgaaggctacatgtactggtgattgccccgaacggtgtggctgcacctcttccacgtgcttgcataaagagtggccacacagcagaaattggaggtgtaaccctacatggtgctggggagttgggaccggctgtacttgctgtggggtggacgtaaaggatctctttacagaccacatgttcattaagtggaaagtggaatacatcaagaccgaggccatagtctgcgtggagctgacttcacaagaacgtcagtgtagtctaattgaggcaggaacacgctttaatctgggccccgttaccatcacgcttagcgaaccacggaacatccagcagaaactccctcccgagattataactctgcatccaaagatcgaagagggtttctttgacttgatgcacgtgcaaaaagtcctgtccgcttctaccgtgtgcaagttacagagctgtacacatgggattccgggagatctccagatctatcacattggcaatctgcttaagggtgacagagttaacggccatctgatccacaaaatagagcctcacttcaatacctcctggatgtcatgggatgggtgcgacttggattactattgtaacatgggagactggccctcttgcacatacactggcgtgacccagcataaccacgccgcgtttgtcaatctcctgaacatcgaaacggattatacaaagactttccattttcacagtaaaagggtaaccgcccacggggacacaccacaactagatctgaaggctcgacccacctacggagcaggcgagattactgtgcttgttgaagtggccgacatggagctccataccaaaaaggtcgagatctcgggtctgaaattcgctagcttgacatgcacggggtgttatgcctgctcctctggaatttcatgtaaggtgcggatccacgtagatgaacctgacgagttaactgtgcatgtcaagagctccgatccagacgttgtggcagcgagtacctctctgatggcccgcaaactcgaatttggcacagacagcacctttaaggctttctcagccatgcccaaaacttccctgtgcttttacatagtggagagagaatactgtaagagttgcagcgaggatgacacgaaaaagtgtgtcgataccaaacttgagcagcctcagtctattctgatcgaacacaaaggtacgatcattggcaagcaaaatgacacttgcacagcaaaggcttcctgttggttggagtcagttaagagcttcttttatgggctaaagaacatgctgggatcggtgttcggctctttcttcgtagggatcctcctgtttcttaccccgttcgtgttactggtcctctttttcatgttcggatggaagatattgttttgcttcaagtgttgcaggcggacccgaggcctgtttaaatacagacatctcaaggatgacgaagagactggttatcgcaggattatcgaacgtctgaatagtaaaaaggggaaaaaccggcttctggatggagagagattggccgacaggaagattgcagagctattctccacaaagacccacatcggctga

SEQ ID NO: 10395 - RNA, 5052 nt, synthetic construct
  misc_feature 1..5052: note = derived and/or modified CDS sequence (opt3) from CCHFV(47-ST-2013)__KR814861.1__GP
  source 1..5052: mol_type = other RNA
atgcacaccctgctcgcctgcttcatcctttacctgcagttgagcggcttagggggagctcatggtcaatccaacgcaacagagcacaatggcactaacacgaccacagtgcccgggacttctcagtcacctaagccaccggccagtaccacactgccccatacccctgaaagctccactgtcaaactaacaaccccaacgtctgagactgaaggatcgggcgagaccacaccccctccaaatactacccagggtcttccccctccagggacaaccccggaaagatcagcgacgactgctacaagcaccagttccactgacaacatgaactctacaacccagatgacgggaaatacccccacacctactgttaatatgagcccatcctcaagtcccagcatgccttctacctcccaaggcattcactatccagtgaggtcactgcttagcgtacccagtccgaagacagccactacccctacacccgtgtctccaggcgagatgtcccctgagaccagctcgcagcattctgcaacttcccggatacccacgctgtacacagccacccaggtctcaactgaaaacaccaatcgcagtacaccacgacagagcaaatcctctgtgcaacccgctacccagagccctatcactccaccggcacagacaattttgctcatgtcagccgctcccaaggccatccaggatatgcaccctagtccaacgaaccgttccaaaagaaatctggaggttgaaattatcctgaccctcagccaagggttaaagaagtattacggaaaaatactgaagctcttgcacctgactctagaggaggacacagaaggtctcctggagtggtgtaaaaggaaccttggctctaattgcgatgacgactttttccagaagcggatcgaagagtttttcattaccggggaaggatattttaacgaggtgctgcagttcaaaacattgtcaactctcagtcccaccgagcctagccatgtccgcctgccaacggcggaaccctttaagtcctactatgcaaagggcttcttatctctggattcgggttactttagcgccaaatgttacccgagatcctcaaccagtgggctccaacttatcaatgtgacacagcaccctgctaggattgccgagactccaggacccaagaccacatctctgaaaactatcaactgcataaacttgcgggcaagcgtattcaaggaacatcgcgaggttgaaattaatgtgctactgcctcagatcgctgtcaacctctccaattgtcacgtggtgattaactcacacgtctgcgattatcccctggacaccgatggcccagttcgacttcctagaatccatcacgagggcacgtttatccccgggacatacaaaattgtgatagacaagaaaaataagctgaacgataggtgtagcttggtaaccaattgcgtgatcaagggacgggaggtccgtaaaggtcagtctgtgctccgccaatataagactgaaattaaaatcggcaaggcctccacagggagtagaaaactgttaagcgaggaaccaggagacgattgtatatctaggacccagctgctaaagactgagaccgcggaaattcatgacgacaactacggcggtccgggggataagatcacaatctgcaatggctccacgattgttgaccagcggctcggatcagagctgggctgttataccatcaaccgagtgaaaagtttcaaactttgcaaaaatagcgccactgggaagacatgcgagattgattcgacccctgtcaaatgtcgccagggattttgcttgaagataacacaagaaggtagaggccacgtgaagctgtccagggggtctgaggtagttctcgacgcatgtgatagctcatgcgaaatcatgattcccaaaggaactggcgacatcctggtggattgtagtggtgggcagcagcatttccttaaggacaacctgatcgatttgggctgcccacacattcccctcctgggaaaaatggctatatacatctgtcggatgtccaatcaccctcgcaccacgatggccttcttattttggttctcttttggctatgtcattacatgcatcttctgtaaggctctgttttacagcctaattatcatagggaccctcggaaagaagatcaagcagtacagagagctgaaaccacaaacttgcaccatttgtgagacagcccccgtgaacgcaatcgacgccgaaatgcatgatcttaattgctcctataacatttgcccttactgtgcttcaaggttgactagcgacggtctggcgcgtcacgtcacccagtgcccgaagcggaaagagaaggtggaagagacagaactctatctgaacttagagcgaatcccatggatagttagaaaactgcttcaggtgagtgagtctacgggcgtagcattgaagaggtccagctggctcattgtcctgctagtgctgctcaccgtttcgctgtcacccgtgcagtctgcccctgtcgggcatggaaaaactatcgaaacataccaaacccgcgagggcttcactagcatttgtctttttatgttgggttccatcctgttcatagtgagctgcttagtaaaggggctcgtggactctgttagcgattcctttttcccaggcctgtcagtctgtcggacatgcagtatcggaagcattaatggctttgaaatcgagtctcacaagtgttattgctcccttttctgttgcccctactgtagacactgctcagctgacagggaaattcatcagctgcacttgagtatctgcaaaaagcgcaaaaccgggagcaacgtgatgctcgccgtgtgtaagcgaatgtgctttaaagcaacgatagaggcctcccggcgtgctctgttcattagatctatcatcaatactaccttcgtcacatgtattctaaccctggccatctgcgttgtgtcgactagcgcagtggagatggaagatctccctgcgggaacatgggagagggaagaggacctgaccaacttttgtcatcaggaatgccaagtaacagagactgagtgtctttgcccgtatgaggctttggtcctgcgcaagcccttattcctcgattcaattgtgaagggcatgaaaaatctgcttaactccaccagtctggaaacgtctctaagcatagaagccccatggggtgcaatcaatgttcagtccacatttaagcctaccgtgtcaactgccaacattgctctctcttggagcagtgtcgagcaccgggggaataaaatcctggtgaccggaagatccgagagcattatgaagttggaagagaggacaggcgtttcttgggacctgggtgtggaagatgcctcagagtccaaattactcactgtaagtatcatggacctgagccagatgtactcgcccgtcttcgaatacctttctggcgatcgacaggtggaggagtggccaaaggcaacctgtacgggggaatgccctgagcgctgtggatgcacatccagtacctgcctgcataaggaatggccccactcacggaactggagatgtaatccaacttggtgctggggcgtggggacaggatgtacctgctgtggcgtcgacgttaaagatttgtttactgaccacatgttcataaagtggaaagtggagtatatcaagacagaagctattgtatgcgtggagctcaccagtcaagagaggcagtgttctctgatcgaagccggtacgcgttttaacctagggccggtcactattaccctgtccgagcctcgcaatatccagcagaaacttcccccagaaataattacactccatcccaagatcgaggaaggattctttgatctgatgcacgtgcaaaaggttttgagcgcgtcaaccgtgtgcaaactgcagagttgtacacatggcatccctggtgacttacagatttaccacataggcaacctcctgaagggggaccgggtcaatggacatcttatccacaaaattgagccacacttcaacactagctggatgtcctgggatggctgcgacctggattattactgtaacatgggggactggccctcttgcacctatacgggagtgacacagcataatcacgccgcttttgttaacttgctcaatatcgagactgattacaccaagacattccattttcacagcaaaagagtgaccgcacacggcgacactcctcaactggatctaaaggccaggccgacctatggtgctggggaaattacagtcctggtagaggtggccgacatggaacttcatacgaaaaaggttgaggtgtccggactcaagttcgcatcactggcgtgcactggctgttacgcctgctctagtggtatctcgtgtaaagtccgaatacacgtggatgagccagacgaattgaccgtacatgtcaagagctccgatcccgacgtggttgctgcctctacatcattaatggcacggaaactggagttcggcaccgatagcacttttaaggctttctccgccatgcctaaaacaagtctctgcttttacatcgtggaacgcgagtattgtaagtcttgcagcgaagacgacaccaagaaatgtgtggatacgaagctggagcagccccagtcaattcttatcgagcacaaagggactattatcggaaagcaaaacgacacatgcaccgcaaaagcctcctgttggctggaaagtgtcaagagcttcttttacggcttgaagaatatgctagggtctgtgttcggaaactttttcgttggcatactgctctttctggctccattcgtacttttagtgctgtttttcatgttcggttggaaaattctcttttgcttcaagtgttgcagaaggacccgggggttgtttaaatatcgacatctgaaggatgacgaggaaactggatacagacgcatcatcgagaggctcaattccaaaaagggcaagaaccgtctgcttgatggcgaacggctggcggacagaaaaattgccgagttgttctcaacaaagacccacatcgggtga

SEQ ID NO: 10396 - RNA, 5052 nt, synthetic construct
  misc_feature 1..5052: note = derived and/or modified CDS sequence (opt3) from CCHFV(1-CR/HU-2015)__KU161584.1__GP
  source 1..5052: mol_type = other RNA
atgcacaccctgctcgtgtgcttcatcctttacctgcagttgttaggcctagggggagcccatgagcaaagcaacgctacagaccacaatagaactaacacgattaccgcaccctccacatctcagaatcctaagccaccggcctcaactacaccccctcataccccagaaagtagcaccataaaactgatcacttccacaggtgaggcggaaggctctggggagaccacgccccctctcaacactacccagggaccatttccccctgaaacaacttcggagcacccagcttcaaccgccacaaataccagcagtacgaactccatgaactctactacacagatgaccgataatactctgacaagcaccgtctccacgtcacttagtattagcccgtctaccccctccacatcacaaggcatccattatcctgttaggagcctgttgagtgtgtcttccccaaagactgcagccacccccacacctatgagcactcgggagatgtcgtctgaaacctcctcacagcacagtgctatgagccgcacaccaaccttccacactgcaacgcaggtatccacagagaatgccaaccgatctactccccgtcagagcgaatcaagtgctcaaccggccacccagtcccctatgaccagccccgcgcagtctatttttctcgtgtcagcagccccaacaaccatccagaatatacatcctagtcccactaacagaagcaaaaggaatctggagatggagatcattctgacactcccacaaggtttaaagaaatactatgggaagatcctgaaacttttgcacctgacgctagaagaggacaccgaaggactcctggagtggtgtaaacggaaccttggctccaattgcgatgacgagttctttcagaagcgcattgaagagttctttatcactggcgaagggtacttcaacgaggtcctgcagtttaaaacattgtctaccctctcgcccacagaacctagccatgctagaccaccgactgccgagcccttcaagtcctattttgcaaaaggattcctgtcaatagatagtggttacttttctgctaagtgttatcctaggagctccacctcaggcttacaactgattaacatcacgcagcacccagcccggattgcggaaacccccgggcctaagacaactagcctcaaaaccatcaattgcatcaaccttcgcgcctctgtgttcaaggagcaccgagaggttgaaattaatgtgctgttgccacagatagcagtcaacctatccaattgtcatgtggtaatcaacagtcacgtttgcgactacagcctggatacagacggacccgtgagactcccgaggatttaccatgagggcactttcatccctggtacctataaaatagtcattgataagaaaaataagctgaacgaccggtgtacgcttgtgacaaattgcgtgatcaaagggcgtgaagtccgcaagggacagtctgttctgagacaatacaagaccgagatcaaaattggcaaggcttccactggctcaaggaaattgctcagtgaggaaccaggggatgactgtatcagccggacacagctgttacgaaccgagactgccgaaattcacgatgacaactatggaggtcccggcgacaagataaccatctgcaatgggtcgacaattgtggatcagcgcctgggatccgagctaggctgttacacgatcaacagagtaaaatcttttaagctctgcgaaaatagcgctaccggtaagacttgcgagatcgactcaacacctgtgaaatgtaggcaggggttctgcctgaagattacccaagagggccggggacatgtcaaacttagtcgcggctccgaagtggttttggatgcctgtgactctagctgcgaggtgatgatacccaaggggacaggagatatcctggtcgactgttccggtggccagcagcactttctcaaagataacctgattgaccttgggtgcccacacatccctctgttgggaaagatggcaatttatatctgtagaatgtcaaatcatcccaggactaccatggccttcctcttttggttcagctttggctacgtgataacgtgcatcttctgtaaggctctgttttatagtttaattatcattggtacactggggaaaaagatcaaacagtaccgtgaactaaagccacaaacctgcactatatgtgagaccgcgccggtaaacgcaattgatgccgaaatgcacgacctcaactgctcttacaatatctgcccttattgtgcttcccggctgacaagcgatggccttgcccgacatgttactcagtgccccaaaagaaaggagaaggtggaggaaaccgagttgtacctgaacctcgaaaggattccatggatcgtccgcaaactgttacaggtgtcggagtcaacaggagtcgcactgaagcggtctagttggcttatagtgttgctcgttctgctaacggtgtccctgagccccgtacagtctgcccctgtcggccacgggaaaaccatcgaaacttatcaaacaagagagggattcaccagcatttgtctctttatgctgggttccatccttttcattgtgtcatgcttggttaagggcctggtggacagtgtcagcgactcctttttcccagggttatctgtgtgtaggacttgctcaatcggaagtataaatggcttcgagattgaaagccacaaatgttactgctccctcttttgttgcccctattgtcgccattgctctgctgatcgagagatccaccagctgcatctttcgatctgcaagaaacggaagacaggtagcaacgtaatgctggccgtgtgtaagcgtatgtgcttcagagcaaccatggaagcgtcaaggcgcgctttgctcattcggtccatcattaatacgacttttgttatatgtatcctgaccctaacaatttgcgtcgtgagtacctctgccgtggagatggaaaacctgcctgcagggacttgggagagagaggaagacctcacaaatttctgtcaccaggagtgccaagtcaccgaaacagagtgtctgtgcccgtacgaggcccttgttttgaggaaaccactgtttttagatagcatcgtgaagggcatgaaaaacctccttaattccacttcactggaaacctctctgagcattgaggctccctggggagccatcaacgtgcagagtacgttcaagcctacagtatccaccgcaaatatagctctaagctggtcttcagtcgaacatcgaggcaacaaaatcctcgtgactgggcgctccgagagtattatgaagctggaggaacggaccggagttagctgggacttgggcgtggaggatgcctcggaatctaagctgttaacagtctccatcatggacctcagccagatgtattcaccagtgtttgagtacctgagtggtgatagacaggttgaagagtggcccaaagcgacttgtaccggggactgccctgaaaggtgtggatgcacgtcttccacatgccttcacaaggagtggccgcacagccgtaattggcgctgtaaccccacctggtgctggggcgtgggtactggctgtacatgctgtggggtagatgtcaaagacctgttcaccgatcatatgtttgtgaagtggaaagtggagtacattaagactgaagccatcgtctgcgttgagttgacatcacaagaacggcagtgtagtctcatagaggctggaaccagattcaatctgggcccagtgacgattactctaagcgaacctaggaacatccagcagaagctgcccccagagatcattacccttcaccctaaaatagaggaagggtttttcgacctcatgcatgtacaaaaggtgctgtccgcatctacagtctgcaaattgcagagctgtacccacggaatccccggcgatttacaggtgtatcatattggtaacctgctcaagggggaccgagttaatggacacctgatccacaaaattgagccacattttaacacatcctggatgtcatgggacggctgcgatcttgactactattgtaatatgggtgattggccgtcttgcacttacaccggcgtgacgcagcacaaccatgccgctttcgtcaatctgttgaacatcgaaacagactatactaagaccttccactttcacagtaagcgggtgacagcccatggggatacccctcaactcgacctgaaagcacgccccacttacggagcgggcgagataaccgttctagtggaggtcgccgatatggaactgcacacaaagaaagtagagatctcggggcttaagttcgctagcctcgcctgcacgggatgttatgcatgctcctctggcatttcatgtaaagtgagaatccatgttgacgaaccagatgagctgactgtgcacgtcaagagctccgaccccgatgtggtagctgccagtacctctttgatggcaaggaaattagaatttggtacagacagcaccttcaaggccttttcagctatgcctaagacttccctgtgcttctacattgtggagcgggagtactgtaaaagttgcagcgaagatgacacaaagaaatgtgtcgacaccaagctcgagcagccacagtctatcctgatagaacataaagggacgattatcggaaagcaaaatgatacttgcacagcgaaggcctcctgttggcttgagtcagttaagagctttttctatggcctgaagaacatgttgggttcggtgtttggcaatttctttatcgggattctactgttcctcgcacccttcgtgctgcttgtcttatttttcatgtttggatggaaaatcctgttctgctttaagtgttgccgaagaacccgcggcctcttcaaatacaggcacttgaaggacgatgaagagaccgggtatcgtcggataattgagagactgaacaataagaaaggaaagaacaggctcctggacggcgaacgccttgctgatcgaaaaatcgccgagctgttttctactaagacacacattggttga

SEQ ID NO: 10397 - RNA, 5049 nt, synthetic construct
  misc_feature 1..5049: note = derived and/or modified CDS sequence (opt3) from CCHFV(3820-ST-2007)__KR814868.1__GP
  source 1..5049: mol_type = other RNA
atgcacaccctgctcgtgtgcttcatcctttacctgcagttgagcggcttagggggagcccatggtcaatccaacgctacagagcacaatggcactaacacgaccacagtccccgggacttctcagtcacctaagccaccggcaagtaccacactgccccatacccctgaaagctccactgttaaactaacaaccccaacgtctgagactgaaggatcgggcgagaccacaccccctaatactacccagggtctcccactgcccgggacaacccctgaaagatcagccacgactgcgacaagcaccagttccactgacaacatgaactctacaacccaggtgacggataataccccaacaagcactgtatccatttcaccgagttcatcttcctcaatgcccagcaccagtcaaggaatacaccatcctgtgaggtctcttctgtccgtcagctcgccaaagacagtgactacccccacacctatgtctccaggcgagatgtcccccgagacctcaagtcagcacagcgctatgtcccgggttccgactttgtatacggccacacagatctctaccgaaaatactgaccgcagcacccctcgacagtcagagagttccgtgcaacccgcaacacagagcccaattacctctcctgcccagactatcctcctgatgtcagctgcacccaaagccattcaggatatgcacccaagtcccacaaaccgtagcaagagaaatctggaagtcgagatcatactcacgttatcccaaggcctgaaaaagtactatgggaagatccttaaattgctgcatctaaccctcgaggaagacactgagggactgcttgaatggtgtaagaggaacctgggttctaattgcgatgacgactttttccagaaacggattgaggaatttttcatcacaggcgaggggtactttaacgaggtgttgcagttcaagaccctctcgacactgagccctactgaaccatcccacgtacgcttaccgaccgctgagccctttaaatcatatttcgccaagggatttctgagtattgattctggctacttcagcgcgaagtgttatcctagatcctcaacgagcggtctccaacttatcaatgttacccagcatccagcaaggatagccgaaacacccgggcctaaaactacctctctgaagacaattaactgcatcaatttgcgggcttccgtgtttaaagagcaccgcgaagtcgagattaacgtgctactgccacagatcgccgtgaacctcagtaattgtcacgtcgttatcaacagccatgtgtgcgattactctctggacactgatggacccgtacgacttccgagaatacaccatgagggcaccttcattcctggcacgtacaagatcgtgattgacaggaaaaataagctgaacgatcggtgttccttggtcacaaattgcgtgatcaaagggcgtgaagttcgcaagggacagtcagtgctcagacaatataagaccgagataaaaattggtaagacaagtacaggcagcaggaaactgttatcggaggaaccaggggacgactgtatctcccggacccagctgctaaagactgaaaccgcagagatccacgatgacaactacggatctcccggcgataaaattacaatctgcaatggtagcacgattgtcgaccagcgactcgggtcagagctgggctgttataccataaaccgcgtgaagagttttaaactttgcgaaaattccgctactggaaaaacatgcgagatcgattctacccctgtaaagtgtagacagggcttctgcttgaaaattacacaagaagggaggggacatgttaagctgagccggggttccgaggtggtcctcgacgcctgtgattcaagctgcgagatcatgatccccaaaggcactggggacattctggtggattgtagtggaggccagcagcacttccttaaggacaacctgatagatttgggttgcccacacatccctctcctggggaagatggcgatttacatctgtcgcatgtctaatcatcccagaaccacgatggcctttttattctggttttccttcggctatgtcattacatgcatcttttgtaaagcactgttctacagcctaataatcattggaaccctcggcaagaaaatcaagcagtatagggaactgaaaccacaaacttgcaccatttgtgagacagctccggtgaacgccatcgacgctgaaatgcacgaccttaattgctcgtacaacatatgcccttactgtgcctcacgtttgacttctgatgggctggcacggcatgttacccagtgccccaagcgaaaggagaaagtggaagagacagagctctatctgaatttagaaaggattccatggatcgtaagaaagctgcttcaggtcagtgagtccacgggagtggccttgaaacgcagctcttggctcattgttctgctagtgctgctcgctgtcagcctgtcccccgtgcagtcagcgcctgtaggtcacggcaagaccatcgaaacttaccaaacacgggaggggtttaccagtatatgtcttttcatgttgggaagcatcctgtttattgtgtcttgcttagttaaaggcctcgtcgactccgtgtcagatagtttctttccaggtctgagcgtgtgtaagacttgctccatcgggtctattaacggcttcgaaatcgagtcgcacaaatgttattgcagcctcttttgttgcccctactgtagacattgctcagcagacagggagatacaccagctgcatttgtccatttgcaagaagcgcaaaacaggaagtaacgtcatgctcgccgtttgtaagcgaatgtgcttcaaagctaccatcgaagcctctcggcgtgcactgctaatcagaagcattatcaatacgactttcgtgatgtgtattctgaccctcgccatatgcgtggtatccacatcagctgtcgagatggaagatctgcctgccggcacctgggagagggaagaggaccttactaacttttgtcaccaggagtgccaagtgacagaaaccgagtgtttgtgcccgtatgaagcactggttttacgcaagccactcttcctggattctatcgtgaaagggatgaagaatcttctgaacagcacaagtctagagacttccctcagcattgaggcgccctggggagctatcaatgtccagtctacctttaagcctacggtgtcaacagccaacattgcactgtcctggagtagcgttgaacatcggggcaataaaatcttggtgaccggtagatcggagtctataatgaagctggaagagaggactggggtatcctgggacttaggagtcgaagatgccagcgagtcaaaactcctgaccgtgagtatcatggacctttctcagatgtactccccagtgttcgagtatctgagcggcgatcgacaggtcgaagagtggcccaaggctacatgtactggtgactgccctgaacgctgtggctgcacctcaagtacgtgcttgcacaaagagtggccgcacagccggaactggagatgtaatcccacatggtgctggggagttgggaccggctgtacttgctgtggggtggatgtaaaggacctctttacagaccatatgttcattaagtggaaagtggaatacatcaagaccgaggccattgtctgcgtggagctgacttcccaagaaaggcagtgttctctaatcgaggcaggaacacgttttaacctgggcccagttaccataacgcttagcgaacctcgcaatattcagcagaaacttcccccagagatcatcactctgcaccctaagattgaagagggtttctttgatttgatgcatgtgcaaaaagtcctgtccgcttcaaccgtgtgcaagttacagtcttgtacacacgggatacccggagacctccagatctaccatattggcaacctgcttaagggtgatcgggttaatggccacctgatccacaaaattgagccacatttcaacaccagttggatgtcgtgggacgggtgcgatttggactattactgtaatatgggagattggccgagctgcacatatactggcgtgacccagcacaaccatgccgcgtttgtcaacctcctgaatatcgaaacggactacacaaagactttccactttcactccaaaagagtaaccgcccatggggatacacctcaactagacctgaaggctaggcccacctatggagcaggcgagataactgtgcttgttgaagtggccgatatggagctccacaccaaaaaggtcgagatctctggtctgaaattcgcttcattgacatgcacggggtgttacgcctgcagctccggaattagttgtaaggtgcgaatccatgtagacgaaccagatgagttaactgtgcacgtcaagtctagcgaccccgacgttgtggcagcgtcaacctccctgatggcccggaaactcgagttcggcacagatagtacctttaaggctttcagcgccatgcctaaaacttctctgtgcttttatattgtggaacgcgaatactgtaagtcctgctcagaggacgatactaaaaagtgtgtcgacaccaaacttgagcagccacagagcatcctgatagaacataaaggtacgattatcggcaagcaaaacgatacttgcacagcaaaggcttcgtgttggttggagtctgtgaagagtttcttttacgggctaaagaatatgctgggatccgttttcggcagctttttcgtagggatcctcctgtttcttgcccccttcgtgttactggtcctctttttcatgttcggatggaagattttgttttgcttcaagtgttgcagaaggacccggggcctgtttaaatatcgacacctcaaggacgatgaagagaccggttacagacgcatcatagaaaggctgaacagcaaaaaggggaaaaatcgtcttctggacggagagcggttggcagatagaaagattgccgagctattctccactaagacacacatcggctga

SEQ ID NO: 10398 - RNA, 5052 nt, synthetic construct
  misc_feature 1..5052: note = derived and/or modified CDS sequence (opt3) from CCHFV(Ast199)__KX056051.1__GP
  source 1..5052: mol_type = other RNA
atgcacaccctgctcgtgtgcttcatcctttacctgcagttgagcggcttagggggagcccatgtccaatccaacgctacagagcacaatggtactaacacgaccacagttcccggcacttctcagtcacctaagccaccggcaagtaccacactgccccatacccctgaaagctccactgtgaaactaacaaccccaacgtctgagactgaagggtcgggagagaccacaccccctccaaatactacccagggcctgccccctccaggtacaaccccggaaagacccgccacgactgcgacaaccacttcaagcacagacaacatgaatagtaccacgcaggtaaccgataacacacctacttccaccgtgtctattagcccatcctcaaatcccagtatgcctagcacatctcaagggatacactatccagtcaggtccctcctttcagtgagcagtcccaagactgttaccacaccgacccctatgtctcccggagagatgtccccagagactagctcgcagcattctgctatgtcccggatccctacgctgtacacagccgcacaggtgtcaaccgaaaacactaatcgcagtactccccgacagagcgagtcctctgcccaaccagctacacagagccccaccacttttcctgcacagacaattccattgatgtcagccgctccgaaagccatccaggacatgcaccccagtcctacgaaccgttccaagagaaatctcgaagtcgagattatcctgaccctgagccaaggcctcaaaaagtattacggcaagatattaaaactgcttcacttgactctggaggaagatacagaggggctactcgaatggtgtaagaggaacctgggatctaattgcgacgatgacttctttcagaaacggatcgaggagttctttattaccggtgagggctatttcaacgaggtgcttcagtttaagacaccatcaactctgagtcccaccgaacctagccatgtacgcttgccaacggcggagcccttcaaatcctactttgcaaaggggttcctctctatcgattcgggatattttagcgccaagtgttacccgagatcctcaaccagtggcctgcaattaattaatgttacacagcaccctgctaggatcgccgaaactccaggtcccaaaaccacatctctgaagactataaactgcattaacctccgggcaagcgtgttcaaagagcatcgcgaagtcgagatcaatgtgcttctgcctcagattgctgtgaacttgtccaattgtcacgtcgttatcaactcacacgtgtgcgactacagcctagataccgacgggcccgtacgactgccaagaatccatcacgagggaacgtttattcctggcacatataagatagtgatcgataaaaagaataaactcaacgacaggtgttctctggtcaccaattgcgtgattaagggccgggaagttcgtaaggggcagtccgtgcttcgccaatacaaaactgagatcaagataggaaaagccagtacaggtagcagaaagctgttgtctgaagaacccggcgatgactgtatttccaggacccagctcctgaaaactgaaaccgcggagatccatgacgataactatgggggaccaggcgacaagatcacaatttgcaatggttcaacgatcgtcgatcagcggttagggagtgagctgggctgttacaccattaaccgagtaaagagcttcaaactatgcgaaaattcggccactggaaagacatgcgagatagactccaccccggtaaaatgtcgccagggcttctgcctcaagatcacacaagaagggagaggacacgttaaactgtctaggggtagcgaggtggtccttgatgcatgtgactcaagttgcgagattatgatccctaagggcactggggatatcttggtggactgttccggaggccagcagcattttctgaaggataacctcattgacctgggttgcccccacataccacttctggggaaaatggctatctatatttgtcggatgtctaatcacccccgcaccacgatggccttcttgttttggttcagctttggctacgtcatcacatgcattttctgtaaggctctcttttattccctgatcataatcggaaccttaggcaaaaagattaaacagtacagagaactgaagcctcaaacttgcaccatctgtgagacagccccagtgaacgcaattgatgccgaaatgcatgacctaaattgctcatacaacatctgcccctattgtgctagcaggctcaccagtgacgggctggcgcgtcacgttacccagtgccctaagcggaaagagaaggtggaagagacagagctttacttgaacctggaacgaataccgtggattgtaagaaaactcctgcaggtctctgagtccacgggagtggcattaaagaggtgtagctggctgatcgttcttttggtgctcctgaccgtctcgctatcaccagtgcagtctgcccccgtaggtcatggcaaaactattgaaacatatcaaacccgcgaggggttcactaatatctgcctgtttatgctcggaagtatactgttcatcgtgtcctgtcttgttaagggcttggtcgatagcgtgtctgacagctttttccctggtctgtccgtgtgcaaaacatgttcaattgggagtatcaacggctttgaaattgagagccacaagtgctactgttctttattctgctgtccatattgccggcactgctccgctgatagagagatccatcagctccacctgggaatatgtaagaaaaggaagaccggctcaaatgtcatgcttgccgtttgcaaacgcatgtgtttcaaggcaacgattgaagccagtcgacgggctctgttgatccgtagcatcattaacactacctttgtgatctgcattctcacactggccatatgtgtggtatccacctctgcagtcgagatggaaaatctacccgcggggacttgggagagagaagaggacctgacaaacttctgccatcaggagtgtcaagtgaccgaaacagagtgcctctgtccttacgaagctctggttcttaggaaaccgttgtttctggattcgatcgtgaagggaatgaagaatttactcaacagcacttcactggagacctcccttagtattgaggccccctggggcgcaatcaatgtccagtctacgttcaaaccaacagtgagcaccgccaacattgctctgtcctggtcatctgttgaacaccgcggtaataagatcctagtgactgggcggagcgagagtataatgaaactcgaagagagaaccggagtatcctgggacctgggcgtcgaagatgccagcgagtctaagttgctgacagtgtcaatcatggacttatcccagatgtatagtcctgtgtttgagtacctcagcggtgataggcaggtcgaagagtggcccaaagcaacttgcaccggcgactgtccagaacgatgcgggtgcacgtcgtctacatgtctgcataaggagtggcctcactcccgcaactggcggtgcaatcccacctggtgttggggagttggcactgggtgcacatgttgcggagtggatgtaaaggaccttttcaccgatcacatgtttattaaatggaaggtggaatacatcaaaactgaggctattgtctgtgtggagctgacaagccaagaaagacagtgctcattgatcgaggccggcaccaggttcaacctcggtccagttacgataactctgagtgaaccgcgtaatattcagcagaagctacctcccgagatcatcaccctgcatccaaaaattgaagaggggtttttcgaccttatgcacgtgcaaaaggtcctctctgcgtccacagtgtgtaagctgcagagctgcacccatggaatacccggcgacttgcagatctatcacattggtaacctgttaaaaggcgatcgcctcaacgggcatctgatccacaagattgagcctcactttaatacatcatggatgagttgggacggatgtgatcttgactactattgcaacatgggcgattggccaagctgcacttacaccggggttacgcagcataatcacgccgctttcgtgaacctgttgaatatcgaaacagactatactaaaacctttcatttccactccaagcgggtcacagcacacggagatactccccaactcgacctgaaagccagacctacctacggcgctggtgagataaccgtgctagtggaagttgccgatatggagctgcatacaaagaaagtggaggtctctgggcttaagttcgcaagcctcgcgtgtacgggatgctatgcctgttcctcaggcatctcttgcaaggtgaggattcacgtagacgaaccggatgagctgactgtgcatgtcaaaagttcggacccagatgttgtggctgccagcacctccttgatggcacgaaagttagaatttggtacagactctaccttcaaggctttttcagccatgcccaaaactagcctgtgtttctacatcgtggagcgggaatactgcaaatcctgtagtgaggacgatacaaagaagtgcgtcgacaccaaactcgagcagcctcagtctattctgatcgaacacaagggcacgataattgggaaacaaaacgatacttgtacagcaaaggccagctgctggcttgagtcagtgaaatcctttttctatggactgaagaatatgttgggcagtgtttttgggaacttctttgtaggaatcctactgttcctcgctccctttgtgctgcttgtcttattcttcatctttggctggaagattctgttctgttttaaatgctgccgcagaaccaggggtctcttcaagtaccggcatttgaaagacgatgaagagaccgggtatcgaaagatcatagaaagactgaatagcaaaaagggaaagaaccgcctcctggacggcgagaggcttgcggatcgtaaaattgccgagctgttttctactaagacacacatcggctga

SEQ ID NO: 10399 - RNA, 5052 nt, synthetic construct
  misc_feature 1..5052: note = derived and/or modified CDS sequence (opt3) from CCHFV(Turkey200310849)__DQ211636.1__GP
  source 1..5052: mol_type = other RNA
atgcacaccctgctcgtgtgcttcatcctttacctgcagttgttatgtctgggcggggcccatggacaactaaacacaactgagcacaatggtacgaacaataccacagctcccggcgcaagccagtcccctaagccaccgatgtctactactccccctcatgccccagaatcaagtacaattaaacccaccactcctataagcgaggcggaagggtccggagagacaacctctacgccaaacactacccagggcctctcgtcacccgaaacaactagcgagagacctgctaccacagccatcagtacctcctctacggacagcactaatccaacaacccagatgactgataacacaccgaccctgacggtctccacctcacccagtagctctccttccacaccatcaactccccaaggtatttatcaccctgcaaggagccttctgagtgtttcttccccaaagaccgtgacaactcccaccccgacaagccctggggagatgtcgtctgaaacctcctcacagcatagtgccatgagccggatccccactccacacacggctacacgcgtatccaccgagaatactaaccactctacccctcgacagagcgaatcaagtgcacagcaaacaaccccctccccaatgactagccccgcccagtctattttgctcatgtcagctgcccctacagcggtgcaggacatccatccaagtccgacgaatcgtagcaaaagaaacctggagaccgagataatcctgactctctcccagggattaaagaaatactatggcaagattctgaagctgttgcacctgacactagaagaggataccgaaggcctcctggagtggtgcaaaaggaatcttgggtctaactgtgacgatgactttttccaaaagcggatcgaagagtttttcatgacaggagagggttactttaatgaagtcctgcagttcaaaactttgtcgaccctcagccccacggagccttcccatgcacgcctgccaaccgccgaaccctttaagtcatatttcgctaaaggctttttaagtattgattctgggtacttcagcgccaagtgctatcctagatcctcagcaagcggactgcagctcatcaacgtgacacaacacccagctaggatagccgagactcccggcccgaagaccacatctcttaaaactattaattgtatcaacctgcgggcgtccgtttttaaggaacaccgcgagattgagatcaacgtgttgctacctcagatcgccgtcaatctgagtaactgccatgtggtaattaatagccacgtttgtgactactctctcgataccgacggtccagtgcgactgcccagaatataccatgaagggacgttcatccctggaacatataaaattgtcatcgataagaaaaacaaacttaatgacaggtgcaccctggtgactaactgtgtgataaagggccgggaggtccgtaagggccagtccgttttgcgccagtacaagacagaaattaaaatcgggaaggcatcaaccggatttagaaaactcctgagtgaggaacccggtgatgactgcatcagcaggactcaattactgcggaccgagacagctgagattcacgacgataattatggcgggccaggagacaagatcacgatttgtaacggctcgaccatagtggatcagcgactaggttccgaactcgggtgctacactatcaatcgcgtaaaatctttcaagctgtgcgagaacagcgccacaggcaagacctgtgaagtggactcaacacctgtcaaatgcagacagggattctgtcttaagattactcaggagggcagggggcatgtgaaattgagtcggggatccgaggttgtgctggatgcttgcgactctagctgtgaagtcatgatccccaagggtaccggcgatatcctcgtggactgctccgggggacaacagcactttctgaaagataatcttattgacctgggctgtccacacataccgttgctcggtaagatggccatctatatttgccgcatgtcaaaccatcctagaacgacaatggcattcctgttttggttcagctttgggtacgtaatcacctgtattagttgcaaggccttattctattctctgatcataatcggcactctagggaaaaagattaaacagtacagggagctcaagccccagacctgtacaatctgcgaaactgctccagttaatgcgattgatgcagagatgcacgacctgaactgctcctacaatatctgtccctattgcgccagccgtcttacctcggacggcttggctcggcatgtgacacaatgtcctaaacgaaaggaaaaggtcgaggagacggaactgtacctcaacctggagagaataccatggattgtgaggaaattactgcaggtctcagaatctaccggggtggcccttaagcgcagttcctggttgatcgttctcctggtgctactgactgtaagcctctctcccgtccagagcgcacctgtgggacacggtaaaacaattgagatctatcagacccgggaaggctttgcctccatatgcctgttcatgcttgggtcaatcttgtttattgttagttgtctggtgaagggattagtcgatagcgtgtctgactccttctttccgggcctctcagtatgcaaaacttgtagtatcggtagcgtgaacgggttcgagattgagtcccacaagtgctactgttctctgttttgctgtccatattgcagacattgctcggctgatagggaaatccaccaacttcatctgagcatatgtaaaaagcgcaagacaggctcaaatgttatgttggccgtctgcaaacgaatgtgtttccgggcaaccattgaggcgtcccgtagagctctcctgatcaggagtatcattaacacgactttcgtgatctgcattctaaccctgacaatatgtgtggtctctaccagcgccgttgaaatggagaatctccccgcaggaacttgggaacgcgaggaggacctgacaaacttttgccaccaggaatgtcaggtgaccgagacagaatgcctttgtccttacgaggccttggtgctgcggaagccattattcctcgattccatcgtaaaaggcatgaagaatctgcttaactcaacttctctggagaccagcctaagtattgaagctccctggggagccatcaatgtccaatccacgtttaaacctgcagtgagcacagctaacattgccctctcttggtcatccgttgagcatagaggaaataagatcctggtgaccggcaggagtgaaagcataatgaagttggaggaacgaactggtgtctcgtgggacctgggggtggaggatgcgtctgagtccaaattactcaccgttagcatcatggacctgtcacagatgtatagtccggtgttcgaatacctttctggagatcgccaggtagaggaatggcccaaggccacatgcactggcgactgtccagagcggtgcggttgcacctccagcacgtgtctgcacaaagaatggcctcactcaagaaactggaggtgcaatcccacatggtgttggggcgtcgggaccggatgcacttgttgcggcgtggatgtgaaggacttgtttacagatcatatgttcgtcaaatggaaggttgagtacattaagaccgaggctatcgtgtgtgtagaactcaccagtcaggagcgtcaatgcagcctgattgaagcagggacacgctttaacctaggaccagtgaccatcacgctgtccgagcctcggaatatacagcagaaacttcccccagaaattatcactctccacccgaagatcgaggagggcttctttgacctgatgcatgtccagaaagtgttgtctgccagcaccgtttgtaagctgcaatcctgcacacacggtattcctggggacttacaggtgtatcatataggaaacctcctgaaaggcgatagagtcaatggtcaccttatccacaagattgaatcacatttcaacacctcttggatgagttgggacggctgtgatctggactactattgcaacatgggggattggccctcgtgcacatacactggagtgacccagcacaatcatgctgcctttgttaacttgctcaatatcgagacggactatacaaagactttccactttcacagcaaaagggtgaccgcacatggcgatacaccacagctggacctaaaggcgcgacccacctacggggccggagaaattactgtcctggtagaggtggctgatatggagcttcacaccaaaaaggttgaaatctccggcctcaaattcgcctctctggcatgtacaggttgctatgcttgttcaagcgggatatcctgcaaggtgcggatccatgtcgacgagcctgatgaattgacggtgcacgtaaaaagttctgacccagatgtggtcgccgcaagcacttcattaatggcccgcaagctggagttcggaaccgactccacatttaaggctttcagtgcgatgcccaaaaccagcctctgtttttacattgttgaaagagagtactgcaagtcttgttccgaggacgatactcaaaaatgcgtggacacaaggctggaacagcctcagtcaatccttattgagcataagggcaccatcataggtaaacaaaacgatacgtgtactgccaaggcaagctgctggctggaatcggtgaagtctttcttttatggcttgaaaaatatgctagggagtgtcttcggaaacctgtttattggcatcctcctgttccttgctccgtttgtgttactggttctcttctttatgttcgggtggaagatcttgttctgttttaaatgctgccggcgaacaagaggactgttcaagtaccgccacctcaaagacgatgaggaaaccggctataggcgtattatcgagcggcttaattccaagaagggtaaaaacagacttctggacggggataggttggccgaccgcaagatagccgagctatttagcaccaaaactcacattggatga

SEQ ID NO: 10400 - RNA, 5052 nt, synthetic construct
  misc_feature 1..5052: note = derived and/or modified CDS sequence (opt3) from CCHFV(5170-R-2011)__KR814873.1__GP
  source 1..5052: mol_type = other RNA
atgcacaccctgctcgtgtgcttcatcctttacctgcagttgagcggcttagggggagcccatggtcaatccaacgagacagaacacaatggcactaacacgaccacagtccccgggacttctcagtcacctaagccaccggctagtaccacactgcagcatacccccgagagctccactgttaaactaacaacccctacgtctgaaactgagggatcgggcgaaaccacaccaccccctaatactacccagggtctcccaccccctgggacaaccccagagagatcagcaacgactgccacaagcaccagttccactgacaacatgaatagtacaacccaagtgacggataacaccccgacaagcactgtatccatttcacccagtagctctccttccatgccatcaaccagccagggaatacactatcccatcaggagtctgctttctgtgtccagccctaagacagtcactaccccaacacccatttcgccgggcgagatgtctcctgaaacctcctcacagcatagtgcgatgagccggatccccactctgtacacggctacacaggtgtccaccgagaatactaaccgctctaccccacgacaaagcgaatcaagtgttcagcctgccacacagtcccccattaccagcccagcacagactatcttgctcatgtctgccgctcccaaagcaatacaagacatgcacccttcaccaacaaatcgtagtaagagaaacctggaggtggagatcattctgacgctcagccagggcctgaaaaagtattacgggaagatcctgaaacttttgcacctgaccctagaagaggatactgaaggactcctggagtggtgtaagaggaatcttggttccaactgcgacgatgactttttccagaaacggattgaagagtttttcatcacaggcgaggggtattttaatgaagtcctgcaattcaagaccttgtctacactctcgccgactgagctgagccatgtgcgcttacccaccgccgaaccttttaaatcctacttcgctaagggatttctgtcaatagatagtggctatttctctgccaagtgttacccaagaagctccacgtcaggtctccagcttattaacgtaacccagcaccccgcgaggatcgcagagacacctgggccaaaaactaccagcctgaagacaattaattgcatcaacttgcgggcctctgtttttaaagaacatcgcgaggtggagatcaacgtcctactgccccagattgctgtgaatctctccaactgtcacgtggtcataaatagtcacgtttgcgactacagcctggatactgacggaccggtgcgacttcctagaatccatcacgaaggcaccttcattccaggcacgtataagatcgtaatagataaaaagaacaaactgaatgacaggtgttctttggtgacaaactgcgtcattaaggggcgggaggtgcgtaagggacaatccgttctccgccagtacaaaaccgaaatcaagatcggtaaagcctcaactggcagtagaaagctgttaagcgaggaacccggggatgactgtatttcgaggacacagctgctaaaaaccgagactgcagagatccatgacgataattatggaggccctggtgacaagattaccatatgcaacgggtccacaatcgtggatcagcggctcggctctgaactgggatgttacacgattaatcgagtcaagagctttaaactttgcgagaactcagctaccggcaagacttgcgaaatcgacagtacacccgtgaaatgtcgccaagggttctgcttgaagatcacccaggagggaagaggtcacgtaaaactgtccaggggctctgaggttgtgctcgatgtctgtgacagctcctgcgaaattatgataccaaaggggacaggagatatcctggtggactgttcaggcggtcagcagcatttccttaaggataatctgattgacttggggtgccctcacatccccctcctgggcaaaatggccatttatatctgtcggatgagcaaccacccacgcactaccatggcgtttttattctggtttagtttcggatacgtcataacgtgcatcttttgtaaggccctgttctattctctaattatcattggcacactcgggaaaaagatcaaacaatacagagagctgaagccgcagacctgcactatatgtgaaaccgcacctgtgaatgctattgatgccgagatgcatgaccttaactgctcctacaatatctgcccctattgtgctagcaggttgacatcggaaggactggcccgtcacgttactcagtgcccaaagcggaaagagaaggtggaggaaaccgagctctacctgaacttagaacgaatcccctggattgtaagaaaactgcttcaggtctcagagtctacaggtgtggcattgaagaggagttcctggctcatagttctgctagtgctgctcacggtcagcctgtctcctgtgcaaagcgccccagtaggccatgggaaaaccatcgaaacttatcagacacgcgagggatttacctccatttgtcttttcatgttgggctcaatcctgtttattgtgagttgcttagttaagggtctcgtcgacagcgtgtctgattccttctttcccgggctgtcagtgtgtaaaacttgcagtatcggcagcataaacggattcgagattgaatcccacaagtgttactgctctctgttttgttgcccttattgtcggcactgctcggctgacagagagatccatcagctgcacttgagcatctgcaagaaaaggaagacaggctcaaatgtcatgctcgcggtttgtaaacgcatgtgcttcaaggcaaccattgaagcctcccgacgggctctgctaatccgtagtattataaacacgactttcgtgatctgtattctgaccctcgccatctgcgtggtatctacaagcgcagtcgagatggaagatctgccggccgggacctgggagagagaggaagaccttactaatttttgtcatcaagagtgccaggtgacagaaaccgagtgtttgtgcccatacgaggctctggttttaaggaaacccctcttcctggattccattgtgaagggaatgaagaaccttttaaattcaacatctctagaaactagcctcagtatcgaggccccttggggcgcaataaacgtccagtccacctttaaaccaacggtgagcacagcgaatatcgctctgtcttggtcatccgttgaacaccgcggtaacaagattttggtgaccgggcggagtgagagcatcatgaaactggaagagagaactggagtatcgtgggacttaggcgtcgaggatgcctctgaatccaagctcctgaccgtgagcattatggacctttcacagatgtatagtcccgtgttcgagtacctgtctggtgataggcaagtcgaagagtggcctaaagcaacatgtactggcgactgcccggaacgatgtgggtgcacctccagcacgtgcttgcataaggagtggccccactcacgcaattggcggtgtaacccaacatggtgctggggagttggcaccgggtgtacttgctgtggagtggatgtaaaggacctctttacagatcacatgttcatcaaatggaaggtggagtacataaaaaccgaagccattgtctgcgtggagctgacttctcaggaaagacagtgtagcctaatcgaggctggcacaaggtttaatctgggtcctgttaccatcacgctttccgaaccccgtaacattcagcaaaagctcccacctgagataatcactctgcatcccaaaattgaggaagggttctttgacttgatgcacgtgcagaaggtcctgtctgccagcaccgtgtgcaagttacagtcctgtacacatggaatcccaggcgacctccagatttatcacatcggtaatctgcttaaaggcgatcgcgttaacgggcatctgatacacaagatcgagccgcacttcaatacctcatggatgtcttgggacggatgcgatttggactactattgtaacatgggcgattggcctagttgcacatacactggggtgacccaacataaccacgcagcttttgtcaatctcctgaacattgaaacggactatacaaaaactttccattttcactcgaagcgggtaaccgcccacggagatacaccccagctagacctgaaagcgagaccaacctacggcgccggtgagatcactgtgcttgttgaggtggctgatatggaactccataccaagaaagtcgagattagcgggctgaagttcgcatccttgacatgcacgggatgttatgcctgttcttcaggcatcagctgcaaggtgaggatacacgtagacgaacccgatgagttaactgtgcatgtcaaatccagtgaccctgatgttgtggctgcctctaccagcctgatggcacgaaagctcgagttcggtacagactcaacctttaaagcgttctccgccatgccaaagacaagtctgtgcttttacattgtggaacgggagtactgtaaaagctgctctgaagacgatactaagaagtgtgtcgacaccaaacttgagcagccccaatccatcctgatcgaacacaagggcacgattatcgggaaacagaatgatacttgcacagctaaggcctcatgttggttggagagcgtgaaatcgttcttttatggactaaagaacatgctgggctctgttttcgggtcctttttcgtaggaatactcctgtttcttgcacctttcgtgttactggtcctctttttcatgttcggctggaagattttgttttgcttcaaatgttgccgcagaaccaggggtctgtttaagtaccggcatctcaaagacgatgaagagaccgggtatcgaagaatcattgagcgccttaatagtaagaaaggaaagaacaggcttctggacggcgaacgtttggctgatcggaagatcgccgagctattcagcactaaaacacacataggctga

SEQ ID NO: 10401 - RNA, 5055 nt, synthetic construct
  misc_feature 1..5055: note = derived and/or modified CDS sequence (opt3) from CCHFV(SCT ex Afghanistan)__KC344856.1__GP
  source 1..5055: mol_type = other RNA
atgtacaccctgctcgtgtgcgccatcctttgtccccagccttggagcctggagggcacacacgtcccattgaacgggactaagcataatggaacgggtattaccgctgcaccgggcgggtcccaaggacccacatctcctgcctcaactgcggttagtttaaccccagaccccttcacaaccgaacctactgctagcgccgtggagctggaatcctctggcgagggtcacacatcgctatcagtaaccacgcaggggctcactagcccagaaaccacacccggactgcctactgtgaccgatacaggcgtcagttccacctctatatttggcatcgggattagagtggcaggagacacgccaactagcacaacccatactggtcttccgtcctcacccagtatgcctagcacagcccagggcccacaccatgctgttagggggctgttgtctgtgtcctcaacccggcccggagaggcaagcacgatcaccgtccctggcgaggccggtacagaagctaacagttcttccagcgccatttcgaaaaagccagcgccctctccgactgcagaggccatcaccgaagctaataactcctcaaatcctcgccagcccgagctcagtacacaaccagccatacctgggctggtgactagctccgcacagcccatcctgctccagtctgctaccagcacagccgcgcaggatatttatccatcacccaccaaccgaagtaaacgtaatttagagatggaaatcattctgactctttcccaaggattgaagaaatactatggcaagatcctgagaatactagacctcacgctggaggaagatacagagggccttctggaatggtgcaagaggaacttggggctcacctgtaatgacaacttctttcaggagcggattgaggagttctttctgactggagagggtcacttcaatgaagtattacagtttaaaacccctagcacactgtctccaaccgagccgactcacacacgcacgcccaccgttaagcctttcaaatcatactttgccagaggcttcctcagtatcgatagcgggtatttttccgcaaagtgctactctaaaacttcgaacagcggacttcagctgattaatatcacacaacatccagctaggatcgccgacacccccggccctaagattacaaacttgaaggctataaattgtatcaacctaaaagcctccgtgttcaaggaacaccgggagattgagatcaacgtcctgctcccacaggtggcagtgaatctgtcaaactgccatgtccttataaaaagtcacgtttgtgattattctctggacattgatggtgccgtgcgcttgccccacgtacatcacaaggggacttttatcccgggcacctacaaaatcgtgattgacaagcgaaataaacagaacgatagatgcacgctcgtcaccaattgtgtgatcaagggaaaggaaattaggaaaggccaaagcgctctgcggcagtaccgtacagagatacgcatcgggaaggcgtccgcaggatcaagaaggttactgagcgaagagtctggtgacgactgcatttcccggactcagctactccgaaccgaaacagccgaggttcataacgataattatggcgggcctggagacaaaatcactatctgtaacggcagtaccattgtggatcagcgcctgggtagcgagcttgggtgctacacgataaatagagtcaagtctttcaaattgtgcgaaaactccgctacaggcaagtcatgtaagatcgacagtaccccagtgaaatgcaggcaaggattctgtctgaagattactcaggagggccgggggcacgtaaaactcagccgcggatcggaagttgtgctggatgcctgcgactcctcttgtgagatcatgattcccaagggtacaggcgatatccttgtcgactgcagcgggggacagcagcattttctgaaagataatttgatagacctcggctgtcctaacatccccctgttaggtaagatggcaatttatatctgcagaatgtcaaatcacccaaagaccactatggccttcctgttttggttcagttttgggtacgtgattacctgtatcttctgcaaagtcatattttatctactcattgtggttggcacactgggaaagaaattcaagcaatacagggagcttaaacctcagacgtgtaccatctgcgaaactacacccaccaacgctattgatgccgagatgcacgacttgaattgctcctataacatctgtccatactgcgcatctcgtctgacaagcgacggcctcgcgcggcatgtgactcagtgtccgaagcgaaaggaaaaagtagaggaaaccgagctgtacttaaacctggagagaataccttggatcgtcaggaagctgcttcaggtgtccgaatcaacgggggttgctctcaaacgcagcagttggctgattgtgctactggtcctcctgacagtgtctctttcccccgtacaaagcgccccaatcggacacggcaagaccattgagacttatcagacccgggaaggttacatctcggtgtgcttgtttgttctgggaggaatattattcgtcgtgtcatgtctcattaaaggcctggtggattctgtcggtaatagctttttccccggcctttccatctgcaagacatgtagcatcgggtctgttaacggatttgagattgaaagccataaatgctattgttccctgttgtgctgtccttactgcagacactgctcaactgacagggagatccaccagctccatctgagtatttgtaagaagcgccgaaccggcgggaatgtgatgctagcagtgtgcaaacggatgtgtttccgtgccacaatggaggtaagcaacaaggtcctgttcataagaaatatcattaacacgacctttgtgatctgcattctcatcctggctgtttgtgtggtctctacttccgccgtggaaatggagtcacttccagcaggaacatgggaaagggaggaagatttgaccaatttctgccaccaggagtgtcaagttactgagacagaatgcctgtgtccctatgaggctttagtgctccgcaaacctctgtttcttaacagtatagtaaagggcatgaaaaatctgctaaacagcaccaatctcgaaacgtccctgtctatcgaggccccgtggggtgcgattaacgtccagtcgactttcaagccaaccgtgagcacagccaatatcgctttgtcatggtccagtgtggagcatcgggggaacaagattctggtctctggaagaagcgaatccatcatgaaattagaggaaaggaccggcatatcatgggacctcggtgttgaggatgcatctgaaagcaagagtctgactgtgtccgtaatggaccttagccagatgtactctcccgtgtttgagtatctgtcaggcgatcgacaagtcgaggaatggcctaaagccacatgcaccggggactgtccagagcgctgcggatgcacatccagtacttgtttgcacaaggaatggccccatagccggaattggagatgcaaccctacctggtgttggggcgtggggacgggatgcacatgttgcggcctcgatgttaaagacctgttcaccgattacatgtttgtgaagtggaaggtcgagtacattaaaactgaagctatcgtgtgtgttgagctaacctcgcaggagaggcagtgctctctgatcgaagccggtacacgtttcaaccttgggccggtgactattaccctctccgagccccgcaatatacagcaaaagctgccacctgaaatcattacgttgcacccccggatcgaggaaggatttttcgacctgatgcacgtccagaaagtattaagcgcatcaacagtgtgtaagctccagagttgcacccatggcgttccaggtgatcttcaggtgtatcacattggcaaccttctgaaaggggacaagttgaatggacatatgatccacaagatagagcctcattttaacacttcttggatgtcctgggacggctgtgatctcgactactattgcaatatgggggattggcccagctgcacatacaccggagtcactcaacacaaccacgcggccttcgtgaatctgctaaacatcgagacagactataccaaaaattttcatttccactcaaagagagtaacggctcatggcgatactccacagctggaccttaaagccaggccgacctacggtgcaggggaaattacagtgctcgtcgaggttgctgatatggaactgcacaccaagaaaatcgacattagtggattgaagttcgccagcttaacatgtgcaggctgctatgcctgttcctctggcatcagctgcaaagtgcgaatacacgtggatgagcctgacgagctgactgtccatgtgaagtccgaagatcccgacattgttgctgcgtcaacctctctcatcgcccggaagctggagcttgggacggatagtacatttaaagcattctcggctatgccaaagactagcctgtgtttttacatcgtagaacgcgagtactgcaaatcctgttctaaggaagacacccagaaatgcgtgaacacaaagttggagcacccccaggggattctaatcgagcataagggtaccataattggcaaacaaaatgacacttgtaccgccaaggccgggtgctggctggaatcagtcaaaagtttcttttatggactcaagaacatgctgtccggcatcttcggtaatgtgtttattgggatcttcttgtttttagctcctttcgttctgctcatattgtttttcatgttcggatggagactgctcttttgtttcaaatgctgcaggcggacacgaggcctgtttaagtacagacaccttaaggaggatgaagagagtggctatcgcaggattatcgaacgtctgaacaataaaaaggggaaaaacaagttgctagacggagagcggctggcagatagaaggatcgccgaactcttctctacgaaaactcatattggttga

SEQ ID NO: 10402 - RNA, 5055 nt, synthetic construct
  misc_feature 1..5055: note = derived and/or modified CDS sequence (opt3) from CCHFV(SPU 44/08)__KJ682805.1__GP
  source 1..5055: mol_type = other RNA
atgtacacacccctgctctgcgccatcctttgtctgcagttgtggagcttagagggcatttatgggctgtccaacaatacccaacacaacgacacttctacgataaaggtgcctgaagagtcacagaaaaccagtctaccagctaatacagcaagcccgatcacttccgatccccctccaaccacacccaccgcctctgcgtcgggacctgaaggttcaggcgacactagcacaagtccacccgtcaccacgcaggggcctactccaccggagaccacacccgaacctcatactaccattgatatcgacaagtcctctacagctattgccgatatcagcacccagacggttaaaaacataccaactcccacagcacacacctccctcccttcaactctgagtgccccaacaatgccccaagaggctcatcacaccgcaagaggacttctgagcgtgacgtctaccaagccgggcgaggcctccacacctacttcacccggtgaagctagcaccgaggccagttctccacagcctacaatcagggaaactccctccccaccccctaccacacagaccccaactgagattaataacccgaatacgagccggcagcccatgccttcgacacaaccagcggcaccctcttccgtaacccatcctgcccagccaactccctcacagagtgacgtgccgaccgctgcccaggatatccaccctagcccaacaaaccgctccaaacgaaatttggagatggaaattatcctcaccctgtctcaagggctgaagaagtactatggaaaagtcctcaagttactggaccttactttggaggaagatacagagggcctgctagaatggtgcaaacgtaacctcggcctgacgtgtgacgataatttctttcagaagagaatagaggagttctttcttaccggggaaggacacttcaacgaggtgctgcagtttaaaactcccagcacattgtcacctaccgaacccgcaagggttgagagtccaacagtggaacctttcaagtcctactttgctaagggtttcctcctgatggacagcggctatttttctgccaaatgctaccccaagtcaagtaatagcgggttacaactgattaacgtcactcagcatctcatccggattaccgatacgccaggaccgaaaatcaccaatcttaagacaatcaactgtattaacctgaaagcgttggtgttcaaggagcaccgcgagatagaaatcaatgtactactgcctcaggttgccgtgaacctctccaattgccatgtcctgattaaatctcacgtgtgtgactattcgatcgacatagatggccccgtgagacttccaaggattcaccatgagggtacttttatccccgggacctacaagatcgtcattgacaagaaaaacaagcagaatgatcggtgcacactggttactaactgtgtgatcaaaggacgcgaaattcgaaagggccaaagcgtattgagacagtacaggaccgagataaaaatcggcaaggcatcctcagggagtcggcgtctcctgtctgaagagagcaatgacgattgcttatcccgcacgcagctgctaagaacagagaacgctgaaattcactcagacaattatggaggtcctggcgataagatcaccatctgtaacgggagcactattgtggaccagaggctcggatctgagctgggctgctacacaataaatcgggtcaaatccttcaagttatgcgaaaacagtgccaccggtaaaagctgtgagatcgattctactccagtgcgatgccgccaagggttttgtttgaagattacccaggagggcagaggacatgttaaactgtccaggggctcagaagtggtcctcgacgcttgcgatagtagctgtgagatcatgattcccaaggggacaggagacatcctggtggactgctcgggtggccagcagcacttccttaaggataatctggtagacttggggtgtcctaacataccgctcctgggaaaaatggccatctatatttgccggatgtccaatcatccaaagacgaccatggcattcttattttggttctcttttggctacgttatcacttgtattctgtgcaaagccatcttctatctactcatagtggtcggtacactggggaagaaatttaagcaataccgcgaacttaagccccagacctgtacaatttgcgagactaaccctgtgaacgctatcgatgcggaaatgcacgacttgaattgcagctataacatttgtccatactgcgcatcaagactgaccagtgatggcctcgccaggcacgtcatgcagtgtcccaaacgtaaggagaaaatcgaggaaacggagctgtacttaaatctggaacggataccttgggtggttcgaaagttgcttcaggtgtccgagtctacaggagtagctctcaaaagaagctcctggctggtcatcctactggtgctcctgaccgtttcacttagcccggtgcaaagtgcccccatttctcatggcgaaactgtcgaggtgtatcagaccagggaggggtacacatccatctgcttgttcgtactgggaagcattttatttctcgtgtcgtgtctgatgcgcggtcttgttgactcagtctctaacagtttctttccaggcctgtccatctgcaagacttgtagcatagggtctattaatggattcgaaatcgagagccacaaatgctattgttccttgttttgctgtccttactgccggcattgctcagcagatatcgaaattcacaagctccacctgagtatctgtaagaaaagaaagaccggcagcaacgtgatgctagccgtgtgcaaaaggatgtgtttccgcgctacagtcgaggtttctaataaggccctgctcattcgaaacataatcaatacgacctttgtggtgtgcattctgatccttgcagtatgtgtcgtgtccacttcagcggttgaaatggagaacttgcccgctggtacatgggagaaagaagaggacctgaccaatttctgccatcaggaatgtcaagtgactgagacagagtgcttatgtccatatgaagccctcgtcctgcggaagcctcttttcctggatagtattgtgaaggggatgaaaaacctactcaatagcacctccctggagacgtctttgtcgatcgaagcaccctggggcgccataaacgttcagagcacttttaagccaaccgtgtcagctgccaatatcgcactgtcctggagttctgtagagcaccgtggaaacaaaattttagtcagcggcagatccgaatcaatcatgaagctcgaggagaggacagggatttcttgggacctgggagtggaagatgctagcgagagtaaacttctgaccgtgtccgtcatggacttgagccagatgtactctccggttttcgaatatctctcaggcgatcgccaggtggaggaatggcctaaggccacttgcacaggtgactgtcccgagcggtgcgggtgcacctccagtacatgtctgcataaggagtggccacacagcagaaactggaggtgcaatcccacttggtgttggggagtaggcaccggttgcacgtgttgcggcctagacgtgaaagatctgtttacagactacatgttcgtcaagtggaaagtggattacatcaagaccgaagcgatagtttgtgtggagcttacttcgcaagaacgacagtgctctctcattgaggccgggacccgctttaacctgggacctgtcacaatcactttgtccgaaccacggaatatccagcagaaactgccccctgagattgtgaccttacatccgagaatagaggaaggcttctttgacctcatgcacatccaaaaggttctgagcgcttcaacggtgtgtaaacttcagagttgcacacacggggtcccaggagatctgcagatttatcatatcggcaacttgctcaagggtgacaaggtaaatgggcacctgattcataaaatcgagccccacttcaacacctcttggatgtcctgggatggatgtgacctagattactattgcaatatgggcgactggcctagctgctcatacactggtgtgacacagcataaccacgcagcctttgttaatatgctgaacatagaaaccgattatactaagaatttccactttcatagtaaaagggtgacagctcacggcgacacgccccaacttgatctcaaggcccgtccaacctacggggcaggagagatcactgtcctggtggaggtagcggacatggaattgcataccaaaaagattgagatcagcggcttaaagttcgcctccctgacatgtaccgggtgctatgcttgttctagcggaatttcctgcaaagtgcgcatccacgtcgacgaacctgatgagctcacagttcacgtgaagtcagaagaccccgatatagtggccgcatctagttcgctgatggctcggaaacttgagtttggcactgacagcaccttcaaggccttctccgcaatgccaaaaacgtctctgtgtttttacattgtcgagagagaatactgcaagtcatgtagcaaggaggatacacagaaatgcgtgaacactaagttggaacagcctcaatccatcctaatcgagcataaaggtaccattatcgggaagcagaatgacacatgtaccgccaaagctagttgctggctggaatctataaagagcttcttttatggactcaagaacatgctgtcaggcattttcggtaatgtttttatcggcattttcctttttcttgcgccgttcatcatgctgatactctttttcatgtttgggtggaggattttgttctgtttcaaatgctgccgacggactcgcggactgtttaagtacagacacctcaaagatgacgaggagatcggctataggaagatcattgaacggctgaacaacaaaaaggggaagaataaacttctggatggagagcgattggccgacagaaagatcgcagaactattctccaccaaaacacatattggctga

SEQ ID NO: 10403 - RNA, 5052 nt, synthetic construct
  misc_feature 1..5052: note = derived and/or modified CDS sequence (opt3) from CCHFV(K323_27)__KX013472.1__GP
  source 1..5052: mol_type = other RNA
atgcacaccctgctcgtgtgcttcatcctttacctgcagttgagcggcttagggggagcccatggtcaatccaacgctacagagcacaatggcactaacacgaccacagtccccgggacttctcagtcacctaagccaccggcaagtaccacactgccccatacccctgaaagctccactgttaaactaacaaccccaacgtctgagactgaaggatcgggcgagaccacaccccctccaaatactacccagggtctccccctgcctgggacaaccccagaaagatcagccacgactgcgacaagcaccagttccactgacaacatgaactctacaacccaggtgacggataataccccgacaagcactgtatccatttcacccagtagctctccttccatgccatcaaccagccaaggaatacaccatcccgtgaggagtcttctgtctgtctccagccctaagacagtgactaccccaacacccatgtcgccgggcgagatgtctcctgagacctcctcacagcacagtgctatgagccggatccccactttgtatacggccacacaggtttccaccgaaaatactgaccgctctaccccacgacagagcgagtcaagtgtgcaacctgcaacacagtcccccattaccagcccagcccagactatcctcctgatgtctgctgcacccaaagccattcaggatatgcacccttcaccaacaaaccgtagtaagagaaatctggaagtcgagatcatactcacgttaagccaaggcctgaaaaagtactatgggaagatccttaaattgctgcatctaaccctcgaggaagacactgagggactgcttgaatggtgtaagaggaacctgggttccaattgcgatgacgactttttccagaaacggattgaggaatttttcatcacaggcgaggggtactttaacgaggtgttgcagttcaagaccctctctacactgtcgccgactgaaagctcccacgtacgcttacccaccgctgagccttttaaatcatatttcgccaagggatttctgagtattgattctggctacttcagcgcgaagtgttatccaagatcctcaacgagcggtctccaacttatcaatgttacccagcatcccgcaaggatagccgaaacacctgggccaaaaactacctctctgaagacaattaactgcatcaatttgcgggcttccgtgtttaaagagcaccgcgaagtcgagattaacgtgctactgccccagatcgccgtgaacctcagtaattgtcacgtcgttatcagctctcatgtgtgcgattactccctggacactgatggaccggtacgacttcctaggattcaccatgagggcaccttcataccaggcacgtacaagatcgtgattgacagaaaagataagctgaacgaccggtgttcattggtcacaaattgcgtgatcaaagggcgtgaagttcgcaagggacagagtgtgctcagacaatataagaccgagataaaaattggtaaggcaagcactggctcgaggaaactgttatccgaggaacccggggacgattgtatctctcggacacagctgctaaagaccgaaactgctgagatccacgacgataactacggaggccctggtgacaaaattaccatctgcaatgggagcacaattgtcgatcagcgactcggctcagagctgggatgttatacgataaaccgcgtgaagagttttaagttatgcgaaaattccgccaccggcaaaacttgcgagatcgactctacacccgtaaagtgtagacaggggttctgcttgaaaattacccaagaaggaaggggtcatgttaagctgagccggggctccgaggtggtcctcgatgcgtgtgactcaagctgcgagatcatgatcccaaaagggacaggagatattctggtggactgtagtggcggtcagcagcacttccttaaggataacctgatagacttggggtgccctcacatccccctcctgggcaagatggccatttacatctgtcgcatgtctaatcatccaagaactaccatggcatttttattctggttttccttcggatatgtcattacgtgcatcttttgtaaagctctgttctacctactcataatcattggcacactggggaagaaaatcaagcagtatagggaacttaaaccgcaaacctgcactatttgtgagaccgcccctgtgaacgctatcgacgccgaaatgcacgatttgaattgcagctacaacatatgcccctactgtgcatcgcgtctgacatcagacggactcgcccggcatgttactcagtgcccaaagcgaaaggagaaagtggaagagaccgagctgtatttaaatctggaaaggattccctggatcgtaagaaaacttttgcaggtctctgagagtacaggtgtggctctcaagcgctccagctggctgacggttctactggtgctcctgaccgtctctcttagccctgtgcagtccgcgccagtaggccacgggaacactattgaaacataccaaacccgggagggatttacttcaatctgtttgttcatgctgggcagtatattatttatcgtgagctgcctcgttaagggtctggtcgattctgtgtccgactcattctttcccgggcttagtgtgtgtaaaacatgcagcattggctccatcaatggattcgaaattgagtctcacaagtgttattgctcgctgttttgttgccctcattgtagacacaggagcgcagatcgcgagatccatcagttgcacctctcaatatgcaaaaagcgaaagaccggctccaacgtcatgctggccgtttgcaaacggatgtgtccgaaggctacgattgaagccagtcgtagagcactaccaatcaggtctatcattaacactaccctggtgatgtgcatcctcacactggccatttgtgtggtaagcacctccgctgtcgagatggaagaccttcccgccgggacttgggagcgcgaagaggatttgacaaatttctgccatcaggagtgtcaagtgaccgaaacagagtgcctgtgtccttacgaagcattagttctccggaaaccactgttccttgactcaatagcgaagggaatgaaaaacctgctaaattctactagcctcgagaccagtctgtccatcgaggctccctggggcgccattaacgtgcagagcacgtttaagcctacagtctctaccgcaaatatcgccttgtcatggtccagtgtggaacacagaggtaacaagattctggttactgggaggagcgagtcgatcatgaaattagaggaacgaaccggagtgtcttgggatctcggcgtagaagacgcttccgagagcaagctgcttacagtctcaataatggatctgagtcagatgtattctccggtgttcgagtacttgtccggtgaccgccaggtggaagagtggcccaaagccacttgcaccggcgattgtccagaacggtgcgggtgtacgagctcaacatgcctccacaaggagtggcctcatagtagaaattggaggtgcaaccccacctggtgttggggagtcggcactgggtgcacatgttgcggagttgacgtgaaagacctgtttaccgatcacatgttcatcaagtggaaggtagaatatattaaaactgaggcaatcgtgtgtgtcgagctaacaggccaagaacgtcagtgcagcctgattgaggctggtacccgctttaatcttgggccagtgacgatcactctctccgaacctcggaacatacagcagaagctgcccccagagattatcaccttgcatccgaaaatcgaagagggattctttgacctgatgcacgttcaaaaggtgttatctgccagcacagtctgtaaactccagtcctgcacccatggcattcctggtgatctgcagatataccacatcggcaatcttctgaagggggacagagtgaacggacacttgattcataagatcgagccccacttcaatacatcatggatgtcttgggatggctgtgacctcgattactattgcaacatgggggactggccaagttgtacttacaccggagttacgcagcataatcacgcggcctttgtgaacctgctaaacattgaaacagattatactaaaaccttccactttcattcgaagagggtcacagctcacggcgacactccccaactggatcttaaagcacgacctacctacggtgccggggagatcaccgtactcgtggaagttgctgacatggagctgcatacaaagaaagtggagataagcggattgaagttcgcctccttaacgtgcactggctgctatgcatgttcttcaggtatcagctgcaaagtccggattcacgtggatgaaccagacgagctgaccgtacatgtgaagtccagtgaccccgatgtcgttgcggcctctacaagcctcatggctcgcaagctggaatttggcaccgactcaactttcaaagccttctccgcaatgcctaagacaagtctttgtttttacatcgtggagagagaatattgcaaaagctgttctgaggatgacaccaagaaatgcgtggatacgaagctggagcagccgcagtccattttgatcgaacacaaggggactataattggaaaacaaaatgacacatgtaccgctaaggcctcatgctggctagagagcgtcaaatcgttcttttacggcctgaagaacatgctcgggtctgtgttcggatcctttttcgttggcatcctgctttttcttgcaccattcgtactgctcgtgttgtttttcatgtttggttggaaaatcctgttctgtttcaagtgctgtaggcggacccgagggctctttaagtacagacacctgaatgatgacgaagagactggatatcgcaggattatcgaacgtcttaacagtaaaaagggcaaaaatcggctgttggatggcgagagactagccgacaggaagatagctgagctgttcagcacaaaaacccatattgggtga

SEQ ID NO: 10404 - RNA, 5052 nt, synthetic construct
  misc_feature 1..5052: note = derived and/or modified CDS sequence (opt3) from CCHFV(1231-CR/TI-2015)__KU161585.1__GP
  source 1..5052: mol_type = other RNA
atgcacaccctgctcgtgtgcttcatcctttacctgcagttgttaggccttgggggagcccatgagcaaagcaacgctacagaccacaatagaactaacacgattaccgcaccctccacatctcagaatcctaagccaccggcctcaactacaccccctcataccccagaaagtagcaccataaaactaatcacttccacaggtgaggcggaaggctctggggagaccacgccccctctcaacactacccagggaccatttccccctgaaacaacttcggagcacccagcttcaaccgccacaaataccagcagtacgaactccatgaactctactacacagatgaccgataagactctgacaagcaccgtctccacgtcacttagtattagcccgtctaccccctccacatcacaaggcatccattatcctattaggagcctgttgagtgtttcttccccacggactgcagccacccccacacctatgagcactcgcgagatgtcgtctgaaaccaattcccagcactcagctgtgagtcgaacaccaaccttccacactgcaacgcaggtaagcacagagaatgacaaccgttccacccccagacagtctgaaagctcagcccaaccggctactcagagtcctatgacctcccccgcccagagcatcctcctggtgtctgcggcaccaacaaccatacagaatatccatccttcacccactaacaggagtaaacggaatctggagatggagattatcctcacattaccacaaggtctgaagaaatactatgggaagattcttaagttgctgcacctaacgctcgaagaggataccgaaggactgcttgagtggtgtaaacgcaacctgggcagcaattgcgacgatgaatttttccagaagagaatcgaggagtttttcataactggcgaagggtactttaacgaggtcttgcagttcaaaacactctccaccctgtctcccatggaaccttcgcatgccaggccaccgacagctgagccctttaagagctatttcgccaaaggatttttatccattgactcaggttacttcagtgcaaagtgttatcctcggtctagctcctcaggcctgcaactcatcaacattactcagcacccagctcgcatcgccgaaacccccgggcctaagacgaccagccttaaaacaatcaattgcattaacctgcgagcgtctgtgtttaaggagcacagagaggttgaaataaatgtgttgctaccacagatcgccgtcaacctgtccaattgtcatgtggtaattaacagtcacgtttgcgattacagcctcgacactgatggacccgtgaggctgccgcggatctaccatgagggcaccttcatacctggtacatataaaattgtcatcgacaagaaaaataagctgaacgatcgttgtactctggtgaccaattgcgtgacgaaagggcgcgaagtcagaaagggacagtctgttttgaggcaatacaagacagagatcaaaattggcaaggcatccaccggctcacggaaactcctgagtgaggaaccaggggacgattgtatcagccgaactcagttactgcgcacagagaccgctgaaattcacgacgacaactatggaggtcccggcgataagataactatctgcaatgggtcgaccattgtggaccagagactaggatccgagctcggctgttacacaatcaacagggtaaaatctttcaagctgtgcgaaaatagcgccacgggtaagacctgcgagatcgattcaactcctgtgaaatgtcggcaggggttttgccttaagattacacaagagggccgcggacatgtcaaattgagtagaggctccgaagtggttctggacgcttgtgattctagctgcgaggtgatgatacccaaggggaccggagacatcctcgtcgattgttccggtggccagcagcacttcctgaaagacaaccttattgatctggggtgcccacacatccctttgctcggaaagatggccatttatatctgtaggatgtcaaatcatccccgtacaactatggcatttctgttctggtttagcttcggctacgtgataacctgcatcttttgtaaggccttattctatagtctgattatcattggtacgctagggaaaaagatcaaacagtaccgggaactcaagccacaaacatgcaccatatgtgagactgctccggtaaacgcgattgacgcagaaatgcacgatctgaactgctcttacaatatctgcccttattgtgcctcccgacttaccagcgacggcttggctagacatgttacacagtgccccaaaaggaaggagaaggtggaggaaactgagctgtacctcaacctggaacgcattccatggatcgtccggaaattacttcaggtgtcggagtcaaccggagtcgccctgaagagatctagttggttgatagtgctcctggttctactgacagtgtccctcagccccgtacagtctgcacctgtcggccacgggaaaacgatcgaaacctatcaaactagggagggatttacaagcatttgtctgttcatgcttggttccatcttgtttattgtgtcatgcctggttaagggcttagtggagagtgtcagcgactctttctttccagggctctccgtgtgtcgaacctgctcaatcggaagtataaatggcttcgaaattgagagccacaaatgttactgctccctgttctgttgcccctattgtcgccattgctctgccgatcgggaaatccaccagcttcatctgtcgatctgcaagaaacgtaagactggtagcaacgtaatgttggctgtgtgtaagagaatgtgctttagggccacaatggaggcatcacgccgggcgctcctgattagatccatcattaataccacgttcgttatatgtatcctaactctgaccatttgcgtcgtgagtacatctgctgtggaaatggagaacctccctgccgggacctgggagagggaagaggacctgactaatttttgtcaccaggaatgccaagtcacagagaccgagtgtctttgcccgtacgaagcattggttctgcgaaaaccattattcctcgatagcatcgtgaagggcatgaaaaacctgcttaattccacatcactggagacttctctaagcattgaagccccctggggagctatcaacgtgcagagtacctttaagcctacggtatccacagccaatatagcactcagctggtcttcagtcgagcatcgcggcaacaaaatcctggtgaccgggcggtccgaaagtattatgaagttggaggagagaactggagttagctgggacctgggcgtggaagatgcttcggagtctaagttactcaccgtctccatcatggacctgagccagatgtattcaccagtgttcgaataccttagtggtgataggcaggttgaggaatggcccaaagccacatgtactggggactgccctgagcgttgtggatgcacctcttccacgtgcctgcacaaggagtggccgcacagccgcaattggcggtgtaaccccacatggtgctggggcgtgggtaccggctgtacttgctgtggggtagatgtcaaagacttgtttacagatcatatgttcgtgaagtggaaagtggaatacattaagaccgaggcgatcgtctgcgttgaactcacttcacaagagagacagtgtagtctgatagaagccggaacaaggtttaatctaggcccagtgaccattacgctgagcgagcctcgaaacatccagcagaaacttcccccagagatcattactctccaccctaaaatagaagaggggttctttgacctgatgcatgtacaaaaggtgttgtccgcttctaccgtctgcaaactgcagagctgtacacacggaatccccggcgatttacaggtgtatcatattggtaacctcctgaagggggaccgggttaatggacaccttatccacaaaattgaaccacatttcaacacctcctggatgtcatgggacggctgcgatctggactactattgtaatatgggtgattggccgtcttgcacatacactggcgtgacccagcacaaccatgcagcctttgtcaatttgctcaacatcgagacggactatacaaagactttccacttccacagtaagcgcgtgaccgctcatggggatacacctcaactggacctaaaagccagacccacctacggagcaggcgagataactgttctggtggaagtcgcggatatggagcttcacaccaagaaagtagaaatctcggggctcaagtttgccagcctggcttgcacaggatgttatgcctgctcctctggcatttcatgtaaagtgaggatccatgttgacgagccagatgaattgacggtgcacgtcaagagctccgaccccgatgtggtagcagctagtacttctttaatggcccggaaactggagttcggtaccgacagcacatttaaggcattctcagccatgcctaagacctccctctgcttttacattgtggagcgagaatactgtaaaagttgcagcgaggatgacactaagaaatgtgtcgacacaaagctggaacagccacagtctatccttatagagcataaagggaccattatcggaaagcaaaatgatacgtgcactgctaaggcgtcctgttggctggaatcagttaagagcttcttttatggcttgaagaacatgctaggttcggtgttcggcaactttttcatcgggattctgctctttctggcccccttcgtgcttttagtcctgttctttatgttcggatggaaaatcctcttttgcttcaagtgttgcagacgcacaaggggcttgtttaaataccgtcacctgaaggacgatgaggagaccgggtatcggagaataattgaaaggctcaataataagaaaggaaagaaccgcctgcttgacggcgagcgactggcagatagaaaaatcgctgaattgttctctaccaagactcacattggttga

SEQ ID NO: 10405 - RNA, 5052 nt, synthetic construct
  misc_feature 1..5052: note = derived and/or modified CDS sequence (opt3) from CCHFV(K229_194)__KX013463.1__GP
  source 1..5052: mol_type = other RNA
atgcacaccctgctcgtgtgcttcatcctttacctgcagttgagcggcttagggggagcccatggtcaatccaacgctacagagcacaatggcactaacacgaccacagtccccgggacttctcagtcacctaagccaccggcaagtaccacactgccccatacccctgaaagctccactgttaaactaacaaccccaacgtctgagactgaaggatcgggcgagaccacaccccctccaaatactacccagggtttaccccctccagggacaaccccggaaagacccgccacgactgcgacatcaaccagcagtactgacaacatgaactccacaacccaggtgacggataatacccctatttctacagtaagcatatccccatcaagtagcccctctatgccttccacttcacaaggaatccactatccagtgaggagcctgcttagtgtctcttcccccaagaccgtgacaactccgacccctatgagccccggcgagatgtcgccagagacatcttcccagcattcagctatgagtcggattcctaccctgtacactgccacgcaggttagcacagaaaataccaaccgctccactccccgacagtctgagagctcagcacaaccagccacccagagtcccacaacctcccctactcagacaatcttgctcatgagcgctgcaccaaaagccattcaggacatgcacccgtctcccacgaatcgttcaaagagaaacctggaagtggagatcatactgaccctcagtcaaggcctcaaaaagtattacgggaagatcctgaaacttttgcacctgactctagaggaagatacagagggactcctggaatggtgtaagaggaatcttggtagcaactgcgacgatgactttttccagaaacggattgaggaatttttcatcaccggcgaggggtattttaatgaggtcctgcagttcaagacattgaacactctctcccctaccgaaccatctcatgtgcgcctgcccacggctgagccttttaaatcgtacttcgccaagggatttttaagcgtagattccggctatttctcagcgaagtgttacccaagaagttctaccagcggtctgcaactcattaatgttacacagcaccccgcaaggatcgccgaaactccggggcctaaaaccacatcccttaagactataaactgcattaacctgcgggcttcagtgtttaaagagcatcgcgaagtcgagatcaatgtgttgctaccacagattgccgtgaacctgagcaattgtcacgtcgttatcaactctcacgtgtgcgactactccctcgataccgacggacccgtacgactgcctagaatccatcacgagggcacgttcattcccggcacatataagatagtgatcgataaaaagaataaacttaacgacaggtgtagtctggtcaccaattgcgtgattaaggggcgggaagttcgtaagggacagagcgtgttgcgccaatacaaaactgagatcaagataggtaaagcatctacaggctccagaaagctcctgtcagaggaaccaggggatgactgtattagtaggacccagttactgaaaactgaaaccgctgagatccatgacgataactatggaggccctggtgacaagatcacaatttgcaatgggagcacgatcgtcgatcagcggctaggctcggagctcggatgttacaccattaaccgagtgaagtcctttaaactgtgcgaaaattctgccactggcaagacatgcgagatagacagcacccccgtaaaatgtcgccaggggttctgccttaagatcacacaagaaggaagaggtcacgttaaattgtcaaggggcagtgaggtggtcctggatgcgtgtgactcctcttgcgagattatgatcccaaaggggactggagatatcctcgtggactgtagcggcggtcagcagcatttcctgaaggggaaccttattgatctgggctgcccgcacatacctttgctcggaaaaatggccatctatatttgtcggatgtccaatcacccccgcaccacgatggcatttctgttctggttttcattcggctacgtcatcacatgcatcttttgtaaggctttattctatagcctgattataatcgggaccctagggaaaaagattaaacagtacagagaactcaagccacaaacttgcaccatctgtgagacagcccccgtgaacgctattgacgccgaaatgcatgatctgaattgcagttacaacatctgcccttattgtgcatctaggcttacttccgacggtttggcccgtcacgttacccagtgcccaaagcggaaagagaaggtggaagagacagagctgtacctcaacctggaacgaataccctggattgtaagaaaattactgcaggtcagcgagtcgacgggcgtggctcttaagaggtcatcttggttgatcgttctcctggtgctactgaccgtcagtctctcccctgtgcagagcgcgccggtagggcatggaaaaactattgaaacatatcaaacccgcgagggctttactaatatctgtctgttcatgcttggttctatattgtttatcgtgagctgcctggttaaggggttagtcgactccgtgtcagatagtttctttccaggcctcagcgtgtgtaaaacatgctctattggatccatcaacggcttcgaaattgagtcacacaagtgttactgcagtctgttttgttgcccctattgtcggcactgcagcgcagacagagagatccatcagcttcacctggggatatgcaagaaaaggaagaccggatccaatgtcatgttggccgtttgtaaacgcatgtgcttcaaggctacgattgaagcctctcgacgggcactcctgatccgttcgatcattaacactaccttcgtgatctgtattctaacactggccatatgcgtggtaagcacctcagctgtcgagatggaaaatctccctgccggcacttgggagagagaagaggatctgacatccttttgtcatcaggagtgccaagtgaccgaaacagagtgtctttgcccatacgaagcattggttctgaggaaacccttattcctcgacagtatcgtgaagggtaagaaaaacctgcttaattctactagcctggagacctccctatcaattgaggcgccttggggagctatcaacgtccagtctacgtttaagccgacagtgagcaccgccaatattgcactcagttggtccagcgttgaacaccgcggaaacaaaatcctggtgactggccggtctgagtcaataatgaagttggaagagagaaccggtgtatcctgggatctgggcgtcgaagacgccagtgagagcaaattactcacagtgtcgatcatggatctgtctcagatgtattcccccgtgttcgagtaccttagcggggacaggcaggtcgaagagtggccaaaggctacttgtaccggagattgccctgaacgatgtggctgcacgtcaagtacatgcctgcataaggagtggccccactctcgcaattggcggtgtaacccaacctggtgctggggagttgggactggctgtacatgctgtggtgtggacgtaaaagatttgtttaccgaccacatgttcattaagtggaaagtggaatacatcaagactgaggccattgtctgcgtggagctcacatcccaagaaagacagtgtagcctgatcgaggcagggaccaggtttaatctaggacctgttacgataactctgtcagaaccccgtaacattcagcagaaacttccaccggagatcatcaccctccatcctaagattgaagagggcttctttgatctgatgcacgtgcaaaaggtcttgagtgctagcacagtgtgcaaactgcagtcctgtacccatggtatacccggcgacttacagatctatcacattgggaatctcctgaagggagaccgccttaacggccatctgatccacaaaattgagccacacttcaacacatcttggatgagctgggatgggtgcgacttggattactattgtaatatgggagactggccctcctgcacttacaccggcgttacgcagcataaccacgccgcgtttgtgaatctcctgaacatcgaaacagattatactaagaccttccattttcactcaaaacgggtcacagcccacggtgacacccctcaactagatctgaaggctagaccaacttacggggcaggagagataaccgtacttgtggaagttgccgacatggagctccatacgaaaaaggtggagatctctggcctgaagttcgctagtttggcctgcacaggttgttattcgtgcagctccggcatttcttgtaaagtcaggatccacgtggatgaacccgacgagttaactgtacatgtgaagtcaagcgatcctgacgtcgttgcagcgtccaccagtctgatggcccgaaaactcgaatttgggacagattctacctttaaggctttcagcgccatgccgaaaacttcactgtgcttttacattgtggagcgggaatactgtaagtcctgcagtgaggacgacacaaagaaatgtgtggataccaaacttgagcagccacagagcatcctgatagaacacaaaggaacgattatcggcaagcaaaatgacacttgcacagcaaaggcttcttgttggttggagtccgtcaagtcattcttttatgggctaaagaacatgctgggaagcgtgttcggcaatttcttcgttggtatcctcctgtttcttgcccccttcgtattactggtgctctttttcatgttcgggtggaaaattttgttttgcttcaagtgttgccgcagaaccaggggactgtttaaataccggcatctcaaggatgacgaagagaccggctatcgaaaaatcatagaaagactgaactcgaagaagggcaaaaatcgccttctggatggggagaggttggcagaccgtaagattgccgagctattctctactaaaacacacatcggatga

SEQ ID NO: 10406 - RNA, 5052 nt, synthetic construct
  misc_feature 1..5052: note = derived and/or modified CDS sequence (opt3) from CCHFV(K315_14)__KX013469.1__GP
  source 1..5052: mol_type = other RNA
atgcacaccctgctcgtgtgcttcatcctttacctgcagttgagcggcttagggggagcccatggtcaatccaacgagacagaacacaatggcactaacacgaccacagtccccgggacttctcagtcacctaagccaccggctagtaccacactgcagcatacccccgagagctccactgttaaactaacaacccctacgtctgaaactgagggatcgggcgaaaccacaccaccccctaatactacccagggtctcccaccccctgggacaaccccagagagatcagcaacgactgccacaagcaccagttccactgacaacatgaatagtacaacccaagtgacggataacaccccgacaagcactgtatccatttcacccagtagctctccttccatgccatcaaccagccagggaatacactatcccatcaggagtctgctttctgtgtccagccctaagacagtcactaccccaacacccatttcgccgggcgagatgtctcctgaaacctcctcacagcatagtgcgatgagccggatccccactctgtacacggctacacaggtgtccaccgagaatactaaccgctctaccccacgacaaagcgaatcaagtgttcagcctgccacacagtcccccattaccagcccagcacagactatcttgctcatgtctgccgctcccaaagcaatacaagacatgcacccttcaccaacaaatcgtagtaagagaaacctggaggtggagatcattctgacgctcagccagggcctgaaaaagtattacgggaagatcctgaaacttttgcacctgaccctagaagaggatactgaaggactcctggagtggtgtaagaggaatcttggttccaactgcgacgatgactttttccagaaacggattgaagagtttttcatcacaggcgaggggtattttaatgaagtcctgcaattcaagaccttgtctacactctcgccgactgagcccagccatgtgcgcctgcctaccgccgaaccatttaaatcctacttcgctaagggatttttatcaatagatagtggctatttctctgccaagtgttaccccagaagctccacgtcaggtctgcagctcattaacgtaacccagcaccctgcgaggatcgcagagacaccagggcccaaaactaccagccttaagacaattaattgcatcaacctgcgggcctctgtttttaaagaacatcgcgaggtggagatcaacgtcttgctaccgcagattgctgtgaatctgtccaactgtcacgtggtcataaatagtcacgtttgcgactacagcctcgatactgacggacctgtgcgactgccaagaatccatcacgaaggcaccttcattcccggcacgtataagatcgtaatagataaaaagaacaaacttaatgacaggtgttctctggtgacaaactgcgtcattaaggggcgggaggtgcgtaagggacaatccgttttgcgccagtacaaaaccgaaatcagaatcggtaaggcctcaactggcagtaggaaactcctgagcgaggaacctggggatgactgtatttcgcggacacagttactgaagaccgagactgcagagatccatgacgataattatggaggccccggtgacaaaattaccatatgcaacgggtccacagtggtcgatcagcgactaggctctgaactcggatgttacacgatcaatcgcgtaaagagctttaagctgtgcaaaaactcagctaccggcaagacttgcgagattgacagtacaccagtgaaatgtagacaagggttctgccttaagatcacccaggaaggaaggggtcacgttaaattgtcccggggctctgaggtggtcctggatgtgtgtgacagctcctgcgagatcatgattcctaaggggacaggagatatactcgtcgactgttcaggcggtcagcagcatttcctgaaggataatcttatcgacctggggtgcccccacattccattgctcggcaaaatggccatctatatttgtcgcatgagcaaccacccgagaactaccatggcgtttctgttctggtttagtttcggatacgtgatcacgtgcatattttgtaaggccttattctattctctgatcattatcggcacactagggaaaaagattaaacaatacagggaactcaagcctcagacctgcactatctgtgagaccgcacccgttaatgctatagatgccgaaatgcatgacctgaactgctcctacaatatttgcccatattgtgctagccgtcttacatcggagggattggcccggcacgtgactcagtgccccaagcgaaaagaaaaggtagaggagaccgaactgtacctcaacctggagagaatcccttggattgtcaggaaattattacaggtgtcagaatctacaggtgttgcacttaagcgcagttcctggttgatcgtgctcctggtcctactgacggtgagcctctctccagtacaaagcgcccccgtgggccatgggaaaaccatagagacttatcagacacgggaaggatttacctccatctgtctgttcatgcttggctcaattttgtttatcgttagttgcctggtcaagggtttagtgtacagcgtgtctgactccttctttcctgggctctcagtctgtaaaacttgcagtattggcagcatcaacggattcgagatagagtcccacaagtgttattgctctctgttttgttgcccgtactgtagacactgctcggctgatagggaaattcatcagcttcacctgagcatctgcaagaaacgcaagacaggctcaaatgttatgttggcggtgtgtaaacgaatgtgcttcaaggcaaccatcgaggcctcccggcgtgctctcctgattagaagtatcattaacacgactttcgtgatatgtatcctaaccctggccatttgcgtagtctctacaagcgcagtggaaatggaggacctcccagccgggacctgggaaagggaggaggatctgactaatttttgtcatcaagaatgccaggttacagagaccgaatgtctttgcccctatgaggctttggtgctgcgcaaacctttattcctcgactccatcgtcaagggaatgaagaaactgcttaactcaacatctctggagactagcctaagtattgaagccccatggggcgcaatcaatgtgcagtccacctttaagcccacggttagcacagcgaacatagctctctcttggtcatccgtggagcaccggggtaataaaatcctggtaaccgggagaagtgaaagcattatgaagttggaggaaaggactggagtctcgtgggatctgggcgtggaggacgcctctgagtccaaattactcaccgtgagcatcatggatctgtcacagatgtacagtcctgtcttcgaatacctttctggtgaccgacaagttgaggaatggccgaaggcaacatgtactggcgattgccccgagcgctgtgggtgcacctccagcacgtgcctgcataaggaatggccacactcacggaactggagatgtaatcctacatggtgctggggagtgggcaccgggtgtacttgctgtggagtagacgtgaaagatttgtttacagaccacatgttcattaagtggaaagtcgagtatatcaagaccgaggccatagtgtgcgttgaactcacttctcaggagaggcagtgtagcctgattgaagctggcacacgttttaacctaggtcccgtgaccatcacgctgtccgagccacgcaatatccagcaaaaacttcctcccgaaattataactctccatccaaagatcgaggaggggttctttgatctgatgcacgtccagaaggtgttgtctgccagcaccgtttgcaaactgcagtcctgtacacatggcattccgggagacttacagatctaccacattggtaacctcctgaagggcgaccgggtgaatgggcatcttatccacaaaatagaacctcacttcaacacctcatggatgtcttgggatggatgcgacctggattattactgtaatatgggcgactggcccagttgcacatatactggggtcacccaacataaccacgcagcttttgtaaacttgctcaatatcgagacggattacacaaagactttccattttcactcgaaaagagtgaccgcccacggagacacaccacagctggatctaaaggcgaggcccacctatggcgccggtgaaattactgttctggtggaggtcgctgacatggagcttcataccaaaaaggtggaaatcagcgggctcaagttcgcatccctgacatgcacgggatgttacgcctgcagttcaggcattagctgtaaagtacgaatccacgtggatgagcctgacgaattgactgtccatgttaagtccagtgatccagacgtggtggctgcctctaccagcttaatggcacggaaactggagttcggtacagattcaacctttaaggcgttctccgccatgcccaaaacttctctctgcttttacatagtcgaacgcgagtattgtaagagctgctctgaggacgacacaaagaaatgtgtggataccaagctggaacagcctcaatccattcttatcgagcacaaaggcacgatcattgggaagcagaacgacacttgcacagctaaagcctcatgttggctggaaagcgttaagtcgttcttttacggattgaagaatatgctaggctctgtattcgggtcctttttcgtgggaatcctgctctttctggcaccgttcgtccttttagtgctgtttttcatgttcggctggaaaatactcttttgcttcaagtgttgcagaaggacccggggtttgtttaaatatcgacatctgaaggatgacgaggaaaccgggtacagacgcattatcgagaggctcaacagtaaaaagggaaagaatcgtctgcttgatggcgagcggctggctgacagaaaaattgccgaattgttcagcactaagacacacatcggctga

SEQ ID NO: 10407 - RNA, 5055 nt, synthetic construct
  misc_feature 1..5055: note = derived and/or modified CDS sequence (opt3) from CCHFV(BA8402)__AF350449.1__GP
  source 1..5055: mol_type = other RNA
atgtacacacccctgctctgcgccgtgctttgtctgcagttgtggagcttagagggctcccacgggctgtctaacaagacacaacattcaaatacgagtactaccaaagctcctgaagtcagccaggagctaggactcccagtttccacagtgtctactatcacctcggaaccgccctcaattacaagcgcagtaagtgtgtccggttctgagggcagcggggacaccaacacttccccttcagtcacaacccagggaccaacgctgcccgaaactacccttgagcctctgacaactaccgatacagacgccagtagcaccgtggttgtggatgtctctacgcagactgtgaaggacacaccaatatccaccacttatacatcattgcccagcacccctagtgagccaacgaccccgcaaggcacacaccatactgcgagaggtctcctgtctgtaacctccacaaaacccgaagaggctagccctcaggccaatccagggaagatctcgatggaaactaacggacccaggctggcaatttctgagaccccttccttctcaccaacaacccaggcccccactgagaatagtaacccgatcacgagcaaacagctcatgttatccgctcaacctgttacacccaatccaatgacctctcctgtgcagcccgcactgagccagtcagataccagtactgccattcaggacgtccacccatcccccacaggccggagcaagcgcaaccttgaaatggagatcatattgaccctgtctcaaggcctaaagaaatactatgggaagatcctcaaactgcttgatctgactttggaagaggacacagaaggactcctggagtggtgcaagcgaaatttaggtctggtgtgtgatgacaactttttccagaaacgtattgaggaatttttcctcacgggcaaggggcattttaatgaggtgcttcagttcaagaccccttcaactctgagtccaacaggaccggctagaaccggcagccccacagtcgaaccttttaaatcctacttcgccaaggggtttttgtctatggattcgggttatttcagcgcgaaatgctacccaagggcatccaactcaggactacaactgatcaatgttactcagcacagtacccggattacggacacccccggccctaagatcacaaacctcaaaactataaattgtattaacctgaaggcctctgtgtttaaagagcaccgcgaaatcgagattaacgtacttctgccacaggtggctgtcaatttgagctcctgccatgtgctcatcaagtcacacgtttgtgattatagcctggacatcgacggccccgtgagattaccgaggattcatcacgaggggaccttcatacctggaacatacaagatcgtcattgataaaaagaacaaacagaatgaccggtgcactctggtgaccaactgtgtaatcaagggtcgcgaaatacgaaaaggccaatctgttctaagacagtacaggacggagattaagatcgggaaggcctccagtggaagccggcgtctcctgtctgaagagtccggcgatgactgcatctcacgcacacagcttttgagaaccgaaactgcagagattcacaatgataactatggtgggccaggcgacaaaatcacaatttgtaatggaagtaccgtggtcgatcagaggctgggcagcgagctcgggtgctacactataaaccgggtcaattcgtttaacctgtgcgaaaataccgctacaggaaagtcctgtgagatcgactctacgcccgtgaaatgccgacaaggtttctgtcttaagattacccaggaaggccgcgggcatgtgaaactgagcagaggatcagaggttgtgttggatgcctgcgagagttcctgtgaaatcatgatccctaagggcactggtgacattctcgtagattgctctgggggccagcagcacttcctgaaggacaacttaatagacctgggatgtcccaatatcccactactcggcaaaatggcgatttatatctgcaggatgagcaaccatcctaagacaaccatggcctttctgttctggttttccttcgggtacgtcgtgacatgtattctttgcaaagttatcttttatttgctgatagtggtcggaactctcggtaagaaattcaagcaataccgggagctgaagccccagacctgtacgatctgcgaaacaaccccagtgaatgcaattgatgctgagatgcacgacttaaactgctcatataacatctgtccgtactgcgccagccgccctaccagtgatggcctggctagacatgtaatgcagtgtcccaaaaggaaggaaaagattgaggagactgccctttacttgaatctcgaacgtatcccatgggtggttcggaagctgctacaggtctctgagtccacaggggtggcactgaaacgaagctcgtggctcgtggtcctgcttgttttgctgactgtgtcattatctcccgtgcaaagtgcccctataggacacggcaagaccgtagaaacatatcagacgagagagggttacacctccatttgcctctttgtcctggggagcatccttttcattgtgtcttgtctgatgaaaggcttggttgacagcgtgggaaactcctttttcccaggcctctcaatctgcaagacttgtagtatagggagcgtcaatggatttgaaatcgagtctcacaagtgctattgttccctgttctgctgtccctactgcaggcattgctcagctgatcgcgagattcaccggctacatctgagtatctgtaaaaagagaaaaacaggcagcaacgtgatgctcgcggtttgcaagaggatgtgttttcgcgcaaccgtggaagtatccaataaagccctgcttattcgaaacatcataaatactacattcgtcttgtgcattctgatcttagctgtgtgtgtggtctctacctcggccgttgagatggaaagcctccctgcaggtacgtgggagcgggaagaggacctgactaacttctgccaccaggagtgtcaagtgaccgaaacagagtgcctttgtccgtatgaagccctggtactacgtaagccactcttttcagattccatcgtgaaggggatgaaaaatctgttgaacagtacctctctggagactagcttatccattgaggctccctggggagccatcaatgtccagtcaacattcaagcctaccgtgtctgcagcgaacattgctctcagctggagttccgttgaacacagaggcaataaaatactggtgagcggtaggtctgagtcaatcatgaaacttgaggagcgcacaggcatttcctgggacctgggggtcgaagatgccagtgagagcaaattgctcactgtgtcggttatggacctgtctcagatgtactccccagtgtttgagtatctaagcggagatcggcaggtcgaagagtggcccaaggcaacctgcacgggcgactgtcctgaaagatgcgggtgcacatcaagtacctgtctgcataaggagtggccgcactctaggaactggcgatgcaatcccacttggtgttggggagtaggcaccggttgcacatgttgcgggcttgatgtgaaagacctcttcactgactacatgtttatcaagtggaaagttgaatacattaagaccgaggccatcgtgtgtgtcgagctgacgtcccaagaacgccagtgcacattgatagaggctggaacccggttcaacctgggcccagtgactatcacattaagcgaacctagaaacattcagcagaaactgcccccagagatcgtaaccctccatcctaggattgaagagggctttttcgatcttatgcacgtgcaaaaggtcctgtcagccagtactgtttgtaagttgcagagctgcacacatggtgtgcccggggacctccaggtgtatcacatcggaaatctgctaaaaggcgataaggtcaacgggcacctgatacataaaattgagccacactttaatacctcctggatgtcttgggacggatgtgatcttcattactattgcaacatgggcgactggccgagctgcacgtacactggtgtgacccagcacaatcatgcagctttcgttaacatgctcaatatcgaaacagattataccaagaactttcacttccactccaaacgtgtaacagcccatggggacactcctcaactggatttgaaggcgcgccccacctacggagccggcgagatcacggtgttagtcgaagtggctgacatggagctgcacaccaaaaagattgagatatcaggtctcaagtttgcatctctgacttgtaccggctgctatgcctgtagttcggggatcagctgcaaagttcggattcatgtggatgaaccagacgagcttacagtccacgtgaagtccgaagatcccgacatcgtagctgcctcttcaagcctgatggcaagaaaattggagttcggaaccgactccactttcaaggcgtttagtgccatgcctaaaacctctctatgtttctacattgtcgaaagggagtactgcgagagctgttcaaaggaagatacacagaagtgcgtgaatacgaaactggagcagccacaatccatcctcatagaacacaagggcactatcattgggaaacagagtaacacctgtacagctaaggccagctgctggctggagtctgttaaatcctttttctatggacttaagaatatgttatcaggcatctttggtaacgtgttcattggggtctttctgttctttgcacccttcatcctcttgatactgtttttcatgttcggatggcggattctcttttgtttcaagtgctgccgacgcaccagaggcctgtttaaatacaggcatcttaaggacgatgaagagactggctatcggaaaatcatcgagcgactgaataacaagaaagggaagaataagttgctagacggagaaagactggctgatcgcaaaattgccgaactcttcagcacaaagacccacatcggttga

SEQ ID NO: 10408 - RNA, 5055 nt, synthetic construct
  misc_feature 1..5055: note = derived and/or modified CDS sequence (opt3) from CCHFV(UCCR4459)__KY484032.1__GP
  source 1..5055: mol_type = other RNA
atgtacactcccctgctctgcgccgtgctttgtctgcagttgtggagcttagagggctcccacgggctgtctaacaagacacaacattcaaataccagtacgaccaaagctcctgaagtcagccaggagttcggactaccagtttccacagtgtctactatcacctcggacccgccctcaattacaagcgcagtaagtgtgtccggttctgaaggcagcggggataccaacacttccccttcagtcacaacccagggactcacgctgccagagactacccttgaactgttgacaactaccgacacagatgccagtagcaccgtggttgtggacgtctctacgcagactgtgaaggatacacccatatccaccactcacacatcactccctagcaccccaagtgcgacgaccacaccccaaggcactcatcacaccgctagaggtctgctgtctgtaacatccactaaacctgagggggccagcacccaggcaaatccagagaagatctcgatggaaacaaactctccgaggctcgccatttccgagaccccctcatttagtcctactacgcaggctccaacagaaaatagcaaccccatcacctccaaacagttaattttctctgcacaacctgttactccaaatcccgtgaccccgcctgtccagcccgccctgagccagtcagacacaagtaccgctatccaggatatacatccatcccctactagccggtctaagcgcaaccttgagatggagatcattttgacactgtcacaaggactaaagaaatattacggcaagatcctcaaactgcttgacctgacgttggaagaggataccgaaggcctcctggagtggtgcaagcgaaatttagggctggtgtgtgacgatgactttttccagaaacgtattgaagagtttttcctcactggagagggtcactttaacgaagtgcttcagttcaagacacccagtaccctgagcccaacaggccccgccagaactgggtcccctaccgtcgagccatttaagtcttatttcgcgaaaggatttttgtcgatggatagcggctacttctccgcaaagtgctatccgagggcctcaaatagtggtctacaactgatcaacgttacgcagcactctacccggataacagacactcccgggcctaaagtgaccaatctcaagacaattaactgtatcaatctgaaagctagcgtatttaaggaacatcgcgagattgaaatcaacgtgcttctgccacaggtcgccgtgaacttgtcctcatgccacgttctcatcaaaagccatgtgtgtgactactctctggatattgacggacccgtcagattacctaggatacaccacgagggcactttcatcccaggcacctataagctggtgattgataagaaaaataagcagaacgaccggtgcacgctaatcacaaattgtgtaataaaagggcgcgagattcgaaagggacaatccgttctcagacagtacaggaccgaaatcaaaatcggtaaggcaagtagcggctctcggcgtctgctttccgaggaatcaggggatgactgcattagtcgcactcagttgagcagaacagagaccgctgaaatccattcggataactacggaggccccggtgacaagattactatatgtaatgggtccaccatcgtggatcagaggctgggctctgagctcggatgctatacaattaaccgggtcaaaagtttcaagctgtgcgaaaattcagccacgggcaaaagttgtgagatcgactccaccccgatcaagtgccgacaagggttttgtcttaaaattactcaggagggacgcggtcacgtgaagctgtctagaggcagcgaagtcgtgttggatgcgtgcgactcctcatgtgagataatgatccctaaggggacaggagacattctcgttgattgcagcggcggtcagcagcatttcctgaaagacaacttaatcgatctggggtgtccaaatattcccctactcggcaagatggccatctacatatgcaggatgagtaaccaccctaaaaccacaatggcatttctgttctggttttctttcggatatgtgatcacttgtattctttgcaaggtaatcttttacttgctgattgtcgtgggcaccctcgggaaaaagttcaagcaatatcgggagctgaaaccccagacgtgtacaatctgcgaaaccactccagttaatgctatagacgccgagatgcatgatttaaactgctcctacaatatttgtccttattgcgctagccgcctgacctcggacggacttgccagacacgtgatgcagtgtcccaagaggaaagaaaaggtcgaggaaacagagttgtacctcaacctggagcgtatcccatgggtggtacggaaactacttcaggtgtcagaatctactggtgttgcactcaagcgaagttcctggctggtcgtgcttttggtgctgttaaccgtcagcctctctccggttcaaagcgcccctattggccacgggaaaacagtggagacgtaccagaccagagaaggatatacttccatctgcctgtttgtgcttggctcaatactgttcatcgtaagttgtttgatgaagggtctcgtcgatagcgtggggaatagctttttccccggcctgtccatttgcaagacatgttcaatcggaagtattaacggctttgagatcgaaagccataaatgctactgttccctattctgctgtccatattgcaggcactgctctgctgaccgcgagatacataagctgcacctctcgatttgtaaaaagcggaaaaccgggagcaacgttatgctggcggtgtgcaagagaatgtgtttcagggcaactgtcgaggtgtcaaataaggcccttttgatccgcaacatcattaatacaacctttgttgtgtgcatcctgattttagctgtatgtgtcgtgtccacgagtgccgtggaaatggagtctctccccgcaggaacttgggaacgagaggaagatctgaccaacttctgccaccaggagtgtcaagtcacagagaccgaatgcctttgtccttacgaggccctggttctacggaaaccactctttagcgactccatagtgaagggcatgaaaaatctgttgaactcaacttctctggaaacatctttaagtatcgaggctccctggggtgccattaatgtacagtccaccttcaagcctacagtgagcgcagcgaacatcgctctctcttggtcatccgtcgagcatcgtgggaataaaattctggtgagtggaagaagcgaatcgatcatgaagctggaggaaaggactggcatatcttgggatctgggtgttgaggacgcctccgaaagcaagttgctcaccgtgtcaatcatggatctgagtcagatgtattctccggtctttgagtacctatccggcgaccgccaggtggaggaatggccaaaagcaacgtgcacaggggactgtcccgagcggtgcggatgcaccagctcaacttgtctgcacaaggaatggcctcatagtagaaactggaggtgcaatccaacctggtgttggggcgttgggacaggatgcacttgttgcggccttgatgtgaaagacctcttcaccgattatatgtttgtcaagtggaaagtagagtacattaagacggaagccatcgtgtgtgttgagctgacaagccaagagcgacagtgctccttgattgaagctggtacccgcttcaacctggggcccgtgactatcacattatctgagcctcggaatatacagcagaagctcccgcccgaaattgtcaccctgcacccaagaatcgaggaaggatttttcgaccttatgcatgtgaaaaaggtactgagcgcctccactgtgtgtaaattgcaatcatgcacacacggcgtccctggtgatctccaggtttaccacatcggcaacctgctaaagggggacaaagtgaatggacatctgattcacaagatagagccccattttaacacctcttggatgagttgggatggctgtgaccttgattattactgcaacatgggggactggccatcgtgcagctatacgggagtgactcagcacaatcatgcagctttcgtcaacatgctcaatatcgagaccgattacacaaaaatttttcacttccactccaagagggtgaccgcccatggcgacacacctcagctggatttgaaggcgcgtcccacttatggtgccggggaaatcaccgttttagtagaggtggctgacatggaactgcacacgaaaaagattgagatctctggactcaaattcgcatcactgacatgtactggctgctacgcctgtagctccggtataagttgcaaggtccgcatccatgtggacgagccagatgaacttaccgttcacgtgaaatctgaggacccggatattgtcgctgccagctcatccctgatggcacggaagttggaatttggcacagacagtaccttcaaggcgtttagcgccatgcctaaaacttctctatgtttctatatcgtggagagagaatactgcaagtcctgttcaaaagaggatacccaaaagtgcgtaaacacaaaactggagcagccccagagcattctcatcgaacacaaggggacgataattggaaagcaaaatgacacttgtacctcgaaagctggctgctggctggagtctgtcaagagctttttctacgggcttaaaaacatgttatccggaatctttggcaatgtgttcatcggtatttttctgttcctcgccccatttatcttgctgatactcttcttcatgtttgggtggaggattctgttctgttttaagtgctgccgacggacacgcggacttttcaaatatagacatctgaaggatgacgaagagaccggctacaggaagatcattgaacggttgaacaataaaaagggcaaaaacaagctactggatggggagcgactcgcagacagaaaaatcgctgagttatttagcactaagacacacataggatga

SEQ ID NO: 10409 - RNA, 5052 nt, synthetic construct
  misc_feature 1..5052: note = derived and/or modified CDS sequence (opt3) from CCHFV(Ast149)__KX056054.1__GP
  source 1..5052: mol_type = other RNA
atgcacaccctgctcgtgtgcttcatcctttacctgcagttgagcggcttagggggagcccatggtcaatccaacgctacagagcacaatggcactaacacgaccacagcacccgggacttctcagtcacctaagccaccggccagtaccacaccccctcataccccagaaagctccactgtcaaactgacaacccccacgtctgagactgaaggatcgggcgagaccacacctccacccaatactacccagggtctacctccaccggggacaacccccgaaagacctgcgacgactgctacatcaaccagcagtactgacaacatgaactccacaacccaggttacggataataccccaacatctactgtgagcacctccccctcaagtagcccttctatgccatccacatcacaagggattcactatcccgtaaggagcctcctgagtgtgtcttccccgaagactgtcaccacacctacccccatgagcccaggcgagatgtcgcctgagacttcttcccagcattcagccatgagtcggatacccacgctttacacagcagcccaggtgagcaccgaaaatgctaaccgctccactccacgacagtctgagagctcagcacaacccgccacccagagtcctacaacctttccagctcagactatcctgttgatgtccgccgcgccgaaagcaattcaggacatgcaccccagccctacaaatcgttctaagagaaacctcgaagttgagatcattctgacgctgtcacaaggcctcaaaaagtattacgggaagatcttaaaactgcttcacttgaccctggaggaagatactgagggactactcgaatggtgtaagaggaatctgggtagtaactgcgacgatgacttctttcagaaacggatagaggagttctttatcacaggcgaagggtatttcaatgaggtgcttcagtttaagaccctgagcacattgtccccaactgaaccctctcatgtccgcctccctaccgccgagccattcaaatcgtactttgctaagggattcctgagcattgattccggctatttttcagccaagtgttaccccagaagttctacgagcggtttacaactgatcaacgtgacccagcacccggcaaggattgctgaaacacctgggccaaaaactacctccctcaagacaatcaattgcataaaccttcgggcctcagtattcaaagagcatcgcgaagttgagattaacgtgctgttgccccagatcgcggtcaatctaagcaactgtcacgtggtgatttactctcacgtctgcgactattccctggatactgacggacctgttcgactccccagaatccatcacgagggcacctttatcccaggcacgtacaagattgtgatagataaaaagaataaactgaacgacaggtgtagtcttgtaacaaattgcgtgatcaaggggcgggaagtccgtaagggacagagcgtgctgcgccaatataaaaccgagattaagatcggtaaagcctctactggctccagaaagttgctctcagaggaacctggggatgactgtataagtaggacacagctgttaaaaaccgaaactgcagagattcatgacgataactacggaggccccggtgacaagatcaccatctgcaatgggagcacaattgttgatcagcggctgggctcggagctaggatgttatacgatcaaccgagtgaagtccttcaaactctgcgaaaattctgctaccggcaagacttgcgagattgacagcacaccagtcaaatgtcgccaggggttctgcctgaagataacccaagaaggaagaggtcacgtgaaactttcaaggggcagtgaggtagttttggatgcctgtgactcctcttgcgagatcatgattccgaaggggacaggagatatcctggtggactgtagcggcggtcagcagcattttctcaaggataacctgatcgaccttgggtgccctcacattcccctgttgggcaaaatggctatatacatctgtcggatgtccaatcacccacgcactaccatggccttcctcttttggttctcatttggatatgtcattacgtgcatcttctgtaaggcactgttttacagcttaattatcataggcacactggggaaaaagatcaaacagtacagagaactaaagccccaaacctgcactatttgtgagaccgcccctgtgaacgctatcgatgcggaaatgcatgacctcaattgcagttataacatttgcccatactgtgcatctaggctgacatccgacggacttgcccgtcacgtcactcagtgccccaagcggaaagagaaggtggaagagaccgagttgtatctgaatctcgaacgaatcccttggatagttagaaaactgttacaggtgagcgagtcgacaggtgtagctctgaagaggtcatcttggcttattgtcttgctcgtgctgctaacggttagtctgtccccggtgcagagcgccccagtcggccatgggaaaaccatcgaaacttaccaaacacgcgagggattcaccaacatttgtctctttatgctgggctctatccttttcatagtgagctgcttggtaaagggtctggtggattccgtttcagactcatttttccccgggttaagcgtctgtaaaacttgctctatcggctccattaacggatttgaaatcgagtcacacaagtgttattgcagtctcttctgttgcccttactgtcggcactgcagcgcagatagagagattcatcagctgcaccttggcatctgcaagaaaaggaagacagggtccaatgtgatgctggccgtgtgtaaacgcatgtgcttcaaggctaccatagaagcctctcgacgggcattgccaattcgttcgatcatcaacacgacttttgtcatttgtatcctcaccctggcgatttgcgttgtgagcacatcagctgtggagatggaaaatctacccgccggaacctgggagagagaagaggacctgactaacttctgtcatcaggagtgccaagtaacagaaaccgagtgtctctgcccttatgaagcactggtccttaggaaaccgttgtttctggattccatagtgaagggcatgaagaatttactcaacagtacatctctggagactagcctttccatcgaggccccctggggtgctattaatgttcagtcaaccttcaaaccaacggtgtctacagccaacatcgcactgagctggagttccgtcgaacaccgcgggaataagattctagtgaccggacggagcgagtctatcatgaaactcgaagagagaactggcgtttcatgggacctgggtgtggaagatgcttccgagagtaagttgctgaccgtaagcataatggacttatcgcagatgtactctcctgtctttgagtacctctccggcgatcgacaggtggaagagtggcccaaagccacatgtactggggactgcccagaaaggtgtggatgcaccagctcaacgtgcctgcataaggagtggcctcacagtcgcaactggcggtgtaatcccacatggtgctggggcgtggggaccggatgtacttgctgtggcgtcgatgttaaggaccttttcacagatcacatgtttatcaaatggaaggtggaatatattaaaaccgaggcgatcgtatgcgtggagctgacttctcaagaaagacagtgttccttgattgaggccggtacaaggttcaacctcgggccagtcaccatcacgctgagcgaaccgcgtaatatacagcagaagctacctcccgagattatcactctgcatccaaaaatcgaagagggatttttcgaccttatgcacgtgcaaaaggttctctcagctagtaccgtgtgcaagctgcagagctgtacacatggcattcccggtgacttgcagatataccacatcggcaacctgttaaaaggggatcgcctcaatggacatctgattcacaagatcgagcctcactttaacacctcctggatgtcttgggacggctgcgatcttgactattactgtaacatgggggattggccaagctgcacatatactggagtcacccagcataatcacgcagccttcgtgaacctgttgaatattgaaacggactacacaaaaacttttcatttccactccaagcgggttaccgctcacggcgatacaccccaactcgacctgaaagccagacctacctatggtgcaggggagatcactgtgctagtcgaagtagcggatatggagctgcataccaagaaagtggaggtttcaggacttaagttcgcctctctcgcttgcacaggctgttacgcctgcagttcgggtataagctgtaaggtgaggatccacgtcgacgaaccggatgagctgacggtgcatgtaaaatcctctgacccagatgtggtcgcagcttcaactagcttgatggcccgaaagttagaatttggcaccgactccacattcaaagcatttagtgccatgcccaagacctctctgtgcttctacattgttgagcgggaatattgtaaaagctgctcagaggacgatactaagaagtgtgtggacacaaaactcgagcagcctcagtccatcctgattgaacacaaggggaccatcataggaaaacaaaacgatacgtgcactgctaaggcgagttgttggcttgagagcgtgaaatcctttttctacggcctgaagaatatgttggggtctgtctttggaaacttctttgtgggcattctactgttcctcgccccctttgttctgcttgcattattcttcatctttggttggaagatcctgttctgctttaaatgttgccgcagaacaaggggactcttcaagtatcggcatttgaaagacgatgaagagaccggataccgaaagattatcgaaagactgaatagtaaaaagggcaagaaccgcctcctggacggcgagaggcttgctgatcgtaaaatagccgagctgtttagcaccaagactcacattgggtga

SEQ ID NO: 10410 - RNA, 5052 nt, synthetic construct
  misc_feature 1..5052: note = derived and/or modified CDS sequence (opt3) from CCHFV(Ast137)__KX056057.1__GP
  source 1..5052: mol_type = other RNA
atgcacaccctgctcgtgtgcttcatcctttacctgcagttgagcggcttagggggagcccatggtcaatccaacgctacagagcacaatggcactaacacgaccacagtgcccgggacttctcagtcacctaagccaccggcaagtaccacactgccccatacccctgaaagctccactgttaaactaacaaccccaacgtctgagactgaaggatcgggcgagaccacaccccctccaaatactacccagggtttaccccctccagggacaaccccggaaagacccgccacgactgcgacatcaaccagcagtactgacaacatgaactccacaacccaggtgacggataatacccctacatctactgtaagcatttccccatcaagtagcccctctatgccttccacctcacaaggaatacactatccagtgaggagcctgcttagtgtctcttcccccaagacagtgactaccccgacacctatgagccccggcgagatgtcgccagagacctcttcccagcattcagctatgagtcggatccctactctgtacacggccgcacaggttagcacagaaaataccaaccgctccactccccgacagtctgagagctcagcccaaccagctacccagagtcccacaacctttcctgcacagactattttgctcatgtccgccgctccaaaagccatccaggacatgcacccgagccccacaaatcgttctaagagaaacctggaagtggagattatcctgacgctctcacaaggcctcaaaaagtattacgggaagatactgaaacttttgcacctgaccctagaggaagatactgagggactcctggaatggtgtaagaggaatcttggtagtaactgcgacgatgacttctttcagaaacggatcgaggagttctttattacaggcgaagggtatttcaatgaggtcctgcagtttaagaccttgagcacactctcccctactgaaccatctcatgtgcgcctgcccaccgcggagcctttcaaatcgtactttgcaaagggattcttaagcatcgattccggctatttttcagccaagtgttacccaagaagttctacgagcggtctgcaactcattaacgtaacccagcaccccgctaggatcgccgaaacaccggggcctaaaactacctcccttaagacaataaattgcattaacctgcgggcatcagttttcaaagagcatcgcgaagtggagatcaacgtcttgctaccacagattgctgtgaatctgagcaactgtcacgtggtcatcaattctcacgtttgcgactactccctcgatactgacggacccgtgcgactgcctagaatccatcacgagggcacctttattcccggcacgtataagatagtaatcgataaaaagaacaaacttaatgacaggtgtagtctggtgacaaactgcgtcattaaggggcgggaagtgcgtaagggacagagcgttttgcgccaatacaaaaccgagatcaagataggtaaagcctctactggctccagaaagctcctgtcagaggaaccaggggatgactgtattagtaggacacagttactgaaaaccgaaactgcggagatccatgacgataattatggaggccctggtgacaagatcaccatttgcaacgggagcacaatcgtggatcagcggctaggctcggagctcggatgttacacgattaatcgagtcaagtccttcaaactgtgcgaaaactctgccaccggcaagacttgcgagatagacagcacacccgtgaaatgtcgccaggggttctgccttaagatcacccaagaaggaagaggtcacgtaaaattgtcaaggggcagtgaggttgtgctggatgcatgtgactcctcttgcgagattatgatcccaaaggggacaggagatatcctcgtcgactgtagcggcggtcagcagcattttctgaaggataatcttattgacctggggtgcccgcacatacctttgctcggcaaaatggctatccacatttgtcggatgtccaaccatccccgcactaccatggccttcctgttttggttctcatttggatatgtgatcacgtgcattttctgtaaggctttattttacagcctgatcataatcggcacactagggaaaaagattaaacagtatagagaactcaagccacaaacctgcactatctgtgagaccgcccccgtcaatgcaattgatgccgaaatgcacgacctgaactgcagttacaatatctgcccttactgtgcttctaggcttacatccgacggattggcgcgtcatgtgactcagtgcccaaagcggaaagagaaggttgaagagaccgagctgtatctcaacctggaacgaataccctggattgtgagaaaattactgcaggtaagcgagtcgacaggtgtcgcacttaagaggtcatcttggttgatcgtgctcctggttctactgacggtgagtctctcccctgtccagagcgccccggtgggccacgggaaaaccattgaaacttaccaaacacgcgagggattcaccaacatctgtctgtttatgcttggctctatattgttcatcgtaagctatctggtgaagggtttagttgattccgtctcagactcatttttcccagggctcagcgtgtgcaaaacttgttctattggctccatcaatggatttgaaattgagtcacacaagtgctactgtagtctgttctgctgtccctattgccggcattgtagcgctgatagagagatccaccagcttcatctgggcatatgcaagaaaaggaagacagggtccaacgtgatgttggccgtctgcaaacgcatgtgtttcaaggcaaccattgaagcctctcgacgggctctcctgatccgttcgatcattaatacgacttttgttatctgcattctaaccctggccatatgtgtggtgagcacatcagcagtagagatggaaaacctccctgcgggaacctgggagagagaagaggacctgactaatttctgccaccaggagtgtcaagtcacagaaaccgagtgcctttgtccatacgaggctttggtgctgaggaaacccttatttctcgattccatcgttaagggcacaaagaacctgcttaatagtacttctctggaaaccagcctatccattgaggccccttggggtgcaatcaacgtgcagtcaacgttcaaaccgacagtctctaccgccaatattgctctcagctggagttccgtggaacatcgcgggaacaagatcctggttactggacggagcgagtctataatgaaattggaagagagaaccggcgtgtcatgggacctgggtgtagaagatgcctccgagagtaagttactcacagtcagcatcatggacctgtcgcagatgtattctcccgtgtttgagtacctttccggcgatcgacaggtggaagagtggccaaaagcaacttgcaccggggactgtcctgaaaggtgcggatgtacgagctcaacatgcctgcacaaggagtggccccacagtcgcaattggcggtgcaacccaacctggtgttggggcgtcgggactggatgcacatgttgcggcgttgatgtgaaggacttgttcaccgatcatatgtttattaaatggaaggtagaatacatcaaaactgaggctattgtgtgtgtcgagctcacatctcaagaaagacagtgctccctgatcgaggccggtaccaggttcaatctagggcctgtgacgataactctgagcgaaccccgtaacattcagcagaaacttccaccggagatcatcaccctccaccctaaaattgaagagggatttttcgacctgatgcatgttcaaaaggtgttgtcagcgagtacagtctgtaagctgcagagctgcacccacggcatacccggtgacttacagatctatcatattggcaatctcctgaaaggggatcgccttaacggacacctgatccacaagattgagccacattttaacacatcctggatgtcttgggacggctgtgatttggactactattgcaatatgggggattggcccagctgtacttacaccggagtgacgcagcacaaccatgccgctttcgttaatctcctgaacatcgaaacagactatactaaaacctttcacttccactccaagcgggtgacagcacatggcgatacccctcaactagacctgaaagccagaccaacttacggtgctggggagataaccgtccttgtagaagtggccgatatggagctccacacaaagaaagttgaggtgtcaggactgaagttcgcatctttggcgtgcacgggctgctatgcctgtagttcgggtatcagctgcaaggtcaggattcatgtggacgaacccgatgagttaactgtacacgtgaaatcctctgaccctgatgtcgttgctgcctcaaccagcctgatggcacgaaagctcgaatttggcacagactccaccttcaaggcttttagtgccatgccgaagacttctctgtgtttctacatcgtggagcgggaatactgcaaaagctgttcagaggacgatacaaagaagtgcgtggacaccaaacttgagcagccacagtccattctgatcgaacataaggggacgataattggaaaacaaaatgatacttgtacagcaaaggccagttgctggttggagagcgtcaaatcctttttctatggcctaaagaacatgctggggtctgtgtttggaaatttctttgttggcatcctcctgttccttgctccctttgtattactggtcctcttcttcatctttggttggaagattttgttctgttttaaatgctgtcgcagaaccagggggctgttcaagtaccggcacctcaaagacgatgaagagaccggatatcgaaagatcatagaaagactgaacagtaaaaagggcaagaatcgccttctggacggcgagaggttggcggatcgtaaaattgccgagctatttagcactaagacacacatcgggtga

SEQ ID NO: 10411 - RNA, 5055 nt, synthetic construct
  misc_feature 1..5055: note = derived and/or modified CDS sequence (opt3) from CCHFV(C-68031)__DQ211629.1__GP
  source 1..5055: mol_type = other RNA
atgtacactcccctgctctgcgccgtgctttgtctgcagttgtggagcttagagggctcccacgggctgtctaacaagacacaacattcaaataccagtacgaccaaagctcctgaagtcagccaggagttcggactaccagtttccacagtgtctactatcacctcggacccgccctcaattacaagcgcagtaagtgtgtccggttctgaaggcagcggggataccaacacttccccttcagtcacaacccagggactcacgctgccagagactacccttgaactgttgacaactaccgacacagatgccagtagcaccgtggttgtggacgtctctacgcagactgtgaaggatacacccatatccaccactcacacatcactccctagcaccccaagtgcgcccacgacccctcaaggcacacatcacactgctagaggtctgctgtctgtaacctccacaaaaccagagggggccagcactcaggcaaatccggagaagatctcgatggaaaccaactctcccaggctcgccatttccgagacaccttcatttagtccaaccactcaggctcccacggaaaatagcaaccctatcacatccaaacagttaattctgtctgcacaaccagttacccccaatccggtgactcctcccgtccagccagcccttagccagtcagacaccagtacagctatccaggatatacatccttcccccaccagccggtctaagcgcaacttggagatggagatcattctgactctatcacaaggactcaagaaatattacggcaagatcctgaaacttctggacttgacactcgaagaggatacggaaggcctgttagagtggtgcaagcgaaatctggggctcgtgtgtgacgatgacttctttcagaaacgtattgaagagttctttcttaccggagagggtcacttcaacgaagtgctgcagtttaagactccaagtacattgagccccaccggccctgccagaacagggtccccaactgtcgagccgttcaagtcttattttgcgaaaggattcctatcgatggatagcggctacttttccgcaaagtgctatcccagggcctcaaatagtggtctgcaactcatcaacgttacccagcactctacgcggataaccgacacacctgggccaaaagtgactaatctgaagaccattaactgtatcaatcttaaagctagcgtattcaaggaacatcgcgagattgaaatcaacgtgctgttgccccaggtcgccgtgaacctctcctcatgccacgttctgatcaaaagccatgtgtgtgactactctttagatattgacggacctgtcagactgccaaggatacaccacgagggcacatttatccccggcacttataagctagtgattgataagaaaaataagcagaacgaccggtgcaccctcatcacgaattgtgtaataaaagggcgcgagattcgaaagggacaatccgttctgagacagtacaggacagaaatcaaaatcggtaaggcaagtagcggctctcggcgtcttttgtccgaggaatcaggggatgactgcattagtcgcacccagctgagcagaactgagacagctgaaatccattcggataactacggaggcccgggtgacaagattaccatatgtaatgggtccactatcgtggatcagaggctcggctctgagctgggatgctataccattaaccgggtcaagagcttcaaactttgcgaaaattcagccacaggcaaaagttgtgaaatcgactccacgcctatcaagtgccgacaagggttctgtctgaaaattacccaggagggacgcggtcacgtgaagttgtctagaggcagcgaagtcgtgctcgatgcgtgcgactcctcatgtgagataatgatcccaaaggggactggagacattctggttgattgcagcggcggtcagcagcattttcttaaagacaacctgatcgatctagggtgtcccaatattcctctcctgggcaagatggccatctacatatgcaggatgagtaaccaccccaaaacaaccatggcattcttattttggttctcttttggatatgtgatcacatgtattttgtgcaaggtaatcttctacctgctcattgtcgtgggcactctggggaaaaagtttaagcaatatcgggagttaaaaccacagacctgtacgatctgcgaaacaacccctgttaatgctatagacgccgagatgcatgatctgaactgctcctacaatatttgtccctattgcgctagccgccttacttcggacggattggccagacacgtgatgcagtgtccaaagaggaaagaaaaggtcgaggaaaccgagctctacctgaacctagagcgtatcccgtgggtggtacggaaactgctccaggtgtcagaatctacaggtgttgcactgaagcgaagttcctggcttgtcgtgttgctggtgttactcactgtcagcctgtctcctgttcaaagcgcccccattggccacgggaaaaccgtggagacataccagacgagagaaggatatacctccatctgccttttcgtgctgggctcaatattgtttatcgtaagttgtctcatgaagggtctggtcgatagcgtgggcaattctttctttccagggctatccatttgcaagacttgttcaatcggaagtattaacggcttcgagacagaaagccataaatgctactgttccctgttttgctgtccctattgcaggcactgctctgctgaccgcgagatccataagctccacctgtcgatatgtaaaaagcggaaaaccgggagcaacgttatgcttgcggtgtgcaagagaatgtgtttcagggcaactgtcgaggtgtcaaataaggccttgctgattcgcaacatcatcaatacaaccttcgttgtgtgcattttaatcctcgctgtatgtgtcgtgtccacgagtgccgtggaaatggagtctctgcctgcaggaacttgggaacgagaggaagatcttaccaacttttgccaccaggagtgtcaagtcacagagaccgaatgcctgtgtccatacgaggccctagttctccggaaacccctgttcagcgactccattgtgaagggcatgaaaaatttgctgaactcaacttctttagaaacaagcctcagtatagaggctccttggggtgccatcaatgtacagtccacctttaagccgacagtgagcgcagcgaacattgctctgtcttggtcatccgtcgagcatcgtgggaataaaatccttgtgagtggaagaagcgaatcgattatgaagctggaggaaaggactggcatctcttgggatttgggtgttgaggacgcctccgaaagcaagctcctgaccgtgtcaataatggatctaagtcagatgtattctccagtcttcgagtacctgtccggcgaccgccaggtggaggaatggcccaaagcaacgtgcacaggggactgtcctgagcggtgcggatgcaccagctcaacttgtcttcacaaggaatggccacatagtagaaactggaggtgcaatcccacctggtgttggggcgttgggacaggatgcacttgttgcggcctcgatgtgaaagacctgtttaccgattatatgttcgtcaagtggaaagtagagtacatcaagacggaagccattgtgtgtgttgagttgacaagccaagagcgacagtgctccctgatcgaagctggtacccgctttaacttagggcctgtgactattacactctctgagccgcggaatatccagcagaagctgcccccagaaatagtcacccttcaccctagaattgaggaaggattctttgacctgatgcatgtgaaaaaggtattgagcgcctccactgtgtgtaaactccaatcatgcacacacggcgtccccggtgatctgcaggtttaccacatcggcaacctactgaagggggacaaagtgaatggacatcttatccacaagattgagccacatttcaacacctcttggatgagttgggatggctgtgacctcgattattactgcaacatgggggactggccttcgtgcagctatacgggagtgactcagcacaatcatgcagcttttgtcaacatgctgaatatagagaccgattacacaaaaatcttccactttcactccaagagggtgaccgcccatggcgacacaccccagttggatttaaaggcgcgtccaacttatggtgccggggaaattaccgttctggtagaggtggctgacatggaactccacacgaaaaagatcgagatttctggactgaaattcgcatcacttacatgtactggctgctacgcctgtagctccggtatcagttgcaaggtccgcatacatgtggacgagccggatgaactgaccgttcacgtgaaatctgaggaccctgatatcgtcgctgccagctcatccttgatggcacggaagctagagttcggcacagacagtacctttaaggcgttcagcgccatgcccaaaacttctctgtgtttttatattgtggagagagaatactgcaagtcctgttcaaaagaggatacccaaaagtgcgtaaacacaaaactcgagcagccacagagcatcctgattgaacacaaggggacgatcataggaaagcaaaatgacacttgtacctcgaaagctggctgctggcttgagtctgtcaagagtttcttttacgggcttaaaaacatgctgtccggaattttcggcaatgtgtttatcggtatcttcctctttttggcccccttcattctgctcatcctgtttttcatgttcgggtggaggatattattttgtttcaagtgctgccgacggacacgcggactgtttaaatatagacatttgaaggatgacgaagagaccggctacaggaagattatcgaacggctaaacaataaaaagggcaaaaacaagctgctcgatggggagcgattagcagacagaaaaattgctgagctgttcagcactaagacacacatcggatga

SEQ ID NO: 10412 - RNA, 5052 nt, synthetic construct
  misc_feature 1..5052: note = derived and/or modified CDS sequence (opt3) from CCHFV(K340_6)__KX013475.1__GP
  source 1..5052: mol_type = other RNA
atgcacaccctgctcgtgtgcttcatcctttacctgcagttgagcggcttagggggagcccatgtccaatccaacgctacagagcacaatggtactaacacgaccacagcacccggcacttctcagtcacctaagccaccggccagtaccacactgccccatacccctgaaagctccactgttaaaccaacaacccccacgtctgagactgaagggtcgggagagaccacacctccacccaatactacccagggcctacctccaacaggtaccacgccggaaagatcagcgactacagctaccagcacaagttccacagacaacatgaatagcaccacccaggtgaccgatagcacacccacttccaccgtatcaacaagtccttcttcttcctcaagcatgccaagtacttctcaagggattcaccatcccgtgaggtccctcctgagcgtctcgtctcctaagaccgtgacaaccccaactcccatgtccccgggagagatgtcacctgagacgagtagccagcactccgccatgtctcgggttcccacactttataccgcaactcaggtgagcaccgaaaacacagaccgctcaaccccacgacagagtgagtccagcgtccaacctgccactcagtctcccataacatcaccagctcagacgatcctgttgatgagtgcagcccccaaagctattcaggatatgcaccctagcccaaccaatcgttccaagagaaacctcgaagtggagatcattctgactctgtctcaaggcctcaaaaagtactatggcaagatcttaaaactgcttcatttgacactggaggaagacaccgaggggctactcgaatggtgtaagaggaatctgggatcgaactgcgatgacgactttttccagaaacggatagaggaatttttcatcacaggtgagggctactttaatgaggtacttcagttcaagactctgagcaccttgtccccgacggaaccctcacacgttcgcctccctaccgccgagccatttaaaagttatttcgcgaaggggtttctgtctattgatagcggatacttctccgcaaagtgttatcccagatcaagcacatctggcttacaactgatcaacgtgactcagcatcctgccaggattgctgaaaccccaggtcccaaaacaacttccctcaagaccatcaattgcataaaccttcgggccagtgtctttaaagagcaccgcgaagtggagattaatgtgctgttgccgcagatcgcagtcaacctaagcaactgtcacgttgtgattaattctcatgtatgcgattactccctggacacggatgggcctgtgcgactcccaagaatccaccatgagggaacattcatccccggcacctacaagattgtcatagacaggaaaaacaagctgaatgatcggtgttcacttgtgactaactgcgttatcaaaggccgtgaagtgcgcaaggggcagagtgtcctgagacaatataagacagagattaaaatcggaaaggctagcaccggttcgaggaaattgctctccgaggaacctggcgacgactgtatatctcggactcagctgttaaagaccgaaacagccgagattcacgatgacaattacgggggacccggcgataaaatcacgatctgcaacggtagcaccattgtggaccagcgactggggtcagagctaggctgttatactatcaatcgcgtaaagagttttaagctctgcgaaaactccacaaccggaaaaacatgcgagattgattctactccagttaagtgtagacagggcttctgcctgaaaataacccaagaagggaggggacatgtgaagctgagccggggttccgaggtcgtgttggacgcgtgtgattcaagctgcgagatcatgattcctaaaggcacgggggacatcctggtcgattgtagtggaggccagcagcacttcctcaaggacaatctgatcgatcttggttgcccccacattccaccgctggggaagatggccatatacatctgtcgcatgtctaaccatcctagaacaaccatggcatttttgttctggttttccttcggctatgtgattacttgcatcttttgtaaagctctcttctacagcctgattatcataggaaccttaggcaagaaaatcaagcagtatagggaactgaaaccccaaacatgcactatttgtgagaccgccccagttaatgctatcgacgccgaaatgcacgacctaaactgctcgtacaatatttgcccctactgtgcatcacgtctcacatctgatgggctggcccggcatgtgacgcagtgccctaagcgaaaggagaaagtagaagagaccgagctttatttgaacctggaaagaatcccatggatagtcaggaagctccttcaggtgagtgagtccactggagttgctttaaaacgcagctcttggctgattgtgcttttggtcctcctgacagtgagcctatcccccgtacagtcagcgcctgtgggtcacggcaagaccatcgaaacttaccaaacacgggaggggtttaccagtatttgtctgttcatgctcggaagcatcctgtttatagtttcttgccttgtcaaaggcttggtggactccgtgtcagatagtttctttccgggtctgagcgtctgtaagacgtgctccatcgggtctattaatggcttcgaaatcgagtcgcacaaatgttattgcagcttattttgttgcccatactgtagacattgctcagcagacagggagattcaccagctccatctgtccatctgcaagaagcgcaaaactggaagtaacgttatgcttgccgtgtgtaagcgaatgtgcttcaaagctaccatagaagcctctcggcgtgcactgttgattagaagcatcatcaacacaaccttcgtgatgtgtattctcactctggccatctgcgtagtctccacatcagctgtggagatggaagatctacccgccggcacctgggagagggaagaggacctgacaaatttttgtcaccaggagtgccaagttactgaaaccgagtgtctctgcccttatgaagcactggtgcttcgcaagccattgtctctggatagcattgtcaaagggatgaagaacttactcaatagtacgtccctggagacaagcctttctatagaggcgccctggggagctatcaacgtgcagtcaaccttcaagcctactgtttccaccgccaatattgcactgagttggagctcggtggaacatcggggcaacaaaatcctagtaacaggtagatctgagtccattatgaagctcgaagagaggactggggtcagctgggacctgggagtggaagatgcctcagagagtaaattgctgaccgtgtctatcatggacttatcccagatgtacagcccggtctttgagtatctctcaggcgatcgacaggttgaagagtggcccaaggctacgtgtacaggtgactgcccagaacgctgtggctgcaccagtagcacttgcctgcacaaagagtggcctcactcccggaattggagatgtaaccccacatggtgctggggtgtgggaaccggctgtacttgctgtggggtagatgtgaaggaccttttcacagaccatatgtttataaagtggaaagtcgaatacatcaagaccgaggccattgtgtgcgttgagctgacgtctcaagaaaggcagtgtagcttgatcgaggcaggaactcgtttcaatctcggcccagtgaccattacactgtccgaacctcgcaacatccagcagaaactacccccagagataattaccctgcacccgaagatcgaagaggggtttttcgatcttatgcatgtccaaaaagtgctctcagcttctacagtttgcaagctgcagagttgtactcacgggatccctggagacttgcagatttaccatataggcaatctgttaaagggtgatcgggtgaacggccacctcatccacaaaattgagccccattttaatacctcgtggatgagctgggacgggtgcgatctggactattactgtaacatgggagattggccatcctgcacgtatacaggcgtcactcagcacaatcatgccgcgttcgtaaaccttctgaacatcgaaaccgactacacaaagacctttcacttccactctaaaagagtgactgcccatggggatacgccccaattggacctcaaggctaggcctacatatggagcaggcgagattacggttctggtggaagtcactgatatggagctacacaccaaaaaggtggagatctcaggtctgaaatttgccagccttacatgcaccgggtgttacgcttgctccagtggaatatcttgtaaggtacgaatccatgtggacgaaccagatgagctcactgtccacgttaagagctcagaccccgacgtggtggccgcatccacaagtctgatggcgcggaaattggagttcggcaccgatagcacgttcaaggccttttctgctatgcctaaaacttccttatgcttctatattgtcgaacgcgaatactgtaagtcatgcagcgaggacgatactaaaaagtgtgtggacaccaagctggagcagccgcagtcgatcctcattgaacataaaggtaccatcataggcaagcaaaatgatacttgcacagccaaagcatcttgttggctggagagtgttaagtcctttttctacgggcttaaaaacatgctgggaagcgtatttggctcattctttgtggggattttgctattcctggctccatttgtcctcctggtgcttttctttatgttcggatggaagatcttattctgctttaagtgttgcagaaggacccggggcctgttcaaatatcgacactttaaggacgatgaagagacaggttacagacgcatcattgaaaggctcaattccaaaaaggggaaaaaccgtttgctggacggagagcggctcgccgatagaaagatcgcagagctgttctctactaagacgcacataggctga

SEQ ID NO: 10413 - RNA, 5055 nt, synthetic construct
  misc_feature 1..5055: note = derived and/or modified CDS sequence (opt3) from CCHFV(Hy13)__AY900145.1__GP
  source 1..5055: mol_type = other RNA
atgtacactcccctgctctgcgccgtgctttgtctgcagttgtggagcttagagggctcccacgggctgtctaacaagacacaacattcaaataccagtacgaccaaagctcctgaagtcagccaggagttcggactaccagtttccacagtgtctactatcacctcggacccgccctcaattacaagcgcagtaagtgtgtccggttctgaaggcagcggggataccaacacttccccttcagtcacaacccagggactcacgctgccagagactacccttgaactgttgacaactaccgacacagatgccagtagcaccgtggttgtggacgtctctacgcagactgtgaaggatacacccatatccaccactcacacatcactccctagcaccccaagtgcgacgaccacaccccaaggcactcatcacaccgctagaggtctgctgtctgtaacatccactaaacctgagggggccagcacccaggcaaatccagagaagatctcgatggaaacaaactctccgaggctcgccatttccgagaccccctcatttagtcctactacgcaggctccaacagaaaatagcaaccccatcacctccaaacagttaattttctctgcacaacctgttactccaaatcccgtgaccccgcctgtccagcccgccctgagccagtcagacacaagtaccgctatccaggatatacatccatcccctactagccggtctaagcgcaaccttgagatggagatcattttgacactgtcacaaggactaaagaaatattacggcaagatcctcaaactgcttgacctgacgttggaagaggataccgaaggcctcctggagtggtgcaagcgaaatttagggctggtgtgtgacgccgactttttccagaaacgtattgaagagtttttcctcactggagagggtcactttaacgaagtgcttcagttcaagacacccagtaccctgagcccaacaggccccgcgagaactgggtcccctaccgtcgagccatttaagtcttatttcgcaaaaggatttttgtcgatggatagcggctacttctccgccaagtgctatccgagggcttcaaatagtggtctacaactgatcaacgttacgcagcactctacccggataacagatactcccgggcctaaagtgaccaatctcaagacaattaactgtatcaatctgaaagccagcgtatttaaggaacatcgcgagattgaaatcaacgtgcttctgccacaggtcgcagtgaacttgtcctcatgccacgttctcatcaaaagccatgtgtgtgactactctctggacattgatggacccgtcagattacctaggatacaccacgagggcactttcatcccaggcacctataagctggtgattgacaagaaaaataagcagaacgatcggtgcacgctaatcacaaattgtgtaataaaagggcgcgagattcgaaagggacaatccgttctcagacagtacaggaccgaaatcaaaatcggtaaggctagtagcggctctcggcgtctgctttccgaggaatcaggggacgattgcattagtcgcactcagttgagcagaacagagaccgccgaaatccattcggacaactacggaggccccggtgataagattactatatgtaatgggtccaccatcgtggaccagaggctgggctctgagctcggatgctatacaattaaccgggtcaaatctttcaagctgtgcgaaaattcagcgacgggcaaaagttgtgagatcgattccaccccgatcaagtgccgacaagggttttgtcttaaaattactcaggagggacgcggtcacgtgaagctgtctagaggcagcgaagtcgtgttggacgcctgcgattcctcatgtgagataatgatccctaaggggacaggagacattctcgttgactgcagcggcggtcagcagcatttcctgaaagataacttaatcgacctggggtgtccaaatattcccctactcggcaagatggcaatctacatatgcaggatgagtaaccaccctaaaaccacaatggcttttctgttctggttttctttcggatatgtgatcacttgtattctttgcaaggtaatcttttacttgctgattgtcgtgggcaccctcgggaaaaagttcaagcaatatcgggagctgaaaccccagacgtgtacaatctgcgaaaccactccagttaatgccatagatgctgagatgcatgacttaaactgctcctacaatatttgtccttattgcgccagccgcctgacctcggatggacttgcaagacacgtgatgcagtgtcccaagaggaaagaaaaggtcgaggaaacagagttgtacctcaacctggagcgtatcccatgggtggtacggaaactattacaggtgtcagaatctactggtgttgccctcaagcgaagttcctggctggtcgtgcttttggtgctgttaaccgtcagcctctctccggttcaaagcgctcctattggccacgggaaaacagtggagacgtaccagaccagagaaggatatacttccatctgcctgtttgtgcttggctcaatactgttcatcgtaagttgtttgatgaagggtctcgtcgacagcgtggggaatagctttttccccggctcctcaatttgcaagacatgtagtatcggaagcattaacggctttgagatcgaatcccataaatgctactgttctctgttctgctgtccatattgcaggcactgctcggcggatcgcgagatacataagctacacctgagcatttgtaaaaagcggaaaaccgggtcaaacgttatgctcgcagtgtgcaagagaatgtgtttcagggccactgtcgaggtgtccaataaggctctgcttatccgcaacatcattaatacaacctttgttgtgtgcatcttgattctggccgtatgtgtcgtgagtacgtctgcagtggaaatggagagcttacccgccggaacttgggaacgagaggaagacctcaccaacttctgccaccaggagtgtcaagctacagagaccgaatgcctgtgtccttacgaggcccttgtcctgcggaaaccactattttccgattcaatagttaagggcatgaaaaatctcctgaactctactagcttggaaacaagtctgtccatcgaggcaccctggggtgcgattaatgtgcagagcaccttcaagcctacagtatctgctgccaacatcgcattatcatggtccagtgtggagcatcgtgggaataaaattctcgtcagcggaagatcggaatctatcatgaagctggaggaaaggactggcatatcctgggaccttggtgtggaggatgccagcgaatcaaagctgttgaccgttagtatcatggacctctctcagatgtattccccggtgtttgagtacctgagcggcgatcgccaggtcgaggaatggccaaaagctacgtgcacaggggactgtcccgagcggtgcggatgcacctcaagtacttgtctacacaaggaatggcctcatagcagaaactggaggtgcaatccaacctggtgttggggcgtggggacaggatgcacttgttgcggcctggacgttaaagatcttttcaccgaccacatgtttgtgaagtggaaagtcgagtatattaagacggaagccatcgtatgtgtggagctcacatcccaagagcgacagtgctctctgattgaagcaggtacccgcttcaacttggggcccgttactatcacactgagcgagcctcggaatatacagcagaagttaccgcccgaaattgtgaccctccatccaagaatcgaggaaggatttttcgatctgatgcacgtcaaaaaggtgctttccgcttcaactgtatgtaaactgcaatcttgcacacacggcgtgcctggtgacttgcaggtctaccatatcggcaacctcctgaagggggataaagttaatggacacctaattcataagatagagccccactttaacaccagttggatgtcgtgggacggctgtgatctggactactattgcaacatgggggattggccaagctgctcctacacgggagtgactcagcataatcacgccgcgttcgtgaacatgcttaatatcgagaccgactatacaaaaatttttcacttccattctaagagggtcaccgcccacggcgatacacctcagctcgacctgaaggctcgtcccacttacggtgcaggggaaatcaccgtgttggttgaggtagccgatatggaattacatacgaaaaagattgagatctcaggactgaaattcgctagcctcacatgtactggctgctatgcctgttccagtggtatatcttgcaaggtgcgcatccacgtcgacgagccagacgaactgaccgtgcacgttaaaagcgaggatccggacattgtggcagcgtcatccagtcttatggcccggaagctggaatttggcacagatagcaccttcaaggctttttctgccatgcctaaaacttccttgtgtttctacatcgtcgagagagaatattgcaagtcatgtagcaaagaggacacccaaaagtgcgtgaacacaaaactagagcagccccagtcgattctgatcgaacataaggggacgataattggaaagcaaaatgatacttgtacctctaaagcaggctgctggctcgagagtgtaaagtcctttttctacgggctgaaaaacatgcttagcggaatctttggcaatgtcttcatcggtatttttctgttcctggctccatttatcctcttgatactgttcttcatgtttgggtggaggattctcttctgttttaagtgctgccgacggacacgcggactgttcaaatacagacaccttaaggacgatgaagagaccggctataggaagatcattgaacggctgaacaataaaaagggcaaaaacaagttgctagacggggagcgactggccgatagaaaaatcgcagagctcttttcaactaagacacatataggatga

SEQ ID NO: 10414 - RNA, 5052 nt, synthetic construct
  misc_feature 1..5052: note = derived and/or modified CDS sequence (opt3) from CCHFV(4574-ST-2008)__KR814870.1__GP
  source 1..5052: mol_type = other RNA
atgcacaccctgctcgtgtgcttcatcctttacctgcagttgttaggccccgggggagcccatggtcaacctaacgctacagagcacaatagaactaacacgaccacagcaccaagcacttcccagtctccgaagccccctgtctcaaccgccccaccccatgcgctggagagtcctacaattaaaagcaccactccaacatccgagaccgaaggctctggggagacgacttcgccccctaataccacacagggaccatcactaccggaaactacccccaagaggcctgctacaaccgccacgagcactccaagtacagacaacaccaattccactacacacgttaccgataacaatcccacgtctaccataagcacatccccttcaagtagcccatctactccctccaccccgcggggcatccatcaccctgcacgcaacctcctgtcagtgagcagtcccaaaacagccactaccccaacacctacctctcccggtgagatttccagcgagacttcgtctcttcactccgctatgtcacgaacgagtacactgtataccgcaactcaggccagcaccgaaaatgctaaccattccgccccacgtcaatctgagagccccgcgcagcctacaaccacttcattgatgacaagtccagcacagtccatcctcgtaatgagcgccgctccgacggccattcagaatatccacccctctcctaccaacagatcaaagaggaatctggaaatggagataatcctgactctcagtcaagggctgaaaaagtactatggaaagattctgaaacttttgcatctgacactagaggaagacaccgagggcctcctggaatggtgtaagcggaaccttggcagcaattgcgaggatgactttttccagaaacgcatcgaagagtttttcatgacaggggagggatactttaacgaagtgctgcagttcaagactttgtccaccctctctccaacggagccctcgcacgcaagacctccaaccgtcgaaccctttaaaagctatttcgctaagggttttctgtccattgattcaggctacttcagtgccaagtgttatccgaggtctagcacatccgggttacagctgatcaacgtgactcaacaccctgcgcggatagccgagaccccaggacccaaaacaacttcactcaagaccattaattgcatcaaccttcgcgcaagcgtttttaaagaacatcgagagattgagatcaatgtgctgttgcctcagatcgctgtcaacctatctaattgtcacgtggtaattaactcccatgtttgcgactacagtctggatacggacggccccgtgagactcccacacatataccatgaaggtacattcatccctgggacctataagattgtcatcgataaaaagaataaactgaacgacaggtgtactcttgtgacaaattgcgtgataaagggacgggaggtccgtaagggccagagcgttctgcgccaatacaaaaccgaaattaagatcggcaaagtgtctactgggtccagaaagttgctctcagaggaaagtggagatgactgtatcagcaggacccagctgttacggacagagacggccgagattcacgatgacaactatggtggccccggggacaaaatcaccatttgcaatggatcgactatagtagatcagcgactgggctccgaactaggttgttacacaatcaaccgcgtgaagtcttttaagctctgcgagaatagcgctaccgggaaaacatgcgaaattgactcaactccagtcaagtgtagacagggcttctgcctgaaaatcacccaagagggaaggggccacgtgaaacttagtcgggggtccgaggttgtgttggatgcctgtgactctagctgcgaagtcatgatcccgaaaggaacgggtgatattctggtggactgttccggcgggcagcagcatttcctcaaggataacctgatagaccttggatgccctcacatccccctgttgggcaagatggcaatttatatctgtcgcatgtcaaatcatccaagaacaaccatggcctttctcttctggtttagcttcggttacgtaattacttgcctgttttgtaaggctttattctatagtctgatcataatcgggaccctaggcaagaaaattaagcagtacagggagctccgtccccaaacatgcactatctgtgaaaccgcgcctgttaacgcaattgatgccgagatgcacgacctgaactgctcttacaatatctgcccatattgtgcttcccggcttacaagcgatggattggcccgacacgtgccccagtgccctaaaagaaaggaaaaggtcgaggagacggaactgtacctcaacctggagaggataccgtggattgtgcgcaaattactgcaggtctcggaatcaaccggcgtggcacttaagcggtctagttggttgatcgttctcctggtgctactgactgtatccctcagcccagtccagtctgcccccgtggggcatggaaaaacaattgagacctatcaaactagagaaggttttacaagcatctgtctgttcatgcttggctccatattgtttctggtttcatgcttagtgaaggggctcgtcgacagtgtgagcgactctttctttcctggactgtccgtatgtaaaacctgctcaatcggcagtattaatggtttcgagatcgagagccacaagtgttactgctcccttctgtgttgcccatattgtaggcattgctctgctgatcgcgaaattcaccagttgcatctctcgatctgcaaaaagcgaaagacggggagcaacgtgatgctggccgtttgtaaacggatgtgctttcgtgcaactatagaggcgtcaagaagggctctactgattcgctccatcatcaataccacattcgtcatttgtatcctcaccctgactatttgcgtggtgagtacatctgccgtcgaaatggagaaccttcccagcggcacctgggaaaaggaggaggacttgacaaatttctgtcaccaggaatgccaggttactgagaccgaatgtctgtgcccttacgaggcattagtgctccggaaaccgctgtttcttgattccatagtgaagggaatgaaaaacctgctaaattcaacgtctctcgagacaagcctgagtatcgaagccccctggggcgctattaacgtacaatccaccttcaagccaactgtcagcaccgccaatatcgcattgtcttggtcatccgtggagcacagagggaacaagattctggttacaggaaggagtgaaagcatcatgaaattagaggaacgaactggcgtgtcgtgggacctcggtgtcgaggatgcttctgagtccaagctgcttaccgtgagcataatggacctgtcacagatgtatagtcctgtttttgaatacttgtctggggatcgccaggtggaggaatggcccaaagccacgtgtacaggagactgcccagagcggtgtggctgcacctccagcacttgcctccataaggaatggcctcactcaagaaattggaggtgtaaccccacatggtgctggggtgtaggcaccgggtgtacttgctgtggagtcgatgtgaaagacctgttcacagatcatatgtttgtgaagtggaaggtcgagtacatcaaaaccgaggcgattgtttgcgtggaactaacgagtcaagagcgtcagtgtagcctgatcgaagccggcactcgcttcaatcttgggccagtaaccattacactctccgagccgcggaacatccagcagaagctgcctcccgaaataattaccttgcacccaaaagtggaggagggatttttcgacctgatgcatgtccaaaaggtgttatctgctagcacagtttgcaaactccagtcctgtactcacggcatccccggtgatttacaggtgtatcacatcgggaaccttctgaagggagacagagtcaatggccatttgattcacaagatagaacctcattttaacacctcatggatgtcttgggacggttgcgatctcgactactattgtaatatgggcgattggccaagttgcacgtacacaggggtgactcagcacaaccacgcagccttcgttaatctgctaaacatcgagaccgactatacaaaaacctttcatttccactcgaagagggtgactgctcatggagatacaccccaactggaccttaaagcccgacctacctacggcgcaggggaaattacggtcctcgtagaggtggcggatatggagctgcacactaagaaagttgaaatcagcggattgaagtttgcctccttagcttgcaccggctgttatgcctgttcttcaggtattagctgcaaagtgcggatccatgtcgacgagccggatgaactgacagtgcacgtaaagtccagtgacccagatgtggtcgcagcttctaccagcctcatggcccgcaagctggagttcgggactgactcaacattcaaagcattttccgccatgcccaagaccagtctttgcttctacatagttgaaagagagtactgtaaaagctgctctgaggaagatacgcagaagtgtgtggacactaaactggagcagcctcagtccatcttgattgaacacaagggaacaatcattggcaagcaaaatgatacctgcaccgctaaagcgtcatgttggctagagagcgtgaagtcgtttttctatggtctgaaaaacatgctcggctctgtctttgggaatttctttatcggaatactgcttttcttagccccctttgtgctgctcgttttgttctttatgttcggctggaagattctgttctgctttaaatgttgcaggcgggcacgagggctcctgaagtacagacatcttaaggacgacgaagagactggatatcgcaaaatcatcgagaggctgaacaataagaaaggcaagaaccgtttgctagatggtgaacggctggctgacagaaaaattgccgaactcttcagtacaaagacccacatcgggtga

SEQ ID NO: 10415 - RNA, 5052 nt, synthetic construct
  misc_feature 1..5052: note = derived and/or modified CDS sequence (opt3) from CCHFV(75-ST-2010)__KR814864.1__GP
  source 1..5052: mol_type = other RNA
atgcacaccctgctcgtgtgcttcatcctttacctgcagttgttaggccccgggggagcccatggtcaacctaacgctacagagcacaatagaactaacacgaccacagcaccaagcacttcccagtctccgaagccccctgtctcaaccgccccaccccatgcgctggaaagtcctacaattaaaagcaccactccaacatccgagaccgaaggctctggggagacgactccccctccaaataccacacagggaccgtcgctacccgaaactacccctgagaggccagctacaaccgccacgtcaactcccagcacagacaacaccaatagtactacacacgttaccgataacaatcctacgtccaccatatctacaagcccatcctcaagtcccagcactccgtctacccctcggggcatccatcaccccgcacgcaacctcctgtccgtgtcaagcccaaagacagccactacccctacacccaccagtccaggtgagatttcttccgaaactagctcgcttcactctgctatgtcccgaacgtcaacactgtataccgcaactcaggccagtaccgagaatgctaaccatagcgcgccccgtcaatccgaatctcctgcccagccaacaaccactagcttgatgacatcaccggcacagagtatcctcgtaatgtccgccgctcccacggccattcagaatatccaccctagcccaaccaacagatctaaaaggaatctggagatggagataatcctgactctctcacaagggttaaagaaatactatggaaagattctgaagctgttgcatctgacactagaagaggacaccgaaggcctcctggagtggtgtaaacggaaccttggcagtaattgcgatgacgatttcttccagaagcgcatcgaagagtttttcatgacaggggagggatactttaacgaagtgctgcagttcaaaactttgagcaccctctcccccacggagccttctcacgcaagaccacccaccgtcgaaccgtttaagtcgtatttcgctaaaggttttctgagcattgactccggctacttctcagccaagtgttatcctaggagttctacaagcgggttacagctgatcaacgtgactcaacacccagcgcggatagccgagacccccggacctaagacaacttccctcaaaaccattaattgcatcaaccttcgcgcatcagtttttaaggaacatcgagagattgagatcaatgtgctgttgccccagatcgctgtcaacctaagcaattgtcacgtggtaattaactctcatgtttgcgattactccctggacacggatggcccagtgagactccctcacatataccatgaaggtacattcatccccgggacctataaaattgtcatcgacaagaaaaataagctgaacgataggtgtactcttgtgacaaattgcgtgataaaaggacgggaggtccgtaagggccagagtgttctgcgccaatacaagaccgaaattaaaatcggcaaggtgagcactgggtctagaaaattgctctccgaggaatcaggagacgattgtatcagtaggacccagctgttacggacagagacggccgagattcacgacgacaactatggtggcccaggggataagatcaccatttgcaatggaagcactatagtagaccagcgactgggctcggaactaggttgttacacaatcaaccgcgtgaaatcctttaagctctgcgaaaattctgctaccgggaagacatgcgagattgatagcactccggtcaaatgtagacagggcttctgcctgaagatcacccaagagggaaggggccacgtgaaactttcacgggggagtgaggttgtgttggacgcctgtgattcctcttgcgaagtcatgatccctaagggaacgggtgacattctggtggattgtagcggcgggcagcagcatttcctcaaagacaacctgatagatcttggatgcccccacatcccactgttgggcaagatggcaatttatatctgtcgcatgtccaatcatcccagaacaaccatggcctttctcttctggttttcattcggttacgtaattacttgcctgttttgtaaggctttattctatagcctgatcataatcgggaccctaggcaaaaagattaaacagtacagggagctccgtcctcaaacatgcactatctgtgaaaccgcgccagttaacgcaattgacgccgagatgcacgatctgaactgcagttacaatatctgcccctattgtgcttctcggcttacatccgacggattggcccgacacgtgcctcagtgcccgaagagaaaagaaaaggtcgaggagacggaactgtacctcaacctggagaggataccatggattgtgcgcaagttactgcaggtcagcgaatcgaccggcgtggcacttaaacggtcatcttggttgatcgttctcctggtgctactgactgtaagtctctcccccgtccagagcgcccctgtggggcatggaaagacaattgagacctatcaaactagagaaggttttacatctatctgtctgttcatgcttggcagcatattgtttctggtttcctgcttagtgaaagggctcgtcgactcagtgagtgatagcttctttccaggactgtctgtatgtaagacctgctccatcggctcaattaatggtttcgagatcgagagtcacaaatgttactgcagccttctgtgttgcccctattgtaggcattgctccgctgaccgcgaaattcaccagttgcatctctctatctgcaagaaacgaaagacggggtcgaacgtgatgctggccgtttgtaagcggatgtgctttcgtgcaactatagaggcgagcagaagggctctactgattcgctcaatcatcaataccacattcgtcatttgtatcctcaccctgactatttgcgtggtgtccacaagtgccgtcgaaatggagaaccttccttctggcacctgggaaaaagaggaggatttgacaaatttctgtcaccaggaatgccaggttactgagaccgaatgtctgtgcccgtacgaggcattagtgctccggaagcccctgtttcttgacagcatagtgaaaggaatgaagaacctgctaaattccacgtcactcgagacatctctgagcatcgaagccccatggggcgctattaacgtacaaagtaccttcaaacctactgtctccaccgccaatatcgcattgagctggtcttcagtggagcacagagggaacaagattctggttacaggaaggtccgaaagtatcatgaagttagaggaacgaactggcgtgagctgggatctcggtgtcgaggacgcttcggagtctaaactgcttaccgtgtccataatggatctgagccagatgtattcacccgtttttgaatacttgagtggggaccgccaggtggaggaatggccaaaggccacgtgtacaggagattgccctgagcggtgtggctgcacctcttccacttgcctccataaagaatggccccacagcagaaattggaggtgtaacccaacatggtgctggggtgtaggcaccgggtgtacttgctgtggagtcgacgtgaaggatctgttcacagaccatatgtttgtgaaatggaaggtcgagtacatcaagaccgaggcgattgtttgcgtggaactaacgtcacaagagcgtcagtgtagtctgatcgaagccggcactcgcttcaatcttgggccggtaaccattacactcagcgagcctcggaacatccagcagaaactgcccccagaaataattaccttgcaccccaaggtggaggagggatttttcgatctgatgcatgtccaaaaagtgttatccgcttctacagtttgcaagctccagagctgtactcacggcatccctggtgaccttcaggtgtatcacatcgggaaccttctgaaaggagacagagtcaatggccatttgattcacaagatagaaccacattttaacacctcctggatgtcatgggatggttgcgacctcgattactattgtaatatgggcgactggccctcttgcacgtacacaggggtgactcagcacaaccacgcagccttcgttaatctgctaaacatcgagaccgattatacaaagacctttcatttccacagtaaaagggtgactgctcatggagacacccctcaactggatcttaaggcccgaccgacatacggcgcaggggaaattacggtcctcgtagaggtggcggacatggagctgcacactaaaaaggttgaaatctcgggattgaaatttgccagcttagcttgcaccggctgttatgcctgctcctctggtatttcatgtaaggtgcggatccatgtcgatgagccagacgaactgacagtgcacgtaaaaagctccgatcccgacgtggtcgcagctagtacctctctcatggcccgcaagctggagttcgggactgatagcacattcaaggcattttcagccatgcctaaaacctccctttgcttctacatagttgaaagagagtactgtaagagttgcagcgaggaagacacgcagaaatgtgtggacactaagctggagcagccccagtctatcttgattgaacacaaaggaacaatcattggcaagcaaaatgatacctgcaccgctaaggcgtcctgttggctagagtcagtgaaatcgtttttctatggtctgaagaacatgctcggcagcgtctttgggaatttctttatcggaatactgcttttcttagccccatttgtgctgctcgttttgttctttatgttcggctggaaaattctgttctgctttaagtgttgcaggcgggcacgagggctcctgaaatacagacatcttaaggacgatgaagagactggatatcgcaagatcatcgagaggctgaacaataaaaagggcaaaaaccgtttgctagacggtgaacggctggctgatagaaagattgccgagctcttttctacaaaaacccacatcgggtga

SEQ ID NO: 10416 - RNA, 5052 nt, synthetic construct
  misc_feature 1..5052: note = derived and/or modified CDS sequence (opt3) from CCHFV(37-R-2013)__KR814858.1__GP
  source 1..5052: mol_type = other RNA
atgcacaccctgctcgtgtgcttcatcctttacctgcagttgttaggcctgggtggagcccatagacaaagcaacgctacagagcacaatggtactaacacgaccacagcaccctccacttctcagtcacctaagccaccggtcagtaccgcgccccctcatgccccagaaacaagcaccattaaacccactactcctgcttccgagaccgaaggctctggggagacgactccaccccctaataccacacagggaccatcgccgcccgaagccactcctgagaggccagcaaccacagttacctcaacgcccagcactgacaacacaaatagtaccactcacgccacagataacaatcctacctccacgatatctaccagcccatcctcaagtcccagcacaccgtctactcctcagggcatccatcaccccgctcggaacctactctccgtgtcaagcccaaagaccgcaacaactcctacccccacaagtccaggtgacatttcttccgagaccagctcgctgcactctgccatgtcccgcactcccacgcttcatacagctacccaagcctcaactgaaaatgcgaaccacagtgcacctcgacagagcgagtcctctgcccagcagaccacaaccagcccaatgacttcaccggctcaacccatcctggtaatgagtgccgcacctacagctattcagaatatccatccatcccccacgaaccgtagcaaaagaaatttggaaatggagataatcctcaccctgtctcaggggctgaagaaatattacggaaagattctcaagttactgcaccttactttggaggaagatacagagggcctgctagaatggtgtaaaaggaacctcggctcaaattgcgacgatgactttttccagaagcggatcgaggaatttttcatgaccggggagggatattttaacgaggtgctgcaattcaaaacacttagtactctgagccctaccgaaccatcccacgcccgacccccgacggtcgagccttttaagtcttacttcgcgaaagggtttttgtcgattgatagcggctatttctccgccaagtgttacccaagactcaccacatcagggctgcagttaatcaacgtgactcagcatcccgcaaggatagctgaaacccctggacccaagacaacaagtctgaaaaccattaattgcatcaacctccgggcctctgtttttaaggagcaccgcgaaattgagatcaatgtgcttctgccacaaatcgctgtcaacttgagcaattgtcatgtggtaattaactcccacgtttgcgactattcactagatacggacggccctgtgcgactgccccatatataccacgagggtacattcatcccagggacctacaaaattgtcatcgataagaaaaataagctcaacgacagatgtactctggtgacaaattgcgtgataaaaggaagggaagtccggaagggccagagcgttcttcgtcagtataagaccgagattaaaatcggcaaggcctctactgggtcccgcaaactgttgagtgaggaaccgggagatgactgtatcagcagaacccagctcctgaggacagaaacggcagagattcacgacgataactacggtggccctggggacaagatcaccatttgcaatggatctactatagtggatcaacggttaggctccgagctgggttgttatacaatcaaccgagtaaaatcatttaagctatgcgaaaatagtgccaccgggaagacatgcgagattgacagcactcccgtgaaatgtcgccagggcttctgcctcaagatcacccaggaaggaagaggccatgtcaaactgtcgagggggtccgaggtggttcttgatgcttgtgacacgtcttgcgaggtgatgatcccaaagggaacaggtgatattttggtcgactgtagcggcgggcagcaacacttcctgaaagataacctcatagacctgggatgcccccatatccctcttctgggcaagatggcgatttacatctgtcggatgtcaaatcacccacgcaccactatggcatttttgttctggtttagtttcggttatgtgattacctgcatcttttgtaaggccctcttctactccctgataatcattgggacattaggcaaaaagatcaaacagtatagagaactgaagccccagacttgcaccatttgtgagacagctcctgtaaacgccatcgatgcagaaatgcacgacctaaactgctcttacaatatatgcccgtactgtgccagcaggctcacgtccgacggactggctcgtcatgttccacagtgccccaaacggaaggagaaggtggaagagaccgagctttatttgaacctggaacgcattccttggatcgtcagaaaactcctgcaagtgtcagagagcactggcgtcgccttaaagaggagttcttggctgattgtgcttttggttctcctgacagtgtccctaagcccagtacagtcggcacccgtcgggcacggaaaaaccatcgaaacttaccagacacgcgagggttttacctcagtgtgtctgttcatgctcggctctatactgtttcttgttagttgcttggtgaaggggctggtcgattccgtgagcgactctttctttcctggattaagcgtatgtaaaacgtgctccatcggctcaattaatggtttcgaaatcgagagtcataagtgttattgcagcctcttttgttgcccgtactgtcggcactgctctgcggatagagagattcatcagctgcacctttccatctgcaaaaagaggaagatggggtcaaacgtgatgctggctgtttgtaaacgcatgtgcttccgagccactatagaagcaagtcggcgtgccttgctcattagaagcatcatcaataccacattcgtcatttgtatcctgaccctaactatttgcgtggtgtccacatctgctgtcgagatggaaaacctgccctcgggcacctgggagagggaagaggacctcacaaatttttgtcaccaagagtgccaggttactgaaaccgagtgtctgtgcccatatgaagcccttgtgttgcgcaagcctctgttcttagatagcatagtgaaaggaatgaagaacctccttaattcaacgtccctggagacaagtctgtctatcgaggcaccctggggcgctattaacgtacagagcacctttaaaccaactgtctccaccgccaatatcgcgctatcatggtctagcgtggaacatcgggggaacaagattctcgttacaggaagaagtgagtccatcatgaagctggaagagaggactggcgtgagctgggacttgggtgtcgatgacgcctctgaatcaaaactgttaaccgtgtccataatggatctcagtcaaatgtacagccctgttttcgagtatctgtcgggggaccgacaggtggaggaatggcccaaggctacgtgtacaggagattgcccagagcgctgtggctgcacctcttccacttgccttcacaaagaatggccgcatagccggaattggagatgtaaccctacatggtgctggggtgtaggcaccgggtgtacttgctgtggagtcgacgtgaaggatctgtttacagaccacatgttcgtgaaatggaaggtcgagtacatcaagaccgaagcaattgtttgcgtggagttgacgtcacaggagaggcagtgtagtctcatcgaagccggcactcgttttaatctggggcccgtaaccattacactatctgagccacgcaacatccaacagaaactgccccctgaaataattacccttcatccaaaggtggaggaaggattctttgacctcatgcacgtccagaaagtgctgtccgctagcacagtttgcaagttgcagtcatgtactcacggcatccccggtgatctgcaagtgtaccatatcgggaacttactcaaaggagaccgggtcaatggccacctgattcataagatagagcctcacttcaacaccagttggatgagctgggatggttgcgaccttgattattactgtaatatgggcgactggccgtcctgcacgtatacaggggtgactcagcacaaccatgccgcatttgttaatctgttgaacatcgagaccgattacacaaagaccttccactttcattctaaaagagtgactgcgcacggagacaccccacagctcgatctgaaggccaggcccacatatggcgctggggaaattacggtcctagtagaggtggccgacatggaactgcatactaaaaaggttgagatcagcggacttaaattcgcatccctcgcttgcaccggctgttacgcctgctcatctggtattagttgtaaggtgcgaatccacgtcgatgagcctgacgaactgacagtgcacgtaaaatcgaatgatcccgacgtggtcgcagccagcacctccttgatggctcggaagttagagttcgggactgactctacatttaaggcgttctcagccatgccaaaaaccagcctgtgcttttatatagttgaacgcgagtactgtaagtcctgcagtgaagaggatacgcagaaatgtgtggacactaagctcgagcaacctcagtctatcctgattgaacataaaggaacaatcattggcaagcagaacgtgacctgcaccgcaaaggctagctgttggcttgagtcagtcaaatccttcttttacggtctgaagaatatgttgggcagtgtgttcgggaactttttcatcggaatactactgtttctcgcccccttcgttctgcttgtattatttttcatgttcggctggaaaattctgttttgcttcaagtgttgcagaaggactcgggggctcttgaaatatcgactgctcaaggatgacgaagagacaggatacagacgcatcatcgaaaggctgaataacaagaaaggcaagaatcgtcttctggatggtgagcggttggccgacagaaaaattgctgagctatttagcaccaagacacacatcgggtga

SEQ ID NO: 10417 - RNA, 5052 nt, synthetic construct
  misc_feature 1..5052: note = derived and/or modified CDS sequence (opt3) from CCHFV(Kashmanov)__DQ211631.1__GP
  source 1..5052: mol_type = other RNA
atgcacaccctgctcgtgtgcttcatcctttacctgcagttgttaggcctagggggagcccatggtcaaagcaacgctacagagcacaatggcactaacacgaccacagcaccctccacttctcagtcacctaagccactggtcagtaccgccccgccccatgcgctcgaaagctccacaattaaacctaccactccagcttctgagacagaagggtcgggagagaccacgccccctccaaatactacccagggcccctcacctccagaaacaactccggagagacccgccaccacagcaaccagcacgcctagtactgacaacacaaattccaccactcacgttacagataacaatccaacctctacgataagcacctccccctcaagtagcccttctacaccatccactccccagggtatccatcacccggccaggaacctgctttcagtgagcagtcctaagaccgctacaactcccaccccaacatctcctggggagatttccagcgaagcatcgtctctgcactccgccatgtcacggaccagtactttgtatacggctacacaagtaagcaccgagaatgccaaccattccgcgccccgccagtctgaaagctcagcacagccaactaccacaagtcccatgacctcccctgcccagagcatcctcgtgatgtctgctgccccaattgcaatccaaaatatacacccgtcacccactaaccgaagtaaacgtaatctggagatggagatcattctgacactcagccagggattaaagaaatactatggcaagatcctgaaacttttgcatctgacgctagaagaggacaccgaaggcctcctggagtggtgtaaaagaaaccttgggtccaattgcgatgacgactttttccagaagaggattgaagagtttttcatgactggagagggttactttaacgaagtcctgcagttcaaaacattgtctaccctctcgcctacagagccaagccacgctgggccccctactgtggaaccatttaagtcctatttcgccaaagggtttctgtcaatcgatagtggatacttctctgcgaagtgttatccccggagctccacctcaggcttacaactgataaacgttacgcagcacccggcccgcattgcagagacccctggtccaaagacaactagcctcaaaaccatcaattgcattaaccttagagcttctgtgtttaaggaacatagggagatcgagatcaatgtcctgttgccccagattgccgtgaacctatccaattgtcacgtagttataaacagtcatgtgtgcgattacagcctggacacagatgggcctgtccggctcccccacatctaccatgaaggaactttcattccaggcacctataaaatcgtgatagacaagaaaaataagctgaacgatcgctgtacgcttgtgacaaattgcgtcattaaaggccgagaggttagaaaggggcaatctgtgctgaggcagtacaagaccgaaatcaaaatcggaaaggcttccactggttcacggaaattgctcagtgaggaacctggcgacgattgtattagccgtacacagctgttacgcaccgagactgccgagatccacgacgacaactatgggggacccggcgataagattaccatatgcaatggttcgacaatcgtagaccagagactggggtccgaactaggctgttacacgattaacagggtgaaatcttttaagctctgcgagaatagcgcaaccggaaagacttgcgaaatcgattcaacaccagtcaaatgtcggcaaggcttctgcctgaagatcacccaggaggggcgaggacacgtgaaacttagtcgcggttccgaggttgtgttggacgcctgtgattctagctgcgaagtcatgattccgaagggcacaggggacatactggtggattgttccggaggccagcagcatttcctcaaagacaacctgatcgatcttggttgccctcacattcccctgttggggaagatggctatctatatttgtagaatgtcaaatcatccaaggactaccatggcgtttctcttctggtttagcttcggctacgtaatcacgtgcatattttgtaaggcactgttctatagtttaatcattatcggaacactgggcaaaaagattaaacaataccgggagctaaagccccagacctgcactatctgtgaaaccgcccctgttaacgctatagacgccgagatgcacgatctcaactgctcttacaatatttgcccatattgtgcatcccgcctgacaagcgacgggcttgccagacacgtgccccagtgccctaaaaggaaggaaaaggtcgaggagactgaattgtacctgaacctcgagcgtatcccgtggattgtgcggaaactgttacaggtctcggaatcaaccggagtggctctgaagcgatctagttggcttatcgttttgctcgtgctgctaacagtatccctgagcccagtccaatctgcccccgtgggtcatggcaaaacgatagagacctatcagactagagaagggtttacaagcatctgtctcttcatgctgggatccattctgtttttggtttcatgcctggtgaagggcttagtcgacagtgtgagcgattctttctttcctggtctctccgtatgtaaaacctgcactatcgggtcaattaatggcttcgagatcgagagtcacaagtgttactgcagcctgttttgttgcccatattgtaggcattgctccgcagaccgcgaaatacaccagcttcatctgtctatttgcaaaaagcggaagacaggatcgaacgtgatgttggcggtttgtaaaagaatgtgcttcagggctaccatcgaggccagccgccgagcactcctgatccggtcaattatcaatacgactttcgtcatttgtatactaaccctgacaatctgcgtggtgtccaccagtgccgtcgaaatggagaacctcccctctggcacttgggaacgtgaggaggatctgacaaatttttgtcaccaggaatgccaagttaccgagacagaatgtctttgcccttacgaggctttggtgctgagaaagccgttattcctcgacagcattgtgaaagggatgaagaactcccttaattcaacttctcttgagaccagcctgagtatcgaagccccctggggagcaattaacgtacagtccacgtttaaaccaacagtcagcaccgctaatatcgccctatcttggtcatccgtggagcacaggggcaacaagatactcgttactggtcgcagtgaaagcatcatgaagctggaggaacggaccggggtgtcgtgggatttgggagtcgaggacgcgtctgagtccaaactgttaacagtgagcattatggatctctcacagatgtatagtcctgttttcgaatacctgtctggcgacagacaagtggaggaatggcccaaggccacttgtaccggtgattgcccagagaggtgtggctgcacgtccagcacatgccttcataaagaatggcctcactcacgaaattggcgctgtaaccccacctggtgctggggcgtaggaactggctgtacatgctgtggggtcgacgtgaaggatctgtttaccgaccatatgttcgtgaaatggaaggtcgagtacatcaagactgaggctattgtttgcgtggaattgacaagtcaggagcggcagtgtagcctcatcgaagcaggaaccagatttaatctgggcccagtaacgataactctatccgagccgaggaacattcagcaaaaactgcctcccgaaatcatcacccttcacccaaaggtggaggagggtttctttgatctcatgcatgtccagaaagtgctgtctgccagcacagtttgcaagttgcagtcctgtacccacgggattcccggagacttacaggtgtatcacataggcaacctgctcaaaggtgaccgtatcaatggccatctgattcacaagatcgaacctcatttcaacacatcatggatgtcttgggatgggtgcgaccttgattactattgtaatatgggagactggccaagttgcacttacaccggcgtcacgcaacacaaccacgctgcctttgtgaatctgttgaacattgagacagattatactaagaccttccattttcactcgaaacgcgttacagcacatggggacactccccagctcgatctgaaggcgcggcctacttacggagccggcgaaatcaccgtgctagtcgaggtagctgacatggagctgcacacaaagaaggtggaaataagcggtcttaaattcgcctccctcgcatgcacggggtgttatgcttgttcttcaggaatcagctgcaaggttaggattcatgtggatgagccggacgaactgactgtccacgtgaaatccagtgatccagacgtagtggccgcatctaccagcttgatggccagaaagttagagttcggcacagattcaacctttaaggctttctccgcgatgcccaaaaccagtctgtgcttttacatcgtcgaacgagagtactgtaagagctgctctgaggaagacacacagaaatgtgttgacaccaagctcgagcagcctcaatccattctgatcgaacacaaaggtacgataattggcaagcagaatgatacttgcacagccaaggcatcatgttggcttgagagcgtgaaatcgttcttttatgggctgaagaacatgttgggatctgtgttcggcaactttttcatcgggatcctactgtttctcgctcccttcgtcctgcttgtgttatttttcatgttcggatggaaaattctgttttgcttcaagtgttgccggcgcaccagaggcctcttgaaatacaggcatctgaaggacgatgaagagaccggttatcggcgaatcatagagagactcaataataagaaagggaagaaccgcctgcttgacggagaaaggctggccgatcgtaaaattgccgagttgtttagtactaagacacacatcggctga

SEQ ID NO: 10418 - RNA, 5052 nt, synthetic construct
  misc_feature 1..5052: note = derived and/or modified CDS sequence (opt3) from CCHFV(Haskovo-V46/13)__KR092379.1__GP
  source 1..5052: mol_type = other RNA
atgcacaccctgctcgtgtgcttcatcctttacctgcagttgttaggcctagggggagcccatggtcaaagcaacacaactgagcacaatggcacgaacaataccacagctcccgggacttcccagtctcctaagccacatatgtcaaccacaccgccccacgcacctgaaagtagcaccattaaaccaactacacccacctccgagacggaaggatctggcgagactacccctccatcgaacacaactcagggtccctcacctccagaaaccacaagcgagagaccggccaccacggcgataagtacttcctctacagacaatatgaaccccaccagccagatgactgataatacacctacctccacggtctcaatcagtccaagctcctccccctcaacccctagcacaccacaagggatgcatcaccccgctaggagtctgctctctgtttccagcccgaagactgccaccacacctactcccacctcgccagtggaggtaggatctgaaacatcctcacagcacagtgcaatgagctccacccctactccccatacggccacacaggtgtctaccgagaacactaatcacagcaccccacggcagtcagaacccagtgctcaacagacaaccccttccccaatgccgagccccgcacagtctactctgcttatgtcagccgctcctacagccgtccagaacacgcatccaagtcccaccaatcgcagcaaacgaaacctggagatggagattatcttgactctctcccaaggcctgaagaaatattacggcaagattctgaagctcttacacctgacacttgaagaggacaccgaagggttgctggagtggtgtaaacgtaatctaggatctaactgcgatgacgactttttccagaagagaatcgaagagtttttcatgacaggtgagggctattttaatgaagtgctccagttcaaaactctgtcgacccttagccctatggagccatcccacgcggaactgcccacggcagagccgtttaagtcatacttcgccaaagggtttttgagtatagactctggatatttcagcgctaagtgttaccctaggtcctcaaccagcggcctccaactgatcaacgttacacagcatccagcccggattgcagaaactcccggtcctaagaccacatctttaaaagctatcaactgcattaatctgcgcgcctccgtgtttaaggagcacagagagatcgaaataaacgtcctccttccccagattgcggtgaatctgagtaactgtcatgtagttatcaatagccacgtgtgcgattattctttggacactgatgggccagtcaggctacctcatatttaccacgagggaaccttcatccccggcacgtacaaaatcgtgattgacaagaaaaacaagctgaatgatcggtgtacactcgtgaccaactgcgtcataaaaggccgcgaagttcgaaaggggcagtccgtgctgagacaatataagactgagatcaaaattggaaaggcctcaacaggtagtaggaaacttctgagcgaagagttgggcgacgattgtatctcgcggacccagctcctgcgtactgagaccgcagaaatacacgacgacaattacgggggaccaggcgataagattacaatctgcaacggttccacgatcgtagaccagcgcttagggtctgagctgggctgttataccattaatagaggaaagagctttaaactatgcgaaaactcagctactggcaagacatgcgagatcgatagtaccccggtgaaatgtaggcaggggttctgcctcaagattacacaagagggacggggtcatgtcaaactgtcccgaggctctgaagtggttcttgacgcctgtgatagctcctgcgaggtgatgatacctaaggggactggagacatcttggtcgattgttcaggcggtcagcagcacttcctgaaagacaatctcattgatctggggtgcccccatatcccacttctgggcaagatggctatctacatttgtcgcatgagcaaccaccccagaaccacgatggcctttttgttctggtttagtttcggatatgtgataacatgcatcttttgtaaggcactcttctactctctgattatcattggcaccttagggaaaaagatcaaacagtatagggaactgaagcctcaaacttgcaccatatgtgagacaactccagtaaatgccatcgacgctgaaatgcacgatctaaactgctcctacaacatttgcccctactgtgcgagccggctcacctcggacggactggcacgccatgttacacagtgccctaaaagaaaggagaaggtggaggaaacggagctttatttgaatctggaaaggatcccgtggattgtccgtaaactcttacaggtgtcagagtctaccggtgtcgccctgaagcggagttcctggctgatcgtgcttttggttctcctgccagtgagcctatctcccgtacagagcgctcctgtcggccacgggaaaactatagaaacataccaaacccgagagggatttacttccatttgtctgttcatgctcggctcaatcctgtttattgtgagttgccttgttaagggtttggtggacagcgtcggggattctttctttccaggcctgtccgtgtgtaaaacatgctcaatcggaagtataaacggcttcgagatcgaaagccataagtgttattgctccttattttgttgcccctactgtagacactgctctgccgacagggagattcatcagctccacctgtcgatctgcaaaaagcgcaagaccgggagcaatgtaatgcttgcagtgtgtaaacggatgtgcttcagagccacgattgaggcttcaaggcgcgccctgttgatccgatccataattaacactaccttcgcaatgtgtatcctcacactgaccatctgcgttgtcagtacttctgcggtggagatggaaaatctacctgctggaacatgggagcgggaggaagatctgaccaacttttgtcaccaggagtgccaagtgacagaaactgagtgtctctgcccgtatgaggccctggtccttcgtaagcccttgttcctggacagcattgttaaaggcatgaagaatttactcaactccacctcactggaaacgtctcttagcatcgaggcaccatggggtgccattaatgtgcagagtacatttaaacctaccgtgtccactgctaacatagccctgagctggtcttcagtagaacatagagggaataagatcctagtcaccggaaggtccgagagtattatgaagctcgaagaacgcacaggcgtgagctgggatctgggtgttgaggacgcatcggaatctaaattgctgactgtgtccatcatggatttaagccagatgtactcacccgtcttcgagtatctcagtggcgacagacaggtggaagagtggccaaaggctacctgtacgggggattgccctgaacggtgtggatgcacatcttctacctgcctgcacaaagagtggccccatagcaggaactggcgatgtaatccaacttggtgctggggcgttgggacaggatgtacctgctgtggcgtggacgtaaaggatctttttactgaccacatgttcgtcaaatggaaggtggagtacattaagacagaagccatcgtgtgcgtcgagctgacctcacaagaacgccagtgtagtttgatagaggcgggtacgcggtttaacctcgggccggttactatcaccctgagcgaacctagaaatattcagcagaaactacccccagagatcattacactgcatcccaagatcgaggaaggattctttgatcttatgcacgtgcaaaaagtactctccgcctctaccgtgtgcaagctgcagagctgtacacacggcatacctggtgacttgcaggtctaccatattggcaacctgttaaaaggggacagggtgaacggacacctcatccataagatcgagccacacttcaatacttcctggatgtcatgggatggctgcgacctggattattactgtaacatgggggactggccctcttgcacctatacgggagttacacagcacaatcatgctgcatttgtgaaccttctgaatattgaaactgattacaccaagacattccactttcatagtaaacgtgtcaccgcccacggcgacactcctcaattggatctcaaggctcgcccgacctatggtgccggggagataacagtgctggttgaggtggcagacatggaactacatacgaaaaaggtcgagatctcgggactgaaattcgcgagccttacttgcaccggctgttacgcctgctcctctggtatttcatgtaaggtacggatccacgtggatgaaccagacgagctcacagttcacgtgaaaagctccgatcccgacgtcgtggctgccggcaccagtctgatggcaagaaagttggagttcgggactgattctacatttaaggctttcagcgccatgcctaaaacctcattatgcttttatattgtagaaagggagtactgtaagtcctgcagtgaagacgacacgcagaaatgtgtggatactaagctggagcagccccaaagcatcctcatagaacataaaggaacaatcattggcaagcagaacgatacctgcaccgcacgagcctcttgttggctggagtccgtcaagtcattcttttacgggcttaaaaatatgctgggaagcgttttcggcaactttttgatcggtattctactgttcctcgctccatttgtgctgcttgtgttattctttatgttcgggtggaagatcctgttctgctttaaatgttgccggcgcactagaggactcttcaagtataggcacttgaaagatgacgaagagacaggctaccggcgaataattgagagactcaattcgaagaagggcaaaaaccgcctgctggatggggaaaggcttgcggaccgtaagatcgccgagctgttttctaccaaaacacatatcggatga

SEQ ID NO: 10419 - RNA, 5052 nt, synthetic construct
  misc_feature 1..5052: note = derived and/or modified CDS sequence (opt3) from CCHFV(Min)__KX013481.1__GP
  source 1..5052: mol_type = other RNA
atgcacaccctgctcgtgtgcttcatcctttacctgcagttgttaggcctagggggagcccatggtcaaagcaacgctacagagcacaatggcactaacacgaccacagcaccctccacttctcagtcacctaagccactggtcagtaccgccccgccccatgcgctcgaaagctccacaattaaacctaccactccagcttctgagacagaagggtcgggagagaccacgccccctccaaatactacccagggcccctcacctccagaaacaactccggagagacccgccaccacagcaaccagcacgcctagtactgacaacacaaattccaccactcacgttacagataacaatccaacctctacgataagcacctccccctcaagtagcccttctacaccatccactccccagggtatccatcacccggccaggaacctgctttcagtgagcagtctgaagaccgctacaactcctacccccacatctccaggggagatttccagcgaaacctcgtctttgcactccgcaatgtcacggactagcacgctctatacagccacccaagtaagcactgagaatgctaaccattccgcccctcgccagtctgaaagctcagcgcagcccaccacaaccagtccaatgacttcccccgcacagagcatcctggtgatgtctgccgctcctattgccatccaaaatatacacccatcaccgacaaaccgaagtaaacgtaatctggagatggagatcattctcacgttaagccagggactgaagaaatactatggcaagatccttaagttgctgcatctaaccctcgaagaggacactgaaggcctgcttgagtggtgtaaaagaaacctggggtccaattgcgatgacgactttttccagaagaggattgaagagtttttcatgacaggagagggttactttaacgaagtcttgcagttcaaaaccctctctacactgtcgcccactgagcctagccacgcacggccacccaccgtggaaccttttaagtcctatttcgctaaaggctttttatcaatcgatagtgggtacttctctgccaagtgttatccacgcagctccacgtcaggactgcaactcataaacgttacccagcaccccgcgagaattgccgagacaccgggccctaagactaccagccttaaaacaatcaattgcattaacctgagggcatctgtgtttaaggaacatcgggagatcgagatcaatgtcttgctaccacagattgctgtgaacctgtccaattgtcacgtagttataaacagtcatgtgtgcgattacagcctcgacactgatggtcccgtccgcctgcctcacatctaccatgaagggaccttcattcccggaacgtataaaatcgtgatagacaagaaaaataaacttaacgatcgatgtacactggtgaccaattgcgtcattaagggcagagaggttaggaagggccaatctgtgttgcggcagtacaagactgaaatcaaaatcgggaaggcctccacaggatcacgtaaactcctgagtgaggaaccaggtgacgattgtattagccgcacccagttactgagaactgagaccgctgagatccacgacgacaactatggcgggcctggagataagattacaatatgcaatggctcgacgatcgtagaccagaggctaggttccgaactcgggtgttacaccattaaccgggtgaaatcttttaagctgtgcgagaatagcgccactggcaagacatgcgaaatcgattcaacccccgtcaaatgtcgacaaggattctgccttaagatcacacaggagggccgcgggcacgtgaaattgagtagaggatccgaggttgtgctggacgcatgtgattctagctgcgaagtcatgattccaaagggtactggcgacatactcgtggattgttccgggggacagcagcatttcctgaaagacaaccttatcgatctgggctgcccgcacattcctttgctcggtaagatggccatctatatttgtaggatgtcaaatcatccccggaccacgatggcttttctgttctggtttagcttcgggtacgtaatcacatgcatattttgtaaggcgttattctatagtctgatcattatcggcaccctagggaaaaagattaaacaataccgcgagctcaagccacagacttgcaccatctgtgaaacagcacccgttaacgccatagacgctgagatgcacgatctgaactgctcttacaatatttgcccttattgtgcctccagacttactagcgacggcttggcaaggcacgtgccacagtgccccaaacgtaaggaaaaggtcgaggagaccgaactgtacctcaacctggagcggatcccttggattgtgcgaaaattactgcaggtctcggaatcaacaggggtggcccttaagagatctagttggttgatcgttctcctggtgctactgacggtatccctcagcccggtccaatctgctccagtgggacatggtaaaaccatagagacttatcagacaagggaaggctttaccagcatctgtctgttcatgcttgggtccattttgtttctggtttcatgcttagtgaagggactcgtcgacagtgtgagcgattctttctttcccggcctgtccgtatgtaaaacttgcacaatcggttcaattaatgggttcgagatcgagagtcacaagtgttactgcagcctgttttgttgcccttattgtcgccattgctccgccgaccgggaaatacaccagctgcatttgtctatttgcaaaaagagaaagaccggctcgaacgtgatgctcgcagtttgtaaaaggatgtgcttccgcgcgacgatcgaggctagccgacgggccctgctaatccgttcaattatcaatactaccttcgtcatttgtatactgacactcaccatctgcgtggtgtccacaagtgcagtcgaaatggagaacctgccatctggaacttgggaaagagaggaggatcttaccaatttttgtcaccaggaatgccaagttacagagactgaatgtttgtgcccctacgaggccctggtgttaaggaagcctctcttcctggacagcattgtgaaaggcaccaagaaccttcttaattccacgtcactagagacatctctcagcatcgaagctccgtggggagccattaacgtacagagtacctttaaacccactgtctccaccgcaaatatcgctctgagctggtcttcagtggagcaccgcggaaacaagatattggttacaggccggtccgaaagtatcatgaagctggaggaaagaactggtgtgagctgggatttaggggtcgaggacgcctcggagtctaaactcctgaccgtgtccattatggatcttagccagatgtattcaccagttttcgaatacctgagtggagacaggcaagtggaggaatggcctaaggcgacgtgtacaggcgattgccccgagcgatgtggttgcacctcttccacttgcttgcataaagaatggccacacagccgcaattggcggtgtaaccctacatggtgctggggcgtagggaccggatgtacttgctgtggcgtcgacgtgaaggatctctttacagaccatatgttcgtgaaatggaaggtcgagtacatcaagaccgaggccattgtttgcgtggaactgacgtcacaggagagacagtgtagtctaatcgaagctgggactaggtttaatctgggacccgtaaccataacacttagcgagccacgtaacattcagcaaaaactcccgcctgaaatcatcaccctgcaccccaaggtggaggagggcttctttgatttgatgcatgtccagaaagtgctgtccgcatctacagtttgcaagttacagagctgtactcacggtattccaggggacctccaggtgtatcacataggaaacctgcttaaaggcgaccgcatcaatggtcatctgattcacaagatcgaaccccatttcaacacctcctggatgtcatgggatggctgcgacttggattactattgtaatatgggggactggccttcttgcacgtacacaggagtcactcaacacaaccacgccgcttttgtgaatctcctgaacattgagaccgattatacaaagaccttccattttcacagtaaacgggttactgcccatggcgacaccccacagctagatctgaaggcaagacccacatacggggcgggagaaatcacggtgcttgtcgaggtagccgacatggagctccacactaaaaaggtggaaatatcgggcctgaaattcgctagcttggcctgcaccggttgttatgcatgctcctctgggatctcatgtaaggttaggattcatgtggatgagcctgacgaattaacagtccacgtgaaaagctccgatccggacgtagtggctgccagtacctctctgatggcacgaaagctcgagttcggaactgatagcacatttaaggccttctcagctatgccaaaaacctccctgtgcttttacatcgtcgaacgggagtactgtaagagttgcagcgaggaagacacgcagaaatgtgttgacactaaacttgagcagccccaatctattctgatcgaacacaagggcacaataattggtaagcagaatgatacctgcaccgcgaaggcctcctgttggttggagtcagtgaaaagtttcttttatggcctaaagaacatgctggggtcggtgttcggaaactttttcatcggcatcctcctgtttcttgcacctttcgtcttactggtgctctttttcatgttcgggtggaaaattttgttttgcttcaagtgttgccgcagaactaggggactgctcaaataccggcatctgaaggacgatgaagagacaggctatcgaagaatcatagagcgccttaataataagaaaggtaagaacaggctgttggacggggaacgtctagctgatcggaaaattgccgagctgttttctaccaagacacacatcggatga

SEQ ID NO: 10420 - RNA, 5052 nt, synthetic construct
  misc_feature 1..5052: note = derived and/or modified CDS sequence (opt3) from CCHFV(Kosovo/9553/2001)__AY675511.1__GP
  source 1..5052: mol_type = other RNA
atgcacaccctgctcgtgtgcttcatcctttacctgcagttgttaggccttgggggagcccatggtcaaagcaacgctacagagcacaatggcactaacacgaccacagcacccgggacttcccagtctcctaagccaccggcctcaaccacacccagtcatgcgcctgaaagctccaccattaaactaactacaccaacctctgagacggaaggatcgggcgagactacaccccctacatcaactacccagggtagcccacccctcgaaacaacccctgagagaagtacgactacagctacctccacttctgggacagacaatatgaacagcaccacgcagatgaccgataatacaccaactctgaccgcctccacatcaccgagtagctctccctccactccttcaaccagccaaggacttcactatccagtcaggagtctgttgtctgtttccagccccaagacagtgaccactcctacgccaatgtcgcccggcgagatgtcttccgaaacatcaagtcagcatagcgcaatgtcccggaccccgactcctcacaccgccacacaggtatctaccgagaacgctaatcgcagcacttcacgacagagtgaatccagcgcacaacccgccacacagtctccagtgacgagtcctgctcagagtatactcctgatgagcgccacccccactacaatccagaacattcacccatcccccaccaatcgttctaaaagaaacctggagatggagatcattctcacattatcgcaaggcctgaagaaatactatgggaagatccttaagttgctgcatctaactctcgaagaggacaccgaaggactgcttgagtggtgtaaaaggaatctgggtagcaactgcgatgacgactttttccagaagcggatagaagagtttttcatcacgggcgaggggtactttaatgaagtcttgcagttcaaaaccctctccacaccttcaccaactgagccgagtcacgcgcgcctgcccaccgcagaaccttttaagtcttatttcgccaaaggatttttaagcattgattccggctacttctcagctaagtgttatccaagaagctctacatccggtctgcaactcatcaacgtgactcagcatcccgccaggattgcagagacccctgggccaaagatcacgagtcttaaaacaataaattgcattaacctgcgggctagcgtttttaaggaacaccgcgaggtggagatcaacgtcttgctaccccagattgccgtgaatctgtctaactgtcacgtagttatcaattcccatgtgtgcgattactcactcgacaccgatggaccggtccgactgcctagaatctaccacgaaggcactttcatgccaggcacatataaaattgtgatagacaggaagaacaaacttaatgatcggtgtaccctggtgactaactgcgtcatcaaggggcgtgaggttcgcaaaggacagagtgtgttgagacaatacaagaccgaaattaagatcggtaaagcgcccacaggcagcaggaagctcctgtcggaggaacctggggacgattgtatatcccggacgcagttactgcgaaccgagactgccgagattcatgacgacaattatggaggccccggtgataaaatcacaatctgcaacgggtctaccattgtagaccagcgcctaggcagcgaactcggatgttacacaatcaatagagtgaagtcatttaaactgtgcgagaacagtgcaactggcaagacctgcgaaattgattccacgccagtcaagtgtaggcaggggttctgccttaaaataacacaagagggacggggtcacgtgaagttgtctcgcggcagcgaggttgtgctggacgcttgtgattcctcatgcgaagtcatgatccctaaagggaccggagacattctcgtggattgtagcggcggtcagcagcatttcctgaaggacaatcttatcgatctggggtgcccccacatcccattgctcggcaaaatggccatttatatagctagaatgagtaaccacccgaagactaccatggcctttctgttctggttttctttaggatacgtaatcacatgtattctgtgcaaggcactattctattccctcatcattatcggcactctggggaaaaagataaaacagtacagggagcttaagcctcaaacctgtacaatctgcgaaacggcccccgttaatgctattgacgcggagatgcatgatttgaactgtagctacaatatctgcccatattgcgcatcgcgtctgacctcagacggactcgcccggcacgtgaaacagtgtcccaagcgaaaggaaaaagtcgaggagactgaactgtacttaaacctggagaggattccttgggtggtcagaaaacttctccaggtgtctgaaagtacaggtgttgctttgaagcgctccagctggctgatcgtgctactggtactcctgaccgtctctcttagcccagtgcagtccgcccccgttggccatgggaagactatagagacatatcaaacccgggaaggatttacgtcaatttgcttgttcatgctgggcagtatcttatttattgtgagctgtctcgtcaaaggtctggtggactctgtatccgattcattctttcctgggcttagtgtgtgcaagacttgtagcatcggctccataaacggattcgagatcgagtctcacaaatgctactgttcgctgttttgctgtccgtattgcagacactgtagcgcagacagggaaattcatcagttgcacctctcaatctgcaagaagcgcaaaaccggctccaatgttatgctggccgtctgcaagcgaatgtgtttccgggctacaattgaggccagtcgtagagcactactgatcaggtctataattaacaccacttttgtgatctgcatcctcacactgaccatttgtgtggcgagcacatccgctgtcgaaatggagactcttccagccgcaacctgggaacgcgaggaggatttgacgaatttctgccatcaggaatgtcaagttcccgagacagaatgcctgtgtccttacgaggccttagtgctccggaaaccactgttccttgactcaatcgtgaaggggatgaaaaacctgctaaattctaccagcctcgagacttcactgtccattgaagctccctggggagccataaacgtacagagcacctttaagcctacagtctctactgcaaatatcgctttgtcatggtccagtgtggagcacagaggcaacaagattctggttaccggtaggagcgaatcgatcatgaaattagaggaacgaacgggggtgtcttgggatctcggagtcgaggacgcctccgagagcaagctgcttacagtgtcaattatggatctgagtcagatgtattctccggttttcgaatacttgtccggcgaccgccaggtggaggaatggcccaaagcgacctgcactggtgattgtccagagcggtgcggctgtacaagctcaacctgcctccataaggaatggcctcacagtagaaattggaggtgcaaccccacttggtgttggggagtagggacaggctgcacctgttgcggggtcgacgtgaaagatctgtttacggaccacatgttcgtgaagtggaaggtcgagtacatcaaaactgaggccatagtttgtgtggaactaaccagccaagagcgtcagtgctccctgatcgaagctggaacacgctttaatcttggcccagtaaccattacactctctgagcctcggaacatccagcagaagctgcccccagaaattatcactttgcatccgaaaatagaggagggtttctttgatctgatgcacgtgcaaaaggtcttaagcgcatccaccgtgtgtaaactccagtcatgcacgcatgggattcctggagacctgcaggtttatcacatcggcaatcttctgaagggtgacagagtgaacggccatttgatccacaagattgaaccccacttcaatacatcttggatgagttgggatgggtgtgacctcgattactattgcaacatgggagactggccatcgtgtacttacaccggcgtcacacagcataaccacgccgcttttgtgaatctgctaaacatagagaccgattatactaaaaccttccattttcacagcaagagggttacagcccacggggacacgccccaactggatcttaaagcacgacctacttacggagcgggcgaaatcaccgtgctcgtcgaggtagccgacatggagctgcatacaaagaaagtggaaatttccggtttgaagttcgcttctttagcctgcaccgggtgctatgcatgttcaagcggaatctcctgcaaagttcggattcacgtggatgagccagacgaactgactgtccatgtgaagagttctgatcccgacgtagtggctgccagcacatcactcatggcacgcaagctggagtttggcaccgattccacgttcaaagccttcagtgctatgcctaagactagcctttgtttttacatcgtcgaaaaagagtactgcaagtcttgttccgaggacgacaccaaaaagtgcgttgataccaagctggaacagccgcagtcaatattgatcgagcacagaggtaccattatcggcaaaccaaatgacacttgtcccgcgaagacaagctgctggctagaatcggtgaaatctttcttttatgggctgaagaacatgctcggaagtgtgttcggcaactttttcattgggatcctgctgtttttagcccctttctttctgtggatgctctccttcatgtttggatggaaaatattgttctgtttcaagtgctgtaggcggacccgaggcctgtttaagtacagacatctcaaagatgacgaggaaacaggttatcgcaggattatcgagcgtctgaataataagaaagggaagaaccggcttctggatggagagagattggcagacaggaaaatcgctgaactattcagcactaagacgcacattggctga

SEQ ID NO: 10421 - RNA, 5052 nt, synthetic construct
  misc_feature 1..5052: note = derived and/or modified CDS sequence (opt3) from CCHFV(4495-ST-2008)__KR814869.1__GP
  source 1..5052: mol_type = other RNA
atgcacaccctgctcgtgtgcttcatcctttacctgcagttgttaggccccgggggagcccatggtcaacctaacgctacagagcacaatagaactaacacgaccacagcaccaagcacttcccagtctccgaagccccctgtgtcaaccgccccaccccatgcgctggaaagtcctacaattaaaagcaccactccaacatccgagaccgaaggctctggggagacgactccccctccaaataccacacagggaccgtcgccccctgaaactaccccagagaggcccgctacaaccgccacgtcaactcctagcacagacaacaccaatagtactacacacgttaccgataacaatccaacgtccaccatatctacaagcccctcctcaagtccgagcactccttctacaccccggggcatccatcacccagcacgcaacctactctccgtgtcaagccctaagaccgccactacccccacaccaaccagtcccggtgagatttcttccgaaactagctcgctgcactctgctatgtcccgaacgtcaacactttataccgcaactcaggccagtaccgagaatgctaaccatagcacacctcgtcaatccgaatctccagcccagccgaccactacaagcctgatgacgtcacccgcgcagagtatcttggtaatgtccgcagcccctaccgctattcagaatatccacccaagccccactaacagatctaaaaggaatctcgagatggagataatcctgacactgtcacaagggctcaagaaatactatggaaagattttaaagctgcttcatttgaccctggaagaggacacagaaggcctactcgagtggtgtaaacggaacctgggcagtaattgcgatgacgactttttccagaagcgcatcgaagagtttttcatgactggggagggatactttaacgaagtgcttcagttcaaaaccctgagcacgttgtcccctaccgagccatctcacgccagacccccgacagtcgaaccttttaagtcgtatttcgcaaaaggttttctcagcattgattccggctacttctcagctaagtgttatccaaggagttctactagcgggctgcagttaatcaacgtgacccaacaccccgcccggatagcggagacacctggacccaagactacctccctgaaaacgattaattgcatcaacctccgcgcctcagtttttaaggaacatcgagagattgagatcaatgtgcttctgccacagatcgcagtcaacttgagcaattgtcacgtggtaattaactctcatgtttgcgattactccctagacacagatggccctgtgagactgccccacatataccatgaaggtaccttcatcccagggacttataaaattgtcatcgacaagaaaaataagctcaacgataggtgtacactggtgaccaattgcgtgataaaaggacgggaggtccgtaagggccagagtgttcttcgccaatacaagactgaaattaaaatcggcaaggtgagcaccgggtctagaaaactgttgtccgaggaatcaggagacgattgtatcagtaggacacagctcctgcggacggagaccgctgagattcacgacgacaactatggtggcccgggggataagatcactatttgcaatggaagcacaatagtagaccagcgattaggctcggaactgggttgttacaccatcaaccgcgtgaaatcctttaagctatgcgaaaattctgccacagggaagacttgcgagattgatagcacccctgtcaaatgtagacagggcttctgcctcaagatcacgcaagagggaaggggccacgtgaaactgtcacgggggagtgaggttgtgcttgacgcttgtgattcctcttgcgaagtcatgatccccaagggaacaggtgacattttggtggattgtagcggcgggcagcagcatttcctgaaagacaacctcatagatctgggatgcccacacatcccccttctgggcaagatggccatttatatctgtcgcatgtccaatcatcctagaaccactatggcatttttgttctggttttcattcggttacgtaattacctgcctcttttgtaaggccctgttctatagcttaatcataatcgggacactgggcaaaaagattaaacagtacagggagctacgtccacaaacttgcaccatctgtgaaacagctcccgttaacgcgattgacgcagagatgcacgatctcaactgcagttacaatatctgcccttattgtgcctctcggctgacgtccgacggacttgctcgacacgtgccgcagtgcccaaagagaaaagaaaaggtcgaggagaccgaattgtacctgaacctcgagaggataccctggattgtgcgcaagctgttacaggtcagcgaatcgactggcgtggccctgaaacggtcatcttggcttatcgttttgctcgtgctgctaacagtaagtctgtcccctgtccagagcgcaccagtggggcatggaaagaccattgagacttatcaaacaagagaaggttttacctctatctgtctcttcatgctgggcagcatactatttttggtttcctgcctggtgaaagggttagtcgactcagtgagtgatagcttctttcccggactctctgtatgtaagacgtgctccatcggctcaattaatggtttcgagatcgagagtcacaaatgttactgcagcctgctttgttgcccttattgtaggcattgctccgccgaccgcgaaattcaccagctgcatttgtctatctgcaagaaacgaaagactgggtcgaacgtgatgctcgctgtttgtaagcggatgtgctttcgtgccaccatagaggcaagcagaagggcgctgctaattcgctcaatcatcaatacaaccttcgtcatttgtatcctgactctcacaatttgcgtggtgtccaccagtgctgtcgaaatggagaacctgccgtctggcacatgggaaaaagaggaggatcttactaatttctgtcaccaggaatgccaggttaccgagacggaatgtttgtgcccctacgaggccctggtgttacggaagccactctttctggacagcatagtgaaaggaatgaagaaccttctaaattccacatcactggagacctctctcagcatcgaagcaccttggggcgccattaacgtacaaagtactttcaaacccaccgtctccacagctaatatcgccctgagctggtcttcagtggagcacagagggaacaagattttggttactggaaggtccgaaagtatcatgaagctggaggaacgaaccggcataagctgggatttaggtgtggaggacgcatcggagtctaaactcctgacggtctccatcatggatcttagccagatgtattcaccagtgtttgaatacctgagtggggaccgccaggttgaggaatggcctaaggctacatgtaccggagattgccccgagcggtgtggctgcacttcttccacatgcttgcataaagaatggccacacagcagaaattggaggtgtaacccgacctggtgctggggtgtgggcactgggtgtacatgctgtggagtagacgtcaaggatctcttcaccgaccatatgtttgtgaaatggaaggtggagtacattaagacggaggccatcgtctgcgttgaactgacttcacaagagcgtcagtgtagtctaattgaagcgggcacccgcttcaatctggggcctgtgacaatcacccttagcgagccccggaacatacagcagaaactcccacccgaaattatcacactgcaccctaaggtagaggagggatttttcgatttgatgcatgtgcaaaaagtcctgtccgcctctactgtgtgcaagttacagagctgtacccacggcatcccaggtgacctccaggtttatcacattgggaacctgcttaaaggagacagagtgaatggccatctgatacacaagatcgaaccccattttaacacgtcctggatgtcatgggatggttgcgacttggattactattgtaatatgggcgactggccttcttgcacatacactggggtcacccagcacaaccacgctgcattcgtgaatctcctgaacattgagacagattataccaagacttttcatttccacagtaaaagggttaccgcccatggagacacaccgcaactagatctgaaggctcgaccaacgtacggcgccggggaaatcactgtgcttgtcgaggtagcagacatggagctccacaccaaaaaggtggaaatttcgggactgaaatttgcgagcttggcctgcacaggctgttatgcttgctcctctggtatctcatgtaaggttcggatacatgtggatgagcccgacgaattaaccgtccacgtgaaaagctccgatcctgacgtagtggccgcaagtacttctctgatggctcgcaagctcgagttcgggacagatagcaccttcaaggccttttcagcaatgcccaaaacgtccctgtgcttctacatcgtcgaaagagagtactgtaagagttgcagcgaggaagacactcagaggtgtgttgacacaaaacttgagcagccacagtctattctgatcgaacacaagggaaccattatcggcaaacaaaatgatacctgcactgccaaggcttcctgttggttggagtcagtcaagagctttttctatggtcttaaaaacatgctgggctcggtgtttgggaatttctttataggcattctcctgttccttgcgccttttgtgttactggtcctcttctttatgttcggatggaagatcttgttctgctttaaatgttgccggcgagccagagggctgctcaagtaccgccatctgaaagacgatgaagagacaggatataggaagatcattgagcgtcttaacaataagaaaggcaagaaccggctgttggacggtgaaagactagcagataggaaaatcgctgagctgttctctaccaagacacacatagggtga

SEQ ID NO: 10422 - RNA, 5052 nt, synthetic construct
  misc_feature 1..5052: note = derived and/or modified CDS sequence (opt3) from CCHFV(Mamon)__KX013478.1__GP
  source 1..5052: mol_type = other RNA
atgcacaccctgctcgtgtgcttcatcctttacctgcagttgttaggcctagggggagcccatggtcaaagcaacacaactgagcacaatggcacgaacaccacaactgctccctccacctctcagtcacctaagccactggtcagtacagcaccgccccatgccctcgaaagctccaccattaaacctactacaccagcgtctgagaccgaagggtcgggagagacgactccccctccaaatataacccagggcccctcacctccagaaacaactccggagagacccgctaccacagccaccagcacgcctagtactgacaacacaaattccaccactcacgttacagataacaatccaacctctacgatcagcacctccccctcaagtagcccttctacaccatccactccccagggtattcatcacccggcaaggaacctgctttcagtgagcagtcctaagaccgccacaactcccaccccaacatctcctggggagatctccagcaaaacctcgtctctgcactccgctatgtcacggacgagtactttgtatacagcaacccaagtaagcactgaaaatgccaaccattccgctccccgccagtctgagagctcagcccagccaaccacaaccagtcccatgacttcccctgcgcagagcattctcgtgatgtctgcagccccaacagctatccaaaatatacacccgtcacccacgaaccgaagtaagcgtaatctggaaatggagatcattctgaccctcagccagggactgaaaaagtactatggcaagatcctgaaacttttgcatctgactctagaggaagacacagagggcctcctggaatggtgtaagagaaaccttgggtccaattgcgatgacgactttttccagaaaaggattgaggaatttttcatgaccggagagggttactttaacgaggtcctgcagttcaagacattgtctactctctcgcctaccgaaccaagccacgcccggccccctacggtggagccatttaaatcctatttcgcaaagggctttctgtcaatcgatagtgggtacttctctgctaagtgttatccccgcagctccacctcaggattacaactgataaacgttacacagcacccggccagaattgcggaaactcctggcccaaaaaccacaagcctcaagactatcaattgcattaaccttagggcctctgtgtttaaagagcatcgggaaatcgagatcaatgtcctgttgccccagattgcagtgaacctatccaattgtcacgtagttataaacagtcatgtgtgcgattacagcctggacaccgatggtcctgtccgcctcccccacatctaccatgaggggacgttcattccaggaacatataagatcgtgatagacaaaaagaataaactgaacgatcgatgtacccttgtgactaattgcgtcattaagggcagagaagttaggaagggccaatctgtgctgcggcagtacaaaacagagatcaagatcgggaaggcttccaccggatcacgtaagttgctcagtgaggaacctggtgacgattgtattagccgcactcagctgttaagaaccgaaacagccgagatccacgacgacaactatggcgggcccggagataaaattacgatatgcaatggctcgaccatcgtagaccagaggctgggttccgagctagggtgttacactattaaccgggtgaagtcttttaagctctgcgaaaatagcgctacaggcaaaacctgcgagatcgattcaacaccagtcaagtgtcgacaaggattctgcctgaaaatcactcaggaaggccgcgggcacgtgaaacttagtagaggatccgaggttgtgtctgacgcctgtgatagctcctgcgaggtcatgattccgaaaggtaccggcgacatattggtggattgttcagggggacagcagcatttcctgaaggacaacctcatcgatctgggctgccctcacattccccttctgggtaagatggcaatctatatttgtaggatgagcaatcatccacggacgacagtagcctttttgttctggtttagtttcgggtacgttataacctgcatcttttgtaaagctctcttctattctctgatcattatcggcactttaggaaagaaaattaagcaataccgcgaactgaaaccccagacctgcacaatctgtgagactgcgcctgtgaacgcaatagacgccgaaatgcacgatctaaactgctcctacaatatttgcccatattgtgctagcagactcacctcggacggcctggccaggcacgtcccccagtgccctaagcgtaaggagaaagtggaagagacagagctttacttgaacctggaacggatcccgtggattgtccgaaagctcttacaggtgtcagagtctacgggggttgcattaaaaagaagttcctggctgatcgtgcttttggtactcctgaccgtcagcctatctccagtgcaaagcgcccccgttggacatggtaagactatagaaacatatcagaccagggagggctttacttccatctgtctgttcatgctcgggtcaattctgtttcttgtgagttgcttggtcaaaggactggtggacagcgtatctgattccttctttcctggcttatcagtgtgtaagacatgcagtatcggtagcattaatgggttcgaaatcgagtcccacaaatgttactgctctctcttttgttgcccatattgtcgccattgctcggctgaccgggagatacaccagctgcatcttagcatttgcaagaagagaaaaaccggctcaaacgttatgctggccgtctgtaagaggatgtgcttccgcgcaacgatcgaagcgtcccgacgggctttgctcatccgtagtattatcaatactaccttcgtgatttgtatactgacactaaccatctgcgtggtctctactagcgccgttgagatggaaaacctgccctccggaacatgggagagagaagaggatctcaccaatttttgtcaccaggagtgccaagtgacagaaactgagtgtctgtgcccttacgaagcacttgtgttgaggaaaccgctgttcttagactcaattgtaaagggcatgaaaaacctccttaattctaccagcctggagacgagtctgtccatcgaggccccctggggagctattaacgtccagagcacatttaagccaaccgtgtctactgccaatatcgcactatcatggtccagtgttgaacaccgcgggaacaagatactcgtgaccggccggagcgagtcgatcatgaaactggaagagagaacaggtgtctcttgggatttgggggtggaagacgcttccgagagcaagctgttaactgtttcaattatggatctcagtcagatgtattctcctgtgttcgagtacctgtccggagacaggcaagtagaagagtggcccaaagccacctgtacgggcgattgcccagaacgatgtggttgcacaagctcaacctgccttcataaggagtggcctcacagtcgcaattggcggtgtaaccccacttggtgctggggcgtcgggacaggatgtacctgctgtggcgtggacgtgaaagatctgtttactgaccatatgttcgtcaagtggaaggttgaatacatcaaaacagaggcgattgtgtgcgtagagttgaccagccaggaaagacagtgttccctcatcgaggccgggacgaggtttaatctgggaccagtgactataaccctatctgaaccgcgtaacattcagcaaaagctgcctcccgagatcatcacacttcacccaaaagtcgaagagggcttctttgatctcatgcatgtgcagaaggttctgagcgcttccaccgtgtgcaaattgcagtcatgtacacacggtattcccggggacctgcaggtctatcacataggaaacttactcaagggcgaccgcgtgaatggtcatctgatccacaagattgagcctcatttcaacacttcttggatgagttgggatggctgcgaccttgattactattgtaatatgggggactggccatcgtgcacctacacgggagttacacaacacaaccacgcagcctttgtgaatctgttgaacatcgaaactgattataccaaaacattccattttcacagcaagcgggtcaccgctcatggcgacactccccagctcgatctgaaagccagacctacctacggggcaggagagattacagtgctagtagaagttgcggacatggagctgcacacgaagaaagtggagatctccggccttaagttcgcctctctcgcttgcactggttgttatgcctgctcaagcgggatatcctgtaaagtcaggatccatgtggatgaaccggacgagctgaccgtacacgtgaagagttctgatccagacgtcgttgcagctagcacatcattgatggcccgaaagttagagttcggaaccgattccacttttaaagcattcagtgccatgcccaagacaagcctgtgcttttacattgtggaacgggaatactgtaaatcttgctccgaggaggacacccagaagtgtgtggacacgaaactcgaacagcctcaatcaatcctgattgagcacaagggcactatcataggtaagcagaatgatacatgcaccgctaaaaccagctgttggcttgaatcggtcaagtctttcttttatggcctgaaaaacatgttggggagtgtgttcggaaactttttcattggcatcctactgtttctcgcgcccttcgttctgcttgtattatttttcatgttcgggtggaagatcctgttttgcttcaaatgttgccgcagaactaggggactcttgaagtaccggcatctgaaggacgatgaggaaacaggctatcgaagaattatcgagcgcctcaataataaaaagggtaaaaacaggctgcttgacggggagcgtctggccgatcggaagatagcagaattgttttccaccaaaacacacattggatga

SEQ ID NO: 10423 - RNA, 5052 nt, synthetic construct
  misc_feature 1..5052: note = derived and/or modified CDS sequence (opt3) from CCHFV(81-R-2014)__KR814865.1__GP
  source 1..5052: mol_type = other RNA
atgcacaccctgctcgtgtgcttcatcctttacctgcagttgttaggcctagggggagcccatggtcaaagcaacgctacagagcacaatggcactaacacgaccacagtcccctccacttctcagtcacctaagccactggttagtaccacaccgccccatgcactcgaaagctccaccattaaacctactacaccaacctctgagacggaagggtcgggagagactgcccctctgcctaataccacacagggcccaccccctccagaaactaccccggagagacccgcgacaaccgtgacgtcaactcctagcacagacaacaccaatagtactatacacgtaacagataacaatccaacctccacgatctctaccagcccctcctcaagtcctagcacaccatctactccccagggtattcatcacccggctaggtcccttctgtcagtgagcagtcctaagaccgccacaactcccaccccaacatctcctggggagatcaactccgaaaccagctcgttgcactctgcaatgtcccggactcccacgctccatacagccacccaagtctcaactgagaatgctaaccacagtgcaccacgccagagcgaatcctctgcccagcccaccacaaccagcctgatgacttcacccgctcagagtattctgctcatgtccgccgcgccaacagcaatccaaaatacgcatccgagccccaccaaccgatctaaacgtaatttagagatggagataatcctgactctttcacagggattgaagaaatattacggcaagattctgaagctactccacctgacacttgaagaggacaccgaaggcctgttggagtggtgtaaaagaaacctcgggagtaattgcgatgacgatttcttccagaagaggatcggagaatttttcatgacaggtgagggctattttaacgaggtgctgcagttcaaaactttaagcaccctgtcccctacggaaccatctcacgcccggctccccaccgttgagccttttaagtcgtacttcgctaaagggtttcttagcattgactccggatatttctcagccaagtgttacccacgcagttctacaagcggcctgcaattgatcaacgtgactcagcatcccgcaagaatagctgaaaccccgggtcctaagacaacttccctaaaaaccattaattgcatcaacctgagggcctcagtctttaaggagcaccgggaaattgagatcaatgtgctcctgccacagatcgcggtaaaccttagcaattgtcatgttgtgattaactctcacgtctgcgattattccctggacacggatgggcccgtgcgcttgcctcatatataccacgagggaacattcatccccggcacctacaaaattgtgatcgacaagaaaaataagctcaacgatcgatgtactctggtcacaaattgcgttataaaaggcagagaagtgaggaaggggcaaagtgtattacggcagtataagaccgagattaaaatcggaaaggccagcactggttctcgtaaactgctatccgaggaaccaggcgacgattgtatctcacgcacccagctcctgagaacagaaacggcagagattcacgacgacaactacgggggacctggcgataagatcaccatttgcaatggtagtactatagtggaccagaggcttgggagcgagttgggctgttatacaatcaaccgggtcaaatcgtttaagctgtgcgaaaattccgctaccggaaagacatgcgagattgattctactcccgtgaaatgtcgacaaggcttctgcctcaagatcacccaggaagggcgcggacatgttaaactgagcagaggttcagaggtggtccttgacgcctgtgatagttcctgcgaggtgatgatcccaaagggcacgggggacattctggtagattgttctggaggccagcagcacttcttgaaagacaacctcatagatctgggttgcccgcatatccctttactggggaagatggctatttacatctgtaggatgagcaatcacccccggacaaccatggcctttctattctggttttccttcggctatgttattacttgcatcttttgtaaggcactcttctactcactgataatcattggaacccttggcaaaaagatcaaacaatatcgcgaattgaagccacagacatgcactatttgtgagaccgcccccgtgaacgctatcgacgcggaaatgcacgatctgaactgcagctacaatatatgcccttactgtgcaagtagactcacatctgacgggctggccaggcatgtcccacagtgccccaaacgtaaggagaaggtggaagagacggagttatatctgaaccttgaacggattccttggatcgtccgaaaattgctccaggtgtccgagagcaccggagttgctctgaagagatcgtcatggctaattgtgctgctcgtactgcttactgtctctttgagtccggtgcaatccgccccagttggtcacggcaaaacaatcgaaacctaccagactagggaggggtttacaagcatatgtctgttcatgttaggatctatcctctttctggtgagctgccttgtcaagggcctggtggactccgtatcagatagtttctttcccggtttgagcgtgtgtaaaacctgctctattgggtccatcaatggcttcgaaattgagtcacataagtgttattgcagtctcttttgttgcccttactgtcgccactgcagcgcagaccgggagatccatcagctgcacctatccatatgcaaaaagagaaagacgggatctaacgttatgctggccgtctgtaaaaggatgtgcttccgcgctactattgaagcctcgcgacgggcactcctgatccgtagcatcattaataccacattcgtgatctgtattcttaccttgactatatgcgtggtctcaacatccgcggttgagatggaaaacctgccagctggcacctgggagagagaagaggatttaacaaatttttgtcaccaggagtgccaagtgactgaaaccgagtgtctctgcccctatgaagccctggtgcttaggaagcctctgttcctagacagtatcgtaaaagggatgaagaacctccttaattctacgagcttggagacatccctgtcaattgaggcaccgtggggagccatcaacgtccagtctacctttaaacccactgtgagcaccgctaatattgccttaagttggtccagcgttgaacatcgcggcaacaagatcctcgtgacaggtcggtctgagtcaataatgaagctggaagagagaactggggtctcctgggatcttggagtggaagacgcaagtgagagcaaactgttgaccgtttcgatcatggatctctctcagatgtactccccagtgttcgagtatctgagcggcgacaggcaagtagaagagtggcctaaggctacgtgtacaggtgattgccccgaacgatgtggctgcacctcaagtacttgcctacacaaagagtggccacattctcgcaattggcggtgtaaccctacatggtgctggggagtcgggaccggctgtacttgctgtggggtggacgtgaaggatctgtttacagaccacatgttcgtcaaatggaaggttgaatacattaagaccgaggccatcgtgtgcgtagagcttacgtcccaggaaagacagtgtagcctcattgaggcgggaactaggtttaatctgggccccgtgaccatcacattgtcagaaccacgtaacatacagcaaaaactgccgcctgagattatcaccttacatcccaaggtcgaagagggtttctttgatctcatgcacgtgcagaaagttctgagtgccagcacagtgtgcaagctgcagtcctgtactcacgggatcccaggagacctgcaggtctaccatattggcaacttgctcaaaggtgaccgcataaatggccacctgatccataagattgagccccacttcaacacctcttggatgagctgggatgggtgcgacctagattattactgtaatatgggagactggccttcctgcacgtatacaggcgtgactcaacacaaccatgctgcatttgttaatctgcttaacatcgaaaccgattacacaaagaccttccactttcattcaaaacgggtgactgcccacggggacaccccacagctcgatctgaaggctagacccacatatggagccggcgagattacggtcttggtagaagtggcagacatggagttacatactaaaaaggttgagatctctggtctgaaattcgcgagtctcgcctgcaccgggtgttacgcttgctcgagcggaatatcctgtaaggtgaggatccacgtcgatgaacctgacgagctgacagtgcacgtaaaatcttcagatccggacgtggtcgccgcaagcacctcccttatggctcgaaagctggaatttggcactgatagtacatttaaggccttctctgcaatgccaaaaaccagcttgtgcttttatattgttgagcgggaatactgtaagtcatgctccgaggaggacacgcagaaatgtgtggacactcgcctagaacagccccaaagtatcctgattgagcataagggtacaatcataggcaaacagaatgatacctgcaccgccaaggctagctgttggctcgaatctgtgaagtccttcttttacgggctgaaaaacatgcttggatcagtcttcggcaactttttcattgggatcttactgtttctcgcgcctttcgtgttgctggttctctttttcatgttcggatggaagatcctgttttgcttcaaatgttgcagaaggactcggggccttctgaagtatcgacacttgaaagacgatgaggaaacaggttacagacgcattatcgagaggctaaataataagaaggggaaaaaccgtctgctcgacggagagcggttagccgatagaaagatagcagaactgtttagcaccaaaacacatattggctga

SEQ ID NO: 10424 - RNA, 5052 nt, synthetic construct
  misc_feature 1..5052: note = derived and/or modified CDS sequence (opt3) from CCHFV(5180-R-2011)__KR814874.1__GP
  source 1..5052: mol_type = other RNA
atgcacaccctgctcgtgtgcttcatcctttacctgcagttgttaggcctagggggagcccatagacaaagcaacgctacagagcacaatggtactaacacgaccacagcaccctccacttctcagtcacctaagccaccggtcagtaccgcgcccccttatgccccagaaagctccacaattaaacccaccactcctgcttctgagacagaaggctcgggggagaccacgccaccccctaatactacccagggaccatcaccgcccgaagccacacctgagaggccagcaactaccgccacaagcacccccagtacggacaacactaattccacaacccatgctactgataacaatcctacatctaccataagcacgtccccatcaagtagcccctctaccccgtccacacctcagggcatccaccatcccgcacggaacctgctctcagttagcagtccaaagactgccaccacacctactcccacctctccaggtgacatttccagcgagacatcgtctctgcactccgctatgtcacgcacccccactcttcacacggccacacaagcgagtaccgaaaatgcaaaccatagcgcccctcgacagtccgagtctagcgctcagcagactaccacatcaccaatgaccagtccggcccaacccatcctggtgatgtccgcagctcctactgccattcagaatatccacccaagccccacaaaccgttctaaaagaaatttggaaatggagataatcctcacgctgtcacaggggctgaagaaatactatggaaagattctcaagttactgcatcttaccttggaggaagatactgagggcctgctagaatggtgtaaaaggaacctcggcagtaattgcgacgatgactttttccagaagcggatcgaggaatttttcatgacaggggagggatactttaacgaggtactgcaattcaaaacccttagcacactgtcccctactgaaccatctcacgcgagacccccgaccgtggagccttttaagtcgtatttcgccaaaggatttttgagcattgattccggctacttctcagcaaagtgttatccacgcctcagtacgtctgggctgcagttaatcaacgtcacccagcaccccgctaggatagccgaaacacctggacccaagactaccagcctgaaaacaattaattgcatcaacctccgggcttccgtgtttaaggagcatcgcgaaattgagatcaatgttcttctgccacaaatcgccgtgaacttgtcaaattgtcacgtcgtgattaacagccatgtatgcgactactctctagatactgacggccctgttcgactgccccacatataccatgagggtaccttcatcccagggacgtataaaattgtgatcgataagaaaaataagctcaacgacagatgtacactggtcaccaattgcgtgataaaaggaagggaaattcggaagggccagtccgtgcttcgtcagtacaagactgagatcaaaatcggcaaggcaagtacagggagccgcaaactgttgtctgaggaaccgggagatgactgtatttccagaacccagctcctgaggactgaaaccgccgagatccacgacgataactatggtggccctggggacaagattacaatatgcaatggatcaacgatcgtcgatcaacggttaggcagtgagctgggttgttacaccattaaccgagttaagagctttaaactatgcgaaaattcggctactgggaagacatgcgagatcgactccacccccgtgaaatgtcgccagggcttctgcctcaagatcacacaggaaggaagaggccacgtaaaactgtctagggggagcgaggtggtccttgatgcgtgtgacacttcatgcgaggtgatgattccaaagggaaccggtgatatattggttgactgtagtggcgggcagcaacatttcctgaaagataacctcatcgacctgggatgcccccacattcctcttctgggcaagatggcaatctatatttgtcggatgtccaatcatccacgcacgacaatggcctttttgttctggttttctttcggttacgtgataacctgcatcttttgtaaggctctcttctatagcctgatcattatcgggactttaggcaaaaagattaaacagtacagagaactgaagccccagacctgcacaatctgtgagactgcccctgtcaacgcaatagatgccgaaatgcacgacctaaactgctcctacaatatttgcccgtattgtgcttcaaggctcaccagcgacggactggcccgtcacgtgccacagtgccccaaacggaaggagaaggtagaagagacagagctttacttgaacctggaacgaatcccttggattgttagaaaactcctgcaagtgagtgagtctacgggcgtcgcattaaagaggtccagctggctgatcgtgcttttggtcctcctgaccgtgtcgctatcaccagttcagtctgcgcccgtggggcatggaaaaactatagaaacatatcagacccgcgagggttttacaagtgtatgtctgttcatgctcggctccatcctgtttcttgtcagctgcttggtgaaggggctggttgattctgtgagcgactccttctttcctggattatcagtctgtaaaacatgcagtattggcagcatcaatggtttcgaaattgagtctcacaagtgttactgctccctcttttgttgcccgtattgtcggcattgctcagctgatagagagatccaccagctgcatcttagtatatgcaaaaagaggaagatggggagcaacgtgatgctggccgtatgtaaacgcatgtgcttccgagcaaccattgaagcctcccggcgtgctttgctcatcagatctatcattaatacgactttcgtgatctgtattctgaccctaacaatatgcgttgtctcgaccagcgccgtggagatggaaaacctgccctcaggcacttgggagagggaagaggacctcacaaatttttgtcaccaagagtgccaggtgaccgaaacagagtgtctgtgcccatacgaagcacttgtcttgcgcaagcctctgttcttagattccatcgttaaaggaatgaagaacctcctgaatagtacttctcttgagaccagcctgtccattgaggctccctggggcgccatcaacgtgcagtcaacgtttaaaccaacagtgtctaccgcgaatattgccctaagctggagttccgtagaacaccgggggaacaagatcctcgtcactggaagaagcgagtctataatgaagctggaagagaggaccggcgtgtcatgggacttgggtgttgaagatgcttccgagagtaaactgttaacagtgagcatcatggacctctcgcaaatgtattctcctgtcttcgagtacctgtccggggatcgacaggtggaagagtggcccaaggcaacttgtaccggagactgcccagaacgctgtggctgcacgagctcaacatgccttcataaagagtggccgcacagtcggaattggagatgtaaccctacctggtgctggggtgttggcactgggtgtacatgctgtggagtggatgtaaaggacctgtttaccgatcatatgttcgtcaaatggaaggtggaatacattaagactgaggccatcgtgtgcgtcgagttgacatctcaggaaaggcagtgttccctcattgaggctggcacccgttttaatctggggcccgttacgatcactctaagcgaaccacgcaacatacaacagaaactgccccctgagattatcacccttcacccaaaggtggaagagggattctttgacctcatgcatgtacagaaagtgctgtcagccagtacagtctgcaagttgcagagctgtacccacggcatccccggtgacctgcaagtgtatcacattgggaacttactcaaaggagatcgggttaatggccatctgatacacaagatcgagcctcatttcaacacatcctggatgtcttgggacggttgcgatcttgactactattgtaatatgggcgattggccgagctgcacttacaccggggtgacgcagcacaaccacgcagcgtttgtcaatctgttgaacattgaaacagactatactaagaccttccattttcactccaaaagagtgacagcccatggagataccccacagctcgacctgaaggctaggcccacttacggcgccggggagatcaccgttctagtggaagtcgcagatatggagctgcacactaaaaaggtagagatttcaggacttaaattcgcttctctcgcctgcacgggctgttatgcatgcagttcgggtatcagctgtaaggtgcgaatacatgttgacgaacctgatgagctgactgtgcacgtcaaatccaatgaccccgatgtggtagccgcttctacctcattgatggcgcggaagttagagttcgggacagacagcacctttaaggccttctccgcaatgccaaaaacaagtctgtgcttttacatcgtggaacgcgaatactgtaagtcttgcagcgaggaggacactcagaaatgtgtcgataccaagctcgaacaacctcagtcaattctgatcgagcacaaaggaacgattatcggcaagcagaacgacacttgcacagctaaggcctcctgttggcttgaaagtgttaagagcttcttttatggtctgaaaaatatgttgggctctgtgttcgggaactttttcataggtattctactgtttctcgcccccttcgtgctgcttgtcttatttttcatgttcggctggaaaatcctgttttgcttcaagtgttgcagaaggacccgggggctcttgaaataccgactgctcaaggatgacgaggaaaccggatatagacgcatcattgagaggctgaataacaagaaaggcaagaatcgtcttctggatggtgagcggttggctgacagaaaaatcgcagaactattttccactaagacacatatagggtga

SEQ ID NO: 10425 - RNA, 5052 nt, synthetic construct
  misc_feature 1..5052: note = derived and/or modified CDS sequence (opt3) from CCHFV(24-R-2012)__KR814856.1__GP
  source 1..5052: mol_type = other RNA
atgcacaccctgctcgtgtgcttcatcctttacctgcagttgttaggcctgggtggagcccatagacaaagcaacgctacagagcacaatggtactaacacgaccacagcaccctccacttctcagtcacctaagccaccggtcagtaccgcgccccctcatgccccagaaagctccacaattaaacccaccactcctgcttctgagacagaaggctcgggggagaccacgccaccccctaatactacccagggaccatcaccgcccgaagccacacctgagaggactgcaaccacagccaccagcacgccaagtactgacaacacaaattccaccactcacgctacagataacaatcccacctctacgataagcacctccccttcaagtagcccatctacaccctccactccgcagggcatccatcaccctgcacggaacctactctcagttagcagtcccaagaccgccacaactccaacccctacatctcccggtgacatttccagcgagacctcgtctctgcactccgctatgtcacgcactccaacgcttcatacagccacccaagcgagtactgaaaatgcaaaccacagcgctccccgacagtccgagtctagcgcccagcagaccacaacctcacctatgactagcccagcccaaccgatcctggtgatgtccgcagctcccacagccattcagaatatccatcctagcccaacgaaccgttctaaaagaaatttggaaatggagataatcctcaccctgtcacaggggctgaagaaatattacggaaagattctcaagttactgcaccttactttggaggaagatacagagggcctgctagaatggtgtaaaaggaacctcggcagtaattgcgacgatgactttttccagaagcggatcgaggaatttttcatgaccggggagggatattttaacgaggtactgcaattcaaaacacttagcactctgtcccccaccgaaccttctcacgcgcgcccacccacggtggagccgtttaagtcgtacttcgccaaagggtttttgagcattgattccggctatttctcagcaaagtgttaccctagactcagtacctctgggctgcagttaatcaacgtcacacagcatccagctaggatagccgaaactcccggacctaagaccacaagcctgaaaactattaattgcatcaacctccgggcttccgtgtttaaggagcaccgcgaaattgagatcaatgttcttctgccccaaatcgccgtgaacttgtcaaattgtcatgtcgtgattaacagccacgtatgcgactattctctagataccgacggcccagttcgactgcctcatatataccacgagggtacgttcatccccgggacatacaaaattgtgatcgataagaaaaataagctcaacgacagatgtaccctggtcactaattgcgtgataaaaggaagggaagtgcggaagggccagtccgtccttcgtcagtataagacagagattaaaatcggcaaggcaagtaccgggagccgcaaactgttgtctgaagaaccaggagatgactgtatctccagaactcagctcctgaggaccgaaacagccgagattcacgacgataactacggtggcccgggggacaagatcacgatttgcaatggatcaaccatagttgatcaacggttaggcagtgagctgggttgttatactatcaaccgagtgaaaagttttaagctatgcgaaaattcggctacagggaagacctgcgagattgactccacacctgtaaaatgtcgccagggcttctgcctcaagatcactcaggaaggaagaggccatgtgaaactgtctagggggagcgaggtcgtgcttgatgcgtgtgacacctcatgcgaggttatgatccccaagggaacgggtgatattttggtggactgtagtggcgggcagcaacacttcctgaaagataacctcatagacctgggatgcccacatatcccccttctgggcaagatggcaatttacatctgtcggatgtccaatcaccctcgcacaaccatggcctttttgttctggttttctttcggttatgtcattacttgcatcttttgtaaggctctcttctacagcctgataatcattgggaccttaggcaaaaagatcaaacagtatagagaactgaagccacagacatgcactatttgtgagaccgcccccgtgaacgcaatcgatgccgaaatgcacgacctaaactgctcctacaatatatgcccttactgtgcttcaaggctcacaagcgacggactggcccgtcatgtaccgcagtgcccaaaacggaaggagaaggttgaagagacggagctttatttgaacctggaacgaatcccctggattgtgagaaaactcctgcaagtcagtgagtctaccggcgtggcattaaagaggtccagctggctgattgtccttttggtgctcctgactgtttcgctatcacctgtgcagtctgcgccagtagggcacggaaaaacaatcgaaacctaccagactcgcgagggttttacaagtgtctgtctgttcatgctcggctccatactgtttcttgtgagctgcttggttaaggggctggtggattctgtcagcgactccttctttcccggattatcagtgtgtaaaacctgcagtatcggcagcattaatggtttcgaaatcgagtctcataagtgttattgctccctcttttgttgcccttactgtcggcactgctcagctgatagagagattcatcagctgcaccttagtatctgcaaaaagaggaagatggggagcaacgtaatgctggccgtgtgtaaacgcatgtgcttccgagcaacgatagaagcctcccggcgtgctttgctcattagatctatcatcaatactaccttcgttatttgtatcctgacactaaccatttgcgtcgtgtcgactagcgccgtggagatggaaaacctgccgtcaggcacatgggagagggaagaggacctcaccaatttttgtcaccaagagtgccaggtcacagaaactgagtgtctgtgcccctatgaagcacttgttttgcgcaagccactgttcttagattccatagtgaaaggaatgaagaacctcctgaatagtacctctcttgagacgagcctgtccatcgaggctccttggggcgccattaacgtgcagtcaacatttaaacccaccgtatctactgcgaatatcgccctaagctggagttccgtcgaacatcgggggaacaagattctcgtgaccggaagaagcgagtctatcatgaagctggaagagaggacaggcgtttcatgggacttgggtgtggaagatgcttccgagagtaaactgttaactgtcagcataatggacctctcgcaaatgtactctccagtgttcgagtatctgtccggggatcgacaggttgaagagtggcctaaggcaacctgtacgggagactgccccgaacgctgtggctgcacaagctcaacctgccttcacaaagagtggccacatagtcggaattggagatgtaacccgacttggtgctggggtgtgggcacagggtgtacctgctgtggagtagatgtcaaggacctgtttactgatcacatgttcgtgaaatggaaggtggaatacatcaagacagaggccattgtctgcgttgagttgacctctcaggaaaggcagtgttccctcatcgaggctggcacgcgttttaatctggggcctgtgactattaccctaagcgaaccccgcaacatccaacagaaactgccacccgagataattacacttcatcctaaggtagaagagggattctttgacctcatgcacgtgcagaaagtcctgtcagccagtaccgtgtgcaagttgcagagctgtacacacggcatcccaggtgacctgcaagtttaccatatcgggaacttactcaaaggagatcgggtgaatggccacctgattcataagatagagccccacttcaacacttcctggatgtcttgggacggttgcgatcttgactattactgtaatatgggcgattggcctagctgcacctatacgggggtcacacagcacaaccatgcagcgtttgtgaatctgttgaacatcgaaactgactacaccaagacattccactttcattccaaaagagttaccgcccacggagatactccgcagctcgacctgaaggctaggccaacctatggcgccggggagattacagtgctagtcgaagtagcagatatggagctgcatacgaaaaaggtggagatctcaggacttaaattcgcttctctcgcctgcactggctgttacgcatgcagttcgggtattagctgtaaggttcgaatccacgtggacgaacccgatgagctgaccgtccacgtgaaatccaatgaccctgatgtagtggccgcttctacatcattgatggcgcggaagttagagttcgggaccgacagcacttttaaggccttctccgcaatgcccaaaacaagtctgtgcttttatatagtcgagcgcgaatactgtaagtcttgcagcgaggaggacacccagaaatgtgttgatacgaagctcgaacaaccacagtcaatcctgattgagcataaaggaactatcattggcaagcagaacgacacatgcaccgctaaggcctcctgttggcttgaaagtgtgaaatctttcttttacggtctgaagaatatgttgggcagcgtgttcgggaactttttcatcggaatactactgtttctcgcccctttcgtcctgcttgtgttatttttcatgttcggctggaaaattctgttttgcttcaagtgttgcagaaggacccgggggctcttgaaatatcgactgctcaaggatgacgaggaaactggatacagacgcatcatcgagaggctgaataacaagaaaggcaagaatcgtcttctggatggtgagcggttggctgacagaaaaattgcagaactattttccacaaagacccacatcgggtga

SEQ ID NO: 10426 - RNA, 5052 nt, synthetic construct
  misc_feature 1..5052: note = derived and/or modified CDS sequence (opt3) from CCHFV(46-ST-2012)__KR814860.1__GP
  source 1..5052: mol_type = other RNA
atgcacaccctgctcgtgtgcttcatcctttacctgcagttgttaggcctgggaggagcccatggtcaaagcaacgctacagagcacaatggcactaacacgaccacagtcccctccacttctcagtcacctaagccactggttagtaccacaccgccccatgcactcgaaagctccaccattaaacctactacaccaacctctgagacggaagggtcgggagagactgcgcccctgcctaataccacacagggcccaccccctccagaaactaccccggagagacccgccacaaccgtgacgtcaactcctagcacagacaacaccagttccactatacacgtaacagataataacccaacctctacgatcagcacctccccctcaagtagcccttctacaccatccactccccagggtattcatcacccggctaggtcacttctgagcgtgagttctcctaagaccgccacaactcccaccccaacatcccctggggagatcaatagcgaaacctcgtctttgcactccgcaatgtcacggactcccacgctccatacagccacccaagtcagtactgagaacgctaatcacagcgcaccacgccagtccgaatctagcgcccagcccaccacaacctcactgatgacaagtcctgctcagtccattctgctcatgagcgccgcgccaacagcaatccaaaacatacatccgtctcccacgaatcgatcaaaacgtaacttagagatggagatcattctgacccttagtcagggattgaagaaatattacggcaagatcctgaagctactccacctgactcttgaagaggacacagaaggcctgttggagtggtgtaaaagaaatctcgggagcaactgcgatgacgactttttccagaagaggattgaagagtttttcatgaccggagagggttattttaatgaagtgctgcagttcaaaacattatccactctgtctcctaccgagccatcgcacgcccggctccccacggttgaaccttttaagagctacttcgctaaaggctttctttccgtggattcagggtatttcagtgccaagtgttacccacgctctagcacctccggactgcaattgatcaacgtcacacagcatcccgcaagaatagctgagactccgggccctaagaccacatcactaaaaactattaactgcatcaatctgagggccagcgtgtttaaggaacaccgggagattgagatcaacgtactcctgccacagatcgcggttaatctttctaactgtcatgtggtcattaattcccacgtgtgcgattatagtctggacaccgatggtcccgtgcgcttgcctcatatataccacgaagggacgttcatccccggaacatacaaaattgtcatcgacaagaaaaacaagctcaatgatcgatgtaccctggttactaactgcgtgataaaaggcagagaggtaaggaagggccaaagcgtgttacggcagtataagacagaaattaaaatcgggaaggcctctaccggatcccgtaaactgctatcagaggaaccaggtgacgattgtatcagtcgcactcagctcctgagaaccgagacagcagagattcacgacgacaattacggcgggcctggagataagatcacgatttgcaacggcagcaccatagtcgaccagaggcttggttcggaattggggtgttatactatcaatcgggtgaaatcctttaagctgtgcgagaactctgctacaggcaagacctgcgaaattgatagcacacccgttaaatgtcgacaaggattctgcctcaagatcactcaggagggccgcgggcatgtgaaactgtcaagaggaagtgaggtcgtgcttgacgcctgtgattcctcttgcgaagtaatgatcccaaagggtaccggcgacattctggttgattgtagcgggggacagcagcacttcttgaaagacaatctcatagatctgggctgcccgcatatccctttactgggtaagatggctatttacatctgtaggatgtccaaccacccccggacgacaatggcctttctattctggttttcattcgggtatgtgattacctgcatcttttgtaaggcactcttctacagcctgataatcattggcactcttgggaaaaagatcaaacaatatcgcgagttgaagccacagacctgcacaatttgtgaaactgcccccgtcaatgctatcgacgcggagatgcacgatctgaactgcagttacaacatatgcccttactgtgcatctagactcacctccgacggcctggccaggcatgtgccacagtgccccaaacgtaaggaaaaggtcgaggagacagaattatatctgaatcttgagcggattccttggatcgtgcgaaaattgctccaggttagcgaatcgacgggggtggctctgaagagatcatcttggctaattgtactgctcgtcctgcttaccgtgagtttgtccccggttcaaagcgccccagtgggacacggtaaaactatcgagacataccagaccagggaaggctttacttctatatgtctgttcatgttagggagcatcctctttctggtctcctgccttgtgaagggactggtagactcagtgagtgatagcttctttcccggcttgtctgtttgtaaaacatgctccattggttcaatcaacgggttcgagattgagagtcataagtgttattgcagcctcttttgttgcccttactgtcgccactgctccgcagaccgggaaatccatcagctgcacctatctatatgcaaaaagagaaagaccggctcgaatgtcatgctggccgtgtgtaaaaggatgtgcttccgcgctacgattgaggccagccgacgggcactcctgatccgttcaatcattaacgcgactttcgtgatctgtattcttaccttgacaatatgcgtcgtttccaccagtgctgtggaaatggagtctctgccagccggaacttgggaaagagaggaggatttaacaaatttttgtcaccaggaatgccaagtgaccgagacagaatgtctctgcccctatgaggcactggtacttaggaagcctctgttcctagacagcatcgtcaaaggcatgaagaacctcctaaattccacttcattggagacctctctgagcattgaagccccgtggggagctatcaacgtgcagagtacgtttaaacccacagtttccaccgccaatattgcattaagctggtcttcagtggagcatcgcgggaacaagatcctcgtcactggccggtccgaaagtataatgaagctggaggaaagaaccggtgtgagctgggatcttggggttgaggacgcttcggagtctaaactgttgacagtgtccatcatggatctcagccagatgtactcaccagtattcgaatatctgagtggagacaggcaagtcgaggaatggcctaaggccacttgtaccggcgattgccccgagcgatgtggttgcacgtcttccacatgcctacacaaagaatggccacatagccgcaattggcggtgtaaccctacctggtgctggggcgtggggactggatgtacatgctgtggcgtggacgtcaaggatctgtttaccgaccacatgttcgttaaatggaaggtggagtacattaagactgaggcgatcgtatgcgtggaacttacatcacaggagagacagtgtagtctcattgaagccgggaccaggtttaatctgggacccgtcacgatcactttgagcgagccacgtaacatacagcaaaaactgccgcctgaaattatcaccttacatcccaaggtggaggagggcttctttgatctcatgcacgttcagaaagtgctgtccgcttctacagtctgcaagctgcagagctgtacccacggtatcccaggggaccttcaggtgtaccatattggaaatttgctcaaaggcgaccgcataaacggtcacctgatccataagattgaaccccacttcaacacatcctggatgtcatgggatggctgcgacctagattattactgtaatatgggggactggccttcttgcacttataccggagttacgcaacacaaccatgcagcctttgtgaatctgcttaacatcgagacagattacactaagaccttccactttcatagtaaacgggtcacagctcacggcgacaccccacagctcgatctgaaggccagacccacttatggggcaggagaaattaccgtattggtggaggttgcggacatggagttacatactaaaaaggtggaaatctcgggcctgaaattcgccagcctcgcttgcacgggttgttacgcctgctcctctgggatatcatgtaaggtcaggatccacgtggatgagcctgacgaactgactgtacacgtgaaaagctccgatccggacgtcgttgcagctagtacctctcttatggcccgaaagctggagttcggaacagatagcacctttaaggcattctcagccatgccaaaaacttccttgtgcttttatattgtggaacgggagtactgtaagagttgcagcgaggaagacacacagaaatgtgtggacacccgcctagagcagccccaatctatcctgattgaacataagggcacgatcataggtaaacagaatgatacttgcacagctaaggcgtcctgttggctcgagtcagtcaagagcttcttttacggcctgaaaaacatgcttgggtcggtgttcggaaactttttcattggcatcttactgtttctcgcccctttcgttttgctggtactctttttcatgttcgggtggaagatcctgttttgcttcaaatgttgcagaaggacccggggacttctgaagtatcgacacttgaaagacgatgaagagaccggctacagacgcattatcgagaggctaaataataagaagggtaaaaaccgtctgctcgacggggaacggttagcagatagaaagatagctgagctgttttctactaaaacacatattggatga

SEQ ID NO: 10427 - RNA, 5052 nt, synthetic construct
  misc_feature 1..5052: note = derived and/or modified CDS sequence (opt3) from CCHFV(ROS/HUVLV-100)__DQ206448.1__GP
  source 1..5052: mol_type = other RNA
atgcacaccctgctcgtgtgcttcatcctttacctgcagttgttaggcctagggggagcccatagacaaagcaacgctacagagcacaatggtactaacacgaccacagcaccctccacttctcagtcacctaagccactggtcagtaccgccccgccccatgcgctcgaaagctccacaattaaacctaccactccagtttctgagacagaaggctcgggggagaccacgccccctccaaatactacccagggaccctcacctccagaagctacaccggagaggcccactaccacagccaccagcacgcctagtactgacaacacaaattccaccactcacgtgacagataacaatccaacctctacgataagcacctccccctcaagtagcccttctacaccatccactccccagggcatccatcacccggcacggaacctgctttcagtaagcagtcctaagaccgccacaactcccaccccaacatctcctggtgagatttccagcgaaacctcgtctctgcactccgctatgtcacgcacttccacgttgtatacagcaacccaagtgagcactgagaatgccaaccattccgctccccgacagtctgaaagctcagcccagcagaccacaaccagtccaatgacttcccccgcgcaaagcatcctcgtcatgtctgcagcccctacagctattcagaatatccacccatcaccgacgaaccgtagtaaaagaaatctggagatggagataatcctgaccctcagccaggggttaaagaaatactatggaaagattctgaaacttttgcatctgactctagaagaggacacagaaggcctcctggagtggtgtaaaaggaaccttggctccaattgcgatgacgactttttccagaagcggatcgaagagtttttcatgaccggggagggatactttaacgaagtgctgcaattcaaaacattgtctactctctcgcccaccgagcctagccacgcccgcccacccacggttgaaccttttaagtcctatttcgcaaaaggttttctgtcaattgatagtggctacttctctgctaagtgttatccaagattaagcacctccgggctgcagctcatcaacgtgacacagcaccccgccaggatagcggagactccgggacctaagaccacatcacttaaaactattaattgcatcaacctgcgggccagcgtctttaaggaacatcgcgagattgagatcaatgtgttgctaccacaaatcgcagtaaacctgtctaattgtcacgttgtgattaactcccatgtctgcgattacagtctcgacaccgatggccccgtgcgactgcctcacatataccatgaaggtacgttcatccccgggacatataaaattgtgatcgacaagaaaaataaacttaacgatagatgtaccctggtcactaattgcgttataaagggaagggaggtgcggaagggccagagcgtattgcgtcagtacaagacagaaattaaaatcggcaaggcttctaccgggtcccgcaaactcctgtcagaggaaccaggagacgattgtatcagtagaactcagttactgaggaccgagacagccgagattcacgacgacaactatggtggccctggggataagatcacgatttgcaatggaagcaccatagtggaccaacggctaggctcggaactcggttgttacactatcaaccgagtcaaatcctttaagctgtgcgaaaattctgctacagggaagacctgcgagattgatagcacacccgtgaaatgtcgccagggcttctgccttaagatcactcaggagggaagaggccacgttaaattgtcaagggggagtgaggtggtcctggacgcctgtgattcctcttgcgaagtgatgatcccaaagggaaccggtgacattctcgtagattgtagcggcgggcagcaacatttcctgaaagacaaccttatagatctgggatgcccgcacatccctttgctcggcaagatggcaatttatatctgtcggatgtccaatcatccccgcacgacaatggcctttctgttctggttttcattcggttacgttattacctgcatcttttgtaaggctttattctatagcctgataatcattgggactctaggcaaaaagatcaaacagtacagagagctcaagccacagacctgcacaatttgtgaaactgcgcccgtgaacgcaatcgacgccgagatgcacgatctgaactgcagttacaatatatgcccttattgtgcttctaggcttacctccgacggattggcccgtcacgtcccacagtgccccaaacggaaggaaaaggtggaggagacagaactgtacctcaacctggagcgaatcccttggattgtcagaaaattactgcaagtgagcgaatcgacgggcgttgcacttaagaggtcatcttggttgattgtgctcctggtactactgaccgtcagtctctccccggtgcagagcgccccagttgggcatggaaaaactatcgagacatatcagacccgcgaaggttttacttctatatgtctgttcatgcttggcagcatcttgtttctggtgtcctgcttagtcaaggggctcgtggactcagtaagtgatagcttctttcccggactgtctgtgtgtaaaacatgctccattggctcaatcaatggtttcgagattgagagtcacaagtgttactgcagcctgttttgttgcccttattgtcggcattgctccgctgacagagaaatccaccagctgcatttgtctatatgcaaaaagaggaagaccgggtcgaacgttatgctcgccgtctgtaaacgcatgtgcttccgagcaacgattgaggcgagccggcgtgctctgctaatcagatcaatcattaatactaccttcgtgatctgtattctgacactcaccatatgcgtggtctccacaagtgccgttgaaatggagaacctgccatctggcacttgggaaagggaggaggatcttaccaatttttgtcaccaagaatgccaggtgacagagactgaatgtttgtgcccctacgaggcactggtgttacgcaagcctctcttcctggacagcatcgtaaaaggaatgaagaaccttcttaattccacctcactagagacgtctctcagcattgaagccccgtggggcgctatcaacgtccagagtacatttaaacccaccgtgtccactgccaatattgcactgagctggtcttcagttgagcaccgggggaacaagatcttggtgaccggaagatccgaaagtataatgaagctggaggaaaggacaggcgtcagctgggatttaggtgtggaggacgcttcggagtctaaactcctgactgtttccatcatggatcttagccaaatgtattcaccagtgttcgaatacctgagtggggaccgacaggtagaggaatggcctaaggccacctgtacgggagattgccccgagcgctgtggctgcacatctagtacctgcttgcataaagaatggccacacagccggaattggagatgtaaccctacttggtgctggggtgtcggcacagggtgtacctgctgtggagtggacgtgaaggatctctttactgaccatatgttcgtcaaatggaaggttgagtacattaagacagaggcgatcgtgtgcgtagaactgacctcacaggagaggcagtgtagtctaattgaagccggcacgcgttttaatctggggcccgtgactatcacccttagcgagccacgcaacatacaacagaaactcccgcctgaaattatcacactgcaccccaaggtcgaggagggattctttgatttgatgcatgtgcagaaagttctgtccgcttctaccgtgtgcaagttacagagctgtacacacggcatcccaggtgacctccaagtctatcacattgggaacctgcttaaaggagaccgggtgaatggccatctgatacacaagatcgaaccccatttcaacacttcctggatgtcatgggatggttgcgacttggattactattgtaatatgggcgactggccttcttgcacctacacgggggttacacagcacaaccacgcagcctttgtgaatctcctgaacattgagactgattataccaagacattccattttcacagtaaaagagtcaccgctcatggagacactccacagctagatctgaaggccaggcccacctacggcgcaggggaaatcacagtacttgtggaggttgcggacatggagctccacacgaaaaaggtggaaatttcgggactgaaattcgccagcttggcttgcactggctgttatgcctgctcctctggtatctcatgtaaggtccgaatacatgtggatgagcctgacgaattaaccgtacacgtgaaaagctccgatccggacgtcgttgcagctagtacatctctgatggcccggaagctcgagttcgggaccgatagcacttttaaggcattctcagccatgccaaaaacatccctgtgcttttacatcgtggaacgcgagtactgtaagagttgcagcgaggaagacacccagaaatgtgtggacacgaaacttgagcaaccccagtctattctgatcgaacacaagggaactattatcggcaagcagaatgatacatgcaccgctaaggcgtcctgttggttggagtcagtcaagagcttcttttatggtctaaagaacatgctgggctcggtgttcgggaactttttcataggcattctcctgtttcttgcccctttcgttttactggtactctttttcatgttcggatggaaaatcttgttttgcttcaagtgttgcagaaggacccgggggctgctcaaataccgactgcttaaggacgatgaagagactggatatagacgcatcattgagaggctgaataataagaaaggcaagaaccgtttgctagacggtgaacggctggcagatagaaaaatcgctgagctcttttctacaaagacccatatagggtga

SEQ ID NO: 10428 - RNA, 5052 nt, synthetic construct
  misc_feature 1..5052: note = derived and/or modified CDS sequence (opt3) from CCHFV(Saf)__KX013487.1__GP
  source 1..5052: mol_type = other RNA
atgcacaccctgctcgtgtgcttcatcctttacctgcagttgttaggcctagggggagcccatggtcaaagcaacgctacagagcacaatggcactaacacgaccacagcaccctccacttctcagtcacctaagccactggtcagtaccgccccgccccatgcgctcgaaagctccacaattaaacctaccactccagcttctgagacagaagggtcgggagagaccacgccccctccaaatactacccagggcccctcacctccagaaacaactccggagagacccgccaccacagcaaccagcacgcctagtactgacaacacaaattccaccactcacgttacagataacaatccaacctctacgataagcacctccccctcaagtagcccttctacaccatccactccccagggtatccatcacccggccaggaacctgctttcagtgagcagtcctaagaccgctacaactcccaccccaacatctcctggggagatttccagcgaaacctcgtctctgcactccgcaatgtcacggaccagtacgttgtatacagccacccaagtaagcactgagaatgctaaccattccgcgccccgccagtctgaaagctcagcccagccaaccacaaccagtcccatgacttcccctgcacagagcatcctcgtgatgtctgccgctccaacagccattcaaaatatccacccgtcacccacgaaccgaagtaaacgtaatctggagatggagataatcctgaccctcagccagggattaaagaaatactatggcaagattctgaagctgttgcatctgactctagaagaggacacagaaggcctcctggagtggtgtaaaagaaaccttgggtccaattgcgatgacgactttttccagaagaggatcgaagagtttttcatgaccggagagggttactttaacgaagtcctgcagttcaaaacattgtctactctctcgcctaccgagccaagccacgcacggccccctacggtggaaccatttaagtcctatttcgctaaaggctttctgtcaattgatagtgggtacttctctgccaagtgttatccccgcagctccacctcaggattacaactgatcaacgttacacagcacccggcgagaatagccgagactcctggcccaaagaccacaagcctcaaaactattaattgcatcaaccttagggcatctgtgtttaaggaacatcgggagattgagatcaatgtcctgttgccccagatcgctgtgaacctatccaattgtcacgtagttattaacagtcatgtgtgcgattacagcctggacaccgatggtcctgtccgcctcccccacatacatcacgaagggacgttcatcccaggaacatacaaaattgtgatcgacaaggagaataaactgaacgatcgatgtacccttgtgactaattgcgtcataaagggcagagaagttaggaaaggccaatctgtgctgcggcagtataagacagagattaagatcgggaaagcctccaccggatcacgtaagttgctcagtgaggaacctggtgacgattgtatcagccgcactcagctgttaagaaccgagacagctgaaattcacgacgacaactacggcgggcccggagataaaatcacgatttgcaatggctcgaccatagtagaccagaggctgggttccgagctagggtgttatactatcaaccgggtgaagtcttttaaactctgcgaaaatagcgccacaggcaagacctgcgagattgattcaacaccagtcaagtgtcgacaaggattctgcctgaaaatcactcaggagggccgcgggcatgtgaaacttagtagaggatccgaagttgtgttggacgcatgtgattctagctgcgaggtcatgatcccgaagggtaccggcgacattctggtggattgttccgggggacagcagcactacctcaaggacaacctgatagatcttggctgccctcatatccccctgttgggtaaaatggccatttatatctgtaggatgtcaaatcacccacggacgacaatggctttcctcttttggttcagctttgggtacgtaattacctgcatcttctgtaaggcgctgttttatagtttaataatcattggcactctgggaaagaaaatcaagcaataccgcgaactaaaaccccagacctgcacaatttgtgagactgcacctgttaacgccatcgacgctgaaatgcacgatctcaactgctcttacaatatatgcccatattgtgcctccagactgaccagcgacggccttgcaaggcatgtgccccagtgccctaagcgtaaagagaaggtcgaggaaacagagttgtacctgaacctcgaacggattccgtggatcgtgcgaaagctgttacaggtctcggagtcaacgggggtggccctgaaaagatctagttggcttattgttttgctcgtgctgctaaccgtatccctgagcccagtccaatctgctcccgtgggacacggtaagactatcgaaacatatcagaccagggagggcttcactagcatatgtctctttatgctggggtccatccttttcttggtttcatgcctggtgaaaggattagtcgacagtgtgagcgattcctttttccctggcctctctgtatgtaagacatgctcaattggtagtatcaatgggtttgagattgaaagccataaatgttactgctccctgttctgttgcccatattgtcgccactgctctgccgaccgggagatccatcagcttcacctgtcgatatgcaagaaaagaaagaccggcagcaacgtgatgttggcagtttgtaagaggatgtgctttcgcgcgacgattgaggcttcacgacgggccctcctgatccgttccatcattaatactaccttcgtcatctgtattctaacactgaccatatgcgtggtgagtacttctgcagtcgaaatggaaaacctccccagcggaacatgggagagagaggaagatctgaccaatttctgtcaccaggagtgccaagttacagaaactgagtgtctttgcccttacgaggccttggtgctgaggaaaccgttattttccgactcaatcgtgaagggcatgaaaaacctccttaattctaccagccttgaaacgagtctgtccattgaggctccctggggagccatcaacgtacagagcacattcaagccaaccgtctctactgcaaatattgctctatcatggtccagtgtggaacatcgcgggaacaaaatcctcgttaccggccggagcgagtcgataatgaagctggaagagagaacaggtgtgtcttgggatttgggggtcgaggacgcctccgaaagcaagctgttaactgtgtcaatcatggatctcagtcagatgtattctcctgtttttgagtacctgtccggagacaggcaagtggaagagtggcccaaagcgacctgtacgggcgattgcccagaacgatgtggttgcacaagctcaacctgccttcacaaggagtggcctcatagtcgcaattggcggtgtaaccccacttggtgctggggcgtagggacaggatgtacctgctgtggcgtcgacgtgaaagatctgttcactgaccacatgtttgtgaagtggaaagtcgagtacattaagacagaagccatcgtttgcgtggagttgaccagccaggaaagacagtgttccctcattgaggctgggacgaggttcaatctgggaccagtaactatcaccctatctgaaccgcgtaacatacagcaaaagctgcctcccgagattatcacacttcatccaaaagtggaggaaggctttttcgatctcatgcacgtccagaaggtgctgagcgcatccaccgtttgcaaattgcagtcatgtacacacggtatccccggggacttacaggtgtatcatattggaaacctgctcaagggcgaccgcgtcaatggtcacctgatacataaaatcgagcctcactttaacacttcttggatgagttgggatggctgcgaccttgattactattgtaatatgggggactggccatcgtgcacctacacgggagtgacacaacacaaccatgccgctttcgttaatctgttgaacattgaaactgattatatgaagacctttcacttccatagcaagcgggtgacagcccacggcgacactccccagctcgatctgaaagcaagacctacttacggggcgggagagatcaccgtcctagtagaggtggccgacatggaactgcatacaaagaaagttgagatttccggccttaagtttgtgtctctcgcttgcacgggttgttatgcctgctcaagcgggatctcctgtaaagtcaggatacacgtggatgaaccggacgagctgactgtacacgtgaagagttctgatccagacgtcgttgcagctagcacctcattgatggcccgaaaattagagttcggaacagattccaccttcaaggcatttagtgccatgcccaagactagcctgtgcttctacatcgtggaacgggagtactgtaaatcttgctccgaagaggacacacagaagtgtgtggacaccaaactcgaacagcctcaatcaattctgatcgagcataagggcacgattatcggtaaacagaatgatacttgcacagctaaggcgagctgttggcttgaatcggtcaagtctttcttttatggcctgaaaaacatgttggggagtgtgtttggaaatttctttataggcattctactgttcctcgccccctttgttctgcttgtattattctttatgttcgggtggaagatcctgttctgctttaaatgttgccgcagaaccaggggactcttgaagtaccggcacctgaaagacgatgaggagaccggctatcgaagaatcattgaacgcctcaacaataagaagggtaaaaacaggctgcttgacggggagcgtctggcagatcggaagatcgctgaattgttctccactaaaacacatataggatga

SEQ ID NO: 10429 - RNA, 5052 nt, synthetic construct
  misc_feature 1..5052: note = derived and/or modified CDS sequence (opt3) from CCHFV(52-R-2014)__KR814862.1__GP
  source 1..5052: mol_type = other RNA
atgcacaccctgctcgtgtgcttcatcctttacctgcagttgttaggcctgggtggagcccatagacaaagcaacgctacagagcacaatggtactaacacgaccacagcaccctccacttctcagtcacctaagccaccggtcagtaccgcgccccctcatgccccagaaagctccacaattaaacccaccactcctgcttctgagacagaaggctcgggggagaccacgccaccccctaatactacccagggaccatcaccgcccgaagccacacctgagaggccagcaactaccgccacaagcacccccagtacggacaacactaattccacaacccacgctactgataacaatcctacatctaccataagcacgtccccatcaagtagcccctctaccccgtccacacctcagggcatccatcaccccgcacggaacctactctcagttagcagtccaaagactgccaccacacctactcccacctctccaggtgacatttccagcgagacatcgtctctgcactccgctatgtcacgcacccccactcttcatacggccacacaagcgagtaccgaaaatgcaaaccacagcgcccctcgacagtccgagtctagcgctcagcagactaccacatcaccaatgaccagtccggcccaacccatcctggtgatgtccgcagctcctactgccattcagaatatccatccaagccccacaaaccgttctaaaagaaatttggaaatggagataatcctcacgctgtcacaggggctgaagaaatattacggaaagattctcaagttactgcaccttaccttggaggaagatactgagggcctgctagaatggtgtaaaaggaacctcggcagtaattgcgacgatgactttttccagaagcggatcgaggaatttttcatgacaggggagggatattttaacgaggtactgcaattcaaaacccttagcacactgtcccctactgaaccatctcacgcgcgacccccgaccgtggagccttttaagtcgtacttcgccaaagggtttttgagcattgattccggctatttctcagcaaagtgttacccaagactcagtacgtctgggctgcagttaatcaacgtcacccagcatcccgctaggatagccgaaacacctggacccaagactaccagcctgaaaacaattaattgcatcaacctccgggcttccgtgtttaaggagcaccgcgaaattgagatcaatgttcttctgccacaaatcgccgtgaacttgtcaaattgtcatgtcgtgattaacagccacgtatgcgactattctctagatactgacggccctgttcgactgccccatatataccacgagggtaccttcatcccagggacgtacaaaattgtgatcgataagaaaaataagctcaacgacagatgtacactggtcaccaattgcgtgataaaaggaagggaagtgcggaagggccagtccgtccttcgtcagtataagactgagattaaaatcggcaaggcaagtacagggagccgcaaactgttgtctgaggaaccgggagatgactgtatctccagaacccagctcctgaggactgaaaccgccgagattcacgacgataactacggtggccctggggacaagatcacaatttgcaatggatcaacgatagttgatcaacggttaggcagtgagctgggttgttataccatcaaccgagtgaaaagttttaagctatgcgaaaattcggctactgggaagacatgcgagattgactccacccccgtaaaatgtcgccagggcttctgcctcaagatcacacaggaaggaagaggccatgtgaaactgtctagggggagcgaggtcgtgcttgatgcgtgtgacacttcatgcgaggttatgatcccaaagggaaccggtgatattttggtggactgtagtggcgggcagcaacacttcctgaaagataacctcatagacctgggatgcccccatgtccctcttctgggcaagatggcaatctacatttgtcggatgtccaatcacccacgcacgacaatggcctttttgttctggttttctttcggttatgtgattacctgcatcttttgtaaggctctcttctacagcctgatcataatcgggactttaggcaaaaagattaaacagtatagagaactgaagccccagacctgcacaatctgtgagactgcccctgtaaacgcaattgatgccgaaatgcacgacctaaactgctcctacaatatctgcccgtactgtgcttcaaggctcaccagcgacggactggcccgtcatgttccacagtgccccaaacggaaggagaaggtggaagagacagagctttatttgaacctggaacgaataccttggattgtcagaaaactcctgcaagtgagtgagtctacgggcgtcgcattaaagaggtccagctggctgatcgtgcttttggttctcctgaccgtgtcgctatcaccagtacagtctgcgcccgtcgggcacggaaaaactattgaaacataccagacccgcgagggttttactagcgtgtgtctgttcatgctcggctccatcctgtttcttgttagctgcttggtgaaggggctggtcgattctgtgagcgactccttctttcctggattatcagtatgtaaaacatgcagtataggcagcatcaatggtttcgaaattgagtctcataagtgttattgctccctcttttgttgcccgtactgtcggcactgctcagctgatagagagatccatcagctgcaccttagtatttgcaaaaagaggaagatggggagcaacgtgatgctggccgtttgtaaacgcatgtgcttccgagcaaccatcgaagcctcccggcgtgctttgctcataagatctattatcaatacgactttcgtcatctgtattctgaccctaacaatctgcgtggtgtcgaccagcgccgtcgagatggaaaacctgccctcaggcacttgggagagggaagaggacctcacaaatttttgtcaccaagagtgccaggttaccgaaacagagtgtctgtgcccatatgaagcacttgtgttgcgcaagcctctgttcttagattccattgtgaaaggaatgaagaacctcctgaatagtacttctcttgagaccagcctgtccatagaggctccctggggcgccatcaacgtacagtcaacgtttaaaccaacagtctctaccgcgaatattgccctaagctggagttccgtggaacatcgggggaacaagatcctcgttactggaagaagcgagtctattatgaagctggaagagaggaccggcgtgtcatgggacttgggtgtcgatgacgcttccgaaagtaaactgttaacagtgagcatcatggatctctcgcaaatgtactctcctgttttcgagtatctgtccggggaccgacaggtggaggaatggcccaaggcaacttgtaccggagattgcccagagcgctgtggctgcacgagctcaacatgccttcacaaagaatggccgcatagtcggaattggagatgtaaccctacctggtgctggggtgtaggcactgggtgtacatgctgtggagtcgacgtgaaggatctgtttaccgaccacatgttcgtgaaatggaaggtcgagtacataaagactgaagccatcgtttgcgtggagttgacatctcaggagaggcagtgttccctcattgaagctggcacccgttttaatctggggcccgtaacgatcactctaagcgagccacgcaacattcaacagaaactgccccctgaaatcataacccttcatccaaaggtggaggaaggattctttgacctcatgcacgtccagaaagtgctgtcagccagtacagtttgcaagttgcagagctgtacccacggcattcccggtgatctgcaagtgtaccatatcgggaacttactcaaaggagaccgggtcaatggccacctgatccataagattgagcctcacttcaacacatcctggatgtcttgggatggttgcgaccttgattattactgtaatatgggcgactggccgagctgcacttataccggggtgacgcagcacaaccatgcagcgtttgttaatctgttgaacatagagacagattacactaagaccttccactttcattccaaaagagtgacagcccacggagacaccccacagctcgatctgaaggctaggcccacttatggcgccggggaaatcaccgtcctagtagaggtggcagacatggaactgcatactaaaaaggttgagatttcaggacttaaattcgcttctctcgcctgcacgggctgttacgcatgcagttcgggtatcagctgtaaggtgcgcattcacgtcgatgagcctgacgaactgactgtgcacgtaaaatccaatgatcccgacgtggtcgccgcttctacctcattgatggcgcggaagttagagttcgggacagacagcacctttaaggccttctccgcaatgccaaaaacaagtctgtgcttttatatcgttgaacgcgagtactgtaagtcttgcagcgaagaggatacacagaaatgtgtggacaccaagctcgagcaacctcagtcaatactgatcgaacataaaggaacgattatcggcaagcagaacgatacttgcacagctaaggccggttgttggcttgagtccgtgaaaagtttcttttacggcctgaagaatatgttggggagcgtcttcggaaactttttcattggcatcctactgtttctcgcccccttcgtgctgcttgttttatttttcatgttcgggtggaaaatactgttttgcttcaagtgttgcagaaggacccggggactcttgaaatatcgactgctcaaggacgatgaagagaccggctacagacgcattatcgaaaggctgaataacaagaaaggtaagaatcgtcttctggacggggagcggttggctgatagaaaaatcgcagagctattttctactaagacacacattggatga

SEQ ID NO: 10430 - RNA, 5052 nt, synthetic construct
  misc_feature 1..5052: note = derived and/or modified CDS sequence (opt3) from CCHFV(Turkey-Kelkit06)__GQ337054.1__GP
  source 1..5052: mol_type = other RNA
atgcacacccccttggtgtgcttcatcctctaccttcagctgttgtgtttaggcggggcccatggacaactgaacgctacagagcacaatggtactaacaatacgaccgcacctggcgccagccagtccccaaagccgcccatgtctacaactcctccacatgcgcccgaatcaagtaccattaaacctacaaccccaataagcgaggctgaagggtccggagagactacatctccccctaacaccacgcagggcctatcgtcaccagaaactaccagcgagagaccggccacaactagcatctccacctctagcacagactccaccaatcccacgactcagatgacagataacacccctactccaacagtctcaaccagtcccagttcttccccttcaacgccaagcacaccccaaggtattcaccatccggcaaggagtctcctgtctgtttccagccctaagacagtgactacccccacaccaacttcgcctggggagatgtcttccgaaacctcaagtcagcacagcgccatgtcccggatccccacaccacacaccgctactcgcgtatctacggagattacaaatcatcgaactccccgtcagagcgaatcaagtgcacagcaaaccaccccttccccaatgacaagcccggcccagtctatccttctgatgtcagctgcccccaccgcggtgcaggacatacaccctagtccaactaacagaagcaaaaggaatttggagacagagatcattctcacgctgtcccagggactgaagaaatattacggcaagatcctcaagttactgcatcttaccttggaacaagatactgagggcctgctagaatggtgcaaagggaacctcggatctaattgtgacgatgactttttccagaagcggattgaggaatttttcatgacaggtgagtgctattttaacgaggtcctgcagttcaaaaccctttcgacactgagccccactgaaccttcccacgcacgcttgccaaccgccgagccctttaagtcatacttcgctaaaggctttctcagtatcgattctgggtatttcagcgccaagtgttacccgagatcctcagcaagcggactgcaattaataaatgtgacgcagcaccctgctaggattgccgaaaccccaggccccaagacaacttctctgaaaaccatcaactgcattaatctccgggcgtccgtttttaaggagcatcgcgaagtggagatcaacgtccttctgcctcagatcgccgtgaacttgagtaattgtcacgtagttattaacagccatgtgtgcgactattctctagatacagacggtcccgtccgactgccaagaatataccacgaggggactttcatccctggaacctacaaaattgtgatcgataagaaaaataagctcaacgacaggtgtacgctggtgacaaattgcgtcataaaaggccgggaagttcgtaagggccagtccgtgcttcgccaatataagaccgagattaaaatcgggaaggcatcaactggatttagaaaactgttgagtgaggaacccggtgatgactgtatcagcaggacacagctcctgcggaccgaaactgctgagattcatgacgataactacggcgggccaggagacaagatcaccatttgcaatggctcgacaatagtagatcagcgattaggttccgagctggggtgctatacgatcaaccgcgtgaaatctttcaagctatgtaagaatagcgccaccggcaaaacttgcgaagtcgactcaacaccggtgaagtgtagacagggattctgcctcaaaattacccaagagggcagggggcacgttaagctgagtcggggatccgaagtggtccttgatgcttgtgactctagctgcgaggtgatgatccctaaaggtacaggcgatatcttggtagactgttccgggggacagcagcactttctgaaggataacctcattgacctgggctgcccccatataccacttctgggtcgcatggccatctacatttgtagaatgtcaaatcaccccaggactaccatggcattcttgttttggttcagctttgggtatgttatcacgtgcattttctgtaaggccctcttttacagtctgatcataatcggcacattagggaaaaagattaaacagtatcgtgagctgaagcctcaaacctgcactatctgcgaaaccgctccagtgaacgcgattgatgcagagatgcatgacctaaattgttcttacaacatctgcccctactgtgcctcccggctcacaagcgacggcctggctcgacacgtcactcagtgccctaaaagaaaggaaaaggtggaggaaaccgagctttatttgaatctggagaggataccgtggattgtccgcaaactcttacaggtgtcggaatcaacaggggttgccctgaagcggtctagttggctgatcgtgcttttggtactcctgacggtctccctaagcccagtgcagtctgcacccgttggacacggtaaaaccattgagatctaccaaactagagaaggcttcgccagcatatgtctgtttatgctcgggtccatcctgttcattgtgtcatgccttgtcaagggattggtggatagtgtaagcgagtctttctttcctggcctgtccgtgtgtaaaacatgctcaatcggtagtgttaacgggtttgaaattgagagccataagtgttattgctccttattctgttgcccatactgcaggcactgttctgctgaccgcgagatccatcagctccacctgtcgatatgcaaaaagcgaaagaccggcagcaacgtcatgcttgccgtgtgtaaacggatgtgcttccgtgcaactattgaagcgtcaagaagggctctgttgatccgctccatcattaatacaacctttgtgatctgtattctcacgctgactatatgcgtcgttagtacctctgccgtggagatggaaaacctacccgcaggaacatgggagcgggaagaggatctgaccaatttctgtcatcaggagtgccaagtgactgaaacagagtgtctctgcccttatgaagccctggtacttagaaagccgttgtttctggacagcatcgtcaaaggcatgaagaacttactcaattccacctcactggagacatctcttagcattgaggctccctggggagccatcaacgtgcagagtactttcaaaccaaccgtttccacggcaaatattgctctgagctggtcttcagtggtccacaggggaaacaagatcctagtgacaggccgatccgaaagtataatgaagctcgaggaacgcaccggtgttagctgggatctgggggtggaggacgcctcggaatctaaattgctgactgtatccatcatggatttaagccagatgtactcacctgtctttgagtatctcagtggagacagacaggtggaggaatggcccaaggcgacctgtacaggcgattgcccagagcggtgcggttgtacttcttctacctgcctgcacaaagaatggagccattcaaggaattggcgttgtaaccctacgtggtgctggggcgtggggacaggatgtacctgctgtggcgtcgacgttaaggatcttttcactgaccacatgtttgtgaaatggaaggtagagtacattaagacagaagccatcgtgtgcgtcgctctgaccagtcaagagcgccagtgtagcttgattgaggcagggactcggttcaatctcggacccgtgacaatcaccctgtccgaaccaagaaacatacagcagaaactaccgcctgagattatcacgctgcatcccaagatcgaagagggctttttcgatcttatgcacgttcaaaaagtgctctctgccagcactgtctgcaagctgcagtcctgtacccatggtattccaggggacttacaggtgtaccacataggaaatctgctgaaaggcgacagggttaacggtcacctcatccataagattgaatcacactttaatacatcttggatgagttgggatggctgcgacctggattattactgcaacatgggggactggccctcgtgtacctatacaggagtgactcagcataaccacgctgccttcgtcaatcttctgaacatcgagaccgattacacgaagacatttcacttccatagcaaacgagtaactgcacacggcgacacccctcaattggatctcaaggcgcggccaacatatggggccggaggcattaccgtgctggttgaggtggctgacatggaactacatactaaaaaggtcgagatctccggtctgaaattcgcctctcttgcatgcaccgggtgttacgcttgctcaagcggaatatcctgtaaggtgcgcatccacgtagatgaacccgacgagctcacagtgcatgtcaaaagttctgatcctgacgttgtggccgcaagcacgtcactgatggccagaaagttggagtttggcactgattccaccttcaaggcttttagtgcgatgccgaaaaccagcttatgcttctatattgtggaaagggagtactgtaagtcttgctccgaagacgacacccagaaatgtgtcgatactcggctggagcagccacaatcaatcctcattgaacacaagggtacaatcataggcaaacagaatgatacctgcacggccaaggcaagctgttggctggagtcggtgaagtcctttttctacgggcttaaaaacatgctgggaagtgtttttggcaatttgttcattgggatcctactgtttctcgctcccttcgtactgcttgtgttatttttcatgttcggatggaagatcctgttttgcttcaaatgctgtcgaagaactcgcggcctctttaagtataggcacttgaaagacgacgaggaaacaggttaccgtcggattatcgagagactgaactccaagaaggggaaaaataggctcctggatggagaccgccttgccgatcgaaagatagccgaactgttcagcaccaaaacccatattggctga

SEQ ID NO: 10431 - RNA, 5052 nt, synthetic construct
  misc_feature 1..5052: note = derived and/or modified CDS sequence (opt3) from CCHFV(V42/81)__GU477490.1__GP
  source 1..5052: mol_type = other RNA
atgcacaccctgctcgtgtgcttcatcctttacctgcagttgttaggccttgggggagcccatgtccaacccaacgctacagagcacaatagaactaacacgaccacagcacctggtactagccattccctaaagccactcgtttctaccacaccgccccaggcccctgaatcaagtaccattaaaccaactacacccaccagcgagacggaaggctccggggaggcgactcctctgtctaataccatacaggctccatcgtcacccgaaacaactagcgagaggcctgccaccgcagtgatcagtacatccggaaccgactctacgaacagcactacacagaccactgataataacccaacaaccacggtaggcacctccccgtcaagtagcccctctacaccttccactccacaaggtattcaccatcacgcccggtcacttctgagcgtgaccagtcccgagacagtcactacccctaagccaacatctccccgcgaaatgtccagcgagacctcgaatcagcactctgctatgtcccgaactccgacgcatcacacagtgacccaggtttcaactgaaaacaccagtcatagcacacctcgtcagcccgagtcctctgcacaaccaaccagctcaagtcctatgacttcccccgcccagagcacattgctcatgtctgctgccccaacggcggtgcagtcaatccaccccagtcctaccaatagaagcaaaaggaacctggagactgaaattatcctgacactctcccaggggttaaagaaatattacggaaagatactgaaacttttgcacctgaccctagaggaagacacagagggcctcctggaatggtgtaagcggaatcttggctctaactgcgatgacgactttttccaaaagcgcatcgaggagtttttcatgactggggaaggatattttaatgaggtcctgcagttcaaaaccccatcgacggtgagcccgaccgaaccctcccatgcaagattgcctacagccgagccatttaagtcatacttcgctaaaggttttctcagtattgattctggctatttcagcgccaagtgttactccaggtcaagcacttctgggctgcagttaatcaacgtaacccaacaccccgcacggattgctgaaacacctggaccaaagactacctccctgaaaacgatcaattgcataaacctccgcgccagtgtttttaaggagaaccgagagattgaaatcagcgtgcttctgccccagattgcggtcaatttgtctaactgtcatgtggtgatcaattcccacgtctgcgattattcactagacacagatggcccggttagactgcctaggatcaaccatgagggtaccttcattccagggacttacaaaatagtgatcgacaagaaaaataagctcaacgatcggtgtacactggtaaccaattgcgtgattaaaggacgtgaagtccgcaagggccagagtgtgcttagacagtacaagactgagatcaaaataggcaaggccagcaccgggtcgaggaaactgttgtccaaggaacccggagacgattgtatttctcggacacaactcatgcgaacggagaccgcagagatccacgacgacaactatggtggccctggggataaaatcactatttgcaatggaagcacaatcgttgaccagcgcctgggctcagaattaggttgttacaccattaacagagtgaagagttttaagctgtgcgaaaattccgctacagggaaagcctgcgaggtcgattctactcccgtgaagtgtaggcagggcttctgcctaaaaataacccaggagggacggggccacgtaaagctcagccgcgggtccgaggttgtgctggacgcttgtgattcaagctgcgaagtcatgatcccaaaaggaacgggtgacattcttgtggattgtagtggcgggcaacagcatttcttgaaggacaacctgatcgatctcgagtgccctcacatccccctgcttggaaagctggccatttatatatgtagaatgtctaatcatccaaggacaaccatggcatttttgttctggtttggcttcggttacgtcatcacttgcattctctgtaaagccctgttttattccttaatcattatcgggaccctgggcaagaaaataaagcagtaccgtgaactaaaaccgcagacatgcactatctgtgagaccgctcctgtgaacgcgattgacgcagaaatgcacgatctcaattgcagctataacatctgcccctactgtgcctcgcggctgacatcagacggacttgctcgacacgttacgcaatgcccaaagagaaaggagaaagtggaggaaaccgagttgtacctgaacctcgaaaggattccctggatcgtacgcaagctgttacaggtctctgagagtactggcgtggttctgaaacggtccagctggcttatagtgttgctcgtcctgctaacagtgtctctgagccctgtacagtccgccccagtggggcatggaaagaccattgaaacttatcagacaagagagggtttcacctcaatctgtctctttatgctgggcagtattcttttcatcgttagctgcatagtcaaagggttggtggactctgtgtccgattcatttttccccggactgagtgtctgtaagacgtgcagcatctcctctattaatggctttgagatcgaatcgcacaaatgttactgcagcttattctgttgcccttattgtaggcattgctcagcagaccgcgagattcaccaactccatctgtccatctgccgaaagcggcgtactggtagtaacgttatgcttgccgtgtgtaagagaatgtgctttagggctaccatagaagtgtctcgccgggccctgttgattagaagcatcatcaatacaaccttcgtaatttgtatcctcactctgacaatttgcgtcgtgtccacctcagcagttgagatggaaaacctaccggcggggacatgggagagggaggaagatctgactaatttctgtcaccaggagtgccaggtgaccgaaacggagtgtctctgcccatacgaggctctggtccttcgaaaacccttgtttctggactctatagtgaagggcaaaaagaacttactcaatagcacaagtctggaaacctcccttagcatcgaggccccttggggagcaattaacatccaatctactttcaaaccaaccgtttcagccgctaatattgccctgtcctggagtagcgtggaacaccgcggcaacaagatcctagtatcggggcggtctgagtccataatgaagctcgaagagagaacaggagtcagctggaatctgggcgtggaggatgcatcagaaagtaaattgctgactgtgtctatcatggacttatcccagatgtatagccccgtctttgagtacctctcaggtgataggcaggttgaagagtggcctaaggctacctgtacgggggactgcccggaacgttgtggatgcacaagtagcacttgcctgcataaagagtggccccactcccgcaactggcggtgtaatccaacctggtgctggggcgtgggtacaggctgtacctgctgtggggtagatgtgaaggaccttttcattgatcatatgtttgtcaaatggaaggtggagtatatcaagactgaagccattgtttgcgtggagctgacatctcaggaaagacaatgtagcttgatcgaggcgggaaccaggttcaacctcggccctgtcacgataactctgtccgaaccccgaaatattcagcagaaactaccacctgagatcatcaccctgcaccccaagattgaggaagggtttttcgaccttatgcatgtgcagaaagttctctcagcctctacagtgtgcaagctgcaaagttgtacccacggaataccaggcgatttgcaggtctaccacatcggtaacctgttaaaaggggaccgggtaaacggacatctcattcacaagatcgagccgcattttaatacatcgtggatgagctgggacggctgcgatctggactactattgtaacatgggtgattggccttcctgcacttacaccggcgtgacgcagcacaatcacgctgcattcgttaaccttctgaatattgaaacagactatactaagacctttcatttccactctaaacgcgtgacagcccatggggagactccccagttggatctcaaggctagaccagcctacggagcaggcgagatcaccgtcctggtggaagtagcggacatggagctacacaccaaaaaggtggaaatatcagggctgaaatttgccagccttgcttgcacaggatgttatgcctgctccagtggcatctcttgtaaggtcaggattcatgttgatgagcccgacgaactcacggtgcacgtgaaaagcaacgatcctgacgtcgtggcagcttcaacttccctgatggcccggaagttggagagtggtaccgatagcacattcaaggcattctctgccatgccaaaaacctccttatgcttttacatcgttgagcgagaatattgtaagtcatgcagcgaggacgatactcaaaaatgtgtagaaacaaagctggagcagccccagtcgattctcatcgaacacaaagggaccataattggaaagcaaaatgacacgtgcactgctaaggcgtcttgttggctggagagtgtgaaatccttcttttacggccttaagaacatgctgggtagcgtcttcggcaatttctttatcgggatcttgctatttctggcccctttcgtgctcctggttctgtttttcatgtttggatggaaaattttattctgcttcaagtgttgcagacgcacaaggggcctgtttaaataccgtcatctcaaggaggacgaagagaccgggtatcggagaatcatagaaaggttgaactcaaagaaaggaaagaatcgcctgctcgatggcgagcgactggcagacagaaaaattgctgaacttttctccaccaagactcacatcggttga

SEQ ID NO: 10432 - RNA, 5052 nt, synthetic construct
  misc_feature 1..5052: note = derived and/or modified CDS sequence (opt3) from CCHFV(75-R-2012)__KR814863.1__GP
  source 1..5052: mol_type = other RNA
atgcacaccctgctcgtgtgcttcatcctttacctgcagttgttaggcctagggggagcccatagacaaagcaacgctacaggtcacaatggcactaacacgaccacagcaccctccacttctcagtcacctaagccactggtcagtaccgccccgccccatgcgctcgagagctccattataaaacacacaacccctgtttctgaaactgaggggtcgggagaaacaaccccaccccctaatacgactcagggcccatcacccctggagaccacacctgaaaggccagctactaccgccacaagcaccccgagtacggacaacactaattccacaacccatgtgactgataacaatcccacatctaccatcagcacgtccccttcaagtagcccatctaccccctccacacctcagggtattcaccacccagcacggaaccttctgtcagtaagcagtttgaagactgccaccacacccactccgacctctcctggggagatctccagcgagacatcgtctctccattccgctatgtcacgcaccagtactctgtatacggcaacacaagtgagcaccgaaaatgccaaccactccgctccccgacagtctgagagctcagcccagcagactaccacaagtccaatgacctcccctgcgcaaagcattctggtcatgtctgcagcccccactgctatccagaatacacatccatcacccacgaaccgtagtaaaagaaatctcgaaatggagataatcttaaccctgagccagggacttaagaaatactatggcaagattttgaagctgctacacctcactctggaggaagacacagagggccttctggaatggtgtaaaaggaacttggggtccaattgcgatgacgactttttccagaagcggatcgaggaatttttcatgaccggagagggttactttaacgaggtgctccaattcaaaacactgtctactcagtcgcctaccgaaccaagccacgcccgcccgcccacggttgagccttttaagtcctatttcgcaaaaggctttttatcaattgatagtgggtacttctctgctaagtgttatccaagactgagcacctccggactccagcttatcaacgtgacacaacatcccgccaggatagcggaaactcctggcccaaagaccacatcactgaaaactattaattgcatcaacttgcgggccagcgtctttaaggagcaccgcgaaattgagatcaatgtgctactgccccagatcgcagtaaacctctctaattgtcatgttgtgattaactcccacgtctgcgattacagtctggacaccgatggtccggtgcgacttcctcatatataccacgaggggacgttcatcccaggaacatataaaattgtgatcgacaagaaaaataagctgaacgatagatgtaccttggtcactaattgcgttataaaaggcagggaagtgcggaagggccagagcgtactccgtcagtacaagacagagattaaaatcgggaaggcttctaccggatcccgcaaactgttatcagaggaacccggtgacgattgtatcagtagaactcaactgctaaggaccgaaacagccgagattcacgacgacaactatggcgggcctggagataagatcacgatttgcaatggcagcaccatagtggaccagcggctcggttcggagctggggtgttacactatcaaccgagtcaaatcctttaaactttgcgaaaattctgctacaggcaagacctgcgagattgatagcgcccccgtgaaatgtcgccagggattctgcttgaagatcacacaggaaggcagagggcatgttaaactgtcaaggggaagtgaggtggtcctcgacgcatgtgattcctcttgcgaggtgatgatcccaaagggtactggcgacattctggtagattgtagcgggggacaacagcacttccttaaagacaacctgatagatttgggctgccctcatatccccctcctgggtaagatggccatttatatctgtcggatgtccaatcacccacgcaccacgatggcgtttttattctggttttcattcgggtacgttattacatgcatcttttgtaaggctctgttctatagcctaataatcattggcaccctcgggaaaaagatcaaacagtacagagaactgaagccgcagacttgcaccatttgtgagacagcacctgtgaacgccatcgacgctgaaatgcacgatcttaactgcagttacaatatatgcccctattgtgcctctaggttgacttccgacggcctggcacgtcatgtcccacaatgccccaaacggaaggagaaggtggaagagaccgagctctacctgaacttagaacgaatcccttggattgtcagaaaactgcttcaggtgagcgagtcgacaggggttgccttgaagaggtcatcttggctcattgtgctgctagtactgctcacggtcagtctgtccccagtgcagagcgctcccgttggacacggtaaaaccatcgaaacttatcagacacgcgagggctttacctctatatgtcttttcatgttggggagcatcctgtttttagtgtcctgcctcgtcaagggactggtaaattcagtgagtgacagcttctttcctggcctttctgtgtgtaaaacttgctccattggttcaatcaacgggttcgaaattgagagtcataagtgttactgcagcctgttttgttgcccgtattgtcggcactgctccgccgatagagagatccatcaattgcacctctctatatgcaaaaagaggaagacaggctcgaatgttatgctggcagtctgtaaacgcatgtgcttccgagcgaccattgaagctagccggcgtgccctactgatcagatcaatcattaacacgactttcgtgatctgtattctcaccctgacaatatgcgtggtctccaccagtgcagttgagatggaaaatcttccatctggaacttgggagagggaagaggacttgacaaacttttgtcaccaggagtgccaggtgaccgaaacagagtgtctgtgcccctacgaagccttagtgctccgcaagcctctgttccttgatagcatcgtaaaaggcatgaagaatctgctaaactccacttcactcgagacctctctgagcattgaggctccatggggagccatcaatgtccaaagtacgtttaaacccacagtgtccaccgcaaacattgctttgagctggtcttcagttgaacatcggggaaataagatcctggtgactggcagatccgagagtataatgaagttagaagagaggaccggtgtcagctgggacctcggggtggaagatgcctcggagtctaaactgcttacagtttccatcatggacctgagccagatgtattcacctgtgttcgagtacttgagtggagatcgacaggtagaagagtggccgaaggcgacttgtaccggcgactgccccgaacgctgtggttgcacgtcttccacatgcctccacaaagagtggccacatagccggaactggagatgtaatcctacctggtgctggggcgtcgggactggatgtacatgctgtggcgtggatgtgaaggacctgtttaccgatcacatgttcgtcaaatggaaggttgaatacattaagactgaggccatcgtgtgcgtagagctaacatcacaggaaaggcaatgtagtctgattgaggctgggacccgttttaaccttggacccgtgacgatcactctcagcgaaccacgcaacatacagcagaaactgcctcccgagattatcaccttgcatccaaaggtcgaagagggcttctttgacctgatgcacgtgcagaaagttttatccgcatctacagtgtgcaagctccaaagctgtacccacggtatcccgggggatctgcaggtctatcatattggaaatcttctgaaaggcgaccgggtgaacggtcacttgatacataagatcgagcctcacttcaatacatcctggatgtcatgggacggctgcgatctcgactactattgtaacatgggggattggccctcttgcacttacaccggagttacgcagcacaatcatgccgcttttgtgaacctgctaaatattgaaacagactatactaagaccttccactttcatagtaaaagagtcacagcccacggcgataccccacagctggaccttaaggcaaggcccacttacggggcgggagagatcaccgtactcgtggaagttgccgatatggagctgcatacgaaaaaggtggagatttcgggcttgaaattcgctagcttagcctgcacaggttgttatgcatgctcctctgggatctcatgtaaggtccgaatacacgtggacgaacctgatgagctgactgtacacgtgaaaagctccgacccagatgtcgttgctgccagtacctctctcatggcacggaagctggagttcggaacagacagcacctttaaggccttctcagctatgcccaaaacttccctttgcttttacatcgtggaacgcgaatactgtaagagttgcagcgaggaggatacacaaaaatgtgtggacaccaagctggaacagcctcagtctattttgatcgagcataaaggcacgattatcggtaagcaaaacgacacttgcacagcgaaggcctcctgttggctagaatcagtcaagagcttcctgtatggcctcaagaatatgctggggtcggtgtttggaaacttctttataggcattcttttattcctggcaccgtttgttctcttggtactgttctttatgttcgggtggaaaatcctcttctgctttaagtgttgcagaaggacccggggactgcttaaataccgactgttgaaggatgacgaggaaaccggctatagacgcatcattgagaggctaaataacaagaaaggtaagaatcgtctgctcgatggggagcggttagctgacagaaaaatcgccgaactgttctctactaagacacacataggatga

SEQ ID NO: 10433 - RNA, 5052 nt, synthetic construct
  misc_feature 1..5052: note = derived and/or modified CDS sequence (opt3) from CCHFV(VLG/TI29414)__AY179961.1__GP
  source 1..5052: mol_type = other RNA
atgcacaccctgctcgtgtgcttcatcctttacctgcagttgttaggcctcgggggagcccatattcaaagcaacgctacagagcacaatggtactaacacgaccacagcaccctccacttctcagtcacctaagcccctagtcagtaccgccccgccccatgcgctcgaaagctccacaataaaacctaccactccagtttctgagacagaaggcagtgggggaaccacgccccctccaaatactacccagggcccctcacctccagaggctacaccggaaagacccgccactaccgcaacaagcacccctagtacggacaacactaattccacaacccacgtgactgataacaatccaacatctaccatcagcacgtccccctcaagtagcccttctaccccatccacaccccagggtattcatcacccggccaggaacctgctttcagtaagcagtcctaagactgctaccacacccactccaacctctcctggggacatctccagcgagacatcgtctctgcactccgcaatgtcacggaccagtactttgtatacggccacacaagtgagcaccgagaatgctaaccattccgccccacgccagtctgaaagctcagcgcagcagactaccacaagtccaatgacctcccccgcacaacctattctcgtcatgagcgccgctccaactgccatccagaatatacacccgtctcccacaaaccgatcaaaacgtaatctggagatggaaatcattctgacgctcagtcagggattaaagaaatactatggcaagatcctgaaacttttgcatctgaccctagaggaggatactgaaggcctcctggagtggtgtaagagaagccttgggtccaactgcgacgatgactttttccagaagaggattgaagagtttttcatgacaggagaaggttactttaatgaggtgctgcaattcaaaaccttgtctacactctcgcctactgagccaagccacgcacggccccctaccgttgaaccatttaagtcctatttcgctaaaggctttctgtcaatcgatagtgggtacttctctgccaagtgttatccccgcttaagcacgtccggactgcagctcataaacgtgacccagcacccggcgagaattgccgagacacctggcccaaagactacctcacttaaaacaatcaactgcattaatctgagggcaagcgtctttaaggaacatcgggagatcgaaatcaacgtgttgctaccccaaattgctgtaaatctgtctaactgtcacgttgtgataaattcccatgtctgcgactacagtctcgatactgacggtcctgtgcgcctgccccacatctaccatgaggggaccttcattccaggaacgtataaaatcgtgatagataagaaaaacaaacttaatgaccgatgtacactggtcaccaactgcgttattaagggcagagaggtgaggaagggccagagcgtattgcggcagtacaagactgaaatcaaaatcgggaaggcctctacaggatcccgtaaactcctgtcagaggaacctggtgatgactgtattagtcgcacccagttactgagagctgagcccgccgaaatccacgacgataattatggcgggccaggagacaagattactatatgcaacggcagcaccatcgtggatcaaaggctaggttcggagctcgggtgttacacaattaatcgggtcaaatcctttaagctgtgcgagaactctgcaacgggcaagacctgcgaaatcgacagcactccggtgaaatgtcgacagggattctgccttaagatcacacaggagggccgcgggcacgttaaattgtcaagaggaagtgaagtggtcctggatgcctgtgactcctcttgcgaggtgatgattcctaagggtaccggcgatatactcgtagactgtagcgggggacagcaacatttcctgaaagataatcttatcgacctgggctgcccccacattccattgctcggtaagatggctatctatatttgtaggatgtccaaccatccccggacaactatggcgtttctgttctggttttcattcgggtacgttataacctgcatcttttgtaaggcattattctatagcctgatcattatcggcacgctagggaaaaagattaaacagtaccgcgagctcaagcctcagacatgcaccatctgtgaaactgccccagtgaatgctatagatgccgagatgcacgacctgaactgcagttacaacatttgcccctattgtgcatctagacttacctccgacggcttggccaggcacgtccctcagtgcccgaaacgtaaggaaaaggtggaggaaacagagctgtacctcaatctggagcggatcccatggaacgtccgaaaattactgcaagtgagcgaatcgactggggttgctcttaagagatcatcttggttgattgtgctcctggtactactgaccgtcagtctctcccccgtgcagagcgcccctgttggacatggtaaaacaatcgagacgtatcagaccagggaaggctttacttctatatgtctgttcatgcttgggagcatcttgtttctggtgtcctgcttagtcaagggactcgtggattcagtaagtgacagcttctttccaggcctgtctgtgtgtaaaacatgctccattggttcaatcaatgggttcgagattgaaagtcacaagtgttactgcagcctgttttgttgcccctattgtcgccattgctccgcagatcgggagatccaccagctgcatttgtctatatgcaaaaagagaaagatgggctcgaacgttatgctcgcggtctgtaaaaggatgtgcttccgcgctaccattgaggccagccgacgggcactgctaatccgttcaatcattaatactacattcgtgatctgtattctgaccctcacgatatgcgtggtctccacttcggccgttgaaatggagaacctgccttctggaacctgggaaagagaggaagaccttacaaatttttgtcaccaagagtgccaggtgaccgagactgaatgtttgtgcccgtacgaggctctggtgttaaggaagcccctcttcctggatagcatcgtaaaaggcatgaagaaccttcttaattccacaaacctagaaacctcactctctattgaggccccatggggagcaatcaatgtccagagcacatttaaacctactgtgagtaccgctaacattgccctgtcctggagctctgttgagcaccgcggaaataagatcttggtgacgggccggtcagaatccataatgaagctggaggaaagaacaggtgtcagttgggacttaggggtggaggatgcgagcgaatcgaaactcctgaccgtttctatcatggacctttcccaaatgtatagccccgtgttcgagtacctgtcaggagataggcaggtagaggaatggccaaaggccacttgtaccggcgactgccctgagcgatgtggttgcacaagttctacttgcttgcataaagaatggccccactcccgcaactggcggtgtaatccaacctggtgctgggaggtcggcacggggtgtacatgctgtggatggaacgtgaaggatctctttaccgaccatatgttcgtgaaatggaaggtcgaatacattaagactgaggctatcgtttgcgtggagctgacaagccaggaaagacagtgttcactaattgaggcaggcaccaggtttaacctggggccggtaactatcacacttagtgaacctcgtaatatacaacagaaactgcccccagagattatcaccctgcaccccaaggtggaagagggattctttgatttgatgcatgtccagaaagtgctgagcgcctccacggtttgcaagttacagtcttgtactcacggcatccctggtgacctccaagtgtatcacattgggaacctgcttaaaggagaccgcgtcaatggccatctgatacacaagatcgagccacatttcaacaccagctggatgtcctgggatggttgcgacttggattactattgtaatatgggcgactggccctcatgcacatacaccgggatgacacagcacaaccacgctgcctttgtgaatctcctgaacattgaaactgattataccaagacgttccattttcactctaaacgggttacagcacatggagacactcctcagctagatctgaaggcgagaccgacctacggcgccggggagatcacagtgcttgtcgaagtagctgacatggagctccacaccaaaaaggtggagattagtggactgaaattcgcctcgttggcatgcactggctgttatgcttgcagctccggtatctcttgtaaggttaggatacatgtggatgaaccagacgagttaaccgtccacgtgaaatcaaatgatcccgacgtaatcgccgcaagcacatccctgatggcccgaaagctcgagttcgggacggatagtacttttaaggctttctctgcgatgcctaaaaccagcctgtgcttttacattgccgaacgggaatactgtaagtcatgctccgaggaggacacacagaaatgtgtggacaccaaacttgaacaaccccagagtatcctgattgagcacaagggaactatcataggcaagcagaacgatacatgcaccgcaaaggctagctgttggttggaatctgtcaaatccttcttttatggtctaaagaatatgctgggctcagttttcgggaactttttcattggaatcctcctgtttcttgccccattcgtgttactggtgctctttttcatgttcggctggaaaatcttgttttgcttcaagtgttgccgcagaacgagggggctgctcaaataccggctgcttaaggacgatgaggaaactggatatcgaagaattatcgagcgcctgaataacaagaaaggcaagaataggttgctagacggtgagcgtctggccgatcggaaaatagctgaactctttagcacaaagacccatattgggtga

SEQ ID NO: 10434 - RNA, 5055 nt, synthetic construct
  misc_feature 1..5055: note = derived and/or modified CDS sequence (opt3) from CCHFV__KJ648916.1__GP
  source 1..5055: mol_type = other RNA
atgcacatcagcctgatgtacgccattctctgccttcagctgtgtggcttgggggagacccatggatcccacaacgaaacaagacataataagactgacacgatgaccacacccggtgataacccttcttcagagccaccggtgagtactgctttaagcataaccctggacccctccacagtcacccctactacaccagcatctggcctagaagggtcgggagaggtttatacctcaccccctatcacgactggcagcctcccactgagtgaaaccacacccgagcttcctgtgactaccggtacagataccctgtccgccggggacgtagatccatctacgcagactgcgggaggcacaagcgctccgaccgtgaggacttccttgcccaattcacctagtacaccaagcacaccccaggacacgcaccatcctgtccggaacctcctgtctgtgacctccccaggccccgatgagacatcaactccgagcgggaccggaaaagaaagttctgccacatccagccctcaccccgtttcgaatcgcccacctactcccccagcaaccgcccagggtcccacagagaacgactctcacaatgctaccgaacatcctgagtccctgactcagtcagcaacgccaggcctcatgacaagtccgacccaaattgtgcacccccagagcgccactcctatcaccgtccaggatacacatccatcccccaccaacgcttctaaggccaatttaaaaatggagattatcctgactcttagccaggggttgaagaaatactatggaaagatactgcgactactccaactgacacttgaagaggacacggaaggcctgttggagtggtgcaagcgtaacctcggtctggattgtgacgataccttctttcagaaaagaatcgaagagttctttattactggggagggacacttcaatgaagtgttacagtttaggacacctggcaccctgtcaacaactgagagtaccccagcgggcctccccacggcagaaccgttcaagtcctactttgccaaagggttccttagcatcgactctggatattactcagctaagtgctatagtggtaccagcaactccggcctgcagttgattaatatcacacggcactctactcgcatagtagacacccctgggccaaaaattacaaacctaaagactatcaattgtattaacctgaaggcctcgatctttaaagagcatagagaagttgagatcaacgtgctcctgccccaagtcgcagtgaatcttagcaactgccacgtggtcattaagtcccatgtttgtgattactcactggacatagatggagctgtgaggttgcctcacatctaccatgagggcgtattcattcccggtacctataaaatcgtgatagacaagaaaaataagctcaacgatcggtgcacgctgtttacagactgtgtcattaaagggcgcgaagtgcgaaagggccagagtgttttaagacagtacaagaccgagatcaggatcggaaaagcctctactggcagccggcgtctgctatccgaggaaccatcagatgactgcattagccgcacacaactcctgagaaccgaaactgcggagatccacggggataattatggaggtcctggcgacaagattaccatatgtaacgggtctacaatcgtggatcagaggcttggatccgagttgggctgctacacgattaatcgggtccgaagtttcaaactgtgcgaaaacagcgccaccggtaagaattgtgagatcgactctgtgcccgtaaaatgccgccaggggtattgtctcagaatcactcaggaaggcaggggacacgttaagctgtcccggggctcagaggtggtccttgacgcatgcgatacaagttgtgagattatgataccaaaggggaccggagacatcctggtggattgcagcggtggccaacagcattttcttaaagacaacctcattgatctggggtgtccgaagatccctttactgggaaaaatggctatttacatctgccgcatgtcgaatcaccccaagacaactatggccttcctattctggttttccttcggctatgtcataacctgtatcctctgcaaagctatcttttacctgcttattattgtgggtacgttggggaagagactgaagcagtacagggaactcaaaccacagacatgtaccatctgcgagactacccccgttaacgccatagacgcagaaatgcatgatctgaattgctcttataacatttgtccttactgcgccagccgtttaacatcagacggcctggctcggcacgtgatccaatgtccaaagcgaaaagagaaggtagaagagactgagctttatttgaatctcgaaaggattccctgggtcgtgagaaaactgctacaggttagtgagtccaccggagtggcgctgaagcgctctagctggctcatcgtcctgcttgtgttgttcacagtatccctgtcacctgtgcagagcgcaccgataggccaggggaagacgatcgaagcctaccgggctagagagggatataccagtatttgcttatttgttctcggctctatcctgttcattgtctcctgtcttatgaaaggtctggtggatagcgtggggaactcgtttttcccaggattgtcaatctgcaagacttgttctataagttccattaacggctttgaaatcgagagccacaaatgctactgttctctcttctgctgtccctattgcaggcattgcagcacagacaaggagatccacaaactgcatctatccatttgtaagaaacgcaagaagggttcaaatgtcatgctggccgtttgcaaactcatgtgttttcgagcaaccatggaagtgagtaaccgggccctgttcatccgtagcattataaatactacatttgtgctttgcatcttgattctggctgtatgtgtcgtgtctacctccgccgttgagatggaaaacttacctgcaggcacgtgggagagagaagaggatctcactaatttctgccaccaagagtgtcaggtgaccgaaacagagtgcctgtgtccatacgaagcgcttgtcctgaggaagcccctattcctcgactcaaccgctaaagggatgaagaacctgttgaatagtactagcctggagacatccttatctatcgaggccccttggggagcaattaacgtgcagtcgacctacaaaccgacagttagcactgccaatatcgctctctcatggtccagtgtggaacatcgcggcaacaagatactggtatctgggcggagcgagtccatcatgaaacttgaagagagaaccggaatttcatgggatctgggcgtcgaagacgcctctgagagcaaattgctcacggtgagtgtgatggacctgtcccagatgtatagccccgtctttgagtacctatctggtgataggcaagttggggaatggccaaaggcaacatgcaccggagactgtcctgagcgatgcggctgcacttcatccacctgtctgcacaaagaatggccccacagtcgcaattggcggtgcaacccaacatggtgttggggtgtgggcactgggtgcacctgttgcggacttgatgtaaaggacctcttcacggattatatgtttgtgaaatggaaggtcgagtacatcaagacagaagctattgtgtgtgttgagctgaccagccaggagagacagtgctcgttgatcgaagccggcactaggttcaatctggggcctgtgacaataaccttatctgagccccgtaacattcaacagaaactcccaccggaaatcatcactctgcatcctcgcattgaggaaggatttttcgaccttatgcacgtccagaaggtgctgtccgcgagcacagtttgtaaattgcagtcatgcacccatggcgtgcccggtgatctccaagtctatcacatagggaatctgctaaagggagacaaagtaaacggccatctgatccacaagattgagccacactttaacacgagttggatgtcttgggatggttgtgaccttgattactattgcaatatgggcgactggccctcctgcacttacaccggggtgacacagcataaccacgccagcttcgttaatctcctgaacatcgagaccgattacacaaagaattttcatttccactcaaaacgggtgactgctcacggagacacccctcagttggacttaaaggcaagaccaacgtatggcgccggggaaattacagtcctggtggaggtagctgatatggaactccatactaaaaagatcgagataagtggactgaaatttgccagccttgcatgtaccggctgctacgcgtgttcctctggtatcagctgcaaggtgaggattcacgtcgacgagcccgatgaactgacagttcatgtgaaatccgacgatcctgacgtggtcgccgcttcatctagtttgatggcccgaaagctagagttcgggaccgattcgacttttaaggcattcagcgctatgccgaaaacctccctgtgtttctatatcgtggaacgggagcactgcaagtcttgttcagaagaggacaccaaaaagtgcgttaacacgaaactcgagcagccacaaagcattctgatcgaacataagggaactataattggcaagcaaaattccacctgtacagccaaagcaagttgctggcttgagtctgtaaagagctttttctacggcttaaagaacatgctgtcagggatctttggaaatgtgttcatgggtatctttctcttcttggccccctttattctgctcatcctgttctttatgttcggctggcgcatattgttttgtttcaagtgctgcagaaggacccgggggctgttcaaatatcgacacttgaaggatgacgaagagactggatacagacgcattatcgaaaagctaaacaataaaaagggcaaaaacaagctgctcgatggtgagaggttagctgaccgtcggattgcggagctgttttccacaaaaacccacatcgggtga

SEQ ID NO: 10435 - RNA, 3495 nt, synthetic construct
  misc_feature 1..3495: note = derived and/or modified CDS sequence (opt3) from CCHVF(CCHVF 10200)__U39455.2__Gn-NSm-Gc
  source 1..3495: mol_type = other RNA
agcgaggaaccctccgacgattgcgtgtctagaacccagctgctcaggacagagactgccgaaatccacggcgacaactacgggggacctggtgataagattacgatatgtaatggctcaaccatcgtcgaccaacggcttgggagtgagctgggatgctatacaattaaccgcgttcgatctttcaaattgtgtgaaaattccgctactggcaagaactgcgagatcgattctgtgccagtaaaatgtcgtcagggttactgcttaagaattacccaggaggggaggggacatgtgaagctgtcgcggggctcagaagtcgtgctagacgcatgtgatacaagctgcgagatcatgataccgaaaggcaccggggacatcctcgttgattgtagtggaggtcagcaacactttctgaaggacaatcttattgatctgggctgccccaagatccctttgctcgggaaaatggccatttatatctgtcgcatgtccaaccatccaaagactacaatggcgttcctgttttggttctcttttggatacgtgataacctgcattctgtgcaaagctatcttctatctcttaattatcgtcggcacgctgggtagaaggcttaagcagtaccgggaattgaaaccccagacttgtaccatctgcgagacaactcctgtgaatgccattgacgcagagatgcacgatctgaactgtagctataatatatgcccatactgtgcctcccgcctaacctcagacgggctcgctcgacatgtaatccagtgccccaagagaaaggaaaaagttgaggaaacagagctgtaccttaacctggaaaggattccttgggtggtccggaagttgctccaagtgagtgagagcaccggagtggcactgaaacgttcttcctggttaatcgtcctgctcgttctttttacggtgtcactgagcccagtacagagtgccccgataggccagggcaagactattgaggcttatcgcgccagagaagggtacacatctatctgtttgttcgtgctaggatccatcctgtttattgtcagctgcctcatgaaaggtctggtggactcggttggcaattctttctttcccgggctttccatctgtaagacctgctcaattagtagcataaacggattcgagatcgaatcccacaaatgttattgctctctgttttgctgtccttactgcaggcactgtagcactgataaggagattcataagttgcacctctcaatctgcaaaaagcggaaaacaggcagtaatgtgatgctggcggtctgtaagttaatgtgcttccgagcaaccatggaagtgtccaaccgcgccctgttcatcagaagcattataaatacgacctttgtactatgtatcctcattctggctgtttgcgtggtctctacatcagccgtggagatggagaaccttccagcaggtacttgggaaagggaggaagacttgaccaacttctgtcatcaggagtgccaagtcacagaaactgagtgtctgtgcccctatgaggctctcgtgctgcggaaacctctttttctggatagtaccgccaaggggatgaagaatttgctcaacagcacatccctggaaacctctttatcgatcgaggcgccatggggcgccattaatgttcagagcacttacaaacccacggtgtccacagcaaacatcgctctgtcatggagttctgtagaacaccgcggaaataagatacttgtcagcggcagatccgagtcaatcatgaaactcgaggaaaggaccgggattagctgggacctgggagtggaggatgcctctgaatccaagctattgactgttagtgtgatggacctgagccagatgtattctccggtcttcgagtacctctccggtgatcgtcaagtggaagagtggcctaaagctacctgcacaggcgactgtcccgagcggtgcgggtgtacctcaagtacttgcctgcacaaggaatggccacatagccgaaactggagatgtaatcctacatggtgctggggagtaggcacgggttgtacctgctgtgggttagatgtgaaggacctgtttactgattacatgttcgttaaatggaaggtcgagtatatcaaaacagaagccattgtgtgcgtggagcttacctcgcaggaaaggcagtgttccttgatcgaggcaggcacacgctttaacctcggacccgtcactataaccctgtctgagccacggaatattcagcaaaagctaccccctgaaatcattacgctgcacccaagaatcgaggaaggcttctttgacctcatgcatgttcagaaagtgctgagcgcctcaaccgtgtgcaaacttcagagttgcacacacggggtaccgggagacttgcaggtctaccatataggtaacctgttaaagggcgataaggtgaatgggcacctcatccacaagattgagccccatttcaacacttcctggatgtcttgggacggatgtgatctggactattactgcaatatgggcgattggcctagctgtacctatacaggtgttactcaacacaaccatgcttcctttgtgaatcttctgaacatcgaaaccgactacacgaaaaacttccactttcactcaaagagggtcacagcgcatggggataccccacagttggacctcaaagcacgccccacttatggcgccggagagattacagtgctggttgaggtggctgatatggaactacacaccaagaaaatcgagataagcggcctgaagttcgccagtctcgcatgcactgggtgttacgcctgcagctccagcatttcgtgtaaggtacgaatccatgtcgacgaacctgatgagctgaccgtgcacgtgaaatcagacgatccagacgtcgttgctgcctctagttcccttatggcacggaagttggagttcggaacagacagcacgtttaaagcgttctctgctatgcccaagaccagcctgtgcttttacatcgtggaacgtgagcattgtaaatcctgctcagaagaggatactaagaagtgtgtaaatacaaaattagaacagccgcagagtattctcatcgagcacaagggcaccattataggtaaacaaaacagcacatgcactgccaaggcatcttgctggctggagtccgtgaaatcattcttttatgggcttaagaatatgctgagtggaatcttcggcaacgtctttatgggtattttcctatttctcgcccctttcatcctgttgattctgtttttcatgtttggctggagaatcttattctgtttcaagtgctgtaggcgcacccgggggctctttaaatacagacacctgaaggacgatgaagagacgggatataggcgaataatcgaaaaacttaataacaagaaaggcaagaataagctgttggacggggagcgcctcgctgatggacggattgccgaactgttcagcacaaaaacccatatcggc

SEQ ID NO: 10436 - RNA, 3495 nt, synthetic construct
  misc_feature 1..3495: note = derived and/or modified CDS sequence (opt3) from CCHVF(CCHVF IbAr10200)__AF467768.2__Gn-NSm-Gc
  source 1..3495: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtccgatctttcaaattgtgtgaaaattccgctactggcaagaactgcgagattgattctgttccagtgaaatgtcgtcagggttactgcttaagaatcacccaggaggggaggggacatgtaaagctgtcgcggggctcagaagtggtcctagacgcatgtgatacaagctgcgagataatgatcccgaaaggcaccggggacattctcgtggattgtagtggaggtcagcaacactttctgaaggacaatcttatcgatctgggctgccccaagattcctttgctcgggaaaatggccatctatatatgtcgcatgtccaaccatccaaagactacaatggcgttcctgttttggttctcttttggatacgttattacctgcatcctgtgcaaagctattttctatctcttaatcatcgtgggcacgctgggtaagagacttaaacagtacagggaattgaagccccagacttgtaccatttgcgagacaactcctgtcaatgccatagacgcagagatgcacgatctgaactgtagctataatatctgcccatactgtgcctcccggctaacctcagacgggctcgctcgccatgtgattcagtgccccaagcgaaaagaaaaggtagaggaaacagagctgtaccttaacctggaaagaatcccttgggttgtgaggaaattgctccaagtcagtgagagcaccggagtggcactgaagcggtcttcctggttaatagtgctgctcgtcctttttacggtttcactgagcccagtgcagagtgccccgattggccagggcaaaactatcgaggcttatcgtgcccgcgaagggtacacatctatctgtttgttcgtactaggatccattctgtttatcgtgagctgcctcatgaagggtctggtcgactcggtgggcaattctttctttcccgggctttccatttgtaaaacctgctcaataagtagcatcaacggattcgagattgaatcccacaagtgttattgctctctgttttgctgtccttactgcagacactgtagcactgataaggagatccataaattgcacctctcaatctgcaagaaaaggaagaaaggcagtaatgttatgctggcggtgtgtaagttaatgtgcttccgggcaacaatggaagtctccaaccgagccctgttcattcgcagcataatcaataccacgtttgtgctatgtattctcatcctggctgtatgcgttgtgtctacctcagccgtcgagatggagaaccttccagcaggtacatgggaaagagaggaagacttgactaacttctgtcatcaggagtgccaagtgaccgaaacagagtgtctgtgcccctatgaggctctcgtcctgaggaagcctctttttctggatagtactgccaaagggatgaagaatttgctcaacagcacctccctggaaacatctttatcgattgaggcgccatggggcgccatcaatgtgcagagcacctacaaacccactgtttccacggcaaacatagctctgtcatggagttctgtggaacaccggggaaataagatcctagtaagcggccgctccgagtcaattatgaaactcgaggaaagaacagggatcagctgggacctgggagtcgaggatgcctctgaatccaaacttttgaccgtgagtgttatggacctgagccagatgtattctccggtgttcgagtacctctccggtgataggcaagtcggcgaatggcctaaggctacttgcaccggggactgtcccgagcgttgcggatgtacatcaagtacctgcctgcacaaagagtggccacatagccggaactggcgatgtaatcctacttggtgctggggcgtgggtacagggtgtacgtgctgtggcttagatgtaaaggacctgtttaccgattacatgttcgtgaaatggaaggttgaatatattaaaactgaggccatcgtctgcgtggaacttacatcgcaggagagacagtgttccttgatagaagcaggaaccaggtttaacctcggccccgtgacaattactctgtctgagccacgcaatatccagcaaaagctaccccctgagattatcaccctgcacccacggatagaagaggggttctttgacctcatgcatgtccagaaggttctgagcgcctcaacggtgtgcaaacttcagagttgcacccacggagtgccgggtgacttgcaggtataccatatcggcaacctgttaaagggggataaagtcaatggacacctcattcacaagatcgaaccccatttcaacacatcctggatgtcttgggacggctgtgatctggactattactgcaatatgggtgattggcctagctgtacttataccggggtgacacaacacaaccatgcttcctttgttaatcttctgaacattgagactgactacaccaaaaacttccactttcactcaaagagagtgacggcgcatggcgatacaccacagttggacctcaaagcaaggcccacctatggagccggcgaaatcactgtcctggtggaggttgctgatatggagctacacacaaagaagatagaaattagcgggctgaaattcgccagtctcgcatgcaccggatgttacgcctgcagctccggcatcagctgtaaggtgcgcatccatgtagacgagcctgatgaactgactgtccacgtgaaatcggacgatccagacgtggtcgctgcctcatctagtcttatggcacgaaagttggagttcggtaccgactccacatttaaagcgttcagcgctatgcccaagacgtctctgtgcttttacattgttgagcgggaacattgtaagagctgctccgaggaagataccaaaaagtgtgtgaatactaaattagagcagccgcagtcaatcctcattgaacacaaggggacaataatcggaaaacaaaacagtacctgcacagccaaggcaagctgctggctggagtctgtaaagtccttcttttatggccttaaaaatatgctgtcaggtattttcggcaacgtgtttatggggatcttcctatttctcgcccctttcattctgttgatcctgtttttcatgtttggatggcgtatattattctgtttcaagtgctgtagaaggactcgcggcctctttaaataccggcacctgaaggacgatgaggaaaccgggtatagaaggatcattgagaaacttaataacaagaagggaaagaataagctgttggacggcgaacgactcgctgatcgccggatcgccgagctgttcagtacgaaaacacatattggt

SEQ ID NO: 10437 - RNA, 3495 nt, synthetic construct
  misc_feature 1..3495: note = derived and/or modified CDS sequence (opt3) from CCHVF(CCHVF Turkey-Kelkit06)__GQ337054.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtaaaaatagcgctactggcaagacctgcgaagttgactccacaccagtgaaatgtcgacagggtttttgcttaaagattacccaggaggggcgtggacatgtaaagctgtctagaggctcggaggtggtcctagatgcatgtgactcaagctgcgaagtgatgatcccgaaaggcactggggatatactcgttgactgtagtggaggtcagcaacacttcctgaaggataaccttatcgacctgggctgcccccatattcctttgctcgggaggatggccatctacatttgtcggatgtccaatcacccacgcacaaccatggcgtttctgttctggttttctttcggatatgtgatcacgtgcatattttgcaaagctctgttctacagcctcattatcattggcactttaggtaagaaaatcaagcagtatagagagctgaagccccagacctgtacaatctgcgaaactgcccctgtcaacgcaattgatgccgagatgcatgaccttaattgttcctacaacatatgcccatattgtgcttcaaggttgaccagtgacgggctggcacggcacgtgacacagtgccccaaacgcaaggagaaagtagaagagaccgaactatacctcaatctggagcgaatcccttggattgttagaaaacttctgcaagtgagcgaatctacgggagtcgccttgaagaggtcctcatggctcatcgtgctgttagtgctgctcactgtcagccttagtccagttcagtctgctccggtgggccacggcaagacaatagagatttaccagacccgggaggggtttgcctccatctgtctgttcatgttgggaagcatcctatttattgtatcgtgcctggtgaaaggtctcgtcgattctgtgtccgaatcattctttcccggcctgagtgtttgtaagacttgcagcatcgggtccgtgaacggattcgagattgaatctcataagtgttattgcagccttttctgctgtccttactgccgtcactgttcagcggaccgcgagatacatcagctgcacttgagtatctgcaaaaagagaaaaacaggctccaatgtcatgctcgcagtgtgtaagaggatgtgctttcgggccaccattgaagctagccgacgcgccctgttaatcagatctatcattaacacgaccttcgtaatatgtatcctgacactaactatttgcgttgtgtcaaccagtgcagtcgagatggagaatctcccagctggtacatgggaaagggaggaagatctgactaacttttgtcaccaagagtgccaggtgaccgaaacagagtgtctttgcccctatgaggccttggtcctgcggaaacctctcttcctggacagcatcgtgaaggggatgaagaatcttctgaactccacctctttggaaacttcgctcagcattgaggcgccatggggcgccatcaacgttcagtccacgtttaaacccacagtgtcaaccgcaaatatagctctgagttggtctagcgtagtccatcgcggaaacaagatcttagtgactggcagatccgaatcaattatgaaactggaggagaggaccggggttagctgggatctaggagtggaagacgcctctgagtccaagctcctgacagtcagtatcatggatcttagccaaatgtactctccggtgttcgaatatttgtccggtgaccgtcaggtagaggaatggcctaaagctacctgcactggcgattgtcccgagcggtgcgggtgtacatcaagtacgtgcctgcacaaggagtggagccattcgcgaaattggagatgtaacccaacctggtgctggggagtgggcactggttgtacatgctgtggggttgacgtcaaggatctctttaccgaccacatgttcgtgaaatggaaggtggaatacattaaaacagaggccatcgtctgcgttgcactgacttcccaggaaaggcagtgttctttaatagaggccggcacccgctttaatctgggacctgtgacgattacccttagcgaaccccggaacatccaacagaagttgccacccgagattatcacactccatcctaaaatagaggaaggcttctttgacctgatgcacgtgcagaaggtactatcagctagtactgtctgcaagctgcagtcctgcacccacgggatcccaggagatctccaagtgtatcatattggtaatctgcttaaaggcgacagagttaacgggcacttgatccataagattgagtctcacttcaatacaagctggatgtcctgggatggatgtgacctggattactactgcaacatgggcgactggccgtcatgtacttataccggtgtgacgcagcacaatcatgcggcatttgtcaacttactcaatatcgaaacagattacaccaaaactttccacttccatagcaagagggtgacagcccacggggacactccccagctggatcttaaagctcgccctacctatggcgccggaggcataaccgttctggtggaggtagcagacatggaattgcatacaaagaaagtcgagattagtgggctcaagtttgcctctctggcttgcacgggatgttacgcctgctccagcggcatctcgtgtaaggtgcgaatccacgtggatgagccagacgaactaaccgtccacgttaaatcatctgatcccgacgtggtagcagcgagtacttccctgatggctcggaagctcgagttcggtacagacagcacctttaaagccttctctgcaatgcctaagacaagcctgtgcttttatattgtggaacgtgagtactgtaaatcctgctcagaggatgacactcagaagtgtgtcgataccagacttgaacaaccacagagtatcttgattgagcataaggggacgataatcggaaaacagaacgacacatgcaccgccaaggctagctgctggctggaatctgtgaaatccttcttttatggcttaaagaatatgctcggttcagttttcggcaacctgtttattgggatccttctgttcctagccccctttgtgctcctggtcttgttctttatgttcggatggaaaattctgttctgttttaagtgctgtaggcgcactcggggcttattcaagtacagacacctcaaagatgacgaggaaaccgggtacaggcgaatcatagagcgcctgaacagtaagaaaggaaagaatcggcttctggatggcgacagattggcagataggaaaatcgctgagctctttagcacaaagactcatattggt

SEQ ID NO: 10438 - RNA, 3498 nt, synthetic construct
  misc_feature 1..3498: note = derived and/or modified CDS sequence (opt3) from CCHVF(CCHVF SR3)__AJ538199.1__Gn-NSm-Gc
  source 1..3498: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgcgaagtttcaaattgtgtgaaaattccgctactggtaagtcttgcgagattgattcgatccctgtaaaatgtaagcaggggtactgcttaaaaattacccaggagggacgtggccatgtgaagctgtcaagaggcagcgaagtcgtgctagacgtttgtgatagttcctgcgaggtgatgatcccaaaggggacaggagacatactcgtcgattgttctggtggccagcaacactttctgaaagacaaccttgtggatctggggtgcccgaagatccccttgctcggaaaaatggcaatttatatctgtaggatgagcaatcatcctaagaccactatggccttcctgttttggttctcctttggctacgtaattacatgcatcctgtgcaaagcgatattctttctcttaattatcttcggtaccctggggaagcggtttaagcagtatcgcgaacttaaaccacagacgtgtactatttgcgagaccacacccgttaacgctatcgacgccgagatgcacgatttgaattgttcatacaacatctgcccttattgtgcaagtagactgactagcgacggactagccaggcatgtgacccagtgcccacggcgcaaggaaaaagtcgaggaaacagagctctacctgaatcttgaacgaataccctgggtggtgagaaagctgttgcaagtctctgagtccaccggcacggttctcaaaaggtcaagctggctgattgtgttactggtactcttcactgtgagtctttctcctgtccagtccgctccaatcggccacgggaagacaattgagacctaccgggtgcgtgaagagtatactagcatctgtctgtttgttttgggatcgatactattcattgtgtcttttctgatgaaaggtctcgtcgacggcgtggggaacatcttcttcccgggactgtccgtatgcaagacatgttcaatcggcagtattaatggttttgaaatcgagagccacaagtgctactgttcccttttctgctgcccctattgtcgccattgctctgcagatggggaaattcaccagctgcatttgagcatatgtaaaaagagaaaaaccggctcaaacgttatgctcgccgtgtgcaagaggatgtgttttcgggctacgatggaggtcagtaataaagccctgttcatccgatccattatcaacaccacatttgtgatgtgcatcttaaagggagagttcgcggcagtcaagagcattcaccctatagaaatggagtctctgccagccggcacttgggaacgcgaggaagacctaaccaatttttgtcaccaggagtgccaagtgacagagactgaatgtctctgcccctacgaggctctggttcttagaaggcctttgttcctggattcaatcgtgaaagggatgaagaacctcctgaacagtaccagccttgaaacatccctgtctattgaggccccatggggagcaatcaatgtacagtcgacctataaacccactgtcagcacggctaacattgccttgtcctggtcaagtgtggagcatcggggtaataaggttctcgtgtctggccgcagcgaatccatcatgaaactggaggaaagaacagggatatcatgggacttaggagtcgaggatgcgagcgaatctaagctgctaaccgtgtccgtaatggacctcagtcagatgtacagcccggtgtttgagtatctgtctggcgataggcaagttgaggaatggcctaaggccacttgtaccggtgactgccccgagcgttgcgggtgtacatcctcaacctgccttcacaaagaatggccacatagtcggaactggcgatgtaatcctacttggtgctggggcgtcggaacaggctgtacgtgctgtgggttggatgtgaaggacctgttcaccgattacatgtttgtgaaatggaaggtcgagtacatcaaaactgaagcaattgtttgcgtggagctcacaagccaggagagacagtgttcgctgatcgaagctggaaccaggttcaacttaggttccgtgacaattactctgtctgagccccgcaatatccagcaaaagctgccacccgaaataattaccttgcaccctaagatcgaggaaggctttttcgacctcatgcatgtacagaaagtcctgagcgcctcaacggtgtgcaagctacagagttgtacccacggggttccaggagaccttcaggtgtatcacattggcaacctcctgaaaggtgatcgggtcaatgggcatcttatccacaagatagagcaacatttcaacacatcctggatgtcttgggacggctgcgatttggactactattgcaatatgggagattggccgagctgtacttacaccggcgtgacacagcacaaccacgcttcctttgttaatctgttaaacatcgagactgactataccaaaacgttccattttcactcaaagagagtgacagcccatggggatactccccagctcgacctgaaagcaaggcctacctacggagccggcgaaattacagtacttgtcgaggtggctgatatggaactgcacaccaagaagatcgagattagcggtttgaaattcgcggggctcacttgcaccggatgttatgcatgcagttctggcatctcctgtaaggtgcgcatacatgtcgacgagccagatgaactgacagttcacgtgaaaagcgacgatcccgacgtagtggccgcttcgtcatctctaatggcccgaaagctggagtttggtacggacagtaccttcaaagcattttccgccatgcctaagactagcctctgcttctacattgtcgaacgggagtactgtaagtcttgcaataaagaagatacacagaagtgtgtgaacaccaaactggagcaaccacagagcatccttatcgagcacaagggcacaattatcgggaaacagaacaatacttgcaccgctaaggcctcctgttggttggaatcagttaagagctttttctatggactgaaaaacatgttaggcgggatttttggaaatgtgttcataggcatctttacgttcctcacacccttcattctgcttatcctgtttttcatgtttggttggcgtattctattctgctttaagtgctgtagaaggacccgcggactcttcaaataccggcatctgaaggacgatgaggaaactgggtatagaaaaatcatagagaggttgaacaataagaagggcaaaaaccgactgttagacggtgaacgcctcgcagatcggaagatcgcggagctgtttagcaccaaaacacacattggc

SEQ ID NO: 10439 - RNA, 3498 nt, synthetic construct
  misc_feature 1..3498: note = derived and/or modified CDS sequence (opt3) from CCHVF(CCHVF UCCR4413)__KY484038.1__Gn-NSm-Gc
  source 1..3498: mol_type = other RNA
agcgagtcctctgcctcaggctgcatcagtagaacccagatgattaagagcgaaacagctgagatacacgacgatatctacgggggacccggtgaaaaacttactatttgtaacggcacgaccgtggtcgaccaaaggctcgggtccgagcttggatgctatacaatcaatcggattaagacttacaaactgtgtgaaaactctgttaaggagaaaacctgcgagatcgattcggtgcctgtaaagtgtcgccagggcttgtgcttaaagataacacaggaaggtcgagggcatgtgaaactgtcacgtggaagcgagatcgtcctagacatttgtgatagttcctgcgaactcatgatcccaaagggcaccggcgacattctggtggattgttctgggggacagcaacacttccttcaggacaatctggttgatttgggttgcccgaacatccccctcctgggcaaagtggcaatatatatttgtagaatgagcaatcatcctaagactacaatggcctttctgttctggttttccttcgggtacgtcattacctgcatcctctgcaaaatcttattttatctgcttatcattacgggaactttgggcaagaagctgaaacagtacagggagctaaagccacagacctgtacaatatgcgagtcaactcccgtgaacgcgatcgacgctgaaatgcacgatctcaattgtagttataacatttgcccttactgtgccagccggctgacctctgacggtcttatccgccatgtaaatctgtgcccaaaaagaaaggagaaagttgaagagacagaattgtacctcaacctggagaggataccctggttcgtgcggaagttactgcaagtctccgagtcaaccggggtggcactcaaacgcagcagttggcttctgattttggtgatcctactgacggtctctatgtcccctgttcagagcgccccaatcaatcagcagcgagctgtggaagcatatcaagccagagagggatacactggcatttgtctctttatcctgggctcggtacttttcatgacatcttggctgaccaaggggttgattgattccataggagactcatttttcccgggtctctttgtgtgcaagacttgtagtatcggcagcattaacgggttcgaaatcgagtcccacaggtgctattgttctctgttatgctgcccctactgtcggacatgcagcgctgacaaagattcacaccagctgcatctaagtatctgtaagaaaaagaaagccggatccaatgtcatgctcgcggtgtgcaagcgtatgtgttttaaggcaaccattgaagccagcaaccgcgttctgcttataagatctatcattaatacgaccttcatcatttgcatgttgatcctggtggtctgtgtgatatcaacaagtgctgtagagatggaggacctccctgccggcacttgggaaagggaggaagatctgaccaacttctgccaccaggagtgtcaagttacagaaactgagtgcctttgtccatatgaggcatttgtgctgcggaaacccttgttcctcagctccatcgtcaagggtaaaaagaacctgttaaattctgcttcgctggaaaccagcctatccattgaggccccttggggcgcgatcaacgcccagtcaacatttaaaccaaccattagtactgcaaatatcgctctctcttggagctccgtggaacatcgagggaacaaggtcctggtgtcaggacgcagcgagtctataatgaaacttgaggaaagaacgggcatttcctggaatttgggggttgaggacgccagtgaaagcaggatgctgacagtgtctgtaatggatctctcccagatgtacctgcccgtcttcgagtatttatcaggagaccgccaggtggaagagtggccgaaggctacctgcactggtgattgccctgagcggtgtggctgcaccagtagcacatgtctgcacaaggaatggccccactcgagaaactggaggtgcaatccaacctggtgttggggagttgggactggctgcacatgttgcggtcttgacgtgaaagatttgtttacggactacatgttcgtcaagtggaaagtggagtacatcaagaccgaagccattgtatgtgtggagctcacttcccaagaacgtcagtgctctctgatcgaggcagggacacggtttaacctaggccctgttaccataacactgagcgagccccgaaatatccagcagaagctcccatcagaaattgtcactctgcatcccaaaatcgaggaaggattctttgatcttatgcacgtgcaaaaggtgttgagtgcctccaccgtctgtaaactgcagtcttgcacgcatggcgttgctggggacttacaggtgtatcacgtgggaaacctcctgaagggtgacaaaattaatggccatagcatccacaagatagagcctcaccttaacacctcctggatgtcatgggatgggtgcgacctggattactattgtaatatgggagactggccaagctgcacatacactggcgtaacccagcataaccacgcggcattcgtcaatttgctcaacattgaaacagattatactaaaagttttcatttccactctaagagagtgaccgcccacggtgacacgccgcaactggatctaaaggctaggcccatgtacggggccggcgagatcacagttctggtggaggtcgcagacatggaactccattccaaaaacatcgagattagcggactgaagtttgcctcgcttacctgttcaggctgctatgcttgttctagtgggatctcctgcaaagtgcgcattcacgttgatgaacctgacgagttggccgtgcatgtaaagagcgatgacctggatgtcgtggcagcgtctagctccttaatggctcggaaaatagagttcggaactgactcaacattcaaggcctttagtagcatgccaaaggaatctctctgtttctacatcgtggagagagacttttgcaaatcctgtgcagccgaagatacccagaagtgcgtcaaagctaagctggagcagccccagtcaattcttatcgaacacaaaggcactattatcggtaagcaaaatgacacctgtagtacaaagacgagctgctggctggagtccttcaaatcgtttttctacgggctaaagaacatgctctctggagtttttggcagcgccataatgggtatcctgttgttcctggcaccttttattttactcatcctgttctttttctttggctggaggattcttttctgcctgcgctgttgccgacggacccgtgggttgttcaaatataagcatatcaaagatgacgaggaagctggatacaagaagataattgagaaactcaataacaagaaaggcgggacttcaaagctgctagatggagaaagactggccgacaggaaaatcgcggagctgttttccacaaaggcccacatcggc

SEQ ID NO: 10440 - RNA, 3495 nt, synthetic construct
  misc_feature 1..3495: note = derived and/or modified CDS sequence (opt3) from CCHVF(CCHVF 66019)__AB069669.1__Gn-NSm-Gc
  source 1..3495: mol_type = other RNA
agcgaggaatccggcgacgattgcatctctagaacccagctgctcaggacagagactgccgaagtgcacggggacaactacggaggtcccggcgataagattacgatatgtaatgggtcaaccatcgtcgaccaacggcttggaagtgagctgggctgctatacaattaaccgcgttaagagcttcaagttgtgtgaaaattccggtactgggaaatcttgcaagatcgataacacccctgtgaaatgtcgacagggattttgcttaaagattacacaggagggccgtggccatgtaaagctgtcgagagggtcagaggtggtcctagacgcttgtgatagcagttgcgaaatcatgataccaaaaggaaccggtgacatcctcgtggattgttccggcgggcagcaacacttcctgaaggacaatcttgttgatctgggatgcccgaacattcccttgctcggcaaaatggcaatctacatttgtaggatgtctaatcatcctaagactacaatggcctttctgttctggtttagcttcggttatgtgataacctgcatcttttgcaaaattatcttctacctgctcattgtcgtggggacgttaggaaagaagtttaaacagtatcgggagctgaagccacagacttgtaccatctgcgaaacaactcccaccaacgcgatcgacgctgagatgcacgatcttaaatgttcctacaatatttgcccttattgtgcctcacgcttgacaagtgacggcctggcaagacatgtaacccagtgcccaaagaggaaagagaaggttgaagagacggaactatacctcaacctggagcggataccctggatcgtgcgcaaacttctgcaagtcagcgaatctactggcgtggccttgaagcgatcctcatggctcattgtgctgttagtcctgctcacagttagccttagtcctgtgcagtctgctccaatcgggcacggaaagaccatagaggcataccagactagagagggttatacatccgtatgtctgttcatgttgggcgggattctatttgtggtcagctgcctgatgaaaggactcgtggactcggtttctaattccttctttccgggcctgtcaatctgtaagacctgcagtatcggtagcgtgaacgggttcgaaattgagtcccacaaatgttactgctctcttctgtgctgtttgtattgcaggcattgtagcgccgatcgggaaatccaccagctccatctgtcaatttgcaagaaacgtcgcgctggcggaaatgtcatgttagccgtgtgtaagagaatgtgcctgagggcgacgatggaggtaagtaacaaggttctattcatacggtccatcattaataccacatttgtgatctgtatcctcgtcctggcagtgtgcattgtcagcacttctgccgtggaaatggagtcacttcccgctggcacctgggagcgagaagaggacttgacaaacttctgtcaccaagaatgccaggttactgagaccgaatgtctgtgcccttacgaggccctcgtgctgcgcaaaccactttttagtgatagcatagtaaaggggatgaaaaacctgcttaattccacatctctcgagacctcgctgagcatcgaagcaccctggggagctattaacgtccagtccactttcaagcctacggtgtcaacagccaatatcgcgttaagttggtctagcgttgagcacagaggtaacaaaattctggtgtccggcaggtcagaaagcatcatgaagctagaggagcggaccgggatatcttgggacctcggagtcgaagatgcctccgagagtaagctgcttactgtgagcgtaatggacttgtctcaaatgtattccccagtgtttgaatacctgtcaggcgatcgccaggttgaggaatggcccaaagcaacctgcacaggtaattgtccggacagatgcgggtgtaccagtagcacttgcctccataaggagtggcctcactcgaggaactggcgttgtaatcccacatggtgctggggcgtcggaacgggctgtacctgctgtgggctggatgtgaaagacttattcactgattatatgtttgtgaagtggaaagtcgagtacatcaagacagaagctattgtttgcgtggagctgaactcccaggaacggcagtgttctcttatcgaggccggaacccgattcaatttgggtccagtgacaattactctcagcgaacctagaaacatccaacagaagctgccctcagagataattaccctacatccaaggatcgaggaaggctttttcgacctgatgcacgtacagaaagtcctcagtgcttccacggtgtgcaagctgcagtcttgcacccatggggttcccggagaccttcaaatttaccacatcggcaatttgctgaaaggtgatcgcgtgaacgggcacttaatacataagatcgagcctcactttaatacaagctggatgtcctgggacggctgtgatctcgactattactgcaacatgggagattggccatcatgtacttataccggcgtcacacagcataatcacgccgcattcgtgaacctgcttaacattgaaactgactacaccaaaaattttcacttccatagcaagcgggttacggcccacggggatacaccgcagctggacttgaaagctagacccacctatggagcgggcgagatcactgtgctcgtagaagtcgcagatatggagctgcatacaaagaagattgccatcagtggtctaaaattcgcttctctgacctgcactgggtgttacgcctgctccagcggaatatcgtgtaaggtgaggattcacgtggacgagcctgatgaactcaccgtccatgttaaatcagaggacccagatatcgtggcagcctctagttccctgatggctcgcaagttggaatttggcacagacagcacgttcaaagccttttctgcaatgcccaagaccagcttgtgcttctatatcgtagagcgagagtactgtgaatcctgctcaaaggaggacactcagaaatgtgtgaacacaaagctggaacaacctcagagtattttaatcgagcacaaaggtaccattataggcaagcagaatgatacatgcactgcgaaagctagctgctggctcgaatctgtcaagtcctttttctacgggctgaagaacatgctttcaggaatctttggcaatgtgttcattgggatctttctgttcctagccccatttattctcctgatcttgttctttatgttcggatggcggatactgttctgttttaaatgctgtcgtagaaccaggggcttattcaagtatcgctacctcaaagacgatgaggagagtggttatcggagaatcattgaaaggctgaacaataagaaagggaagaacaaacttctggacggagagcgattggcagatcgccggatcgccgaactctttagcacgaaaacacacattggc

SEQ ID NO: 10441 - RNA, 3495 nt, synthetic construct
  misc_feature 1..3495: note = derived and/or modified CDS sequence (opt3) from CCHVF(CCHVF 7001)__AB069670.1__Gn-NSm-Gc
  source 1..3495: mol_type = other RNA
gccgagggcgggagctccgactgcatctctagaacccagctggtgaagacagaagtcgctgagattcacgaagattcatacggaggtcccggcgagaaaataactatctgtaacgggagtacgattgttgaccaaaggctcggaagcgaacttggctgctataccatcaatcgggtgcgctcctacaagctgtgtgagaactctgcatcgggtaaatcatgcgagattgatagcatccctgtaaagtgtaaacaggggttctgcttgaagataacacaggaaggacgaggccatgtgaagttaagtcgtggcactgagatcgtcctggacgtgtgtgattcctcttgcgaactaatgattccaaaagggaccggagacatcctcgttgattgtagcggtggccagcaacactttctgcagaataaccttattgacctggggtgcccgaatgtgcccttgctcggaaagatggccatctatgtctgtagaatgtccaaccatcctaaaacaaccatggcgttcctgttttggttctcatttggctacgtgataacttgcattgcttgcagggtactgttctatctcttaatcgccattggtacagttgggaagaaactgaagcagtaccgggagcttaagccacagacctgtatcgtgtgcgagagtgtccccgtgaatgcaatcgatgccgaaatgcacgagttgaactgtagctataatatttgcccttactgtgcttctcgcctgtccacggacggactaataagacatgtgactcaatgcccaaaaaggcgggaaaaggtcgaggaaaccgagctctttctgaaccttgagcgcatcccctggctggttcgaaaattgctccaggtgtcagaaagcacaggcatggcactgaagagaagttgttggatgattactttactgatcctccttctggtatctatatcccctgtgcagagcgccccagtcggcaaagagagggctattgaaacctaccaggcccgggagacatataccgggatctgcttgttcgtgctaggatcggttctgtttgcggtgtcttggctcacgaaggcactgatcgatggtattggcaattccttctttccggggctttcagtctgtaaaacttgcagtatcggaagcattaacggcttcgaaatagagtcccacaagtgttactgctctctgttttgctgtccctattgccgtgcctgtagctcagacaagaatacacaccgcatgcatttgaacgtgtgcaaaaagagaaaaatgggtagtaatgtaatgctcgctgtttgtaagaggatgtgcttccgggccaccatcgaggcatccaacaaagctctgttaattcgaagcatcatcaactctactttcgtgatttgtatactgatcctaacaatttgcgtcgtgtcaaccagtgccgtcgatatggaaaatctccctgcggggatctgggagaaggaagaggacctgacgaacttttgtcaccaagaatgccaggtgaccgagacagagtgtctttgcccatacgaagccatggttttgcgcaagcccctgttcctcgacaatattgcaaaaggcatgaaaagcctgcttaactccacttctctggagacctcgttgagcatcgaagctccttggggagccataaatgtgcagtccacatttaagccaactgtatcagctgccaacatcgcactcagttggtctagcgtcgagcatagaggcaataagattctggtgtccgggaggtcagagagcatcatgaaattagaggaacggaccggagtttcttggaacctgggtgtggaagatgcctccgagagtaagacactaaccgtcagcgtgatggacctctctcaaatgtattcccccgtattcgaatacctgtcaggcgatcgccaggtggaggagtggccgaaggctacttgcacgggggactgtcctgaaagatgcggatgtacaagttcgacctgccttcacaaagagtggccccacagcaggaattggcgttgtaacccaacttggtgctggggcgttggtaccgggtgtacatgctgtggcttggatgtcaaggactttttcaccgattatatgctggtgaaatggaaggtggaatacattaaaactgaggcgatcgtctgcgttgaactcacatcccaggagcggcagtgttctctgatagaggcaggaacgcgatttaatttaggccctgtgaccattactctgagcgaacccagaaacgtgcaacagaggcttccacccgagatcgtaacattgcatcctaagattgaagaggggttctttgacctcatgcacgtccagaagatcctgtcagccagtaccgtgtgcaaactacagtcctgcacacatggagttccaggtgatttccaagtgtaccacgtcggcaatctgctccgcggggacaaggtgaacggacattctatacacaaaatcgaaccgcactttaatactagctggatgtcctgggatggctgtgacctggactatttctgcaacatgggtgattggccctcatgtacctacacgggggttacccagcataaccgggctgcctttattaatatgcttaacatcgagacagactatactaagaccttccacttccatagcaaaagagtgacagcacacggcgatactcctcagttggacctgaaggccaggccagcttacggagccggcgaggtaaccgtcttagtggaagtggcagatctcgagctgcacacgaaaaagctggaagtcagtgggcttaagattgcgtctttgacatgctccggatgttatgcttgcagctcgggcatctcatgtaaagttcgcatacatgtgaatgagcccgacgagtttaccgtacacgtgcgatctagtgatcctgacgtcgtggccgcaggttccagcctcatggcccggaagattgaatttggggctgattctacttttaaagccttcagctccatgccaaaggactcactgtgcttttacatcgttgagaaagattattgtagtagctgcacagacgatgacacccagaagtgtgtgaacactaagctagaccatccccaatctatcctgattgaacacaaaggaaccatcattggcaagcagaatgatacatgctccacgaaaacctcatgctggctcgagagtgtcaagggtttcttttacggcctgaaaaacatgcttagcgggatattcggaaatgtgtttttgggcatcttcctgtttttagcaccgttcgttctcctgattttcttcttctttttcgggtggcgtcttctgttttgtctaaagtgctgtagaaggactcgcggactcctgaagtacaaacatttgaaggacgaagaggaggctggctataaaaagatcattgaacggctgaacggtaaaaaggggaagtcccagttattcgatggagagagactcgccgacaggaaaatcgcggaactgttttctacaaagatacacatcggc

SEQ ID NO: 10442 - RNA, 3495 nt, synthetic construct
  misc_feature 1..3495: note = derived and/or modified CDS sequence (opt3) from CCHVF(CCHVF 75024)__AB069671.1__Gn-NSm-Gc
  source 1..3495: mol_type = other RNA
agcgaggaatccggcgacgattgcatctctagaacccagctgctcaggacagagactgccgaaattcacggggacaactacggaggtcccggcgataagataacgatctgtaatgggtcaaccattgtggaccaacggcttggaagtgagatgggctgctatacaatcaaccgcgtcaagagcttcaagctgtgtgaaaattccgctactggtaaatcttgcgagattgattcgatccctgttaagtgtcgacaggggtactgcttgaaaataacccaggagggacgtggccatgtgaagttatcaagaggcagcgaagtagtgctggacgcatgtgatagttcctgcgaggtcatgatcccaaaggggacaggagacattctagtggattgttctggtggccagcaacactttctcaaagacaacctgatcgatcttgggtgcccgagcattcccctgttgggaaagatggccatctatatatgtaggatgtccaatcatcctaaaaccactatggcgttcctcttttggttctcatttggctacgttattacatgcatcctgtgcaaggctattttctatctgctcatcatcgtgggtaccttagggaaacggtttaagcagtaccgcgaactgaagccacagacgtgtactatttgcgagaccacacccgccaacgcaatagacgccgagatgcacgatcttaattgtagttataacatctgcccttactgtgctagcagattgacttctgacggactggcaaggcatgtcacccagtgcccaaaacggaaggaaaaagtggaggaaacagagctatacctcaatctggaacgcattccctgggtagttcgaaaacttctgcaagtgtccgagtcaaccggcgtcgccttgaaaagaagcagttggctcatcgtgctgttagtgctgttcgctatatctctctcccctgtccagagcgccccaattggccacgggaagacgatcgagacttatcaggcgagggaagagtacacatcgatctgtctttttgttctgggatctattttgttcatcgtgtcctgcctaatgaaaggtctggtagactcaattggcaacatatttttcccggggctcagtatctgtaagacctgcagcattggatccatcaatggctttgaaatcgagtctcacaagtgttattgcagcctgctttgctgtccctactgccggcattgttcagcagatcgtgaaattcaccagctgcatttgagtatatgcaaaaagcgcaaaactggttccaacgtgatgctcgccgtctgtaagagaatgtgcttcagggctacaatggaggtgagcaataaagccctgttaatccggtctattatcaacaccacgttcgttgtgtgtattctgatcctagcagtctgcgtggtatcaaccagtgctgttgagatggaaagcctccctgccgggacatgggagcgagaagaggacctgactaatttttgtcaccaagaatgccaggtgaccgagacagagtgtctttgcccatatgaagcgttggtcctgcgcagacccctcttcctggattccatagtgaggggcatgaagaaccagcttaactctacttcgctggagaccagcttgtccatcgaagccccttggggagcaattaatgtccaatcaacatacaagccaaccgtgagtactgctaacatcgccctctcttggagctccgttgagcaccggggcaataaaattctggtgtcagggcgcagcgagtctatcatgaagttagaagagagaacgggaatatcctgggacctgggtgtagaagatgctagtgagagcaaactactcacagtctctgtgatggacctgtcccagatgtattcacccgtttttgaataccttagtggcgatcgtcaggtggaggagtggccgaaggcaacctgcactggggactgtcctgaaaggtgcggatgtaccacatcgacctgcttgcataaagagtggccccacagccggaactggcgatgtaatccaacttggtgctggggcgtcggtacagggtgtacgtgctgtggcctggatgtgaaggacctcttcaccgattacatgattgtaaagtggaaagtggaatatatcaagactgaggccattgtttgcgtcgaactgacatcccaggagagacaatgttctttaatcgaggccggaaccaggtttaacctgggcagcgtgacaataactctttcagaacctcgcaatatccagcagaaattgcccccagagattatcaccctccatccccggattgaagaggggttctttgacctgatgcacgtgcagaaggtcctaagtgcttccacggtttgcaaactgcaatcttgcacccatggagtgcctggtgacctccaggtgtaccacgtaggcaacctgcttaagggggataaggtcaatggacacttgatccataaaatagaaccacacctgaacacaagctggatgtcctgggacggctgtgatttagactattactgcaatatgggtgattggccgtcatgtacttataccggggtgacacagcataaccacgcgagcttcgttaatctcctgaacattgagactgactacaccaagagttttcacttccattctaaaagagtgacggcacacggcgatacaccccagcttgacctgaaggccaggcctacctatggagctggcgagatcactgtcttggtggaagttgccgatatggagtttacaccaaagaagatcgaaatttccgggctcaaattcgcaagcctgacctgcactggatgttacgcctgctcgtcaggcatctcttgtaaggtgcgcattcatgtagacgagcccgatgagctaaccgtccacgtgaagagtgacgatcctgacgtggtcgctgcctccagctctctgatggcacgaaaactcgaatttggtacagacagcacgttcaaggcgttctccgctatgccaaaaacctcactgtgcttttacatagttgagcgggaatattgtaagagttgcagcaaagaggatactcaaaagtgtgtgaatacaaaacttgaacagccccagtctatcttgattgagcataaagggaccatcattggaaagcagaacaacacatgcactgccaaagcatcctgctggctggagtcagtaaagagtttcttttacggcctcaaaaatatgttaagcggtatcttcggcaacctgtttatggggatattcctttttctggccccgttcatcctactcattctgtttttcatgtttggatggcgtatcttgttctgttttaagtgctgtagaaggacccgcggcctgttcaagtatcggcacttaaaagacgatgaagagacggggtacagaaggattatcgaacgactcaataacaagaaaggaaagaataaactgcttgacggcgagcgcctggctgatcggagaatagccgaattgttctccacaaagacccacattggt

SEQ ID NO: 10443 - RNA, 3495 nt, synthetic construct
  misc_feature 1..3495: note = derived and/or modified CDS sequence (opt3) from CCHVF(CCHVF 7803)__AB069672.1__Gn-NSm-Gc
  source 1..3495: mol_type = other RNA
agcgaggaatccggcgacgattgcatctctagaacccagctgctcaggacagagactgccgaaattcacggggacaactacggaggtcccggcgataagataacgatctgtaatgggtcaaccattgtggaccaacggcttggaagtgagatgggctgctatacaatcaaccgcgtcaagagcttcaagctgtgtgaaaattccgctactggtaaatcttgcgagattgattcgatccctgttaagtgtcgacaggggtactgcttgaaaataacccaggagggacgtggccatgtgaagttatcaagaggcagcgaagtaatcctggacgcatgtgatagttcctgcgaggtgatgattccaaaggggacaggagacatcctagtcgattgttctggtggccagcaacactttctcaaagacaacctgattgatcttgggtgcccgagcatccccctgttgggaaagatggccatatatatttgtaggatgtccaatcatcctaaaaccactatggcgttcctcttttggttctcatttggctacgtgatcacatgcattctgtgcaaggctatcttctatctgctcatcattgttggtaccttagggaaacggtttaagcagtaccgcgaactgaagccacagacgtgtactatatgcgagaccacacccgccaacgcaatcgacgccgagatgcacgatcttaattgtagttataacatttgcccttactgtgctagcagattgacttctgacggactggcaaggcatgtgacccagtgcccaaaacggaaggaaaaagtcgaggaaacagagctatacctcaatctggaacgcatcccctgggtggtacgaaaacttctgcaagtttccgagtcaaccggcgtggccttgaaaagaagcagttggctcatagtcctgttagtgctgttcgctatttctctctcccctgtgcagagcgccccaatctcgcacggcaagacgatcgagacttatcaggcgagggaagagtacacatctatttgtctttttgtcctggggtccatcttgttcattgtttcatgcctaatgaaaggactggtggacagtataggtaacatctttttcccgggcctcagcatttgtaagacctgctccatcgggtctatcaatggatttgaaattgagagccacaagtgttattgctcactgctttgctgtccctactgccggcattgtagtgcagatcgtgaaatacaccagctgcatttgtccatctgcaaaaagcgcaaaactggcagcaacgtaatgctcgccgcttgtaagagaatgtgcttcagggccacaatggaggtgtctaataaagcactgttaattcggtcaatcattaacaccacgttcgtcgtgtatatcctgatactagctgtttgtgtggtcagtaccagcgccgtggagatggaatccctccctgcgggtacatgggagcgagaagaggacctgactaatttttgccaccaagaatgtcaggtaaccgagacagagtgcctttgtccatacgaagccttggttctgcgcagacccctcttcctggattctatcgtgagggggatgaagaaccctcttaactcgactagcctggagacctccttgtcaattgaagcaccatggggcgctatcaatgtccagagtacatataagcccaccgtgtctactgccaacattgctctcagctggtcctcagtcgagcaccggggaaataaaatcctggtgagcggccgctctgagtccataatgaagttagaagagagaacggggattagttgggacctgggagttgaagatgccagcgagtctaaactactcacagtgtccgtaatggacctgtcacaaatgtacagtccggtctttgaataccttagcggtgatagacaggtggaggagtggcctaaggcaacctgcactggcgactgccccgaacgttgtgggtgcaccacatcgacctgtttgcataaagagtggccacactcccggaactggcgatgcaatcctacttggtgttggggagttggcacaggttgcacgtgttgcgggctggatgtgaaggacctcttcaccgattatatgatcgtcaagtggaaagtggaatacattaagactagaggcatcgtatgtgtggagctgacatctcaggaaaggcagtgcagcttaatagaggccggaacccgctttaacctgggctcagttacaatcactcttagtgagccccggaatattcaacagaaattgccacccgaaatcattaccctccatcctagaatcgaggaagggttctttgacctgatgcacgtccagaaggtgctatccgcttctacggtgtgtaaactgcagagctgcacccatggagtcccaggtgacctccaagtttatcacgtgggcaacctgcttaagggggataaggtgaatggacacttgatacataaaattgagccgcacctgaacacatcctggatgtcatgggacggctgcgatttagactactattgtaatatgggtgattggcccagctgcacttacaccggggtaacacagcataaccacgcgagtttcgtcaatctcctgaacatcgaaactgactataccaagtcttttcacttccattccaaaagggtgacggcacacggcgatacacctcagcttgacctgaaggcccgcccaacctacggagctggcgagatcactgttttggtggaggtcgccgatatggaatttacacccaaaaagattgagatcagcgggctcaaattcgcatcgctgacctgtactggatgctacgcctgttcatctggcattagttgcaaggtgcgaatacatgttgacgaacctgatgagctaaccgtgcacgtaaagtccgacgatccagacgtcgtggctgccagctctagcctgatggcacggaaactcgagtttggtacagactccacgttcaaggcgttctcagctatgcccaaaaccagtctgtgtttttatatcgtggaacgtgagtactgcaagagctgttctaaagaagatactcagaagtgcgtcaatacaaaacttgagcaaccgcagtccattttgatcgaacataaagggaccattatcggaaagcagaacaacacatgtactgccaaagcatcatgctggctggagagtgttaagagcttcttttatggcttaaagaatatgctctccggtatattcggcaactttttcatggggatctttctgttccttgccccttttattctgctaatcctcttctttatgttcggatggaggattctgttttgcttcaagtgttgcaggcgcacccggggcttgttcaagtacagacacctgaaagacgatgaggaaacggggtataggcgaatcatagagcgcttaaataacaagaaaggaaagaataaactcctggacggcgaacggcttgctgatagaaggattgccgagctgttttctacaaagacccacatcggt

SEQ ID NO: 10444 - RNA, 3495 nt, synthetic construct
  misc_feature 1..3495: note = derived and/or modified CDS sequence (opt3) from CCHVF(CCHVF 79121)__AB069673.1__Gn-NSm-Gc
  source 1..3495: mol_type = other RNA
gccgagggcgggagctccgactgcatctctagaacccagctggtgaagacagaagtcgctgagattcacgaagattcatacggaggtcccggcgagaaaataactatctgtaacgggagtacgattgttgaccaaggactcggcagcgaacttggttgctataccatcaatagggtgcggtcctacaagctgtgtgagaactctgcatcggggaaatcatgcgagattgatagcatccctgtaaagtgtaaacagggattctgcttgaagataacacaggaaggccgcggccatgtgaagttaagtcgagggactgagatcgtcctggacgtgtgtgattcctcttgcgaactaatgattccaaaaggaaccggtgacatcctcgttgattgtagcggcgggcagcaacactttctgcagaataaccttattgacctgggatgcccgaatgtgcccttgctcggcaagatggccatctatgtctgtcgtatgtccaaccatcctaaaacaaccatggcgttcctgttttggttctcatttggttacgtgataacttgcattgcttgcagagtactgttctatctcttaatcgccattgggacagttggaaagaaactgaagcagtacagggagcttaagccacagacctgtatcgtgtgcgagagtgtccccgtgaatgcaatcgatgccgaaatgcacgagttgaactgtagctataatatttgcccttactgtgcttctcggctgtccacggacggcctaatacgccatgtgactcaatgcccaaaaagaagggaaaaggtcgaggaaaccgagctctttctgaaccttgagcggatcccctggctggttcgcaaattgctccaggtgtcagaaagcacaggcatggcactgaagcgaagttgttggatgattactttactgatcctccttctggtatctatatcccctgtgcagagcgccccagtcgggaaagagagagctattgaaacctaccaggccagggagacatataccggaatctgcttgttcgtgctaggttcggttctgtttgcggtgtcttggctcacgaaggcactgatcgatggcattggaaattccttctcaccggggcttagtgtctgtaaaacttgcagcatcggctccattaacggttttgaaatagagtctcacaagtgttactgcagcctgttctgctgtccctattgccgggcctgttcaagtgacaagaatacacaccgtatgcatttgaacgtgtgcaaaaagcgcaaaatggggtccaatgtaatgctcgctgtttgtaagagaatgtgctttagggccaccatcgaggcaagcaacaaagctctgttaattcggtctatcatcaactcaactttcgtgatttgtatactgatcctaacaatttgcgtcgtgagtaccagcgccgtcgatatggaaaatctccctgcgggcatctgggagaaggaagaggacctgacgaacttctgtcaccaagaatgccaggtgaccgagacagagtgtctttgcccatacgaagccatggttttgcgaaagcccctgtttctcgactccactgcaaaaggaatgaagtctctgcttaattcgaccagcctggagacatccttgtcaattgaagctccttggggcgccatcaacgtgcagagtactttcaaaccaaccgtatctgctgccaatatagcactcagctggtcctcagtcgagcatcgcgggaacaagatcctggtgagcggaagatctgagtccattatgaaattagaagagaggacaggtgttagttggaatctgggcgtggaagatgccagcgagtctaagaccctaactgtctccgtgatggacctctcacaaatgtatagtcccgtatttgaatacctgagcggggatcgccaggtggaggagtggccgaaggctacgtgcacaggagactgtcctgaacggtgcggctgtacctcgtccacttgccttcacaaagagtggccccactctagaaactggaggtgtaatccaacctggtgctggggtgttgggacaggctgtacctgctgtggattggatgtcaaggacttctttactgattatatgctggtgaaatggaaggtggaatacatcaaaacagaggcgattgtctgcgttgaactcacgagccaggagcgtcagtgttcactgatcgaggcaggcacccggttcaacttagggcctgtgactataacactgagtgaaccccgaaatgtgcaacagagacttccacccgagattgtaaccttgcatcctaagatcgaagagggatttttcgacctcatgcacgtccagaagattctgtccgcctctacagtgtgcaaactacagagctgcactcatggtgttccaggcgattttcaaatctaccacgtggggaacctgctcaggggagacaaggtcaatggccattccatacacaaaatcgaaccgcacttcaacacctcatggatgagctgggatggttgtgacctggactatttttgcaatatgggggattggcccagttgtacgtacaccggcgtgacacagcataaccgcgctgccttcattaacatgcttaatatcgagactgactataccaagacatttcacttccattctaaacgggttactgcacacggagatacccctcagttggacctgaaggccagaccagcttacggcgccggggaggtgacggtattagtcgaagtggcagatctcgagctgcacaccaaaaaccttgaagtgtccggactgaagattgcgagcttgacatgctcgggctgttatgcttgctcatctggtatcagttgtaaggtcaggatacatgttaatgagcccgacgagttcactgtgcacgtacgctccagcgatcctgacgtggtcgccgcagggtctagcctcatggcccgaaaaattgaatttggagctgattccacattcaaggccttttcaagtatgccaaaagacagcctgtgcttctacatcgtggagaaggattattgttcttcctgcaccgacgatgacactcagaaatgtgttaacaccaagctagaccatccccaatcaatcctgattgaacacaagggcacaatcattggtaaacagaatgatacgtgcagtaccaagactagctgctggctcgagtccgtgaaaggctttttctacgggctgaagaacatgctttctggaatatttggcaatgtcttcttggggatctttctgttcttagcaccgtttgtgctcctgattttctttttcttctttggatggcggcttctgttctgtctaaaatgctgtcgtagaacaaggggcctcctgaagtacaagcatttgaaagacgaagaggaggctggttataagaaaatcattgaacgcctgaacgggaagaaaggaaagtcgcagttatttgatggcgagcggctcgccgacagaaagatcgcggaactgttcagcaccaaaatacacatcggt

SEQ ID NO: 10445 - RNA, 3495 nt, synthetic construct
  misc_feature 1..3495: note = derived and/or modified CDS sequence (opt3) from CCHVF(CCHVF 8402)__AB069674.1__Gn-NSm-Gc
  source 1..3495: mol_type = other RNA
agcgaggaatccggcgacgattgcatctctagaacccagctgctcaggacagagactgccgaaattcacaacgacaattacgggggacccggtgataagataacgatctgtaacggctcaaccgtggtcgaccaacggcttgggagtgagctgggatgctatacaattaatcgcgttaaatctttcaagttgtgtgaaaactccgctactggcaaatcttgcgagatcgattcgacccctgtgaagtgtcgacagggtttttgcttaaaaattacacaggaggggcgtggacatgtaaagctgtcaagaggcagcgaagtggtcctagacgcatgtgatagttcctgcgagatcatgataccaaagggcaccggggacatcctcgtggattgttctggaggtcagcaacacttcctgaaagacaatcttattgatctgggctgcccgaacatccccttgctcgggaagatggccatttacatctgtaggatgagcaatcatcctaaaactacaatggcgtttctgttctggttttccttcggatatgttgtgacctgcatactgtgcaaggtcatcttttacctcttaattgtggtaggcacgctgggtaaaaagttcaagcagtatcgggaacttaaaccacagacttgtaccatttgcgagacaactcccgttaacgctatcgacgccgagatgcacgatttgaattgttcatacaacatctgcccttattgtgcaagtcgcctgaccagcgacgggctagccagacatgtgatgcagtgcccaaagaggaaagaaaagattgaggaaacagagctctacctgaatcttgaacggataccctgggtcgtgcgcaaactgttgcaagtgtctgagtccaccggagtcgctctcaagcgatcaagctggctggttgtgttactggtactccttacggtgagtctgtctcctgtccagtccgcaccaatcggccacggcaaaactgtggagacataccagaccagagaagggtatactagcatttgtttgtttgttctaggatcgatcctgttcatagtgtcttgcctcatgaagggtctggtcgactccgtgggcaactcatttttcccggggcttagtatttgtaagacatgcagcatcggatccgtaaatggctttgagatcgaatctcacaaatgttactgcagcctgttctgctgtccctattgcaggcattgttcagccgatcgggagattcaccgtttgcatctcagtatctgcaagaaacgcaagaccggttccaacgttatgctggctgtgtgtaaaagaatgtgcttcagggccacggtcgaagtgagcaataaggcgttactgattcggaacataatcaacaccacatttgtcctatgtattctcatcctggcagtgtgcgttgtgtctacttcagccgtagagatggagagtcttcctgctgggacctgggaacgagaggaagacttgacaaatttctgtcaccaggagtgccaagtcactgaaaccgagtgtctgtgcccatacgaggccctcgtgctgcgcaagcccctttttagcgattccatcgttaaaggcatgaagaacctgttgaatagcacatcgctcgaaaccagcctgtccattgaggcaccttggggagctataaacgtgcagtcaactttcaaaccaacggtcagtgccgcgaatatcgccttatcttggagctccgtggaacacagaggcaacaagattctggtatcagggaggagcgagtctatcatgaaactagaggaacggacaggaatttcctgggacctcggtgtggaggatgcaagtgaaagcaagctgcttaccgtttctgtcatggacttgtcccagatgtattcacccgtgtttgagtacctgagtggcgatcgccaagtggaagagtggccgaaggctacttgcaccggggactgtcctgagagatgcggatgtacaagctcgacctgcctccataaagaatggccccactccaggaattggcgttgtaacccaacttggtgctggggcgtcggtacagggtgtacgtgctgtggcctggatgttaaggacttattcaccgattatatgtttatcaaatggaaggtggagtacataaaaactgaagccatcgtgtgcgtagagctgacatctcaggaacggcagtgtacccttattgaggctggaacacgattcaatttgggccctgtcactatcaccctcagcgagcccagaaacattcagcaaaagctgccacccgaaatcgtgacgctacatcctaggatagaggaagggtttttcgacctgatgcacgttcagaaggtgctctcagccagtaccgtctgcaaactgcagtcctgcacacatggagtgccaggtgaccttcaggtttaccacattggcaatttgctgaagggggataaagtgaacggacacttaatccataagattgagccgcactttaatacttcttggatgagctgggacggctgtgatctcgactattactgcaacatgggtgattggccctcctgtacctatacaggggtaactcaacataatcacgcagccttcgtcaacatgctgaacatcgaaaccgactacacgaaaaattttcacttccattcaaagcgcgtgacagctcacggcgatacccctcagcttgacctgaaagcgcggccaacttatggagcaggcgagataacagtgttggtcgaggttgccgatatggaactccataccaagaagatcgagattagcgggctgaaattcgctagtctaacttgcaccggatgttacgcctgttcttccggcatcagctgcaaggtgagaatccacgtagacgaacccgatgagctgacagtgcatgtcaaatcggaggaccctgatattgtggcagcctcatctagtctcatggctaggaagctggaatttggtacggactccaccttcaaagcctttagcgcaatgccaaagacttctctttgcttctatatagttgagcgcgaatactgtaagagctgctccaaagaggacacacagaagtgtgtgaacaccaaattggaacagccccaatcaattctgatcgagcacaaggggacaatcattggaaaacagagtaatacttgcaccgcgaaggctagctgctggttagagtctgtcaagtcctttttctacggcctcaaaaacatgctgtcaggtatctttggcaatgtgttcattggggtttttcttttctttgccccgttcatactgctaatcctctttttcatgttcggatggcggattctgttttgtttcaagtgctgtcgacgtacgagaggcttgtttaaatataggcacctgaaggatgacgaagagacagggtaccgcaaaatcattgaacggttaaacaataagaagggcaaaaacaagctcctggatggagagagacttgcagacaggaaaatcgccgaactgttcagtaccaagactcatataggt

SEQ ID NO: 10446 - RNA, 3495 nt, synthetic construct
  misc_feature 1..3495: note = derived and/or modified CDS sequence (opt3) from CCHVF(CCHVF 88166)__AB069675.1__Gn-NSm-Gc
  source 1..3495: mol_type = other RNA
agcgaggaatccggcgacgattgcatctctagaacccagctgctcaggacagagactgccgaaattcactcagacaactacgggggacccggtgataagataacgatctgtaatggcagtaccgtggtcgaccaacggcttgggagcgagctgggatgctatacaattaaccgcgttaaatccttcaagttgtgtgaaaattctgctactggcaaatcgtgcgagatcgattcaacccctgtgaagtgtcgacagggtttttgcttaaaaattacacaggaggggcgtggacatgtaaagctgagcagaggcagtgaagtggtcctagacgcatgtgattcctcttgcgagatcatgataccaaagggcaccggggacatcctcgtggattgtagcggaggtcagcaacacttcctgaaagacaaccttattgatctgggctgcccgaatatccccttgctcgggaagatggccatttacatctgtaggatgtccaaccatcctaaaactacaatgggatttctgttctggttttcattcggctatgttgtgacctgcatactgtgcaaggtcatcttttacctcttaattgtggtaggtacgctggggaaaaagttcaagcagtatcgggaacttaaaccacagacttgtaccatttgcgagacaactcccgttaatgcgatcgacgctgagatgcacgatttgaactgtagttacaatatctgcccttattgtgccagccgcctgacctctgacggactagcaagacatgtgatgcagtgcccaaagaggaaagaaaagattgaggaaacagagctctacctgaaccttgaacggataccctgggtcgtgcgcaaactgttgcaagtgtccgagtcaaccggcgtcgccctcaagcgaagcagttggctggttgtgttactggtactccttacggtgtctctgtcccctgtccagagcgctccaatcggccacgggaaaactgtggagacataccagaccagagaaggatatacttcgatttgtttgtttgttctaggttctatcctgttcatagtgtcctgcctcatgaagggcctggtcgactcagtggggaatagtttctttccgggacttagcatttgtaagacatgctccatcggctctgtaaacggttttgagatcgaaagccacaaatgttactgctcactgttctgctgtccctattgcaggcattgtagtgcagatcgggagattcaccgtttgcatctctccatctgcaagaaacgcaagacctggagcaatgttatgctggccgtgtgtaaaagaatgtgcttcagggctacggtcgaagtgtctaacaaggccttactgattcggaatataatcaacaccacatttgtcctatgtattctcatcctggcggtgtgcgttgtgtcaacttccgcagtagagatggagagccttcctgccgggacctgggaacgagaggaagacttgacaaacttctgtcaccaggagtgccaagtcactgaaaccgagtgtctgtgcccatacgaggctctcgtgctgcgcaagcccctgttttccgattctatcgttaaaggcatgaagaatcttttgaactcgacaagcctcgaaacctccctgtcaattgaggccccttggggagcaataaatgtgcagagtactttcaaaccaacgatgtctgctgccaacatcgcgttaagctggtcctcagtcgaacacagaggcaataagattctggtgagcgggaggtctgagtccatcatgaaactagaggaacggacaggaattagttggaacctcggtgtagaggacgccagcgaatctaagctgcttaccgtgtccgttatggatttgtcacagatgtatagtcccgtctttgagtacctgagcggcgaccgccaagtggaagagtggccgaaggcaacttgcaccggggattgtcctgagagatgcggatgtacatcgagtacctgcctccataaagaatggccccactctaggaattggcgttgtaacccaacttggtgctggggcgtgggtacagggtgtacgtgctgtggcctggacgtcaaggatttattcaccgactatatgtttatcaaatggaaggttgagtacataaaaactgaagctatcgtgtgcgtggagctgacaagccaggaacggcagtgtacccttattgaggccggaacacgattcaatttgggccctgtaactatcaccctctcagagcccagaaacattcagcaaaagctgccacccgaaatcgtcacgctacatcctaggatagaggaagggtttttcgatctgatgcacgtgcagaaggttctcagtgcttccaccgtgtgcaaactgcagtcttgcacacatggagtcccaggtgaccttcaggtgtaccacattggcaatttgctgaagggggacaaagttaacggacacttaatccataagattgagccgcactttaatactagctggatgtcctgggatggctgtgacctcgattattactgcaacatgggtgactggccctcatgtacctatacaggggtgactcaacataatcacgccgcattcgtaaacatgctgaacatcgaaaccgattacacgaaaaattttcacttccatagcaagcgcgtcacagcccacggcgacacccctcagcttgatctgaaagctcggccaacttatggagcgggcgagataacagtgttggtggaggtcgcagacatggaactccataccaagaagatcgagattagtgggctgaaattcgcctctctaacttgcaccggatgttacgcttgctccagcggcatctcgtgtaaggttaggattcacgtggatgaacccgacgagctgacagtacatgtgaaatcagaggatcctgacctcgtcgccgcatctagttccctgatggccagaaaacttgaatttggtacggatagcaccttcaaggctttttctgccatgccaaagactagcttgtgcttctatatcgtggagcgcgaatactgtaagtcctgctcaaaagaggacacacagaagtgtgttaacaccaaactggaacagccccaaagtatattaattgagcacaaggggacaatcatcggaaaacagaataacacttgcaccgcaaaggcgagctgctggctcgagtctgtgaagtcctttttctacggcctgaaaaatatgctttcaggtatttttggcaacgtcttcatcggggtgtttctgttctttgctccgttcattctactcatactgtttttcatgttcggatggcgaatcttgttttgtttcaagtgctgtcggcgtacgagaggcctgtttaaatataggcacttaaaggacgatgaagagacagggtaccgcaaaattatcgaacggctcaataacaagaagggcaaaaataagctgcttgacggagagagactggccgataggaaaattgcagaattgttcagtaccaagactcatatcggt

SEQ ID NO: 10447 - RNA, 3495 nt, synthetic construct
  misc_feature 1..3495: note = derived and/or modified CDS sequence (opt3) from CCHVF(CCHVF BA88166)__AF338470.1__Gn-NSm-Gc
  source 1..3495: mol_type = other RNA
agcgaggaatccggcgacgattgcatctctagaacccagctgctcaggacagagactgccgaaattcactcagacaactacgggggacccggtgataagataacgatctgtaatggcagtaccgtggtcgaccaacggcttgggagcgagctgggatgctatacaattaaccgcgttaaatccttcaagttgtgtgaaaattctgctactggcaaatcgtgcgagatcgattcaacccctgtgaagtgtcgacagggtttttgcttaaaaattacacaggaggggcgtggacatgtaaagctgagcagaggcagtgaagtggtcctagacgcatgtgattcctcttgcgagatcatgataccaaagggcaccggggacatcctcgtggattgtagcggaggtcagcaacacttcctgaaagacaaccttattgatctgggctgcccgaatatccccttgctcgggaagatggccatttacatctgtaggatgtccaaccatcctaaaactacaatgggatttctgttctggttttcattcggctatgttgtgacctgcatactgtgcaagggtattttctacctcttaatcgtcgtggggacgctgggaaagaagttcaagcagtatcgggaacttaaaccacagacttgtaccatttgcgagacaactcccgtaaatgcgatcgacgctgagatgcacgatttgaactgtagttacaatatctgcccttattgtgccagccgcctgacctctgacggcctagcaagacatgttatgcagtgcccaaagaggaaagaaaagattgaggaaacagagctctacctgaaccttgaacggataccctgggtggtccgcaaactgttgcaagtgtccgagtcaaccggcgtggccctcaagcgaagcagttggctggtcgttttactggtgctccttacggtatctctgtcccctgtgcagagcgctccaatcgggcacggaaaaactgtcgagacataccagaccagagaaggttatacttcgatttgtttgtttgtgctaggctctatcctgttcatagtttcctgcctcatgaaggggctggtggactcagtcggaaatagctttttcccgggccttagtatttgtaagacatgctccatcggttctgtgaacgggtttgagatcgaaagccacaaatgttactgctcactgttctgctgtccctattgcaggcattgtagtgcagatcgggagattcaccgtttgcatctctccatctgcaagaaacgcaagacctggagcaatgtaatgctggccgtttgtaaaagaatgtgcttcagggctacggtggaagtctctaacaaggccttactgattcggaatataatcaacaccacatttgtgctatgtattctcatcctggcggtctgcgtggtttcaaccagtgcagtggagatggagagccttcctgccggcacttgggaacgagaggaagacttgacaaacttctgtcaccaggagtgccaagtaactgaaaccgagtgtctgtgcccatacgaggctctcgtcctgcgcaagcccctttatctggattccatcgtgaaaggaatgaagaatttgctcaactctacatcgctggaaaccagcttatccattgaggccccttggggcgcaataaatgttcagtcaacttttaaaccaacgatgagtgctgccaacatcgcgctgtcttggagctccgtggaacacagagggaataagattctagtctcaggaaggagcgagtctatcatgaaactcgaggaacggacaggtatttcctggaacctgggcgtggaggacgccagtgaaagcaaacttttgaccgtatctgtgatggatctgtcccagatgtactcacccgttttcgagtatctcagtggggaccgccaagtcgaagagtggccgaaggcaacttgcaccggagattgtcctgagagatgcggctgtacaagctcgacctgcctgcataaagaatggccccactccaggaattggcgttgtaacccaacttggtgctggggtgtggggacaggctgtacgtgctgtggattagacgtgaaggatctgtttaccgactacatgttcatcaaatggaaggtcgagtacataaaaactgaagctatcgtttgcgtggagcttacatctcaggaacggcagtgtaccttgattgaggccggcacacgatttaatctcgggcctgtgatcattactctgagcgagcccagaaacatccagcaaaagctaccacccgaaatagtaaccctgcatcctaggattgaggaaggattctttgatctcatgcacgtccagaaggtgctgtcagctagtacggtttgcaaacttcagtcctgcacccatggtgtgccaggcgacttgcaggtctatcacatcgggaatctgttaaagggagacaaagtgaacggccacctcattcataagatcgagccgcacttcaatacatcttggatgagctgggatggttgtgacctggattactattgcaacatgggggactggccctcctgtacttacaccggcgttacacaacataatcacgccgcatttgtgaacatgcttaacatagaaactgattataccaaaaatttccactttcattcaaagcgcgtaacggcccacggagacacacctcagctggatttgaaagctcggccaacctacggcgcgggggagatcactgtcctcgtggaggtggcagacatggaactgcatacaaagaagattgagatcagcggactaaaattcgccagtctgacctgcactggctgttatgcttgttcttccggtattagctgcaaggtcagaatccacgttgatgaacccgacgagctcaccgtgcatgtaaaatcggaggatcctgacatagtggccgcatcatctagtctgatggccaggaaacttgaatttgggacagattccacgtttaaggctttcagcgccatgccaaagacctctttgtgcttttacattgtcgagcgcgaatactgtaagagctgctccaaagaggacactcagaagtgtgtgaacacaaaactggaacagccccaatcaatcttaatcgagcacaagggaaccattatcggcaaacagaataacacatgcactgcaaaggcgagttgctggctcgagagcgttaagtctttcttttatggtctgaaaaatatgctttccggcattttcgggaacgtgtttataggagtcttcctgtttttcgctccgtttatcctactcattctgttctttatgttcggctggcgaatcttgttctgttttaagtgctgtcggcgtaccagagggctgttcaaatacaggcacttaaaggacgatgaagagacgggatatcgcaaaattatcgaacggctcaataacaagaagggcaaaaataagctgcttgacggtgagagactggccgataggaaaatagcagaattgttttcaacaaagacccatatcggg

SEQ ID NO: 10448 - RNA, 3495 nt, synthetic construct
  misc_feature 1..3495: note = derived and/or modified CDS sequence (opt3) from CCHVF(CCHVF BA66019)__AF350448.1__Gn-NSm-Gc
  source 1..3495: mol_type = other RNA
agcgaggaatccggcgacgattgcatctctagaacccagctgctcaggacagagactgccgaagtgcacggggacaactacggaggtcccggcgataagattacgatatgtaatgggtcaaccatcgtcgaccaacggcttggaagtgagctgggctgctatacaattaaccgcgttaagagcttcaagttgtgtgaaaattccggtactgggaaatcttgcaagatcgataaacatcctgtgaagtgtcgacagggattttgcttaaagattacccaggagggccgtggccacgtaaaactgtcgagagggtcagaggtggtcctagacgcttgtgatagcagttgcgaaatcatgataccaaagggaacaggtgacatcctcgtggattgttccggcgggcagcaacatttcctgaaagacaaccttgttgatctgggatgcccgaatattcccttgctcggcaagatggcaatctacatttgtaggatgtctaaccaccctaaaaccactatggcctttctgttctggtttagcttcggttatgtgatcacatgcatattttgcaagattatcttctacctgctcattgtcgtggggaccttaggaaagaaatttaagcagtatcgggagctgaaaccacagacgtgtactatctgcgaaaccacacccactaatgcgatcgacgctgagatgcatgatcttaagtgttcctacaacatttgcccttattgtgcctcacgcttgaccagtgacggcctggcaagacacgtaacacagtgcccaaaaaggaaggagaaagttgaagagaccgaactatacctcaatctggagcggataccctggatcgtgcgcaaacttctgcaagtcagcgaatctacgggcgtggccttgaagcgatcctcatggctcattgtgctgttagtcctgctcactgttagccttagtcctgtgcagtctgctccaatcgggcacggaaaaacaatagaggcataccagaccagagagggttatacttccgtatgtctgttcatgttgggcgggattctatttgtggtcagctgcctgatgaagggactcgtggactcggtttctaactccttctttccgggcctgtcaatctgtaaaacatgcagtatcggtagcgtgaatgggttcgaaattgagtcccataagtgttactgctctcttctgtgctgtttgtattgcaggcactgtagcgccgatcgggaaatccatcagctccacctgtcaatttgcaaaaagcgtcgcgctggcggaaacgtcatgttagccgtgtgtaagagaatgtgcctgagggcgaccatggaggtaagtaataaagttctattcatacggtccatcattaacacgacctttgtgatctgtatcctcgtcctggcagtgtgcattgtcagcacatctgccgtggaaatggagtcacttcccgctggcacttgggagcgagaagaggacttgaccaatttctgtcaccaagaatgccaggttacagagactgaatgtctgtgcccttacgaggccctcgtgctgcgcaagccactttttagtgatagcatagtaaaagggatgaagaacctgttgaactccacctctctcgagacatcgctgagcatcgaagcaccctggggagctattaatgtccagtccaccttcaaacctactgtgtcaacggccaacatcgcgttaagttggtctagcgttgagcatagaggtaataagattctggtgtccggcaggtcagaaagcatcatgaagctagaggagcggacagggatatcttgggacctcggagtcgaagatgcctccgagagtaaactgcttaccgtgagcgtaatggacttgtctcaaatgtattccccagtgtttgaatacctgtcaggcgatcgccaggttgaggaatggcccaaggcaacttgcaccggtgactgtccggatagatgcgggtgtacaagttctacctgcctccacaaagagtggcctcattcgaggaactggcgttgtaatcccacttggtgctggggcgtcggaacaggctgtacgtgctgtgggctggacgtgaaggatttattcaccgactatatgtttgtgaaatggaaggtcgagtacatcaagactgaagctattgtttgcgtggagctgaactcccaggaacggcagtgttctcttatcgaggccggaacacgattcaatttgggtccagtgaccattacactcagcgaacctagaaacatccaacagaaactgcccccagagataattactctacaccccaggatcgaggaaggctttttcgacctgatgcatgtacagaaggtcctctcagctagtaccgtgtgcaaactgcagtcctgcacgcacggggttcctggagatcttcaaatttaccacatcggcaatttgctgaagggtgaccgcgtgaacgggcatttaatacacaaaatcgagccacattttaatacctcttggatgagctgggatggctgtgacctcgattattactgcaacatgggagactggccgtcctgtacatatactggcgtcacccagcacaatcacgccgcattcgtgaacctgcttaatattgaaacagattacactaagaactttcatttccactcaaaacgggttaccgcccatggggacacgccccagctggatttgaaggctagacctacatatggagcgggcgagatcaccgtgctcgtagaagtcgcagacatggagctgcacactaagaaaattgccatcagcggtctaaagttcgctagtctgacatgcaccgggtgttacgcctgttcttccggaataagctgcaaagtgaggattcatgtggatgagccagacgaactcactgtccacgttaagtcggaggatcccgacatcgtggcagcctcatctagtctgatggctcgcaaacttgaatttggcaccgactccacattcaaggcctttagcgcaatgcctaagacgtctttgtgcttctatatcgtagagcgagagtactgtgaaagctgctccaaagaggatacccagaagtgtgtgaacactaaactggaacaaccacagtcaattttaatcgagcacaagggtacaattataggcaaacagaatgatacctgcacagcgaaggctagttgctggctcgaaagcgtcaagagctttttctacgggctgaaaaacatgctttccggaatctttggcaatgtgttcattgggatctttctgttcctagccccctttattctcctgatcttgttctttatgttcggatggcggatactgttctgttttaagtgctgtcgtagaactaggggcttattcaaatatcgctacctcaaggacgacgaggagtcaggttatcggagaatcattgaaaggctgaacaataaaaaggggaagaacaaacttctggatggagagcgattggcagaccgccggatcgccgaactctttagtaccaagacgcatattggc

SEQ ID NO: 10449 - RNA, 3495 nt, synthetic construct
  misc_feature 1..3495: note = derived and/or modified CDS sequence (opt3) from CCHVF(CCHVF BA8402)__AF350449.1__Gn-NSm-Gc
  source 1..3495: mol_type = other RNA
agcgaggaatccggcgacgattgcatctctagaacccagctgctcaggacagagactgccgaaattcacaacgacaattacgggggacccggtgataagataacgatctgtaacggctcaaccgtggtcgaccaacggcttgggagtgagctgggatgctatacaattaatcgcgttaacagcttcaatttgtgtgaaaacactgctaccggcaaatcctgcgagatcgattctacacctgtgaagtgtcgacagggtttttgcttaaaaattacccaggaggggcgtggacatgtaaagctgtcgagaggctcagaagtggtcctagacgcatgtgagagcagttgcgaaatcatgataccaaaaggcactggggatatcctcgtggactgttccggaggtcagcaacacttcctgaaggataatcttattgacctgggctgcccgaacatccccttgctcgggaagatggccatttacatctgtaggatgtctaatcatcctaaaacaaccatggcgtttctgttctggtttagcttcggatatgttgtgacgtgcatactgtgcaaggtcatcttttacctcttaattgtggtaggcactctgggtaaaaagttcaaacagtatcgggagcttaagccacagacctgtacaatttgcgagactacccccgttaacgctatcgatgccgaaatgcacgacttgaattgttcctacaacatctgcccttattgtgcatcacgcccaacaagtgatgggctggccagacatgtgatgcagtgccccaagaggaaagagaagattgaagagaccgctctatacctcaatctggaacggataccttgggtcgtgcgcaaacttctgcaagtgagcgagtctacgggagtcgcattgaagcgatcctcatggctcgttgtgctgttagtactgctcactgtgagccttagtccagtccagtctgccccgatcggccacggcaaaacagtggagacctaccagactagagaagggtatacatccatttgtctgtttgttttgggaagcatcctattcatagtgtcgtgcctgatgaagggtctcgtcgactctgtgggcaactcctttttccccgggctgtcaatttgtaaaacctgcagtatcggaagcgtaaatggctttgagatcgaatcccacaagtgttactgctctcttttctgctgtccttattgcaggcattgtagcgctgaccgggagattcaccgtctgcatttgtcaatctgcaagaaacgcaagacgggtagtaacgttatgctcgccgtgtgtaaaagaatgtgcttcagggcgaccgtcgaagtgtccaacaaggcactgttaattcggaatataatcaacacaacttttgtcctgtgtattctaatcctcgccgtgtgcgttgtgagcacctctgctgtagagatggagtcactgccagccgggacatgggaacgagaggaagatcttactaatttctgtcaccaggagtgccaagtcaccgaaacagagtgtttgtgcccctacgaggcactggtgctccgcaaacctctgtttagtgacagcatcgttaagggcatgaagaaccttctcaattccacctctttggaaacttcgctcagcattgaggctccatggggagccataaacgtgcagtccacgttcaaacccacagtctcagcggccaatatcgcactgagttggtctagcgtggaacacagaggcaacaagattttagtatccgggaggtcagagagcatcatgaaactggaggaacggaccggaatttcttgggatctaggtgtggaggacgcttccgaaagtaagctcctgactgttagcgtcatggatctttctcagatgtattccccggtgtttgagtacttgtcaggcgaccgccaagtggaagagtggcctaaagctacctgcacaggggattgtcccgagagatgcggatgtaccagtagcacttgcctgcataaggaatggccacactcgaggaattggcgttgtaaccctacatggtgctggggcgtcggtacggggtgtacctgctgtggcctcgacgttaaggatctgttcactgactatatgtttatcaaatggaaggtggagtacataaaaacagaagccatcgtgtgcgtagagttaacctcccaggaacggcagtgtacactgattgaggccggaactcgattcaatcttggccccgtcaccatcacgttgtctgagccaagaaacattcagcaaaagctgccccctgaaatcgtgaccctgcatccaaggatagaggaagggtttttcgatctaatgcacgttcagaaagtgctgagcgcatcaacagtctgcaagctccagagttgcactcatggagtgccgggtgacctgcaggtttaccacattggcaatcttttgaagggggacaaagtgaacggacacctgatccataagattgagccccactttaatacctcctggatgtcttgggatggctgtgacttacattattactgcaacatgggtgattggcctagctgtacatatactggggtaacccaacacaaccacgccgctttcgtcaatatgctcaacatcgaaacggactacacaaagaattttcatttccactccaagcgcgtgaccgcgcatggcgatactccacagctggaccttaaagcacggcccacatatggagccggcgagataaccgtgctggtcgaggttgctgatatggaattgcacactaagaaaatcgagatttcagggctcaagttcgccagcctgacctgcacaggatgttacgcatgcagttctggcatctcctgtaaggtgagaatccatgtagacgaacctgatgagctaacggtgcacgtcaaaagcgaggacccagatattgtggccgcttcgtcatctctgatggccaggaagctcgaatttggtaccgacagtactttcaaagcattttccgcgatgcccaagacaagcctgtgcttctatatagttgagcgcgaatactgtgagtcttgcagcaaagaagatacccagaagtgtgtgaacacaaaacttgagcagccgcaatccattttgatcgagcacaaagggactatcattggaaagcagtcaaatacctgcacggctaaagccagttgctggctggaaagcgtcaagtcctttttctacggcctcaaaaacatgttatctggtatctttggcaatgtgttcattggggtttttctgttctttgcacctttcatacttctgatcctatttttcatgttcggatggcggattctcttttgtttcaagtgctgtcgacgtacaagaggcctgtttaagtataggcatttgaaagacgacgaggaaaccgggtaccgcaagatcattgagcggctgaacaataaaaagggcaaaaacaagttactcgatggagaaagactggccgacaggaagatcgctgagcttttctcaactaaaacccacataggt

SEQ ID NO: 10450 - RNA, 3495 nt, synthetic construct
  misc_feature 1..3495: note = derived and/or modified CDS sequence (opt3) from CCHVF(CCHVF Matin)__AF467769.2__Gn-NSm-Gc
  source 1..3495: mol_type = other RNA
agcgaggaatccggcgacgattgcatctctagaacccagctgctcaggacagagactgccgaaattcactcagacagttacgggggacccggtgataagataacgatctgtaacggcagcaccgtggtcgaccaacggcttgggtccgagctgggatgctatacaattaatcgcgttaaatctttcaagttgtgtgaaaactcggctactggcaaatcatgcgagatcgatagcacccctgtgaagtgtcgacagggtttttgcttaaaaattacacaggaggggcgtggacatgtaaagctgagtagaggctccgaagtggtcctagacgcatgtgattctagctgcgagatcatgataccaaagggcaccggggacatcctcgtggattgttccggaggtcagcaacacttcctgaaagacaatcttattgatctgggctgcccgaacatccccttgctcgggaagatggccatttacatctgtaggatgtcaaatcatcctaaaactacaatggtttttctgttctggtttagtttcggatatgtgataacctgcattctgtgcaaggtcatcttttacctcttaattgtggtaggcacgctgggtaaaaagttcaagcagtatcgggaacttaaaccacagacttgtaccatctgcgagacaactcccgttaacgcgatcgacgctgagatgcacgatttgaattgtagctacaacatttgcccttattgtgcctctcgcctgacctccgacgggctagcaagacatgtgatgcagtgcccaaagaggaaagaaaagatagaggaaacagagctctacctgaatcttgaacggatcccctgggtcgtgcgcaaactgttgcaagtgtcagagagcaccggagtcgccctcaagcgaagttcttggctggttgtgttactggtactccttacggtgtccctgagccctgtccagtcggctccaattggccacggcaaaactgtggagacataccagatcagagaagggtatacctctgtttgtttgtttgtgctaggatccatactgttcattgtctcatgcctcatgaagggtctggtggacagtgatggcaacagctttttcccggggctttccatctgtaagacttgctctatcggaagcattaatggctttgagatcgaatcacacaaatgttactgcagtctgttctgctgtccctattgcaggcattgttccacagaccgggagattcacaagttgcatctcagcatatgcaaaaagcgtaaaaccggttctaacgtaatgctggcagtttgtaagcgcatgtgcttcagagccacggtggaagtctcaaataaggctttactgatcaggagtattatcaacaccacatttgtggtctgtatcctaattctcgccgtgtgcgttgtgagcacttccgcggtagagatggagtctctgcctgcagggacctgggaacgggaggaagatcttataaatttctgtcaccaggagtgccaagtcacagaaactgagtgtttgtgcccatacgaggccctggtgctccgaaaacccctgtttcttgactcgatcattaagggcatgaaaaacctgttgaacagcacctccctcgaaacatcactgagtatcgaggctccttggggagccattaatgttcagtctaccttcaagccaactatgagcgcagctaacatcgccttatcctggtcaagcgtggaacaccgcggcaataaaatactggtctctgggagatccgagagtatcatgaagctagaggaaaggacgggaattagctgggatctcggtgtggaggacgcgtctgaatccaagctgcttacagtatcagtgatggatttgagtcagatgtatagccccgtttttgagtacctgtcgggcgaccggcaagtcgaagagtggccgaaagcaacctgcactggggattgtcctgagcgctgcggatgtacctcctctacatgcctccataaggaatggccccacagcagaaactggaggtgtaatccaacctggtgctggggcgtgggtactgggtgtacatgctgtggcctggacgtgaaagatttattcacggactatatgtttgtcaagtggaaagttgagtacatcaagaccgaagtgattgtgtgcgtagagctgacttcacaggaacgtcagtgtagtcttatcgaggccggaacacggttcaacttgggccctgtcaccataacactctccgagccccgaaatattcagcaaaagctgccacccgaaatcgtgactctacatcctagaattgaggaagggtttttcgacctgatgcacgttcagaaagtgctctctgctagcaccgtctgcaagctgcagtcctgcacgcatggagtgccaggtgatcttcaggtttaccacatcggcaacttgctgaaaggggacaaggtgaatggacacttaatacataaaatcgagccgcactttaacacctcatggatgagctgggatggctgtgacctcgattattactgcaatatgggtgactggcccagttgttcttatacaggggtaactcaacataaccacgccgctttcgtcaatatgctgtccattgaaaccgattacacaaagaactttcacttccatagcaaaagggtgactgcccacggcgacacccctcagcttgatctgaaggcacgcccaacgtatggagccggcgagatcacagtgttggtcgaggttgctgacatggaactccataccaagaaaattgagatctcggggctgaagttcgcgtcactaacttgcacaggatgttacgcatgctctagtggcatatcctgtaaagtgcggattcacgtagatgaacccgacgagctgaccgtgcatgtcaagagcgaggatcctgacatcgtggccgcttctagctccctcatggccagaaaactggaatttggtactgactcaaccttcaaggcatttagtgccatgccaaagacaagcctttgcttctatatcgttgagagggaatactgtaaatcttgctccaaggaggatacgcagaaatgtgtgaataccaagttggaacagccccaatcaattctgatcgagcacaaagggactattataggaaagcagaacgacacatgcaccgctaaggccagttgctggttagagagcgtcaaatcctttttctacggcctcaagaacatgctgtctggtatctttggcaatgtgttcattgggatctttcttttcctggcaccgtttgcgctactcattctgttctttatgttcggatggcgcatcttgttctgttttaaatgctgtcgacggacacgtggcctgttcaagtatagacacttaaaagatgacgaagagactgggtacaggaagataatcgaacgcctcaacaataagaaaggaaagaacaaactgcttgatggcgagcggctggctgacagaaagattgccgaattgttttcgaccaaaacgcatgttggt

SEQ ID NO: 10451 - RNA, 3495 nt, synthetic construct
  misc_feature 1..3495: note = derived and/or modified CDS sequence (opt3) from CCHVF(CCHVF Baghdad 12)__AJ538197.2__Gn-NSm-Gc
  source 1..3495: mol_type = other RNA
agcgaggaatccggcgacgattgcatctctagaaccaggctgctccggacagagactgccgaaattcacggggactcatacggaggtcccggcgataagataacgatctgtaacgggagtaccattgtggaccagcgccttggaagcgagatgggctgctatacaatcaatcgagtcaaatccttcaagctgtgtgaaaactctgctactggtaaatcgtgcaagattgattcaatccctgttaaatgtcgtcaagggtactgcttgaagataacccaggagggaagaggccatgtgaagttaagcaggggcagtgaggtagtgctggacgcatgtgattcctcttgcgaagtcatgatcccaaaagggacaggagacattctagtggattgtagcggtggccagcagcactttctcaaggacaatctgatcgatcttgggtgcccgaacattcccctgttgggaaaaatggccatctatatatgtcggatgtccaatcatcctaagaccactatggcgttcctcttttggttctcatttggctacgttattacatgcatcctgtgcaaagctattttctatctgctcatcatcgtgggtaccttagggaagcgctttaagcaatacagagagctgaaaccacagacgtgtactatttgcgaaaccacacccgtcaacgccatagacgcagagatgcacgatcttaattgtagttataacatctgcccttactgtgccagcaggttgacttctgacggactggctcggcatgtgacccagtgcccaaagcgcaaagagaaggtagaagagacagaactatacctcaatctggagcgaatcccctgggttgtgagaaaacttctgcaggtctccgaatcaaccggcgtggcattgaagaggagcagttggctcattgtgctgttagtcctgctcgccgtttcttccagccctgtgcaatcggctccaataggctatgggaaaacgattgagacttaccaggcccgggagggatatacatctatctgtcttttcgtactgggttccatcttgtttattgtgtcatgcctaaccaagggcctggtcgacagtatcgggaacattttctttccgggactcagcatatgtaagacttgctccatcggctctattaatggtttcgaagtggagagccacaaatgttactgctcactgctttgctgtccctattgccgtcactgtagtgcggatcgcgaaatccatcagctgcacttgtccatctgcaagaaaagaaagacagggagctctgttatgctcgcagtgtgtaaaaggatgtgctttcgggccaccatggaggtctcaaacaaggctctgttaattcgaagtataatcaatacgaccttcgtggtatgtattctgacactagccgtttgcgtggtcagcacttccgcagtggaaatggagtctctccctgctggcacctgggagcgcgaagaggacctgacaaacttctgtcatcaggaatgccaagtcactgagaccgaatgtctttgcccatacgaggccttggtgctgagaaagcccctctttctggattcgatcgttaaaggaacaaagaatcttctgaacagcacctccttggagacttcactcagtattgaagcgccttggggcgccatcaacgtgcagtctacgtataaaccaacagtaagcaccgcaaatatagctctgtcctggtcaagcgtcgagcacagggggaacaagatcttagtgtctggacggtccgaaagtattatgaaactggaggagcgcactggtatcagctgggacctaggcgttgaagatgcctctgagtccaagctcctgaccgtgtcagtcatggaccttagtcagatgtacagccccgtgttcgaatacttgtcgggggatagacaagtagaggaatggccgaaggctacatgcaccggagactgtcctgagaggtgcggctgtactacatccacgtgcctgcacaaagagtggccccattctcgtaattggcggtgtaacccaacctggtgctggggtgtggggactggctgtacatgctgtggactcgatgttaaggacctgtttaccgattatatgttcgtcaaatggaaggtggaatacattaaaacagacgccatcgtgtgcgtcgagttaactagccaggaacgacagtgttcactgatagaggcaggcaccagatttaatcttgggagtgttacgattaccttgtccgaacctaggaacatccagcaaaagctgcccccagagattatcacactgcacccccgcatagaggaaggattctttgacctaatgcatgtgcagaaggtgctgtctgccagcactgtatgcaaactccagtcctgcacccacggtgtccctggcgatctccaggtgtatcatatcgggaatcttttgaagggagacaaagttaacggccacctgattcacaagatcgagccacatttcaatacatcatggatgagctgggatggttgtgacttagattactattgcaacatgggggactggccgagttgtacttacaccggcgtgacgcaacacaatcatgcttcttttgtcaacctcctgaatattgaaacagattataccaaatccttccactttcacagcaagcgggtgactgcgcatggagacacaccccagcttgatctgaaagttagacctacctacggcgcaggggagatcactgtgttggtagaagtcgccgacatggagctccacaccaagaagatagagatttcgggactgaaattcgcttcactaacatgcacgggctgttacgcctgctctagtggtatctcctgtaaggtgaggatccatgtggatgaaccagacgagctgaccgtccacgttaaaagcgatgaccccgacgtggtagcagcctctagctccctcatggctcgcaagctggaatttgggactgattcaacattcaaagccttcagtgcaatgcctaagaccagcctttgcttttatattgtggagcgagagtactgtaagtcttgctccaaagaagacacacagaagtgtgtcaacactaaattggagcagccacaatcaatcctgattgaacataagggaaccataatcggcaaacagaataacacgtgcacagcgaagaccagttgctggttagagagcgtgaagtccttcttttatggtctcaaaaacatgctgtctggcattttcgggaactttttcatgggaatctttcttttcctggctccctttattctactcatcctgttctttatgttcggctggcggatattgttttgtttcaagtgctgtcgtagaactagggggctgttcaaataccgccacttaaaggatgacgaagagaccggatatcggagaatcattgagaggctcaataataaaaagggcaagaacaaactgcttgatggtgaacgactggccgaccgccggatcgcagagttgttttcgacaaagactcacattggg

SEQ ID NO: 10452 - RNA, 3495 nt, synthetic construct
  misc_feature 1..3495: note = derived and/or modified CDS sequence (opt3) from CCHVF(CCHVF VLG/TI29414)__AY179961.1__Gn-NSm-Gc
  source 1..3495: mol_type = other RNA
agcgaggaacccggcgacgattgcatctccagaacccagctgctcagggccgagcctgctgaaattcacgacgataactacgggggaccaggtgacaagataacaatctgtaatggctctactattgtggatcaacggcttgggtcagagctgggatgctatacgatcaaccgcgtcaaaagtttcaagttgtgtgaaaatagcgcaaccggcaaaacatgcgagattgactccactccggttaagtgtcgacagggtttttgcttaaaaatcacccaggaggggcgtggacatgtgaagctgtctagaggctcggaagtagtgctagatgcctgtgactcaagctgcgaggtcatgatacccaagggcacaggggatatcctcgtggactgtagtggaggtcagcaacacttcctgaaagataaccttattgacctgggctgccctcatatcccattgctcgggaagatggcgatttacatctgtaggatgtccaatcacccccggaccactatggcttttctgttctggttttctttcggatatgttataacatgcattttctgcaaagccctgttctacagcctcatcattatcggcaccttaggtaagaaaatcaagcagtatcgcgaactgaagcctcagacgtgtactatttgcgagaccgcaccagtgaacgccatagatgctgagatgcatgaccttaattgttcctacaacatctgcccctattgtgcatcaagattgacaagtgacgggctggccaggcacgtccctcagtgcccaaaacggaaggaaaaagtggaggaaactgagctatacctcaatctggaacgcattccgtggaacgtacgaaaacttctgcaagttagcgagtctaccggagtggctttgaagagatcctcatggctcatcgtcctgttagtgctgctcacagtgagccttagtcccgtccagtctgcccctgttggccacggcaagaccatagagacgtaccagactagggaagggtttacatccatttgtctgttcatgttgggaagcatcctatttctggtgtcgtgcctcgtaaaaggtctggtggattctgtctccgactcattctttccaggccttagtgtgtgtaagacctgcagcatcgggtccattaatggattcgagatcgaatctcataagtgttattgcagcctgttctgctgtccctactgccggcactgttcagcggatcgtgagattcatcagttgcacctcagtatatgcaaaaagcgcaaaatgggctccaacgttatgctggcagtgtgtaagagaatgtgctttagggccactatcgaagctagccggcgagccttactgattcgctctatcatcaatacaaccttcgtcatttgtatactaacgctcaccatctgcgtggtatcaacaagtgcagttgagatggagaacctgcctagcggtacttgggaaagagaggaagaccttaccaatttttgtcaccaagagtgccaggtgacagaaactgagtgtttgtgcccatatgaggctctggtcctcaggaaacccctgttccttgattccattgtgaaggggatgaagaacctgttgaactctaccaatctcgaaacatcgctgagcatcgaggccccgtggggcgcgattaacgtccagtccacctttaaacctactgtgtcaacggccaatatcgcattaagttggtctagcgttgaacatcggggaaacaagatactggtgacaggccgctccgagtcaatcatgaaactagaggaaagaaccggggtaagctgggacctcggagtcgaggatgcttctgaatccaagctgcttactgtgagtattatggacttgagccaaatgtactctcccgttttcgagtatctgtccggtgatcgtcaggtggaagagtggccaaaagctacctgcacaggcgactgtcctgagaggtgcgggtgtacctcaagtacttgcctccacaaggaatggccccatagccggaattggcgatgtaacccaacatggtgctgggaggtcggaacgggctgtacctgctgtggttggaatgtgaaggatctgtttactgaccacatgttcgtaaaatggaaggtggaatacatcaaaacagaggccattgtttgcgtcgaattaacctcgcaggagagacagtgttccctgatcgaggccgggacaaggtttaaccttggccccgtgactataaccttgtctgaacctcgcaatattcaacagaagctcccaccggagatcattacgctgcatcccaaagtggaagagggattctttgacctaatgcacgtccagaaggttctgagcgcatcaaccgtgtgcaagctccagagttgcacacacggcatccctggggatctgcaagtgtatcatataggaaaccttttgaaaggtgaccgggtaaatggccacctgatccataagattgaaccacacttcaacacttcctggatgtcttgggatgggtgtgacttagattactactgcaatatgggagactggcccagctgtacctatacaggcatgactcagcacaaccatgccgcttttgtcaatctcctgaacatcgagaccgattacacgaaaacattccacttccattccaagagagtgaccgcgcacggtgacactcctcagcttgatctgaaagcaaggccaacatatggggccggcgagattaccgttttggtggaagtcgctgacatggagctccatactaagaaagtggaaatctcaggactgaagtttgccagcctagcatgcaccggctgttacgcctgcagttctgggatatcctgtaaggttcgcattcacgtggatgagcccgacgagctgacagtacacgtcaaaagcaacgatccggacgtgatcgctgcctcgacgtcactcatggcacgaaagctggaatttggaaccgactctacttttaaagcgttcagtgctatgcctaagacatccctttgcttttatatcgccgagcgggaatactgtaaaagctgctctgaggaagatacccagaagtgtgtggacacaaagttggagcaaccacagagcattctgatcgagcataaaggcactattataggtaagcagaatgatacctgcacggcaaaagcctcctgctggttagaatcagtcaagagtttcttttatgggctcaaaaacatgctgggaagcgttttcggcaactttttcatcggtattcttctgtttctagctcccttcgtgctcctggtattgtttttcatgttcggctggaagatcctgttttgtttcaagtgctgtcgtagaacaagggggttactcaaataccgcctgcttaaggacgatgaggaaaccggataccggagaattatcgagaggctgaataataaaaagggcaaaaaccgattgctcgacggggaacgcctggccgatcggaagatagcagagctattttctactaagacccacatcgga

SEQ ID NO: 10453 - RNA, 3495 nt, synthetic construct
  misc_feature 1..3495: note = derived and/or modified CDS sequence (opt3) from CCHVF(CCHVF TADJ/HU8966)__AY179962.1__Gn-NSm-Gc
  source 1..3495: mol_type = other RNA
agcgaggaatccggcgacgattgcatctctagaacccagctgctcaggacagagactgccgaaattcacggggacgattacggaggtcccggcgacaagataacgatctgtaacgggtcaaccattgtggatcaacggcttggaagtgagctgggctgctatacaatcaatcgcgtcaagagcttcaagttgtgtgaaaactccgctactggtaaaaattgcgagattgactctgttcctgtgaagtgtcgacaggggtactgcttaaaaatcacccaggagggacgtggccatgtaaagctgtcgagaggctcagaagtggtcctagatgcatgtgacagcagttgcgaggtgatgataccaaaggggacaggagatatctccgttgactgttctggtggccagcaacactttctcaaagataacctgattgaccttgggtgcccgaagatccccctgttgggaaaaatggccatttatatctgtaggatgagcaatcatcctaagaccactatggcgttcctcttttggttctcctttggctacgtgataacacggattctgtgcaaagctatcttctatctgctcattatcgtcggtaccttagggaagcgctttaagcagtacagagaactgaaaccacagacgtgcactatctgtgagaccacacccgccaacgcaattgatgccgagatgcacgaccttaattgctcatataacatatgtccttactgcgctagtaggttgactagcgacggactggcacggcatgtgacccagtgtccaaagcgcaaagaacgagtagaggaaacagagctatacctcaatctggaaagaatcccctggattgttaggaaacttctgcaagtgtctgagtccaccggcgtcgccttgaaacggtcaagctggctcatcgtgctgttagtgctgttcacggtcagtctctctcctgttcagtccgctccaataggctatgggaacactattgagacataccaggcccgtgaagagtataccagcatctgcctttttgtgctgggatcgatcttgttcattgtatcttgtctaatgaagggtctggtggattccatcggcaatattttcttcccggggctcactatatgcaaaacatgttcaatcggaagtattaacggctttgaaatcgagagccacaagtgctactgttccctgctttgctgcccctattgtcgccactgctctgcggacagagaaatccatcagctgcacttgagcatttgtaagaaaaggaagaccggttcaaatgtcatgctcgcagtgtgcaaacggatgtgtttccgagccacgatggaggttagtaacaaggctctgttaatacgctccatcattaataccacattcgtggtctgcatcctgattctagccgtgtgtatcgtaagcacttctgcagttgagatggaatcactccctgctgggacctgggagagagaagaggatctgacaaacttttgccatcaagaatgtcaggtgactgagaccgagtgcctttgtccatacgaagccttggtcctgaggcggcccctcttcctggacagtatagtgaaaggcatgaagaaccctcttaatagcacatccctggagacctctttgtcgatcgaagcgccatggggagccattaacgtccagagcacttataagcccacggtgtccacagcaaatatcgctctctcatggagttctattgagcaccgcggcaacaatatcctggttagcgggagatccgagtcaataatgaaattagaagagaggaccggaattagcggtgatctgggcgtggaagacgcctctgagtccaagctactcactgtaagtgtcatggatctgagccaaatgtactctccggtgtttgaatacctttccggggaccgtcaggttgaggagtggcctaaagctacctgcacaggagattgccccgaacggtgtggctgcacctcaagtacttgtttgcacaaggagtggccacatagccgaaactggagatgcaatcctacatggtgttggggtgtggggacgggctgcacctgttgcggactggacgtcaaagatctcttcatcgactatatgtttgtgaagtggaaggtagactacattaaaactgaagccatcgtgtgtgttgagctgacatcgcaggaaaggcagtgctccttagtcgaggcaggcacccgcttcaacctggggcccgtgacaataactctttctgagccacggaatatccaacagaagttgccccctgaaattatcaccctccacccaagaattgaggaaggatttttcgatctgatgcatgtgcagaaagtcctaagcgcctcaacggtttgtaagctgcagagttgcacccacggtgtgccgggcgacctccaagtgtatcatatcgggaacctgcttaaaggagataaggagaatggccacttgatacacaagattgaaccccattttaacacatcctggatgtcttgggacggttgcgatctggactactattgtaatatgggggattggcctagctgcacttacaccggcgtaacacagcacaaccatgcttccttcgtcaatttactcaacatcgagactgactataccaaatcatttcacttccacagcaagagggtgacggcgcatggagatacaccacagctggaccttaaagcacgccccacctacggcgccggggagatcactgttctggtggaagtcgctgatatggagttgcacacaaagaaaattgaaatcaccggactcaagtttgccagtctgacttgtaccggctgctacgcatgttcttccggtattagctgcaaagtgcgaatacatgttgacgagcctgatgagctaacagtgcacgtaaagtcggacgacccagatgtcgtggccgcttcatctagtctgatggcccggaagctcgaatttgggacggactccaccttcaaagcatttagcgcgatgcccaagacttctctgtgtttctatatcgtggagcgtgaatacagaaaaagctgctccaaggaggatacacagaaatgtgtcaacaccaaacttgaacaaccgcagtcaattttgatcgagcataagggaacaattatcggcaagcagaataacacttgcaccgctaaggccagttgttggctggagagcgttaaatcctttttctatggtttaaagaatatgctctctggcatatttgggaacgtgttcgtaggaatctttctgttccttgcaccttttattctgctaatcctcttctttatgttcggctggaggattctgtcatgctttaaatgctgtcgccggacgagagggttgctgaagcacaggcacttaaaggacgatgaagagacaggataccgacgcatcatagaacggctcaataacaaaaagggcaaaaataagctgcttgacggtgagagactggccgataggcgtattgctgaattgttcagtaccaaaactcatatcggg

SEQ ID NO: 10454 - RNA, 3495 nt, synthetic construct
  misc_feature 1..3495: note = derived and/or modified CDS sequence (opt3) from CCHVF(CCHVF Hodzha)__AY223476.1__Gn-NSm-Gc
  source 1..3495: mol_type = other RNA
agcgaggaatccggcgacgattgcatctctagaacccagctgctcaggacagagactgccgaaattcacggggacgattacggaggtcccggcgacaagataacgatctgtaacgggtcaaccattgtggatcaacggcttggaagtgagctgggctgctatacaatcaatcgcgtcaaatctttcaagttgtgtaaaaactccgctactggtaagtcttgcgaaattgactcgacccctgttaaatgtcgacaggggtactgcttaaagatcacacaggagggacgtggccatgtgaagctgtcaagaggcagcgaggtagtgctagatgcatgtgacagttcctgcgaagtcatgataccaaaagggaccggagatatcctcgtggactgttctggtggccagcaacactttctgaaggataatcttattgacctggggtgcccgaggatccccttgctcggaaaaatggccatttatatctgtcggatgagcaaccatcctaagactacaatggcgttcctgttttggttctcctttggctacgttataacctgcattctgtgcaaagctatcttctatctcttaattatcgtgggtacgctggggaagcgctttaagcagtacagagagcttaaaccacagacttgtaccatctgcgaaacaactcccgccaatgcaattgatgccgagatgcacgacttgaactgttcatataatatatgcccttactgtgctagtaggctgaccagcgacggactagcacggcatgtcacacagtgcccaaagcgcaaagagaaggtggaagagaccgaactctacctgaaccttgagcgaatcccctggattgtaagaaaactgttgcaagtttctgaatccacgggcgtggccctcaagaggtcaagctggctgatcgtcttactggtcctcttcgctgtgagtctttctcctgtgcagtccgccccaataggccacgggaaaactattgagacatatcaggcgcgggaggattacaccagcatctgtctgtttgttttgggatcgatcctattcattgtgtcttgcctgatgaagggtctcgtagactccatcggcaatattttcttcccggggctgactatatgtaagacatgctcaatcggaagtattaacggctttgaaatcgagagccacaaatgttattgctcccttctgtgctgtccctactgccgtcattgttctgcagatcgcgaaatccaccagttgcatctcagcatttgcaagaaaagaaagaccggttcaaatgtgatgctggccgtctgtaaaaggatgtgcttccgggctacgatggaggtgagtaacaaggccttactgatacgatccatcattaataccacattcgttgtgtgtatcctaattctcgcagtctgcgtggtaagcacttctgctgttgaaatggagtcactgcctgccgggacctgggagcgcgaagaggaccttacaaacttttgtcaccaagaatgccaggtgactgagaccgaatgtttgtgcccatatgaggcgctggtcctcagaaggcccctgttccttgatagtatcgtgaagggcaccaaaaatctgttgaacagcacatccctcgagacttctctgtcgatagaagccccttggggagcaatcaacgtccagagcacgtacaagccaacagtgtccaccgctaatattgccttatcatggagttctgttgagcaccggggcaacaaaatcctggtgagcgggcgctccgaatcaattatgaagctagaggagagaactggaatcagctgggacctcggtgtagaagatgcttctgagtccaaactgcttaccgtcagtgtgatggacttgagccaaatgtattctcccgtttttgaatacctgtccggcgatcgtcaggtggaggaatggccgaaggccacatgcaccggggactgtcctgagaggtgcggatgtacttcaagtacatgcctccataaggagtggccccacagccggaattggcgatgtaacccaacgtggtgctggggcgtcggtaccgggtgtacttgctgtggcctggatgtgaaagacttattcacagactacatgtttgtaaagtggaaagtggattatataaagaccgaagcaattgtttgcgtcgagctgacatcgcaggaaagacagtgttcccttgtggaggccggaactaggttcaatttgggccctgtgaccatcacgctctctgaaccccgcaacattcaacagaaactgccacccgagatcataaccctacatcctcggatcgaggaagggtttttcgacctgatgcacgtccagaaggttctcagcgcttcaacagtgtgcaagctgcagagttgcactcatggagtgccaggtgatcttcaagtataccacattggcaatttgctgaaaggggacaaggtcaacggacacttaatccataaaattgagccgcactttaatacctcctggatgtcttgggatggctgtgacctcgattattactgcaacatgggtgactggcccagctgtacatatactggggtgacccagcataatcacgcgtccttcgttaacctgcttaatatcgaaacggattacacaaagtcatttcacttccatagcaaaagagtgaccgcacacggcgacactcctcagctggatttgaaggccaggccaacatatggagctggcgagataaccgtcctcgtggaagttgccgacatggagctgcatactaaaaagattgagatcaccgggctaaagtttgcaagtctgacatgcacgggatgttacgcctgttcttccggcatcagctgcaaagtgcgcattcacgtagatgaacccgacgagctcaccgtccatgtgaagtcggacgatcctgacgtggtcgctgcctcatctagtctgatggcacgaaaacttgaatttggtactgattccacattcaaggcgtttagcgctatgccaaaaacctctttgtgcttctacatcgttgagcgggagtattgtaagagctgctccaaggaagacacacagaaatgtgtgaacactaagctggagcaaccccagtcaattttaatagaacgtaaagggaccatcattggaaagcagaataacacgtgcacagccaaagcaagttgctggctcgagagcgtaaagagctttttctacggcctgaagaacatgctttccggtatctttggcaatgtgttcgtcgggatttttctgttcctagccccgtttatcctcctgatattgttctttatgttcggatggagaatcctgttttgtttcaaatgctgtaggcgcacccggggcttattcaagtataaacacctcaaggatgacgaagagactgggtacagaaggattatcgagcgactgaacaataaaaagggaaagaacaaacttctggatggcgaacgcttggctgaccggagaattgccgagctcttttcaaccaagacacacatcggt

SEQ ID NO: 10455 - RNA, 3495 nt, synthetic construct
  misc_feature 1..3495: note = derived and/or modified CDS sequence (opt3) from CCHVF(CCHVF Kosovo/9553/2001)__AY675511.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatcgcgaggatgtccaatcacccaaaaacaaccatggcttttctgttctggttttctctgggatatgttataacgtgtattctctgcaaggccttattctacagcctgatcattatcggcactcttggtaaaaagatcaagcagtatcgggaattgaaaccccagacctgcacaatttgtgagactgcacctgtgaacgccatagatgctgagatgcatgacctgaattgctcctacaacatctgtccatattgcgcatcacgcctaaccagtgacgggctcgccagacacgtcaagcagtgtcccaaaaggaaggaaaaagtggaggaaacagagctgtaccttaatctggaacggattccttgggtagttcgcaagttgctccaagtgagcgagtctaccggagtcgctctgaaacgatcctcatggttaatcgtgctgctcgtgcttctgacggtcagcttgagtccagttcagtctgccccggtgggccacggcaagactatagagacataccagaccagagaagggtttacttccatttgcctattcatgctgggaagcatcctctttatcgtatcgtgtctggtgaagggtcttgtcgattctgtgtccgactcattctttcccggcctgagtgtttgcaaaacatgtagcattgggtccatcaacggattcgagattgaatctcataagtgctattgtagcttgttttgctgcccttactgtaggcactgctcagcggatcgggagatacatcagctccacctgagtatctgtaaaaagcgtaaaaccggctccaatgtgatgttagcagtctgcaagcgcatgtgtttcagagccacgattgaagctagcaggcgggccctgctaatccgatctatcattaacaccacattcgtgatatgcatcctcactctgaccatttgtgtagcatcaacaagtgctgttgagatggagactcttccagccgcgacctgggaacgcgaggaagacttgacaaatttttgccaccaagagtgtcaggtgcccgaaaccgagtgcctgtgtccttatgaggccctcgtcctgagaaagccacttttcctggatagcatcgtgaaaggtatgaagaacttgctcaattccacttctctggaaacgtcgttaagcattgaggcaccctggggcgctatcaacgtccagtccacatttaaaccgaccgtgtcaactgccaacatagctctgagttggtctagcgttgaacatagggggaataagatcctagtgaccggacggtccgagtcaattatgaaactcgaggaacgcacaggcgtaagctgggacctgggggtcgaggatgcctctgaatccaagctcttgaccgtgagtatcatggacctgagccaaatgtactctcctgttttcgagtatctctccggagatagacaggtggaagagtggcccaaggcaacttgcacaggtgactgcccagagaggtgtggctgcacgtcaagtacctgtctgcacaaagaatggcctcatagccgtaactggcggtgcaatcccacttggtgttggggagtcgggacaggctgcacctgttgcggtgtggatgtaaaggacttatttacagaccacatgttcgtgaaatggaaggttgagtacattaaaactgaagccatcgtctgtgtggagctgacctcgcaggaacgacagtgctcccttatagaggctgggacgagatttaacttgggcccagtgaccattacactctctgagcccaggaatatccaacagaagctgcctccagaaattatcactctacatccgaagatagaggaaggattctttgatctgatgcacgtccagaaagttctcagcgcgtcaaccgtgtgtaagctgcagagttgcacacacggcatccccggggaccttcaagtgtatcatattggaaacttgctgaaaggtgatcgcgtaaatggccacttaatccataagattgagcctcacttcaacacttcctggatgtcttgggacgggtgcgatctcgactactactgtaatatgggagattggccaagctgcacctatacgggcgtcacacagcacaaccatgcagcctttgtgaatctgcttaacatcgaaaccgactacactaaaacattccactttcattccaagcgggttaccgctcacggtgatactccccagctggacttgaaagccagacctacctatggggcaggcgagataacagtgctcgtcgaggtggccgatatggaactgcatacgaagaaggttgagatttcaggactaaaattcgctagcctggcctgtaccggctgctacgcatgtagttctgggatctcctgcaaggtgaggatccacgtagacgaaccagatgagctcactgtccacgtgaaaagctcggaccccgacgtggtcgcggcttcaacatctctgatggcccgcaaacttgagttcggaaccgatagtacatttaaggcattctccgccatgccgaagactagcttgtgtttttatattgttgaaaaggagtactgcaaatcttgtagcgaagacgataccaagaaatgcgtggacacgaagctggagcagcctcaatccatcttaattgaacatcgaggcacaataatcggtaaaccaaatgatacctgtcccgctaagacttcatgctggctcgagagtgtaaagagcttcttttatgggctgaaaaacatgcttggatctgtgttcggcaactttttcattggtatcctgctatttctcgcccctttctttctgtggatgttgtccttcatgtttggctggaagattctgttctgcttcaaatgttgccggcgtaccagagggttatttaagtacaggcacctcaaagacgatgaggaaacaggataccgccggatcatagagagactgaataacaagaagggcaaaaataggcttctggacggggaacgattggcagatcgcaagatcgctgagcttttctcaactaaaacccatattgga

SEQ ID NO: 10456 - RNA, 3495 nt, synthetic construct
  misc_feature 1..3495: note = derived and/or modified CDS sequence (opt3) from CCHVF(CCHVF SPU41/84)__AY900142.1__Gn-NSm-Gc
  source 1..3495: mol_type = other RNA
agcgaggaatcctctgacgattgcatctcaagaacccagctgctcaggacagagactgccgaaattcacggcgacaactacgggggacccggtgataagataacgatctgtaatggcagtaccgtggtcgaccaacggcttgggagcgagctgggatgctatacaattaaccgcgttaaaactttcaagttgtgtgaaaattccgctaccggcaaatcttgcgagatcgattcggtgcctgtaaagtgtcgacagggttactgcttaaaaattacacaggaggggcgtggacatgtgaagctgtcaagaggcagcgaagtcgtgctagacgcatgtgataccagttgcgaggttatgatcccaaagggcactggggacatactcgtggattgttccggaggtcagcaacactttctgaaagacaaccttatcgatctgggctgcccgaagattcccttgctcgggaaaatggccatctatatttgtaggatgtctaatcatcctaagacaaccatggcgttcctgttttggttcagctttggatacgtcatcacgtgcataatttgcaaagtgatcttctatctgctcattatcgtaggcactttaggtaagcggtttaagcagtaccgcgaactgaaaccacagacctgtacaatctgcgagactacccccgttaacgctattgacgccgagatgcacgatcttaattgttcctataacatatgcccttactgtgcatcaagattgacaagtgacgggctggccaggcatgtgacccagtgcccaaagcggaaagaaaaggtcgaggaaacggagctatacctcaatctggaacgcatcccctgggtggtgcgaaaacttctgcaagtcagcgagtctactggagttgctttgaagagatcctcatggctcgtggtactgttagtgctgctcacagtcagccttagtcctgtgcagtctgcaccaatttcccacggcaaaaccgttgaggcctatagggctcgggaaggctacactagcatgtgtctgttcgtgttggggtcggtcctatttctggtgtcttgcctcatgaagggactggtagactccgttggtaacacattctttccgggcctttcaatctgtaagacctgcagtataagctccattaatgggttcgagatcgaatctcaccgttgttattgcagcctgttttgctgtccctactgccgccattgttcagccaacaaagagatccaccagttgcatctcagtatttgcaagaaaagaaaggcgggatccaatgtgatgctggcagtctgtaaaaggatgtgcttccgggccacgatggaagtgagcaaccgagctttattcatccgctctattataaataccacatttgtcctgtgtatcctaattctcgccgcatgcgtggtttcaactagcgctgtggagatggagagcctgcctgccggcacctgggaaagagaggaagatcttacaaacttctgtcaccaggagtgccaagtagcggacactgaatgtttgtgcccatatgaggccctggtcctcaggcggcccctgtttcttgattccatcgtgaagggtatgaagaacctgctcaattctacctcgttggagacaagcctgtccatcgaagcaccttggggcgctattaacgttcagtcaacctacaaaccaactgtgagtacggccaatatagctttatcttggagctccgtcgagcaccgcgggaacaagatcctggtgtcaggaagaagcgaatctattatgaaactagaggagaggacaggcatctcctgggacctcggggtagaagatgccagtgagagcaagctgcttaccgtgtctgttatggacttgtcccagatgtattcacccgtcttcgaatacctgagtggagatcgtcaagtggaggaatggccgaaagcaacttgcaccggtgactgtcctgagcggtgcggctgtacaagctcgacctgcctccataaggagtggccccactcccgaaattggagatgtaacccaacttggtgctggggagtggggacaggctgtacgtgctgtggtctggatgtcaaggacttatttaccgattacatgttcgttaaatggaaggtggaatatattaaaactgaggccatcgtgtgcgtagaactgacatctcaggagaggcagtgtagccttatagaagctgggacccgctttaatttgggccctgtcacaatcactctctcagagccccggaacattcagcaaaagctgccacccgagatcattaccctacatcctagaatcgaagagggattctttgacctgatgcacgtgcagaaagttctcagtgcgtccacggtgtgcaagctgcagtcttgcacccatggcgtcccaggggaccttcaggtgtaccacataggaaatttgctgaagggtgataaagttaacggccacttagtgcataagattgaaccgcacttcaatacaagctggatgtcctgggacgggtgtgatctcgactattactgcaacatgggagattggccctcatgtacttataccggcgtaacacaacataatcacgcaagttttgtcaacatgctgaatatcgagactgactacaccaaaaacttccactttcatagtaagagggtgacggcccacggtgatacacctcagcttgacctgaaagctcgcccaacctatggggccggcgaaattactgtgttggtcgaggttgcagatatggagctccatacaaagaaaatcgaaatatctggactgaagttcacctccctaacttgcaccggctgttacgcctgcagctcggggatctcatgtaaggtgcggattcacgtagacgagcccgatgaactgacagtgcatgtcaaatctgaggaccctgatgtggttgctgccagttccagcctcatggcacgaaagctggagttcggaacggactctacctttaaagcgttcagcgctatgccaaagacttccctttgcttttacatcgtggaacgtgagtattgtaaatcatgcagtgaagaggacacacagaagtgtgtcaacaccaagttggaacagccccaaagcattctgatcgagagaaaaggcacaataattggtaagcagaataacacttgcaaagccaaggcagggtgctggttagagtctgtgaaatccttcttttacggactcaagaatatgctgtcaggcatcttcggtaacgtttttatcggcattttcctttttctggccccgttcatcctactcattctgtttttcatgtttgggtggaggatattgttctgtttcaagtgctgtcgccggaccagaggactgtttaaatataggcacttaaaggatgacgaagagacgggctaccgaaaaatcattgaacgcctcaataacaagaaagggaagaataagctgcttgatggagagcggctggctgacagaaggatcgccgaattgttcagtacaaaaacccacattggc

SEQ ID NO: 10457 - RNA, 3495 nt, synthetic construct
  misc_feature 1..3495: note = derived and/or modified CDS sequence (opt3) from CCHVF(CCHVF UG3010)__AY900143.1__Gn-NSm-Gc
  source 1..3495: mol_type = other RNA
gccgagggcgtgagcaacgactgcgtctccagaacccagctgatcaagacagaagttgctgagattcacgaagattcttacgggggacccggtgagaaaataactatctgtaatggctcaacgattgtggaccaaaggctcgggagtgaacttggatgctataccatcaaccgggtaaagacatacaaactgtgtgagaatagcgcaactgagaagggctgcgaaattgattccgtgcctgtcaaatgtaagcagggtttctgcttgaaggtgacccaggaggggcgcggacatgttaaattatctcgaggcacagaaatcgtgctggacgtctgtgatacctcgtgcgagctaatgataccaaagggcactggggacatcctcgtggattgttcaggaggtcagcaacactttctgcaggacaaccttattgatctgggctgcccgaatgtacccttgctcgggaaaatggccatctatatttgtcgtatgagcaaccatcctaagacaaccatggcgttcctgttttggttcagttttggatacgttatcacgtgcatagtgtgcaaagtcctgttctatctcttaattgtgatcggcactctgtccaagaagctgaaacagtacagagagttgaagccacagacctgtattgtgtgcgaatctacacccgtcaatgctatcgacgccgagatgcacgaactgaactgtaattataacatctgcccttactgtgcaagcaggctaacttccgatggtctcgttcggcatgtgaatcaatgcccaaaacgcaaggagaaagtagaagagaccgagctgtaccttaacctggaaaggattccctggttggtgaggcggctcctgcaggtctcagagagtacagggatggccttaaagcgcagctgttggatgaccacgctgctcatacttctggtggtttctttgtcccctgtgcagtcagctccagtcggacagggcaaagcagtggaagtatatcgagttagagagagctacaccagtatctgcctatttgtgctgggctctgtcctcttcgccgtgtcctggctgattaaggggcttatcgacggaataggtaatagctttttcccgggcctgtcggtctgtaagacatgctctattgggtccatcaacggatttgaaatcgagtcacacaaatgttattgcagtttgttctgctgtccctactgcagggcttgtagctccgataagattacccaccggatgcatctcaatgtgtgcaaaaagcgtaaagccggctctaacgttatgctggcggtgtgtaagcgcatgtgctttaaggcaactgtagaggccagcaacacagctttactgatcagaggtattataaattcaaccttcgtcatctgtgtgctaattctcgttatctgcgtggtcagtacgtccgccgtggacatggaaaacctgcctgcagggatctgggagagggaagaggaccttaccaatttctgtcaccaagaatgccaggtaacagagactgagtgtttgtgcccatatgaagctctgattctccggaaacccctgtaccttgatagcatagccaagggcatgaaatctctgttgaactcaaccaatctcgagacaagtctgagcatcgaagcgccttggggagccattaacgtgcagtccacttttaagccaaccgtttctgcagctaatatcgccttatcgtggagctccgtcgagcatcgaggcaacaaaattctggtgtcagggcgcagtgagtctatcatgaagctagaagagagaacaggaataagctggtccctcggtgtggaagacgcttcagagagcaagaccctgactgtctctgttatggatctttcccaaatgtatagtcccgtgttcgaatacttgagcggcgacagacaggtggaggagtggccgaaagccacgtgcacaggggattgtcaggaacggtgcggatgtacctcttccacttgcctgcacaaggagtggcctcactcacgcaattggagatgtaaccccacctggtgctggggcgtaggtacagggtgtacctgctgtggcctcgacgtcagggatctgtttactgactacatgatggtgaaatggaaggttgaatatgtgaaaacagaggcaatcatgtgcgtcgaattaacgagtcaggagcgtcaatgtagcctgattgaggccggaacccggttcaatcttggcccagtgactatcacattgtcggaacctcgaaacattcagcagagactcccctccgagatcgttaccctgcatccaaagatagaagaggggtttttcgatctaatgcacgtgcagaaggtactgtctgctagcacagtctgcaaactccaatcatgcactcatggagtgcccggtgaccttcaggtgtaccacgtcggcaatcttttgaagggggataaagttaacggacatagtattcacaagatcgaatcccactttaatacctcttggatgagctgggacggctgtgacctggattatttctgcaacatgggtgactggccttcctgtacgtacaccggggtgacacagcataacagggcggcatttattaatatgttaaacatcgagactgattataccaaaacattccactttcattcaaagcgcgtaactgcccacggcgacaccccacagctcgatctgaaagctcggccgacgtacggagccggcgaggtgacagtccttgtggaagttgcagacctggagttgcacaccaagaagatagaagtgagcgggctcaaattcgccagtctgacttgctctggatgttatgcttgctccagcggcatctcgtgtaaggtcaggattcatgtgaatgagcccgatgagtttacagttcacgtgaaatcatctgaccctgatgtcgtagccgcaggtagttccctaatggcgagaaagatcgaatttggggctgacagcaccttcaaagccttttctagcatgccaaagaactccctgtgcttctacattgtggagcgcgattactgttcaagttgcactaatgacgatacccaaaagtgtgttgacacaaaactcgaacatccccagagcatcctgatagagcacaagggaacgattatcggcaaacagaacgacacttgctctactaagacatcctgctggcttgaatcagtgaaaagtttcttctatggtttgaagaatatgctgggcgggatctttggaaacgtcttcttaggcatttttctcttcctggcaccttttgcccttctgatcttctttttctttttcgggtggcgactactcttctgtctgaagtgctgtcggcgtaccagaggattgctgaaatacaagcagttaaaagatgaggaggaagctggctataagaaaattatagagaggctcaatgacaagaagggtaaaagccgcctgtttgatggggaacggcttgccgacagaaagatcgcagagctgttctccacaaaaactcatattgga

SEQ ID NO: 10458 - RNA, 3495 nt, synthetic construct
  misc_feature 1..3495: note = derived and/or modified CDS sequence (opt3) from CCHVF(CCHVF Hy13)__AY900145.1__Gn-NSm-Gc
  source 1..3495: mol_type = other RNA
agcgaggaatccggcgacgattgcatctctagaacccagctgtcaaggacagagactgccgaaattcacagtgacaactacgggggacccggtgataagataacgatctgtaatggcagcaccattgtggaccaacggctcgggtccgagcttggatgctatacaatcaaccgcgtcaaatctttcaagctgtgtgaaaattcggctactggcaaatcatgcgagattgatagcacccctatcaagtgtcgacagggtttttgcttgaaaataacacaggaggggcgtggacatgttaagttaagtagaggctccgaagtggtactggacgcatgtgattctagctgcgagatcatgattccaaagggcaccggggacatcctagtggattgttccggaggtcagcaacacttcctcaaagacaacctgattgatcttggctgcccgaatatccccctgttggggaagatggccatatacatttgtaggatgtcaaaccatcctaaaactacaatggcgtttctcttctggtttagtttcggatatgtcattacctgcattctgtgcaaggtgatcttttacctgctcatcgttgtgggcacgttaggtaaaaagttcaagcagtatcgggaactgaaaccacagacttgtaccatttgcgagacaactcccgtcaatgctatagacgccgagatgcacgatcttaactgtagctacaatatctgcccttattgtgcatctcgcttgacctccgacgggctggccagacatgtgatgcagtgcccaaagaggaaagaaaaggtagaggaaacagagctatacctcaacctggaacggattccctgggttgtgcgcaaacttctgcaagtctcagagagcaccggagtggctttgaagcgaagttcttggctcgtggtcctgttagttctgctcacggtgtcccttagccctgtacagtcggcaccaatcggccacggcaaaactgtggagacataccagaccagagaagggtatacttctatatgtctgtttgtcttgggatccattctattcatcgtgtcatgcctgatgaagggtctcgttgacagtgtgggcaatagctttttcccggggtcctctatctgtaagacatgcagcattggatcaatcaacggctttgagattgaaagtcacaaatgttactgctccctgttctgctgtccctattgcaggcattgtagcgccgatcgggagatacacaagctgcatctgtctatctgcaaaaagcgtaaaaccggttcaaatgtcatgttggctgtgtgtaagcgcatgtgcttcagagccacggtagaagttagtaacaaggcgctcctgattaggaatatcatcaacaccacatttgtggtctgtattttaatactggcagtgtgcgtcgtgagcacttccgccgttgagatggagtctctacctgctgggacctgggaacgggaggaagacctcacaaacttctgtcaccaggagtgccaagccactgaaaccgagtgtctgtgcccatacgaggcacttgtgttgcgaaaacccctgttttcggatagcatcgtaaagggcatgaaaaatctcctgaactccacatcacttgaaaccagtctgtctattgaggctccttggggagccatcaatgtccagagcactttcaagccaacggtgtccgcggccaacattgcattgtcatggagctctgttgaacaccgcggcaataaaatcctcgtgtccgggagaagtgagagcataatgaagctggaggaaaggacaggaatctcttgggacttaggtgtcgaggatgcttccgaatcaaagctgctaaccgtgagtattatggacctcagccagatgtattcgcccgtatttgagtacctgtccggcgatcggcaagtggaagagtggccgaaagccacttgcaccggggactgtcctgagcgctgcggatgtacatcttcaacctgccttcataaggaatggccccacagcagaaactggaggtgtaatccaacttggtgctggggcgttggtacagggtgtacgtgctgtggcttggatgtcaaagacctgttcaccgatcatatgtttgtgaagtggaaagtggagtatatcaagactgaagctattgtctgcgttgagctcacaagtcaggaacgtcagtgttccctgatcgaggccggaacccggttcaacttaggccctgtgacaataactctgtctgagccccgaaatattcagcaaaaacttccacccgaaatcgtgaccttgcaccctagaattgaggaagggtttttcgacctcatgcatgtaaagaaggtcctgagcgcatccacggtgtgcaaactacagtcatgcacccacggagttccaggtgaccttcaggtgtaccacatcggcaacctcctgaagggggataaagtcaatggacatcttatacacaagatcgagccgcattttaacacaagctggatgagttgggacggctgtgatttggactactattgcaatatgggtgattggccctcttgttcctacactggggtgacccagcacaaccacgccgctttcgttaatatgctgaacattgaaacagactatactaaaatctttcatttccacagcaagagggtgaccgcgcatggcgatacgcctcaattagacctcaaggcacgcccaacatacggagccggcgagattaccgtactggtcgaggtggctgatatggaacttcacactaaaaagatcgagatatcggggctgaaattcgcctcattgacatgcaccggatgttatgcatgctctagtggcatttcctgtaaggtgcggatccatgtcgacgaacccgatgagctcactgttcacgtgaaaagcgaggaccctgatatcgtagccgcttctagctccctgatggccagaaagctagaatttggtaccgactcaacattcaaggcatttagtgcgatgccaaaaacgagcctgtgcttctacattgtggagagggaatattgtaagtcttgctccaaagaggacacccagaagtgtgtcaacactaaactcgaacagccccagtcaatcctgattgagcacaaggggacaataatcggaaagcaaaatgatacctgcacaagtaaagctggctgctggcttgagagcgtgaagtcctttttctacggtttgaaaaacatgctgtctggcatttttgggaatgttttcatcggaatctttttattcctcgccccgtttatcctgcttatactgttctttatgttcggctggcgcatcctattctgttttaagtgctgtcgacggactcgtggactcttcaaatacagacatctgaaggacgatgaagagaccgggtataggaagattatcgaacgcttgaacaataaaaagggcaaaaacaagctgttagacggtgagcggctcgcagatagaaaaattgccgaactgttttcgacgaagacacacatcggg

SEQ ID NO: 10459 - RNA, 3495 nt, synthetic construct
  misc_feature 1..3495: note = derived and/or modified CDS sequence (opt3) from CCHVF(CCHVF Semunya)__DQ094832.1__Gn-NSm-Gc
  source 1..3495: mol_type = other RNA
gccgagggcgtgagcaacgactgcgtctccagaacccagctgatcaagacagaagttgctgagattcacgaagattcttacgggggacccggtgagaaaataactatctgtaatggctcaacgattgtggaccaaaggctcgggagtgaacttggatgctataccatcaaccgggtaaagacatacaaactgtgtgagaatagcgcaactgagaagggctgcgaaattgattccgtgcctgtcaaatgtaagcagggtttctgcttgaaggtgacccaggaggggcgcggacatgttaaattatctcgaggcacagaaatcgtgctggacgtctgtgatacctcgtgcgagctaatgataccaaagggcactggggacatcctcgtggattgttcaggaggtcagcaacactttctgcaggacaaccttattgatctgggctgcccgaatgtacccttgctcgggaaaatggccatctatatttgtcgtatgagcaaccatcctaagacaaccatggcgttcctgttttggttcagttttggatacgttatcacgtgcgtggtctgcaaagtgctgttctatctcttaatagtgattggcactctgggtaagaaacttaaacagtacagagagttgaagccacagacctgtatcgtctgcgaatccattcccgttaatgctatcgacgccgagatgcacgaactgaactgtaattataacatctgcccttactgtgcatctaggctaacaagcgatgggctcgtgcggcatgtaactcaatgcccaaaacgcaaggagaaagtggaagagaccgagctgtaccttaatctggaaaggattccctggttggtcagacggctcttacaggtgtccgagtcaacaggaatggccctgaagcgcagttgttggatgaccacgctgctcatacttctggttgtgagcttgtctcctgtccagtccgctccagtgggccaggaaaaagcaatcgaggtatatcaagttcgagaatcatacactagcatttgcctatttgtgctgggcagtgtcctcttcgccgtgtcttggctggtcaaggggcttatcgacggaataggtaactcctttttcccgggcctgagcgtgtgtaagacatgctcgattgggtctatcaatggatttgagatcgagtcccacaaatgttattgctcattgttctgctgtccctactgcagagcttgtagtagcgataagattacccacaggatgcatctcaacatctgcaaacggcgtaaggttggctccaatgtgatgctggccgtatgtaaacgcatgtgctttaaggcgactgtcgaagcatctaacagcgccttactgattagatcaataatcaacagtacattcgtgatttgtgttctaatcctcgtgatctgcgtcgtgtccaccagcgctgtagacatggagaatctgcctgccggtatttgggaaagggaggaagaccttacgaacttctgtcaccaggagtgccaggtgaccgagacagaatgtttgtgcccatatgaggcactgatactccggaagcccctgtttcttgattctatcgctaaagggaagaaatcactgttgaatagtactaacctcgaaaccagcctgtccattgaggccccttggggcgcgatcaatgttcaatctacattcaagccaactgtctcggccgcaaacattgctttaagctggtcctcagtggagcatcgaggaaataaaatcctggtgagtggccgctctgaaagcataatgaagctagaggaaagaaccgggatctcctggtcactcggagtcgaggacgccagcgaatctaagacactgaccgtttccgtgatggatcttagtcagatgtacagccccgtgtttgagtatttgtctggtgacaggcaggtagaggaatggccgaaagctacttgcacgggcgattgtcctgagcggtgcgggtgtacatcctcaacctgcctgcacaaggaatggccccacagtcgcaactggagatgtaatccaacttggtgctggggagtcggcaccggttgtacatgctgtgggctcgacgtgagggatctgttcaccgactacatgatggttaaatggaaggtggagtacgtcaaaactgaagccattatgtgcgtggagttaacaagccaggagcgtcaatgttcgctgatcgaagcaggcacgcggtttaaccttggacctgttaccattactttgtccgagccccgaaatgtgcagcagagactcccatctgaaatcgtaacactgcatcccaagatagaggaaggcttctttgatctaatgcacgtccagaaggtgctgttctgcaaatatagcctccaagccacctcatgcacacatggggtgcctggagacctgcaggtctaccacgttggtaaccttttgaagggcgataaagtgaatgggcatagtattcacaagatcgagtcccactttaacacttcttggatgagctgggacggatgtgacctggattatttctgcaatatgggcgactggccatcctgtacctacacgggtgtaacccagcataacagggctgcgtttgtgaacatgttaaatattgagacagattatactaaaaccttccactttcattcaaagcgcgtcacagcacacggggacactccgcagctcgatctgaaagcccggcccacctacggcgctggagaagtgacggttcttgtggaggtcgccgacctggaattgcacacaaagaagatcgaggtgagcggcctcaaattcgcaagtctgacctgctctgggtgttatgcctgctccagcggaatatcgtgtaaggttagaatccatgtgaacgagcctgatgagttcactgtccacgtaaaatcaaatgacccagatgtggttgctgccggctctagtctaatggcaaggaagattgaatttggtgcggactccacattcaaggcttttagctctatgcccaagaacagcctgtgcttctacatcgtggaacgcgattactgttcctcatgcaccgacgatgacactcaaaagtgtgtcaatattaaactcgagcatcctcagagtatcctgatagaacacaaggggaccattatcggaaaacagaacgacacatgcccaacgaagaccagctgctggcttgagtctgtgaaatcctttttctatggcttgaagaatatgctgggtggcatctttgggaacgtattcttaggaatttttctcttcctggccccctttgcacttctgatcctattctttttcttcggctggcgactcctgttttgtttgaagtgctgtcggcgtactagagggctgttaaaatacaagcagctcaaagatgaggaagaggccggatataagaaaattatagaaaggctgaatgacaagaagggcaaatcacgccttttcgatggtgagcggctggctgacagaaagatcgccaaattgtttagtacaaagacccatattggg

SEQ ID NO: 10460 - RNA, 3495 nt, synthetic construct
  misc_feature 1..3495: note = derived and/or modified CDS sequence (opt3) from CCHVF(CCHVF SPU128/81/7)__DQ157174.1__Gn-NSm-Gc
  source 1..3495: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaagagcttcaaattgtgtgaaaattccgctactggcaaatcttgcgagattgagtcggttccagtgaagtgtcgacagggttactgcttacgtatcacccaggaagggagaggacatgtaaaactgtcaaggggcagcgaggtggtcctagatgcatgtgacacaagttgcgaaataatgatcccgaagggcaccggggatattctcgtggactgttccggaggtcagcaacactttctgaaggataaccttatcgacctgggctgccccaaaattcctttgctcgggaagatggccatctatatatgtcggatgtctaatcatccaaaaactacaatggcgttcctgttttggttcagctttggatacgttattacctgcatcctgtgcaaggctattttctatctcttaatcatcattggcacgctgggtaaacgctttaagcagtacagagagcttaagccccagacttgtaccatatgcgagacaactcctgtgaacgccatcgatgcagaaatgcacgacttgaattgttcctataacatttgcccatactgtgcctcaaggctgaccagtgatgggctagctcggcatgtcacacagtgccccaaacgcaaggagaaagtggaagagaccgaactctacctgaatcttgagcgaatcccttgggtagttagaaagctgttgcaagtgagcgagtctacgggagtcgcactcaaaaggtcctcatggctgatagtgttactggtcctcttcactgtgagccttagtccagttcagtctgccccgattggccacggcaagacaatcgaggcttatcgggcccgtgaggggtacacctccatctgtctgtttgtgttgggaagcattctattcatcgtatcgtgcctgatgaaaggtctcgtggactctgtcggcaactcctttttccccgggctgtcaatttgtaagacttgcagtataagctccatcaatggatttgaaattgagtctcacaagtgttattgcagccttttctgctgtccttactgccgccattgttcagcggacaaagaaatccacaagctgcatttgagtatctgcaaaaagagaaaaacaggctccaacgtgatgctcgcagtttgtaagaggatgtgcttccgggccaccatggaggtgagcaatcgagctctgtttattcgctctataatcaacacgaccttcgtcttatgtattctgatcctagccgtgtgcgtagtttcaacaagtgcagtggagatggaaaatctcccagctggtacttgggagagagaagaggatctgaccaacttttgtcaccaggaatgccaggtcacagagactgagtgtctttgcccctatgaagccttggtgctgaggaagcctctcttcctggacagcattgtcaaagggatgaagaaccttctcaattccacctctttggagacatcgctcagcatcgaagcgccatggggcgccataaacgtgcaatccacctacaaacccactgtttcaacggcaaatatcgctctgagttggtctagcgtggagcaccggggaaacaagattttagtatccggccgctcagagagcatcatgaaactggaagagagaacagggatttcttgggatctaggagtcgaagacgcctccgagagtaagctcctgaccgtgagcgttatggatctttctcagatgtattccccggtgtttgaatacttgtcaggtgacaggcaggtcgaggagtggcctaaggctacttgcaccggcgattgtcccgaacgttgcgggtgtacaagttcgacctgcctgcataaagagtggccacacagccggaattggcgatgtaaccctacttggtgctggggagtgggcacaggttgtacgtgctgtgggctcgacgtaaaggatctgttcaccgactacatgtttgtgaaatggaaggttgaatatatcaaaactgaggccatagtctgcgtggaattaacatcccaagagagacagtgttctctgattgaggcaggcaccaggttcaatcttggacccgtgacaatcactttgagcgaaccacgcaacattcagcagaagctgccccctgagatcataaccctgcatccacggatcgaagagggctttttcgatctaatgcacgtccaaaaggttctgtcagccagtacggtgtgcaaactccagtcctgcacccatggggtgccgggagacctgcaggtataccacattggtaatcttttgaagggcgacaaagtcaacgggcacctgatccataagattgaaccccactttaatacatcttggatgagctgggatggatgtgacttagattattactgcaacatgggcgactggccttcctgtacttataccggtgtgacacagcataatcacgcttcattcgttaacctcctgaatatcgagactgattacaccaaaaactttcacttccatagcaagagagtgacggcgcacggggacacaccacaacttgatctgaaagcaaggcccacctatggcgccggagagataactgtcttggtggaagttgctgacatggagctccatacaaagaagattgaaatcagtggcctgaaattcgcctctctaacctgcactgggtgttacgcatgctccagcggaatctcgtgtaaggtgcgcattcacgtagatgagcctgacgagctgaccgtccatgtgaaatcagatgacccagatgtggtcgccgcttctagttccctcatggcccgaaagctggaatttggcacagacagcacgttcaaagcattttctgcgatgcccaagaccagcctttgcttctacatcgttgagcgggaacactgtaagtcctgctcagaggaagacactaaaaagtgtgtgaacacaaaattggagcagccgcagagtattctgatagagcacaagggtaccatcattgggaaacagaatagcacatgcactgctaaggcctcttgctggttagaatccgtaaagtcatttttctatggactcaaaaacatgctgagtggcatctttggtaatgtgttcattggcatctttcttttcctggggccttttatactactcatcctgttctttatgttcggatggcgtattttgttctgttttaagtgctgtagaaggacccgcggcctgttaaaataccggcatctcaaggaggatgaagagacggggtatagaaggatcattgaacgactgaacaataaaaagggaaagaacaaacttctggacggcgagcgcttggcagatcggagaatcgccgaactcttcagcacaaagacccacataggt

SEQ ID NO: 10461 - RNA, 3495 nt, synthetic construct
  misc_feature 1..3495: note = derived and/or modified CDS sequence (opt3) from CCHVF(CCHVF ROS/HUVLV-100)__DQ206448.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaagagatcctcatggctcatagtcctgttagtgctgctcacggtgagccttagtccggtccagtctgctcccgttggccacggcaagactattgagacataccagaccagggaagggtttacttccatctgtctgttcatgttgggaagcatcctatttctggtgtcgtgcctcgtaaaaggtctggtggattctgtctccgactcattctttcctggccttagtgtgtgtaagacatgcagcattgggtccatcaacggattcgagattgaatctcataagtgttattgcagcctgttctgctgtccatactgccggcactgttcagccgatcgtgagatacatcagttgcacctcagtatctgcaaaaagcgcaaaaccggctccaatgttatgctggcggtgtgtaagagaatgtgctttagggcaacgattgaagccagccggcgagctttactgatccgctctatcattaacaccacattcgtcatatgtatcctaactctcaccatttgcgtggtatcaacaagtgccgttgagatggagaatctgcccagcggtacttgggaaagagaggaagaccttaccaacttttgtcaccaagagtgccaggtgacagaaaccgagtgtttgtgcccttatgaggcactggtcctcaggaaaccactgttccttgattccatcgtgaaggggatgaagaatctgttgaactctacttcgctcgaaacgagcctgtccattgaggctccctggggcgccatcaacgtccagtcaacatttaaaccgaccgtgagtactgcgaatatagccttatcttggagctccgttgaacatcggggaaacaagatcctggtgaccggccgctcagagagcattatgaaactagaggaaagaacaggggtatcttgggacctcggagtcgaggatgcatccgaaagtaagctgcttaccgtgagcatcatggacttgtctcaaatgtactcccctgttttcgagtatctgtcaggtgatcgtcaggtggaagagtggcccaaagctacttgcacaggcgactgtccagagaggtgcgggtgtacgagttctacctgcctccacaaggaatggcctcattcgcggaattggcgatgtaaccccacttggtgctggggagtcggcacaggttgtacctgctgtggggtggatgtaaaggacctgtttacagaccacatgttcgtgaaatggaaggttgagtacattaaaactgaagccatcgtctgcgtggagttaacctcccaggaaagacagtgttctctgatagaggctggcacgaggtttaatcttggaccagtgaccattacattgagcgagccccgcaacatccaacagaagctccctccagaaattatcactctgcatccgaaagtcgaggaaggcttctttgatctaatgcacgttcagaaggtgctgtcagccagtaccgtgtgcaagctccagtcctgcacacacgggatacccggagacctgcaagtatatcatatcggtaatcttttgaaaggcgatcgggtcaacgggcacctgattcataagatcgagcctcacttcaatacttcttggatgagctgggacggatgtgatttagactactactgcaacatgggcgattggccatcctgtacctatacgggtgtgacacagcacaatcatgcagcctttgttaacctcctgaatattgaaaccgactacactaaaacattccacttccattcaaagagagtgaccgctcacggggatactccccagcttgacctgaaagcgaggcctacctatggcgcaggagagatcacagtcttggtggaggttgccgatatggaactccatacgaagaaagtggagataagcggcctgaagtttgctagtctagcctgcaccgggtgttacgcatgcagctccggaattagctgtaaggtacgcatccacgtcgacgaaccagatgagctgactgtgcacgtgaaatcgtcagaccccgacgtcgttgccgcttctacaagtctcatggcccgaaagctggagttcggcaccgattccacatttaaagcattcagcgcgatgccgaagacttctctttgcttttatatcgtggaacgggagtactgtaaaagctgctccgaagaggacacccagaagtgtgtagatacgaagttggaacaacctcagtcaattctgatcgagcataaaggtacaattatagggaagcagaacgatacctgcactgctaaagccagttgctggttagagagcgtgaagtctttcttttatggactcaaaaatatgctgggctccgtcttcggtaactttttcatcggcattcttctgtttctagcaccattcgtgctcctggttttgtttttcatgttcgggtggaagatcctgttttgtttcaagtgctgtcgtagaaccaggggattactcaaataccgcctgcttaaggacgacgaagagacaggctaccggagaattatcgaaaggctgaacaataaaaaggggaaaaaccgattgctcgatggagagcgcctggccgaccggaagatagctgaactattttcaactaagacccacatcggc

SEQ ID NO: 10462 - RNA, 3495 nt, synthetic construct
  misc_feature 1..3495: note = derived and/or modified CDS sequence (opt3) from CCHVF(CCHVF AP92)__DQ211625.1__Gn-NSm-Gc
  source 1..3495: mol_type = other RNA
agcgagggcggggacggaggttgcatctccagaacccagctgattaagacagaaactgccgaggtgcacggcgatgactacgggggacccggcgagaaaataacgatctgtaacggttctaccattgtcgatcaaaggctcgggtcagaacttggatgctatacaatcaatcggattaagagtttcaaactgtgtgaaaacagcgctcagggcaagaattgcgagatcgactccgcacctgttcagtgtcgccagggctactgcttgaaaatatctcaagaggggcgaggacatgtgaagttatcgcgtggttcagaaatcgtactggatgtgtgtgacactagctgcgagattatgatcccaaagggcaccggggatattctagtcgactgtagtggaggccagcagcactttctccagtccaacctggtggatcttggttgcccgaatatccccctgttggggaaaatggccatatatatttgtagaatgtctaaccatcctaagacaaccatggcgttcctcttttggttcagctttggatacgttatcacttgcattctgtgcaaaacactgttctatatcctcatcattataggcaccttaggcaagaaactgaagcaatacagggaacttaagccacagacgtgtactatctgcgagtccgtgcccgtcaatgctattgacgccgagatgcacgatttgaactgttcatataatatctgcccttactgtgcaagtcggctgaccagcgaagggctaacacgccatgtgaaccagtgcccaaaaagaaaggagaaagtagaagagactgaactctacctgaatcttgagaggataccctggattgttcggaagctgctccaggtgtctgagtccaccggagtcgccctcaaacgctcaagctggatgatcgtgctgttaatcctgctcattgtgagtatgtctcctgtccaatccgctccaatcagccaggaacgaacagttgcactttatcagtcgagagaggactacatgggtatttgtctggtgataatgggctctgtattgctagccgtgtccctgctcgtcagggggctgatcgattcaattagtagcacctttttcccgggactttccgtgtgccggacgtgtcacatcggctctatcaacggttttgaaattgagagccacaagtgctattgtgggctgttgtgctgcccctactgtcgtgcttgctcaactgaccaagacgcccatcagttccacctcagtgtttgtaaaaagcgcaaggcgggctccaatgtgatgctggcagtctgcaaaagaatgtgttttaaggccataatcgaagctagcaacaaagtgttattcattaggaatgtaatcaacacaacctttgttgtgtgcattctggtcatggtggcctgtatcgcatcttcagctgccgtcgagatggagaacctacctgcgggaacttgggaacgggaggaagagttgacaaatttctgccatcaggaatgtcaggtgaccgagacggagtgcctgtgtccatatgaaagtttcatacttcgaaagcccttgtttctggatagcatcgccaaaggcgttaagaacctcctgaatagtacctctcttgagacatcgctgagcattgaagcaccttggggagctatcaacgcccaatccacttacaagccaaccgcttcaagtgccaatattgcattgacatggtctagcgtggagcaccgcgggaacaaaatcctcgtatccggtagatcagagagcataatgaagctggaagagaggactggcatttcttggaatttaggggtcgaagacgcctccgagagtcggaccctgacaatcagcgtgatggatctatctcagatgtattcccccgttttcgaatacctctcaggagaccgccaggtggaggagtggccgaaagctacctgcactggcaactgccctgaaagatgtggttgcacgagtagcacatgtctgtacaaggagtggccccactcgaggaattggcgttgcaacccaacctggtgttggggcgtcgggactggatgcacctgttgcggccttgatgtgaaagaattgtttacagaccatatgctggtaaagtggaaggtggagtatattaaaaccgaagcgatcgtttgtgtcgagctcacttcccaggagcggcaatgctctctgatagaagcagggacacgattcagcttaggacctgtgacgatcaccctgtcagagcccagaaatattcagcagaaacttccacccgaattgatcactctccaccctaaaattgaggatggttactttgacctgatgcatgtgcagaaggtcatgagtgcctccacagtttgtaaactacaatcttgcacccacggcgtgccaggggatctgcagatctatcatgtgggaaacctcctgaagggcgacagggtaaatggtcaccttatacacaaggtcgaaccgcatttgaacacaagctggatgtcctgggatgggtgcgacctggactacttctgtaatatgggcgattggccctcatgcacttataccggagtgacgcagcacaaccatgctgcctttgcaaacttactcaatattgagaccgactacacaaaaactttccactttcacagcaagcgcgttaccgcccatggcgatacacctcagctggaccttaaagctcggccaagatatggggccggagagatcactgtgctggtcgaagtggcagatatggagttgcacaccaagaaagttgaagtgacgggcctcaagttcgcgagtctgacatgttctggttgctacgcttgttccagcgggatctcgtgcaaagtaaggattcatgtcgacgagcccgatgagctaaccgtgcacgtgaagtcatctgaccctgatatcgtcgccgcaagttccagcctgatggcccgcaagattgaatttggagttgactctactttcaaggcttttagctccatgccaaaggattcactctgtttctacatagtggagcgagactattgcaacagttgtaaaaatgaagagacacaacggtgcgtaaacgccaagctggaacagccccagagcatccttattgagcataccggcactatcattggtaaacaaaatgatacctgtggctctcgtacatcctgctggttggactcattcaagtcctttttctacgggcttaagagcatgttatccggaatctttggcaacgtgttcctcgggatatttctgttccttgcaccgtttgctctgctactcttctttttctttttcggatggagaatcctgttttgcttcaaatgttgcaggcgcacgcggggcttgttcaagtatagacacattaaagacgatgaggaagtcggttacaagaaaatcattgagaggctgaataacaagaaggggaaacaccgattactcgacggagaacgcctggccgatcggaagatcgcggagctgttttctaccaaaactcatataggc

SEQ ID NO: 10463 - RNA, 3495 nt, synthetic construct
  misc_feature 1..3495: note = derived and/or modified CDS sequence (opt3) from CCHVF(CCHVF ArD8194)__DQ211626.1__Gn-NSm-Gc
  source 1..3495: mol_type = other RNA
gccgagggcgggagcaacgactgcgtgtccagaacccagctggtcaagacagaagttgctgagatccacgaagattcttacggaggtcccggcgagaaaattactatatgtaatgggtcaacgatcgtggaccaaaggctcggaagtgaacttggctgctataccattaaccgggtacgcacatacaagctgtgtgagaatagcgcaactgagaaatcctgcgaaatcgattctgtgcctgtcaagtgtaaacagggtttctgcttgaagattacccaggaggggcgaggacatgtgaagttatcgcgtggcacagaaatcgttctggacgtgtgtgatacctcatgcgagctaatgataccaaaaggcactggggacatcctcgtcgattgtagcggaggtcagcaacactttctgcaggacaaccttattgatctgggctgcccgaatatccccttgctcgggagaacagccatttatgtgtgtaggatgagtaaccatcctaagaccacgatggcgttcctgttttggttctcctttggatacgtaatcacttgcgttgtgtgcaaagtcctgttctatctcttaatagtgattggcaccctgggtaagcggcttaaacagtaccgcgagttgaagccacagacatgtatcgtgtgcgaatctattcccgtcaatgctatcgacgccgagatgcacgatctgaactgtaattataacatctgcccttactgtgcaagcagactaacttccgacgggctcgttaggcatgtgacccaatgcccaaagcggaaagaaaaggtagaggaaacagagctgtaccttaatctggagcgcattccctggttggtgcgaaaactcctgcaggtctcagaaagtaccggagtggccttaaagagaagctgttggatgataacgctgctcatccttctgactgtttctatgtcccctgtgcagtcagctccagtcggccacaaaagggcagtggaggtatatcagatgcgggaaagctacacaggcatttgcttgtttgttctagggagtgtgctgttcgccgtctcttggctcgtgaaggctctgatcgattccataggaaacagctttttcccgggtctttcgatttgtaaaacctgctctatcggctccatcaatgggtttgagattgaatcacacaagtgttattgcagtctgttctgctgtccctactgccgtgcctgtagctccgacaagatcactcatcgcatgcacttgaacgtctgcaaaaagagaaaagtgggatctaatgttatgctcgcggtgtgtaagaggatgtgctttaaagcaacaattgaggccagcaaccgggctaccttcatacgaaacatcattaattcaacgttcgtaatctgtatcctgattttagtcatatgcgtggttagtacctccgccgtggacatggagaacctgcctgcaggcatctgggaaaaggaggaagatctaacaaatttttgtcatcaagagtgccaggtcactgaaaccgagtgtctctgcccatatgaggctctgatgcttcgcaagcccttgttcctggacagaattgccaaaggtatgaagagtctcctgaactctacatcacttgaaactagcctgagcatcgaggcgccttggggcgccattaatgtgcagtccacctttaaaccaacagtatctgcagctaacatcgccttgtcgtggagctccgtggaacacaaggggaataaaatactcgtttcaggaaggagtgagtctatcatgaagctggaggaacggaccggcattagctggtgcttaggggtcgaggatgcttccgaatcaaagactctgacggtgagcgtgatggacctatctcaaatgtactcccccgtcttcgagtatctcagtggagatcgccaggttgaagagtggccgaaagccacatgtaccggtgactgccctgagagatgtggctgcactagctctacctgtctgcacaaggaatggccccattccaggaactggcgttgcaatccaacatggtgttggggagtggggaccggctgcacttgttgcggtcttgatgtgaaagacttgtttacagattacatgctggtaaagtggaaagtcgagtacatcaagacggaagcaattatctgtgtggagctcacctcacaggaacggcagtgcagtctgatagaggccgggactcgattcaacttaggccctgttacaattaccctgagcgagcccagaaatgtgcaacagaggcttccacccgaaatcattacattgcaccctaagatcgaggaaggatttttcgacctcatgcatgtccagaaagtgatgtcggcttccactgtttgcaagctgcagtcttgtacccacggcgtgccaggggatctacaagtatatcatgtcggaaacctgctcaaaggtgacaaggtgaatggccacagcatacacaaaatcgagtcacatctgaacacgagttggatgtcctgggacgggtgcgatcttgactacttttgtaatatgggagattggccgtcttgcacctatacaggcgtgactcagcacaaccatgcggcattcattaacatgttgaatatcgaaaccgactacacaaagacttttcacttccacagcaaacgcgtcaccgcccatggtgatacgccccagctggacttaaaggctcggcctgcctatggggcaggcgagattacagttctcgtggaggtagccgatctggaacttcacaccaagaaaatcgaggtgtccggactgaagtttgcttcattgagctgtagtggctgctacgcctgttcttccgggataagctgcaaagtcaggattcatgtgaacgaaccagacgagttcactgttcacgtgaagtcgaatgatcccgacgtcgtggcagcgggatcatctctcatggctagaaaaatcgagagtggcgccgattccacattcaaggcatttagctctatgcctaagaacagcctgtgtttctatatcgttgaacgcgactactgctcctcatgtaccgatgacgacactcagaaatgcgtggatattaagctagagcatccacaaagtatcctgattgaacacaaaggtaccataatcgggaagcagaatgacacatgccccacgaaaaccagctgttggctcgagtctattaagtcctttttctacggactgaagaacatgctttcaggcatctttggtaatgtcttcttgggcatgctgttatttctcgccccgttcattctgcttatcctgtttttctttttcgggtggcgactactcttttgcctgaaatgttgccggcgtactagaaagttgctgaaatataagcacttaagggatgaagaggagagtggatacaaaaagataatcgaacgcctcaacgacaagaaaggcaagagccggctgttcgatggggagagacttgctgacaggaaaattgccgaactgttctccacaaagacccatatcgga

SEQ ID NO: 10464 - RNA, 3495 nt, synthetic construct
  misc_feature 1..3495: note = derived and/or modified CDS sequence (opt3) from CCHVF(CCHVF ArD15786)__DQ211627.1__Gn-NSm-Gc
  source 1..3495: mol_type = other RNA
gccgagggcgggagcaacgactgcgtgtccagaacccagctggtcaagacagaagttactgagatccacgaagattcttacggaggtcccggcgagaaaattacgatatgtaatgggtcaaccatcgtggaccaaaggctcggaagtgaacttggctgctatacaattaaccgggtacgcacttacaagctgtgtgagaatagcgctaccgagaaatcctgcgaaatcgattctgtgcctgtcaagtgtaaacagggtttctgcttgaagattacacaggaggggcgaggacatgtgaagttatcgcgtggcaccgaaatcgttctggacgtgtgtgatacttcatgcgagctaatgataccaaaaggcacaggggacatcctcgtcgattgtagcggaggtcagcaacactttctgcaggacaaccttattgatctgggctgcccgaatatccccttgctcgggcagaccgcaatttatgtgtgtagaatgagtaaccatcctaagacgactatggccttcctgttttggttctcctttggatacgtaataacctgcgttgtgtgcaaagtcctgttctatctcttaatcgtgattggcacactgggtaagaggcttaaacagtaccgggagttgaagccacaaacttgtatcgtgtgcgaatctattcccgtcaatgcgatcgacgctgagatgcacgatctgaactgtaattataacatctgcccttactgtgccagccgcctaacctccgacgggctcgttagacatgtgacacagtgcccaaagaggaaagaaaaggtagaggaaaccgagctgtaccttaatctggagcggattccctggttggtgcgcaaactcctgcaggtctcagaaagtacgggagtggcattaaagcgaagctgttggataatcactctgctcattcttctgacagtttctatgtcccctgtgcagtcagccccagtcggccacaaaagagctgtggaggtatatcaaatcagggaaagctacaccggcatatgcttgtttgttctagggggagtgctgttcgcagtcagttggctcgtgaaggccctgattgattctatcggtaactcctttttcccgggccttagcatctgtaaaacttgctcgattgggtctatcaatggatttgagattgaatcccacaagtgttattgctcactgttgtgctgtccctactgccgggcttgtagtagcgacaagataacacatcgtatgcacctcaacgtctgcaaaaagcgcaaagtgggctccaatgttatgctggccgtgtgtaagagaatgtgcttcaaagcgaccatcgaggcaaacaacagggccacgtttattcggaatatcatcaactctaccttcgtaatttgtatattaatcctggtcatttgcgtggttagcacatcagctgtggacatggagaatctacctgccggtatctgggaaaaggaggaagatctcactaacttctgtcatcaggagtgccaggtcaccgaaacagagtgtctgtgcccatatgaggcacttatgttgcgaaagcccctgagtctcgactccattgctaaagggatgaagtctctgcttaattctacttcactggaaaccagtttgagcatcgaggccccttggggcgcgataaacgtgcaatccacatttaaaccaaccatctctgccgcaaatattgctctctcgtggagctccgtagaacacaagggaaacaaaatcctggtgtcaggccgcagtgagtctattatgaagttagaggaaagaactgggatcagctggtgcctgggagttgaggatgcctccgaatcaaagacgctaacagtcagcgtgatggacctctctcagatgtactcccccgtgttcgagtatctgagtggtgataggcaggtcgaagagtggccgaaagctacctgtactggcgactgccctgagcggtgtgggtgcaccagctctacatgtcttcacaaggaatggccccattcccgcaattggagatgcaacccaacctggtgttggggagttggcactggttgcacatgttgcgggttggatgtgaaagacctgtttacggattacatgctcgtgaagtggaaagtagagtacataaagaccgaagccattatctgtgtcgagctgacttcacaggaaaggcaatgcagtttaattgaggcaggcacacgtttcaatctgggacctgtgaccatcacacttagcgagccccggaacgttcagcagcgattgccacccgaaataatcactctccaccctaagattgaggaaggctttttcgacctgatgcatgtgcagaaagtcatgtcggcctccaccgtgtgcaagctacaatcttgtacgcacggggttccaggagatctccaggtgtatcatgtaggtaatctgctgaaaggcgacaaggtcaacgggcacagcatccacaaaattgagtcacatcttaataccagttggatgtcctgggacggatgcgatttggactacttttgtaacatgggcgattggccgtcttgcacatatactggtgtgacccagcacaacagagctgcgttcatcaatatgctgaacatagaaacagactacactaagacctttcatttccacagcaaaagggtgacggcacacggggatacaccccagttagacctcaaggcccgccctacctatggcgctggagagattactgtcctggttgaggtggccgatcttgaactgcatacaaagaaaatcgaggtatccggcttgaagtttgcatcactcacctgtagcgggtgctacgcctgtagttctggaatctcctgcaaagtgcggattcacgtcaatgaaccagacgagttcactgtgcatgttaagagcaacgatcccgacgtggtcgctgccggctcgtcactgatggcaagaaaaatcgagtctggtgcggatagtacctttaaggctttctccagcatgcctaaaaattctctatgtttctatattgtggaaagggactactgcagctcctgtacagatgacgacacgcaaaagtgcgttgatataaagctggagcacccacagtcaatcctcattgaacataaagggaccatcattggaaagcagaacgacacttgccccacaaaaaccagttgttggctggagagcatcaagagctttttctacggccttaagaatatgttgtccggtatatttggcaacatcttcctggggatgttactctttctggccccgttcgtgcttctgattctatttttctttttcggatggcgcctcctgttttgcttgaaatgttgccgacggacacgtaagctgttaaaatataagcacctcagagatgaagaggagtcaggctacaaaaagatcattgaaaggctgaatgacaagaaagggaagagtcgccttttcgatggagagcggctggcagacagaaaaatcgccgaattgtttagcactaagacccacgtcggc

SEQ ID NO: 10465 - RNA, 3495 nt, synthetic construct
  misc_feature 1..3495: note = derived and/or modified CDS sequence (opt3) from CCHVF(CCHVF ArD39554)__DQ211628.1__Gn-NSm-Gc
  source 1..3495: mol_type = other RNA
agcgagtccaacaataacgactgcgtgtctagaacccagctgatcaagacagaaaatgccgagattcacggcgatgactacgggggacccggtgagaaaataactatctgtaacggctcaacgattgtcgaacaaaggctcgggagtgaacttggatgctataccatcaatcggattaagagcttcaaactgtgtgagaactccgcttctggcaagggttgcgagatcgattcgacacctgttaaatgtaagcaggggttttgcttgaagataactcaggaaggacgcggccatgtgaaattatcacgaggcagcgagatcattctggacgtatgtgatagttcctgcgaaatgatgatcccaaaggggtctggagacattctagtggattgtagcggtggccagcaacacttcctccaggacaatctggtcgatcttgggtgcccgaacgtgcccctgttgggaaaaatggcaatctacatatgtcgtatgtccaatcatcctaagaccacaatggcctttctcttctggttttcattcggctatgttattacctgcatcttttgcaaagtgattttctacgtcctgatcatcattggtactctggggaagagaataaagcagtatagggagctcaaaccacagacatgtaccatctgcgaggcgacgcccgtgaacgctattgacgccgaaatgcacgatttaaattgtagttacaacatctgcccttattgtgcaagccggctgacttctgagggacttgtacgccatgttacccaatgcccaaagagaaaagaaaagatagaggaaacagagttgtacctgaatctagagaggattccctggtttgtgcggaaactcctgcaggtctccgaatcaactggcgtggcccttaagcgcagcagttggctggtgaccttgctcgtcctgttaacagtttctctgtcccctgtgcagagcgctccaatcggccaggagcgaaccgtagtgacgtaccaagtcagagaatcgtatactgggatgtgtctcttcatccttggatctgtgctgtttgcaatttcctggttgacaaaaggtctagttgactcagtgggcaacatcttctttccggggctgagtgtctgcaagacctgtagcattggatccataaatggcttcgagatcgaatctcacaagtgctactgtagcctcttctgctgcccctattgtaggtactgctcagccgatcggggtgctcaccagagtcatctgtccgtgtgtaaaaagcgtaaaactgggagcaacgtaatgcttgccgtttgcaagcgcatgtgttttagagcgacactgaaagtgtcttcagaggcattgattatcaggagtatcattaacaccacgttcgtcgtgtgcatactcatcctggtcgtgtgtgttgtgagcacctccgccgtagagatggaaaatttacctgctggcacatgggagaaggaagaggacctgactaacttttgccaccaggaatgtcaagtcaccgagacagagtgcctatgtccatatgaagccttcgtgctccggaagcccctgtttcttgactctactgcaaaatcgatgaagtccttgcttaatagcacctcactcgagacaagtctgtctattgaagctccttggggagccatcaacgttcagagcaccttcaaaccaactgcgtccacggccaatattgcactttcatggagctctgtggagcatcgaggcaacaagatcctggtcacagggcgctccgagagtataatgaaattggaagagagaaccggaatcagctggaatctcggtgtggaagatgcttctgagtccaagactctgaccgtatcagtgatggacttaagtcagatgtacagcacagtttttgaatatctgtcgggcgataggcaggtcgaggagtggcccaaggctacctgcactggggactgcccggaacggtgtggatgcacatcctctacgtgtctacacaaagcctggcctcacagccgcaactggagatgcaatcccacctggtgttggggcgtgggtactgggtgcacatgttgcggcctcgatgtgaagaacctgttcaccgactacatgcttattaaatggaaggtcgagtttatcaaaacagaagccattgtttgtgtggagttgacttcacaagaaaggcagtgcagtctgatcgaggcaggaacccgtttcaatctcggcccagtgacgataaccctgtccgagcctcggaacattcagcagaagttacccccagaactggtaacacttcatccccgagtcgaggaagggtttttcgatttgatgcacgtgcaaaaggttctctctgccagcactgtgtgtaaactgcagtcctgcacccatggagtccctggtgacctacaggtgtaccacgttggcaatctgctcaagggggataaaatcaacggaaattcatttcataagattgagccaaacctgaacacaagctggatgagttgggacggctgcgatcttgactattactgtaatatgggtgactggccgtcttgcacttataccggggtgacgcagcacaaccacgctgcgttcgtaaatttgctgaacatcgaaacagattacaccaaaaatttccattttcactccaagagagtcactgcacatggcgagacaccccaattagacctcaaagccaggcctaagtatggagctggcgaggtgaccgtgctggtcgaagttgccgatatggagcttcacactaagaaaatagaaatcagcgggctgaagttcgcatcgttgacctgtacaggatgctacgcctgttcatctggcattagttgcaaagtgcgcctccacgtagacgagccagatgagctgacggtgcatgtcaagtccgacgatcccgacgtggttgctgccagctctagcctaatggcacggaaaatcgaatttggtaccgattccactttcaaggcgttttcaagtatgcctaaggacaaactgtgtttctatattgtggagagagattactgcagctcttgttccaaggaagacacacagaaatgcgtcaacgctaagctcgagcagccacagtcaatcctgatagaacacaaagggaccattatcggaaagcaaaatgatacatgtactgtgaaggccagttgctggcttgagagcgttaaatcctttttctacggcttgaagaacatgctgggtggcatctttgggaatgtgattttaggaatcattatgttcctcgcaccctttgccctgcttctgctattctttctcttcggctggaggatactgttctgcttgcgctgttgccgacggacccgtgggctgtttaaatataagcatatcaaagacgacgaggaatctggatacaagagaattatcgagaggttaaacaataagaaaggcaagaacaaactcttcgatggtgaacgcctggctgacaagaaaattgccgagctgttttcgacgaagacacacatcggg

SEQ ID NO: 10466 - RNA, 3495 nt, synthetic construct
  misc_feature 1..3495: note = derived and/or modified CDS sequence (opt3) from CCHVF(CCHVF C-68031)__DQ211629.1__Gn-NSm-Gc
  source 1..3495: mol_type = other RNA
agcgaggaatccggcgacgattgcatctctagaacccagctgtcaaggacagagactgccgaaattcacagtgacaactacgggggacccggtgataagataacgatctgtaatggcagcaccattgtggaccaacggctcgggtccgagcttggatgctatacaatcaaccgcgtcaaatctttcaagctgtgtgaaaattcggctactggcaaatcatgcgagattgatagcacccctatcaagtgtcgacagggtttttgcttgaaaataacacaggaggggcgtggacatgttaagttaagtagaggctccgaagtggtactggacgcatgtgattctagctgcgagatcatgattccaaagggcaccggggacatcctagtggattgttccggaggtcagcaacacttcctcaaagacaacctgattgatcttggctgcccgaatatccccctgttggggaagatggccatatacatttgtaggatgtcaaaccatcctaaaactacaatggcgtttctcttctggtttagtttcggatatgtcatcacatgcattctgtgcaaggtgatcttttacctgctcatcgttgtgggcacgttaggtaaaaagttcaagcagtatcgggaactgaaaccacagacttgtaccatttgcgagacaactcccgtcaatgctatagacgccgagatgcacgatcttaactgtagctacaatatctgcccttattgtgcatctcgcttgacctccgacgggctggccagacatgtgatgcagtgcccaaagaggaaagaaaaggtagaggaaacagagctatacctcaacctggaacggattccctgggttgtgcgcaaacttctgcaagtctcagagagcaccggagtggctttgaagcgaagttcttggctcgtggtcctgttagttctgctcacggtgtcccttagccctgtacagtcggcaccaatcggccacggcaaaactgtggagacataccagaccagagaagggtatacttctatatgtctgtttgtcttgggatccattctattcatcgtgtcatgcctgatgaagggtctcgttgacagtgtgggcaatagctttttcccggggctgtccatctgtaagacatgctctattggaagcatcaacggctttgagaccgaatcacacaaatgttactgcagtcttttctgctgtccctattgcaggcattgttccgccgatcgggagattcacaagctgcatttgagcatatgcaaaaagcgtaaaacgggttctaatgtcatgctcgctgtgtgtaagcgcatgtgcttcagagccaccgtagaagtttcaaacaaggcgctgttaatcaggaatattatcaacacaacttttgtggtctgtatcctgattctagcagtgtgcgtcgtgagtaccagcgccgttgagatggagtccctccctgctgggacatgggaacgggaggaagacctgactaacttctgtcaccaggagtgccaagtgaccgaaacagagtgtctttgcccatacgaggccttggtactgcgaaaacccctcttttctgattcgatagtcaagggcatgaaaaatctgcttaacagcacctccctggaaacttcattgagtatcgaggcaccttggggagctattaatgtgcagtctacgttcaagccaacagttagcgccgcgaacatcgccctctcctggtcaagcgtggaacaccgcggcaataaaattctggtctctgggagatccgagagtatcatgaagttagaggaaaggaccggaataagctgggacctgggtgtggaggatgcatctgaatccaagctactcactgtatcaatcatggacctgagtcagatgtatagccccgtgtttgagtacctttcgggcgatcggcaagttgaagagtggccgaaagctacctgcacaggggactgtcctgagcgctgcggatgtacctcctctacttgcttgcataaggaatggccccacagcagaaactggaggtgtaatccaacatggtgctggggcgtcggtacggggtgtacctgctgtggcctggatgtgaaagacctcttcactgattatatgtttgtgaagtggaaagtcgagtacattaagacagaagccatcgtttgcgtggagctgacctcacaggaacgtcagtgtagtttaattgaggctggaacacggttcaacctgggccctgtgactatcaccctttccgagccccgaaatatacagcaaaagttgccacccgaaattgtaacgctccatcctagaatcgaggaagggtttttcgacctgatgcacgtcaaaaaggtgctatctgccagcaccgtttgcaaactgcagtcctgcacacatggagtgccaggtgacctccaggtctaccacattggcaacctgcttaagggggataaagtgaatggacacttgatccataagatagagccgcactttaacacttcatggatgagctgggacggctgtgatctggactattactgcaatatgggtgattggcccagttgttcttataccggggttacacagcataaccacgcagccttcgtgaatatgttaaacatcgaaactgactacaccaaaatttttcacttccattccaagagggtaacggctcacggcgatacacctcaactcgacctgaaggcgcgcccaacctatggagcaggcgagatcactgtccttgtggaggtggccgatatggaactgcataccaaaaagattgagatcagcgggttgaaattcgcttcgcttacctgcactggatgttacgcctgctcatctggcataagttgtaaggtccggattcacgttgacgaacccgatgagctgaccgtgcatgtaaaatccgaggaccctgatatcgtggcagccagctctagcctaatggctagaaagctggaatttggtacagactccacgttcaaggccttttcagcaatgccaaaaaccagtctctgcttctatatcgtcgagagggaatactgtaagagctgctctaaagaggacactcagaagtgtgtgaacacaaaactggaacagccccagtccattcttatcgagcacaaggggaccattataggaaagcaaaatgatacatgcacttcaaaagcgggctgctggttggagagtgttaagagctttttctacggtctgaaaaacatgttatccggcatctttgggaatgtgttcattggaatctttctcttcctggctccgtttattcttctgatcctattctttatgttcggctggcgcatactcttctgttttaagtgctgtcgacggacccgtgggctgttcaaatatagacacttgaaggacgatgaagagacgggatacaggaagatcattgaacgcctgaacaataaaaagggcaaaaacaagttactcgacggtgagcggctggccgatagaaaaatcgcagaactcttttctacaaagacccatattggg

SEQ ID NO: 10467 - RNA, 3495 nt, synthetic construct
  misc_feature 1..3495: note = derived and/or modified CDS sequence (opt3) from CCHVF(CCHVF Drosdov)__DQ211630.1__Gn-NSm-Gc
  source 1..3495: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgaggtcatgataccgaaaggcactggggatatcctcgtggactgtagtggaggtcagcaacacttcctgaaggataaccttattgacctgggctgcccccatatccctttgctcgggaaaatggccatttacatctgtagaatgtccaatcacccaaggacaaccatggcgtttctgttctggttttctttcggatatgttataacgtgcatcttttgcaaggctctgttctacagcctcattattatcggcactttaggtaaaaagatcaagcagtatcgggaactgaaaccccagacctgtacaatttgcgagactgcccctgtgaacgcaatagatgccgagatgcatgaccttaagtgttcctacaatatctgcccatattgtgcttcacgcttgaccagtgacgggctggcaagacacgtcacacagtgccccaaaaggaaggaaaaagtggaggaaaccgagctatacctcaacctggaacggattccttggatcgtacgcaagctgctgcaagttagcgagtctacgggagtggccttgaaacgatcctcatggctcatagtcctgttagtgctgctcactgtgagccttagtccagtccagtctgctccggttggccacggcaagacaattgagacctaccagactagagaagggtttacatccatctgtctgttcatgttgggaagcatcctatttattgtgtcgtgcctggtaaagggtctcgtggattctgtctccgactcattctttcccggcctgagtgtgtgtaaaacctgcagcatcgggtccattaatggattcgagatagaatctcataagtgttattgcagccttttctgctgtccttactgcaggcactattcagccgatcgggagatccatcagctgcacttgagtatttgtaaaaagcgtaaaacgggctccaacgttatgctcgcggtgtgcaagcgcatgtgttttaaggcaaccatcgaagccagcagaagggctctgttaatccggtctattataaatacaactttcgtcatctgcattctgatcctagccatttgtgtggtatcaaccagtgcagttgagatggagaacctcccagctggtacatgggaacgagaggaagacctgactaatttttgccaccaagagtgtcaggtgaccgaaacagagtgcctttgtccctacgaggccttggtcctgcgcaaacctctcttcctggatagcaccgtgaaggggatgaaaaaccttcttaattccacttctttggaaacgtcgctcagcatcgaggcgccatggggcgccataaacgtccagtccacatttaagcccaccgtgtcaactgcaaacatcgctctgagttggtctagcgttgaacatagaggaaataaaattttagtgaccggcaggtccgagtcaatcatgaagctggaggaacggacaggggtaagctgggacctaggagtcgaggatgcctctgaatccaagctcctgaccgtgagtattatggaccttagccaaatgtattctccggttttcgagtacttgtccggtgatcgccaggtggaagagtggcctaaagctacttgcacaggcgactgccccgagagatgtgggtgcacgtcaagtacctgtctgcacaaggaatggccacatagcaggaactggcgttgcaatcctacttggtgttggggagtcggcacaggttgcacctgttgcggggtggatgtaaaagacctctttacagaccacatgttcgtgaagtggaaagttgagtatatgaagactgaagccatcgtctgtgtggagctgacctcgcaggaacggcagtgctccttaatagaggcaggcacgcgatttaacctgggacccgtgaccattacactttctgagccaagaaatatccaacagaagttgccccctgaaattatcactctccatccaaaaatagaggaaggcttctttgatctgatgcacgtccagaaggttctaagcgcctcaaccgtgtgtaaactgcagagttgcacacacgggatcccgggagacctccaaatttaccatatcggtaacctgcttaagggcgatagggtgaatgggcacttgattcataaaatcgagccccacttcaacacttcctggatgtcttgggacggatgcgatctggactactattgtaatatgggcaactggcctagctgcacctacacgggtgtaacacagcacaatcatgctgcgtttgtcaacttactcaatatagaaaccgattatactaagacattccacttccattccaaacgcgtgaccgcacacggggacactccacagctggatcttaaggcccggcccacctacggcgctggagagattacagttctggtggaggtcgccgacatggaattgcatacgaagaaagtggagatctcaggcctcaagtttgcaagcctggtttgtaccgggtgctatgcctgtagttctggaatctcctgcaaagtgaggattcacgtagatgaacctgacgagctaactgtccacgtcaagagctcggatccagacgtggtggctgcctcaacatctctgatggcaagaaaactcgagttcggcaccgacagtatctttaaggcgttctccgctatgcccaagacaagcctgtgtttttacattgttgaacgcgagtattgcaaatcttgtagcgaagatgacactaagaaatgcgtggataccaaacttgagcagccgcaatccatattgatcgaacataaaggtacgattatcgggaagcagaacgacacatgtaccgccaaggcatcatgctggctggagagtgtaaagagcttcttttacggattaaagaatatgctcggctctgtgttcggtaactttttcgtcggcattctgctttttctggcccctttcgtgctactcgttctgtttttcatgttcgggtggaaaatcttgttttgcttcaagtgttgccgacggactcgtggactgtttaaatacagacacttaaaggatgacgaggaaaccggctataggcgcataatcgagcggctcaactccaagaaagggaagaatagactgcttgatggagaaaggctggctgaccgaaaaattgccgagttgttctcaacaaagactcatatcggc

SEQ ID NO: 10468 - RNA, 3495 nt, synthetic construct
  misc_feature 1..3495: note = derived and/or modified CDS sequence (opt3) from CCHVF(CCHVF Kashmanov)__DQ211631.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaaaagatcctcatggctcatagtcctgttagtgctgctcacggtgagccttagtccggtccagtctgctcccgttggccacggcaagactattgagacataccagaccagggaagggtttacttccatctgtctgttcatgttgggaagcatcctatttctggtgtcgtgcctcgtaaaaggtctggtggattctgtctccgactcattctttcctggccttagtgtgtgtaagacatgcaccattgggagcatcaacggattcgagattgaatcccataagtgttattgctctctgttctgctgtccatactgccggcactgtagcgccgatcgtgagatacatcagttgcacctctcaatctgcaaaaagcgcaaaacgggcagtaatgttatgctggcggtgtgtaagagaatgtgctttagggcaaccattgaagcctcccggcgagctttactgatccgcagcatcattaacacaactttcgtcatatgtatcctaaccctcacaatttgcgtggtatctacttcagccgttgagatggagaatctgcccagtggtacctgggaaagagaggaagaccttacaaacttttgtcaccaagagtgccaggtgaccgaaactgagtgtttgtgcccttatgaggcactggtcctcaggaaaccactgttccttgatagcatcgtgaaggggatgaaaaattccctgaactctacgtcgttggaaacaagcctctccattgaggctccctggggcgccatcaacgtccagtcaacctttaagccgactgtgagtaccgcgaatatagccctgtcttggagctccgttgaacatcggggaaacaagatcttagtgacaggccgctcagagagcattatgaaactggaggaaagaaccggggtatcttgggacctaggagtcgaggatgcatccgaaagtaagctcctgactgtgagcatcatggacctttctcaaatgtactcccctgttttcgagtatttgtcaggtgatcgtcaggtggaagagtggcccaaagctacatgcacgggcgactgtccagagaggtgcgggtgtaccagtagcacttgcctgcacaaggaatggcctcattcgcggaattggcgatgtaaccccacatggtgctggggagtcggcaccggttgtacatgctgtggggtggatgtaaaggacctctttactgaccacatgttcgtgaaatggaaggttgagtacattaaaaccgaagccatcgtctgcgtggagctgacgtcccaggaaagacagtgttctttaatagaggctggcaccaggtttaatctgggaccagtgacaattactcttagcgagccccgcaacatccaacagaagttgcctccagaaattatcaccctccatccgaaagtcgaggaaggcttctttgatctgatgcacgttcagaaggtgctatcagccagtacagtgtgcaagctgcagtcctgcactcacgggatacccggagacctccaagtatatcatatcggtaatctgcttaaaggcgatcggattaacgggcacttgatccataagattgagcctcacttcaatacctcttggatgagctgggacggatgtgatctggactactactgcaacatgggcgattggccatcctgtacgtatacaggtgtcacccagcacaatcatgcagcctttgtgaacttactcaatatcgaaactgactacacaaaaaccttccacttccattcaaagagagttactgctcacggggatacaccccagctggaccttaaagcgaggcctacctatggcgcaggagagataacggtgctggtcgaggtggccgatatggaattgcataccaagaaagttgagattagcggcctcaagtttgctagtctggcctgcactgggtgttacgcatgttcttccggaatcagctgcaaggtgcgcatccacgtagacgaaccagatgagctaacagtccacgtgaaatcgtcagaccccgacgtggtcgccgcttctaccagtctgatggcccgaaagctcgagttcggcacagattccacttttaaagcattcagcgcgatgccgaagacctctctgtgcttttatattgttgaacgggagtactgtaaaagctgctccgaagaggacacgcagaagtgtgtggatacaaaacttgaacaacctcagtcaatcttgattgagcataagggtaccataatcgggaagcagaacgacacttgcaccgctaaagccagttgctggctggagagcgtaaagtctttcttttatggattaaagaatatgctcggctccgtgttcggtaactttttcattggcatcctgctttttctggcaccattcgtcctactcgtgctgtttttcatgttcgggtggaagattttgttttgtttcaagtgctgtcgtagaacaaggggactgttaaaataccgccacctcaaggatgacgaagagactggctaccggagaatcatagaaaggctgaacaataaaaaggggaaaaaccgacttctggatggagagcgcttggccgaccggaagatcgctgaactcttttcaaccaagacacatattggc

SEQ ID NO: 10469 - RNA, 3495 nt, synthetic construct
  misc_feature 1..3495: note = derived and/or modified CDS sequence (opt3) from CCHVF(CCHVF Oman)__DQ211632.1__Gn-NSm-Gc
  source 1..3495: mol_type = other RNA
agcgaggaatccggcgaggactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaagagcttcaagttgtgtgaaaattccgctactggtaaatcttgcgagattgacaacacccctgttaagtgtaaacaggggttttgcttaaagatcacacaggaaggacgaggccatgtgaagctgtcgcgtgattcagaggtagtgctagacgcatgtgatagcagttgcgaaataatgatcccaaaaggcaccggggacattctcgtcgattgttccggaggtcagcaacacttcctgaaggacaatcttatcgatctgggctgcccgaacattcccttgctcgggaaaatggccatctacatatgtagaatgtctaatcatcctaagactacaatggcgtttctgttctggtttagcttcggatatgtgattacctgcatcctgtgcaaagttattttctacctcttaatcgtggtcggcacgctgggtaagaagttcaaacagtatagggagcttaagccacagacttgtaccatctgcgagacaactcccgtgaacgctattgacgccgaaatgcacgatttgaattgttcctacaacatatgcccttattgtgcatcacggctgaccagtgacgggctagcccgccatgtaatgcagtgcccaaaaagaaaggagaaaatcgaagagacagaactctacctgaatcttgagaggattccctgggttgtgcggaagctgttgcaagtcagcgagtctaccggagtggctctcaaacgctcctcatggctgatcgtgttactggtcctccttacggttagcctgagtcctgtgcagtctgcaccaataggccacggcaagactattgaaacataccagacccgagaggggtatacttccatctgtttgtttgtactaggaagcatcctgttcattgtgtcgcacctcatgaagggtctggtcgactctgtgggcaactcctttttcccggggctttcaatctgcaaaacatgtagtattggaagcataaatggctttgaaatcgagtcccataagtgcttctgttctctgttctgctgcccctactgtagacactgcagcgccgataaagaaattcataagttgcacctctcaatctgtaaaaagaggaaggctggtagtaacgttatgctggccgtgtgcaaacggatgtgttttcgtgcgaccatggaggtctccaataaggcattactgatccgcagcgtgattaacacgaccttcgtagtttgcatactaatcctcgccgtgtgtgtcgtgtctacatcagctgtcgagatggaaagtctgcctgccgggacttgggagagagaagaggaccttaccaacttttgccaccaggaatgtcaagtgacagagactgagtgcttgtgtccatatgaagcactggttctcaggaaacccctgttccttgatagcattgctaagggcatgaaaaatctgttgaactccacctctctcgagacatcgctgagcatcgaagccccttggggagcgattaatgtgcagtccacctttaagccaactgtatcaacggccaacatcgcattaagttggtctagcgtcgagcatcggggcaataagatactggtgtccgggcgatcagagagcatcatgaaactagaggagcgcacaggaatttcttgggacctcggtgttgaagatgcttccgagagtaagctgcttaccgtgagcgtcatggacttgtctcagatgtactcccccgtgttcgaatatctgtcaggcgatagacaagtagaggagtggccgaaagccacttgcaccggggactgccctgaaaggtgtggatgcacaagtagcacctgtctccacaaggagtggccccattcgcggaactggcgctgcaatccaacttggtgttggggcgtgggtacagggtgcacgtgttgcggcctggatgttaaagacttatttaccgattacatgttcgtcaagtggaaggtggaatatatcaaaactgaggctattgtgtgtgtcgaactgacatcccaggagagacagtgctctcttatcgaggccggaaccaggtttaacttgggccctgttacaataactctcagcgaaccccgtaatattcagcaaaagctgccacccgagatcgtgaccctacaccctcggattgaagaggggttctttgacctgatgcatgtgcagaaagtactctcagcaagtacggtctgtaagctgcagtcctgcacccacggagtgccaggtgaccttcaggtttaccacatcggcaacttgctgaaaggggataaggtgaatggacatttaatacacaaagtcgaaccgcatttcaacacatcttggatgagctgggacggctgcgatctcgactactattgtaatatgggtgattggccctcctgcacttacaccggggtgacacaacacaaccacgccgcttttgttaatctgcttaacatcgagactgactataccaagaacttccatttccactcaaagcgagtgacggcgcatggcgatacacctcagctggacttgaaagcaagaccaaattacggagccggcgaggtaaccgtcctcgtggaagtggctgatatggagctgcacactaagaaaattgaaatcagcgggctaaagtttgccagtctgacatgtaccggatgctatgcatgttcttccggcattagctgcaaagtcaggatccatgttgacgagcccgatgagctcactgtgcacgtaaagtcggaagaccctgatatagtggccgcttcatctagtctgatggcccgcaaacttgagttcggtaccgactccacatttaaagcattcagcgcgatgccaaagacgtctttgtgtttttacattgtcgaacgggagtattgcaaaagctgttccaaggaagacacccagaaatgcgtgaacgctaagctggagagaccccagtcaatcttaatcgagcacaaggggactattatcggaaaacaaaatgatacatgtaccgccaaggcaagttgctggctcgaaagcgttaaatctttcttttacggcctgaagaacatgctttccggtattttcggcaatgtgtttatagggatcttcctgtttctagccccgttcattctcctgatcttgtttttcatgttcggatggaggattctgttttgcttcaaatgttgccgccgaacacggggcttatttaagtaccgtcatctcaaggacgatgaggaaactgggtatagaaaaatcatagagaggctgaacaataagaaaggaaagaacaaacttctggacggcgaacgcttggctgatcggaagatcgccgagctcttttcaaccaaaacgcacattggt

SEQ ID NO: 10470 - RNA, 3495 nt, synthetic construct
  misc_feature 1..3495: note = derived and/or modified CDS sequence (opt3) from CCHVF(CCHVF SPU97/85)__DQ211633.1__Gn-NSm-Gc
  source 1..3495: mol_type = other RNA
agcgaggaatccgacggcgattgcatctctagaacccagctgctcaggacagagactgccgaaattcactcagacaactacgggggacccggtgataagataacgatctgtaatggcagtaccattgtggaccaacggcttgggagcgagctgggatgctatacaatcaaccgcgtcaaatccttcaagttgtgtgaaaattctgctactggcaaatcgtgcgagattgattcaacccctgttaagtgtcgacagggtttttgcttaaaaatcacacaggaggggcgtggacatgtgaagctgagcagaggcagtgaaatagtactagacgcatgtgattcctcttgcgagatcatgattccaaagggcaccggggacatcctcgtggattgtagcggaggtcagcaacacttcctgaaagacaaccttattgatctgggctgcccgaatatccccttgctcgggaggatggccatatacatttgtcggatgtccaaccatcctaagactacaatggcgtttctgttctggttttcattcggatatgtcatcacatgcattctgtgcaaagtgatcttttacctcttaatcgttgctggcacggtgggtaagaaattcaagcagtatcgcgaactgagaccacagacttgtaccatttgcgagacaactcccgtcaatgccatagacgcagagatgcacgatcttaactgtagttacaatatctgcccttattgtgccagcaggttgacctctgacgggctggctcggcatgtgatgcagtgcccaaagcgcaaagaaaagattgaggaaacagagctatacctcaacctggaacgaatcccctgggtagttagaaaacttctgcaagtgtccgagtcaaccggagtcgcattgaagaggagcagttggctcacggtgctgttagtgctgctcatagtctctctttcccctgttcagagcgccccaattggccacggcaaaactatcgagacataccaggctcgggaagggtatacctcgttttgtctgttcatcttgggatctattctatttatcgtgtcctgcctggtaaagggtctcattgactcagtgggcaatagtttctttccggggctgagcatatgtaaaacttgctccatcggatctgtcaacggcttcgagattgaaagccacaagtgttactgctcacttttctgctgtccctattgccgtcattgtagtgccgatcgcgagatccacaagctgcatttgtccatctgcaaaaagagaaaaacaggtagcaatgtgatgctcgcggtttgtaagaggatgtgctttcgggcaaccattgaagtgtctaaccgagccctgttaatacgctcaatcattaatacgaccttcgctgtctgtatcctgacactagccgtgtgcgtagttagtactagcgcagtggagatggagtccctccctgctgggacctgggaaagagaggaagacctgacaaacttttgtcaccaggagtgccaagtcactgaaaccgagtgtctttgcccatacgaggccttggtgctgaggaaacccctcttcctggattctattgtcaagggcaagaaaaaccttctgaatagcacatcgttggaaacctccctctcaatcgaggcgccttggggagccataaacgtgcagagtacttttaagccaacggtttctgcagctaatatcgccctgagctggtcctcagtggaacaccggggcaacaaaattttagtaagcgggcgctctgagtccatcatgaagctggaggaaagaacaggaattagttgggacctaggtgtcgaggatgctagcgaatctaaactcctgaccgtgtccgttatggacctttcacagatgtatagtcccgtgttcgagtacttgagcggcgataggcaagtcgaagagtggccgaaggccacttgcaccggggactgtcctgagcgttgcggatgtacatcgtctacctgcctgcataaggaatggccccactcccggaattggcgatgtaacccaacttggtgctggggcgtgggtacagggtgtacgtgctgtggcctcgatgtaaaagacctgtttaccgattatatgttcgtgaagtggaaagttgagtacatcaagactgaagcaatagtctgcgtggagttaacaagccaggaaagacagtgttcactgattgaggccggaaccaggtttaatcttggccctgtgacaatcactttgagtgagccccgcaacattcagcaaaaactcccacccgaaatcataaccctgcatcctcggatcgaggaagggttctttgacctaatgcacgtccagaaggttctgtccgcttctacggtgtgcaagctccagagctgcacccatggagtgccaggtgacctgcaggtataccacattggcaatcttttgaaaggggataaggtcaacggacacctgatccataaaattgagccgcacttcaatacatcctggatgtcatgggacggctgtgatttagactattactgcaacatgggtgattggcccagctgtacttataccggggtgacacaacataatcacgcggcatttgttaacctcctgaatatcgaaactgactacaccaagaacttccacttccatagtaaaagagtgacggcccacggcgatacacctcagcttgacctgaaggctaggccaacctatggagccggcgaggtcactgtgttggttgaggtggcagatatggaactccataccaaaaagatagagatttctgggctgaagtttgcctccctaagctgcaccggatgttacgcttgctcgtcaggcatctcttgtaaagtacgcatccacgtcgacgaacccgatgagctgactgtgcatgtgaagagtgaggaccctgatattgtcgccgcaggttccagcctcatggcgcgaaaactggagttcggggctgactctacctttaaggccttcagcgcaatgccaaaaacatccctttgcttttatatcgttgaacgggaatactgtaagtcatgcagtcgtgaggacacgcagaagtgtgtgaacaccaaattggaaagaccccagagcattctgatagagcacaagggaactatcattggcaaacaaaatgatacatgcaccgccaaggcttcttgctggttagagtccgtaaaatcattcttttacggtctcaagagtatgctgagcggcatcttcgggaacgtgtttattggaatcttcctttttatagccccgttcgtcctgctaatcctctttttcatgttcggctggaggattctgttttgtttcaagtgctgtcgccggacaagagggttgtttaaatataggcacctgaaggacgatgaagagactggataccgaaaaatcattgaacgcttaaataacaagaaaggcaagaataagctcctggacggtgagcggcttgcagatagaaaaatcgctgaactgttctccaccaagtctcatataggg

SEQ ID NO: 10471 - RNA, 3495 nt, synthetic construct
  misc_feature 1..3495: note = derived and/or modified CDS sequence (opt3) from CCHVF(CCHVF SPU103/87)__DQ211634.1__Gn-NSm-Gc
  source 1..3495: mol_type = other RNA
agcgaggaatcctctgacgattgcatctcaagaacccagctgctcaggacagagactgccgaaattcacggcgacaactacgggggacccggtgataagataacgatctgtaatggcagtaccattgtggaccaacggcttgggagcgagctgggatgctatacaatcaaccgcgtcaaaactttcaagttgtgtgaaaattccgctaccggcaaatcttgcgagattgattcggttcctgtgaagtgtcgacagggttactgcttaaaaatcacacaggaggggcgtggacatgtaaagctgtcaagaggcagcgaagtggtcctagacgcatgtgataccagttgcgaggtgatgataccaaagggcactggggacatcctcgttgattgttccggaggtcagcaacactttctgaaagacaaccttattgatctgggctgcccgaagatccccttgctcgggaaaatggccatttatatctgtaggatgtctaatcatcctaagacaaccatggcgttcctgttttggttcagctttggatacgtgataacgtgcgtcctgtgcaaagctattttctatctcttaatcattgtgggcactctgggtaagcggcttaagcagtaccgcgaattgaaaccacagacctgtacaatctgcgagactacccccgtaaacgccatcgacgcagagatgcacgatctgaattgttcctataacatttgcccttactgtgcctcaagactaacaagtgacgggctcgctaggcatgttacccagtgcccaaagcggaaagaaaaggtggaggaaacggagctgtaccttaatctggaacgcataccctgggtcgtgcgaagattgctccaagtgagcgagtctactggagtcgcactgaaaaggtcctcatggttaatcgttctgctcgtgctttttacagtaagcctgagtcctgtgcagtctgccccaatttcccacggcaagaccgtcgaggcttatcaggcccgggaaggctacactgggatgtgtttgttcgtgctaggaagcatcctgtttctcgtttcgtgcctgatgaaaggtcttgtggactctgtcggcaacacattctttccggggctgtccatatgtaagacctgctcaattagtagcatcaatggattcgagatcgaatcccaccgttgttattgctctttgttttgctgtccctactgccgccattgtagcgcgaacaaggagattcaccagctccatctgtcaatctgcaaaaagagaaaaacgggcagtaatgtgatgttagcagtatgtaagaggatgtgcttccgggccaccatggaagtttccaaccgagctctgttcattcgcagcataatcaatacaacttttgtgctatgtattctcatcctggccgtctgcgtggtctctacctcagcagtggagatggagagtcttcctgctggtacatgggaaagagaggaagatttgactaacttctgtcaccaagagtgccaggttaccgacacagaatgtctgtgcccatatgaggccctcgtgctgaggcggcccctttttctggataacatcgtaaaagggatgaagaatttgctcaacagcacctccctggagacttctttatcgattgaagcgccttggggcgccataaatgtccagagcacgtacaagccaacagtgtccaccgcaaacatcgctctgtcatggagttctgttgagcaccgcggaaataaaattctagtgagcggcagatccgaatcaatcatgaagctcgaggagaggactgggattagctgggacctgggagtcgaagatgcctctgagtccaaacttttgaccgtgagtgtaatggacctgagccaaatgtattctcccgtgttcgaatacctctccggtgatcgtcaggttgaggaatggccgaaggctacatgcaccggcgactgtcctgagcggtgcgggtgtacttcaagtacatgcctgcataaagagtggccccacagccgaaactggagatgtaatccaacgtggtgctggggagtcggcaccggttgtacttgctgtgggttagatgtgaaggacctgtttacagattacatgttcgtgaagtggaaaatcgaatatataaagaccgaggccatcgtctgcgttgaacttacatcgcaggagaggcagtgttccttgattgaagcaggcactcgctttaacctcggacctgtgaccatcacgctgtctgagccccggaatattcaacagaaactaccaagcgagatcataaccctgcatcccagaattgaagagggcttctttgacctcatgcacgtgcagaaggtactgtcagccagtacagtctgcaaacttcagtcctgcactcatggggtgcctggagacttgcaagtttaccacatcggtaacctgttaaagggcgataaggtgaatgggcacctcgtccataaaattgaaccacacttcaacacctcttggatgagctgggacggatgtgatctggactattactgcaatatgggcgattggccgtcctgtacatatactggtgtgacccagcataaccacgcttcatttgttaatcttctgaacatcgagacggactacacaaagaacttccactttcatagcaaaagggtgaccgcgcacggggatactccccagttggacctcaaggcacgccctacatatggcgccggagaaataaccgtactggtcgaggtggctgatatggagctacatactaaaaagatcgaaattagtggcctgaaattcacctctctcacatgcacggggtgttacgcctgctccagcggaatctcgtgtaaggtgcggattcacgtcgacgagccagatgaactgaccgttcatgtgaagtcagacgatcccgacgtagtggcagcctctagttcccttatggctcgaaaattggagttcggcactgacagcacatttaaggccttctctgcaatgcctaaaaccagcctgtgcttttacatcgtcgagcgtgaatattgtaagtcctgctcagaggaagatacacagaaatgtgtgaatactaagttagagcaaccacagagtatactcattgaacacaagggtaccatcatcgggaaacagaacaatacgtgcaaggcgagagctggatgctggctggagagcgttaaatctttcttttacggccttaagaacatgctgtccggtattttcggcaatgtgtttatcgggattttcctatttctcgcccccttcatactgttgatcctgtttttcatgtttggatggaggattttattctgtttcaaatgctgtcgccggacaagaggcctctttaagtataggcacctgaaggacgatgaggaaaccgggtaccgaaaaatcattgagcgccttaacaataagaaaggaaagaacaaactgttggacggcgaacggctcgcagatagaaggatcgccgagctgttctcaactaagacccatataggt

SEQ ID NO: 10472 - RNA, 3495 nt, synthetic construct
  misc_feature 1..3495: note = derived and/or modified CDS sequence (opt3) from CCHVF(CCHVF SPU415/85)__DQ211635.1__Gn-NSm-Gc
  source 1..3495: mol_type = other RNA
agcgaggaatccgacggcgattgcatctctagaacccagctgctcaggacagagactacggaaattcactcagacaactacgggggacccggtgataagataaccatctgtaatggcagtacaattgtggaccaacggcttgggagcgagctgggatgctatactatcaaccgcgtcaaatccttcaagttgtgtgaaaattctgccaccggcaaatcgtgcgagattgattcaacacctgttaagtgtcgacagggtttttgcttaaaaatcacccaggaggggcgtggacatgtgaagctgagcagaggcagtgaaatagtactagacgcttgtgattccaactgcgagatcatgattccaaagggcactggggacatcctcgtggattgttctggaggtcagcaacacttcctgaaagacaatcttattgatctgggctgcccgaacatccccttgctcgggaagatggcaatatacatttgtaggatgagcaatcatcctaaaacaaccatggcctttctgttctggttttccttcggatatgtcatcacgtgcattctgtgcaaggtgatcttttacctcttaatcgttgcgggcactgtgggtaaaaagttcaagcagtatcgggaactgcgcccacagacctgtacaatttgcgagactatacccgtcaacgctatcgacgccgagatgcacgatcttaattgttcatacaacatttgcccttattgtgcaagtagattgaccagcgacgggctggccaggcatgtgatgcagtgcccaaaacggaaggaaaaagtagaggaaacagagctatacctcaatctggaacgcatcccctgggttgtgcgaaaacttctgcaagtctctgagtccaccggagtggctttgaaaagatcaagctggctcacggtgctgttagtcctgctcatagttagtctttctcctgtgcagtccgcaccaattggccacggcaagactatcgagacataccaggccagggaagggtataccagcttttgtctgttcatcttgggatcgattctatttgtagtgtcttgcctggtcaaaggtctcatcgactccgtgggcaactcattctttccggggctgagtatttgtaagacttgcagcataggatccatcaatggcttcgagattgaatctcacaagtgttactgcagccttttctgctgtccctattgccggcattgttcagctgatcgtgagatccacaaactgcatttgagtatctgcaagaaacgcaagacaggttccaacgttatgctcgccgtgtgtaaaagaatgtgctttagggcgaccattgaagtcagcaatcgggcactgttaatacgaaacatcattaacacgaccttcgtggtatgtatcctgacactagccgtttgcgtggtctctacttcagctgtggagatggagagtctccctgccgggacctgggaaaaggaggaagacctgacaaatttttgtcaccaggagtgccaagtcactgaaaccgagtgtctttgcccatacgaggcattggtgctgcgcaagcccctcttcctggatagcattgttaaaggcatgaagaaccttctgaactccacatctttggaaacctcgctcagcatcgaggctccttggggagccataaacgtgcagtccacttttaaaccaacggtatcagcggccaatatcgcactgagttggtctagcgtcgaacacagaggcaacaagattttagtgtccgggaggtcagagagcatcatgaaactggaggaacggacaggaatttcttgggacctaggtgttgaggatgcttccgaaagtaagctcctgaccgtgagcgtcatggacctttctcagatgtattcccccgtgttcgagtacttgtcaggcgatcgccaagtagaagagtggccgaaggccacttgcaccggggactgtcctgagagatgcggatgtacaagttctacctgcctgcataaagaatggccccactcgaggaattggcgttgtaacccaacttggtgctggggcgtgggtacagggtgtacgtgctgtggcctcgatgttaaggacctgtttaccgattatatgttcgtcaaatggaaggtggagtacatcaaaactgaagctatagtgtgcgtcgagttaacatcccaggaacggcagtgttctctgattgaggccggaacccgatttaatcttggccctgttacaatcactttgagcgagcccagaaacattcagcaaaagctcccacccgaaatcataaccctgcatcctaggatcgaggaagggttctttgacctaatgcacgtgcagcgcgtgctgtcagcaagtacggtatgcaagctccagtcctgcacccatggagtcccaggtgaccttcaggtgtaccacattggcaatctgttgaaaggggataaggttaacggacacctgatccataaaattgagccgcacttcaatacatcttggatgagctgggacggctgtgatttagactattactgcaacatgggtgattggccctcctgtacttataccggggtgacacaacataatcacgccgcttttgtcaacctcctgaacatcgaaactgactacaccaagaatttccacttccattcaaaacgggtgacggcgcacggcgatacacctcagcttgacctgaaggcaagaccaacctatggagccggcgaggttactgtgttggtagaggtcgctgatatggaactccatacaaagaagatagagattagcgggctgaagtttgccagtctaacctgcactggatgttacgcatgcagctccggcatcagctgtaaagtgaagatccacgtggacgaacccgatgagctgaccgtccatgttaaatcggaggaccctgatattgtggccgctggttcatctctcatggccaggaagctggagttcggggcagacagtacatttaaagcgttctccgctatgccaaagacgagcctttgcttttatatcgtagaacgcgaatactgtaagtcttgcagccgagaggacacccggaaatgtgtgaacactaagttggatcgtccccagtccattctgatagaacacaaaggaacaatcattggcaagcagaataatacctgcacagccaaagcatcatgctggttagagagtgtcaagagcttcttttacggtctcaagaatatgctgtctggcatcttcgggaacgtgtttattggaatcttcctttttatagccccgttcgttctgctaatcctctttttcatgttcggctggaggattctgttttgtttcaaatgctgtagacgcactcgggggttgtttaagtatagacacctgaaagacgatgaggaaaccggatacaggaagatcattgagcgattaaataacaaaaagggcaagaataaactcctggacggtgaacgccttgctgatcggaagatcgccgagctgttctccacgaaatcacatataggg

SEQ ID NO: 10473 - RNA, 3495 nt, synthetic construct
  misc_feature 1..3495: note = derived and/or modified CDS sequence (opt3) from CCHVF(CCHVF Turkey200310849)__DQ211636.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgaggttgactccacaccagtgaagtgtcgacagggtttttgcttaaaaattacccaggaggggcgtggacatgtaaagctgtctagaggctcggaagtggtcctagatgcatgtgactcaagctgcgaggtgatgatcccgaagggcactggggatatactcgttgactgtagtggaggtcagcaacacttcctgaaagataaccttatcgacctgggctgcccccatattcctttgctcgggaagatggccatctacatttgtaggatgtccaatcacccacggacaaccatggcgtttctgttctggttttctttcggatatgtgatcacgtgcataagctgcaaagctctgttttactccctcattatcattggcactttaggtaagaaaatcaagcagtatcgcgaactgaagccccagacctgtacaatctgcgagactgcccctgtcaacgcaattgatgccgagatgcatgaccttaattgttcatacaacatatgcccatattgtgctagtagattgaccagcgacgggctggcaaggcacgtgacacagtgccccaaacggaaggaaaaagtagaggaaaccgagctatacctcaatctggaacgcatcccttggattgttcgaaaacttctgcaagtgtctgagtccacgggagtcgccttgaagagatcaagctggctcatcgtgctgttagtgctgctcactgtcagtctttctccagttcagtccgctccggtgggccacggcaagacaatagagatttaccagaccagggaagggttcgccagcatctgtctgtttatgttgggatcgatcctattcattgtatcttgcctggtgaaaggtctcgtcgattccgtgtcagacagtttctttcccggcctgagcgtttgtaagacttgctccatcgggtctgtgaacggatttgagattgaaagccataagtgttattgctcacttttctgctgtccttactgccggcactgtagtgcggatcgtgagatacatcagctgcacttgtccatctgcaaaaagcgcaaaacaggcagcaatgtcatgctcgcagtgtgtaagagaatgtgcttcagggccaccattgaagctagtcggcgagccctgttaatccgctcaatcattaacacgacctttgtaatatgtatcctgacactaactatttgcgttgtgagtaccagcgcagtcgagatggagaatctcccagctggtacatgggaaagagaggaagacctgactaacttctgtcaccaagagtgccaggtgaccgaaacagagtgtctttgcccctatgaggccttggtcctgaggaaacctctctttctggattccatcgtgaaggggatgaagaatcttctgaactctacctcgttggaaactagcctctccattgaggcgccatggggcgccatcaacgttcagtcaacgttcaaacccgcagtgagtacagctaatatagccctgtcttggagctccgtagaacatcggggaaacaagatcttagtcaccggccgctcagagagcattatgaaactggaggaaagaactggggtgtcttgggacctaggagttgaggatgcttccgaaagtaagctcctgaccgtgagcatcatggacctttctcaaatgtactccccggtctttgagtatttgtcaggtgatcgtcaggtggaagagtggcctaaagccacatgcaccggcgactgtcccgagaggtgcgggtgtacttctagcacatgcctgcacaaggaatggccacattcgcggaattggcgatgtaaccctacgtggtgctggggagtaggcaccggttgtacttgctgtggggtggatgttaaggacctcttcacagaccacatgtttgtcaaatggaaggtggagtacattaaaaccgaagcaatcgtgtgcgtcgagctgacatcccaggaaagacagtgttctttaatagaggccggcactaggttcaatctgggacccgttaccattacgcttagcgagccacgcaacatccaacagaagttgccccctgaaattatcaccctccatccaaaaatagaggaaggctttttcgatctgatgcacgtgcagaaggtgctatcagctagtacagtatgcaagctgcagtcctgcactcacgggatcccgggagacctccaagtctatcatattggtaatctgcttaaaggcgatcgggtgaacgggcacttgatccataagattgagtctcactttaataccagctggatgtcctgggacggatgtgatctggactactactgcaacatgggcgattggccctcatgtacatatactggtgttacccagcacaatcatgcggcattcgtgaacttactcaatatcgaaacggactacacaaaaacctttcacttccatagcaagagagtcactgcccacggggatacacctcagctggaccttaaagctaggccaacctatggcgccggagagataactgtgctggttgaggtggcagatatggaattgcataccaagaaagtagagattagtggcctcaagttcgcctctctggcttgcacagggtgttacgcctgctccagcggaatctcgtgtaaggtccgcatccacgtggacgaacccgatgagctaacggtgcacgtcaaatcatctgaccctgacgttgtggcagcgagtacctccctgatggctcgaaagctcgagtttggcactgatagcacattcaaagccttttctgcaatgccaaagaccagcctgtgcttctatattgtagaacgggagtactgtaaatcctgctcagaagacgatacacagaagtgtgtggacactcgtcttgagcaaccccagagtatcttgattgaacataagggtaccataatcgggaaacagaacgatacgtgcacagccaaggctagctgctggctggagtctgtcaaatcctttttctatggattaaagaatatgctcggctcagtgtttggtaacctgttcattggcatccttctgtttctagccccgttcgttctcctggtgttgtttttcatgtttgggtggaaaattctgttctgtttcaagtgctgtagaaggacccgcggattatttaagtaccggcacctcaaagacgatgaggaaactggctacagaaggatcatagagcgactgaacagtaagaaagggaagaatcgccttctggacggagatcggttggcagacagaaaaatcgctgaactcttcagcaccaagacacatattggc

SEQ ID NO: 10474 - RNA, 3495 nt, synthetic construct
  misc_feature 1..3495: note = derived and/or modified CDS sequence (opt3) from CCHVF(CCHVF Iran-52)__DQ446215.1__Gn-NSm-Gc
  source 1..3495: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgcgtagcttcaaattgtgtgaaaattccgctactggtaagtcttgcgagattgattcgatccctgtaaaatgtaagcaggggtactgcttaaaaattacccaggagggacgaggccatgtgaagctgtcaagaggcagcgaagtcgtgctagacgtttgtgatagttcctgcgaggtgatgatcccaaaggggacaggagacatactcgtcgattgttctggtggccagcaacactttctgaaagacaaccttgtggatctggggtgcccgaagatccccttgctcggaaaaatggcaatttatatctgtaggatgagcaatcatcctaagaccactatggccttcctgttttggttctcctttggctacgtaattacatgcatcctgtgcaaagcgatattctttctcttaattatcttcggtaccctggggaagcggtttaagcagtatcgcgaacttaaaccacagacgtgtactatttgcgagaccacacccgttaacgctatcgacgccgagatgcacgatttgaattgttcatacaacatctgcccttattgtgcaagtagactgactagcgacggactagccaggcatgtgacccagtgcccacggcgcaaggaaaaagtcgaggaaacagagctctacctgaatcttgaacgaataccctgggtggtgagaaagctgttgcaagtctctgagtccaccggcacggttctcaaaaggtcaagctggctgattgtgttactggtactcttcactgtgagtctttctcctgtccagtccgctccaatcggccacgggaagacaattgagacctaccgggtgcgtgaagagtatactagcatctgtctgtttgttttgggatcgatactattcattgtgtcttttctgatgaaaggtctcgtcgacggcgtggggaacatcttcttcccgggactgtccgtatgcaagacatgttcaatcggcagtattaatggttttgaaatcgagagccacaagtgctactgttcccttttctgctgcccctattgtcgccattgctctgcagatggggaaattcaccagctgcatttgagcatatgtaaaaagagaaaaaccggctcaaacgttatgctcgccgtgtgcaagaggatgtgttttcgggctacgatggaggtcagtaataaagccctgttcatccgatccattatcaacaccacatttgtggtctgcatcttaattctggcggtgtgtgttgtgagcacttctgcagtagagatggaatcactacctgccggaacctgggagcgcgaagaggacctcacaaatttctgccaccaggaatgtcaagtcactgagaccgagtgcctgtgtccatacgaagctcttgtgttgagaaggcccctgtttctcgatagtatagttaagggcatgaagaacctgcttaacagcacatccctggagacctctttgtcgatcgaagccccttggggagcaattaatgtgcagagcacttataaaccaacggtctccacagctaacatcgccctctcatggagttctgtggagcaccgggggaataaggtactggtgagcggtcgctccgagtcaattatgaaattagaagagagaaccggcatcagctgggacctgggggttgaagatgcgtctgagtccaagctactcactgtcagtgtgatggacctgagccagatgtactctcccgtgttcgaatatctttccggagataggcaagtcgaggagtggccgaaagcaacctgcacaggcgactgccctgaacgttgtggttgcacctcaagtacttgtttgcataaggagtggccccacagccggaactggcgatgcaatccaacatggtgttggggcgttgggacgggatgcacctgttgcggcctggatgtgaaggacctctttactgattacatgttcgtgaaatggaaggtagaatacataaaaacagaggccatcgtctgtgtggaactgacctcgcaggagagacagtgctccttaattgaggctgggacaaggtttaacctgggatctgttactatcacccttagcgaacctcgcaatattcagcaaaagttgcccccagagatcataacgctccatcccaaaattgaagagggtttctttgacctgatgcacgtgcagaaggtcctatcagccagtaccgtgtgtaagctgcagtcctgcacacatggcgttcctggggacctccaggtgtatcacatcggaaacctgcttaaaggcgatcgggtaaatggtcacttgattcataagatcgaacaacacttcaacacttcttggatgagctgggacgggtgcgatctggactactattgtaatatgggcgattggccatcctgcacctacacaggagtcactcagcataaccacgcttcattcgtgaatttactcaacatagagaccgactatacgaaaacatttcacttccatagcaagagagtgaccgcccacggcgatactccgcagctggaccttaaagcaaggcccacatacggggccggagagatcaccgtcctggttgaagtggctgatatggagttgcatactaagaaaattgaaatcagtggcctcaagtttgcgggtctgacctgtacagggtgctatgcatgttcttccggaattagctgcaaggtacgcatccacgtggaggagcctgacgaactaacggtccatgtgaaatcggatgacccagatgttgtggccgcttcatctagtctgatggcccgaaagctcgagttcggcaccgactccacttttaaagcattcagcgccatgcccaagacatctctgtgtttttacatagtcgaacgggagtactgcaaaagctgttccaaggaagacacccagaagtgcgtgaatacaaaacttgagcaacctcagtcaattttgatcgagcacaagggtactatcattggcaaacagaacaacacctgtacggctaaggccagttgctggctggaaagcgttaaatctttcttttatgggttaaagaatatgctcggaggcatcttcgggaacgtgtttattggaatattcacatttctgaccccattcatccttctgattctattctttatgttcggctggcgtatcctcttttgcttcaagtgttgcagaaggactcgcggtctgtttaaataccggcacttgaaggatgacgaggaaaccgggtatagaaaaattatcgagaggctgaataacaagaaaggaaagaatcgattactcgatggcgaacgcctggcagaccggaagatagcggagcttttctccacaaaaactcatatcggt

SEQ ID NO: 10475 - RNA, 3495 nt, synthetic construct
  misc_feature 1..3495: note = derived and/or modified CDS sequence (opt3) from CCHVF(CCHVF Iran-53)__DQ446216.1__Gn-NSm-Gc
  source 1..3495: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgcgtagcttcaaattgtgtgaaaattccgctactggtaagtcttgcgagattgattcgatccctgtaaaatgtaagcaggggtactgcttaaaaattacccaggagggacgaggccatgtgaagctgtcaagaggcagcgaagtcgtgctagacgtttgtgatagttcctgcgaggtgatgatcccaaaggggacaggagacatactcgtcgattgttctggtggccagcaacactttctgaaagacaaccttgtggatctggggtgcccgaagatccccttgctcggaaaaatggcaatttatatctgtaggatgagcaatcatcctaagaccactatggccttcctgttttggttctcctttggctacgtaattacatgcatcctgtgcaaagcgatattctttctcttaattatcttcggtaccctggggaagcggtttaagcagtatcgcgaacttaaaccacagacgtgtactatttgcgagaccacacccgttaacgctatcgacgccgagatgcacgatttgaattgttcatacaacatctgcccttattgtgcaagtagactgactagcgacggactagccaggcatgtgacccagtgcccacggcgcaaggaaaaagtcgaggaaacagagctctacctgaatcttgaacgaataccctgggtggtgagaaagctgttgcaagtctctgagtccaccggcacggttctcaaaaggtcaagctggctgattgtgttactggtactcttcactgtgagtctttctcctgtccagtccgctccaatcggccacgggaagacaattgagacctaccgggtgcgtgaagagtatactagcatctgtctgtttgttttgggatcgatactattcattgtgtcttttctgatgaaaggtctcgtcgacggcgtggggaacatcttcttcccgggactgtccgtatgcaagacatgttcaatcggcagtattaatggttttgaaatcgagagccacaagtgctactgttcccttttctgctgcccctattgtcgccattgctctgcagatggggaaattcaccagctgcatttgagcatatgtaaaaagagaaaaaccggctcaaacgttatgctcgccgtgtgcaagaggatgtgttttcgggctacgatggaggtcagtaataaagccctgttcatccgatccattatcaacaccacatttgtggtctgcatcttaattctggcggtgtgtgttgtgagcacttctgcagtagagatggaatcactacctgccggaacctgggagcgcgaagaggacctcacaaatttctgccaccaggaatgtcaagtcactgagaccgagtgcctgtgtccatacgaagctcttgtgttgagaaggcccctgtttctcgatagtatagttaagggcatgaagaacctgcttaacagcacatccctggagacctctttgtcgatcgaagccccttggggagcaattaatgtgcagagcacttataaaccaacggtctccacagctaacatcgccctctcatggagttctgtggagcaccgggggaataaggtactggtgagcggtcgctccgagtcaattatgaaattagaagagagaaccggcatcagctgggacctgggggttgaagatgcgtctgagtccaagctactcactgtcagtgtgatggacctgagccagatgtactctcccgtgttcgaatatctttccggagataggcaagtcgaggagtggccgaaagcaacctgcacaggcgactgccctgaacgttgtggttgcacctcaagtacttgtttgcataaggagtggccccacagccggaactggcgatgcaatccaacatggtgttggggcgttgggacgggatgcacctgttgcggcctggatgtgaaggacctctttactgattacatgttcgtgaaatggaaggtagaatacataaaaacagaggccatcgtctgtgtggaactgacctcgcaggagagacagtgctccttaattgaggctgggacaaggtttaacctgggatctgttactatcacccttagcgaacctcgcaatattcagcaaaagttgcccccagagatcataacgctccatcccaaaattgaagagggtttctttgacctgatgcacgtgcagaaggtcctatcagccagtaccgtgtgtaagctgcagtcctgcacacatggcgttcctggggacctccaggtgtatcacatcggaaacctgcttaaaggcgatcgggtaaatggtcacttgattcataagatcgaacaacacttcaacacttcttggatgagctgggacgggtgcgatctggactactattgtaatatgggcgattggccatcctgcacctacacaggagtcactcagcataaccacgcttcattcgtgaatttactcaacatagagaccgactatacgaaaacatttcacttccatagcaagagagtgaccgcccacggcgatactccgcagctggaccttaaagcaaggcccacatacggggccggagaggtcaccgttctggtggaagtagctgatatggagttgcatactaagaaaatcgaaattagtggcctcaagtttgcgggtctgacctgtacagggtgctatgcatgttcttccggaatcagctgcaaggtgcgcattcacgtcgacgagcctgatgagctaacggtgcatgttaaatcggacgatccagacgtggtcgccgcttcatctagtctgatggcccgaaagctcgagttcggcaccgactccacttttaaagcattcagcgccatgcccaagacatctctgtgtttttacatcgtggaacgggaatactgcaaaagctgttccaaggaggatacccagaagtgcgttaatacaaaacttgaacaacctcagtcaatattgattgagcacaagggtactatcatcggcaaacagaacaacacctgtacggctaaggccagttgctggctggagagcgtgaaatctttcttttatgggttaaagaatatgctcggaggcattttcgggaacgtctttatcggaattttcacatttctgaccccattcatacttctgatcctattctttatgttcggctggcgtattctcttttgcttcaagtgttgcagaaggactcgcggtctgtttaaataccggcacttgaaggacgatgaagagaccgggtatagaaaaatcattgaaaggctgaataacaagaaaggaaagaatcgattactcgacggcgagcgcctggcagatcggaagatcgcggaacttttctccacaaaaactcatataggt

SEQ ID NO: 10476 - RNA, 3495 nt, synthetic construct
  misc_feature 1..3495: note = derived and/or modified CDS sequence (opt3) from CCHVF(CCHVF Kosova Hoti)__EU037902.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccagaaggggcgtggacatgtgaagctgtctagaggctcggaggtagtgctagatgcatgtgactcaaactgcgaagtcatgataccgaaaggcactggggatatcctcgtggactgtagcggaggtcagcaacacttcctgaaggataatcttattgacctgggctgcccccatatccctttgctcgggaaaatggccatttacatctgtaggatgagtaaccacccaaagacaaccatggcgtttctgttctggttttccttcggatatgttataacgtgcattttctgcaaagctctgttctactctctcatcattatcggcactttaggtaagaagatcaaacagtatcgggagctgaagccccagacctgtacaatttgcgaaactgcccctgtgaatgcaatagatgccgagatgcatgaccttaactgtagctacaatatctgcccatattgtgcttcccgcttgacctcagacgggctggcaagacacgtcaaacagtgccccaagaggaaagagaaggtggaagagacagaactatacctcaacctggagcggattccttgggtagttcgcaaacttctgcaagtgagtgaaagcaccggagtcgccttgaagcgatcttcctggctcatcgtgctgttagtgctgctcacggtctcacttagcccagttcagagtgctccggtgggccacggcaagactatagagacataccagaccagagaggggtttacttctatttgtctgttcatgttgggatccatcctatttatcgtaagctgcctggtgaaaggtctcgtcgattcggtgtctgactccttctttcccggcctgtcagtttgtaagacatgcagtattgggagcatcaatggattcgaaattgagtcccataaatgttattgctctcttttctgctgtccttactgcaggcactgtagcgccgatcgggaaatacatcagctgcacttgaacatctgcaagaaacgtaagaccggctcaaatgtgatgctcgcggtctgtaagcgcatgtgctttagagcaacgattgaggccagtaggcgggctctgttaatccgatccatcattaacaccacattcgtgatatgtatcctgactctaaccatttgcgtagttagcacatctgccgtggaaatggagaatctcccagcaggtacttgggagcgcgaagaggacctgaccaacttttgtcaccaagaatgccaggtcacagagaccgaatgtctttgcccctatgaggctttggtgctgagaaaacctctcttcctggattcaatcgtcaaggggatgaaaaaccttctgaatagtactagcttggagacgtccctctctattgaagccccatggggcgcgatcaacgtgcagtcgacatttaagcccaccgttagcactgccaatatagcactgtcctggtcaagtgtggagcataggggaaacaaaatcttagtaaccggccggtctgaaagcattatgaagctggaggagcgcacagggatctcctgggacctaggagtcgaagatgcttcagagagcaagctcctgaccgtgtctattatggacctttcccaaatgtacagtccggttttcgaatatttgagcggtgatagacaggtggaggaatggcctaaagccacttgcacaggcgactgtccccagaggtgcgggtgtacgtcttcaacctgcctgcacaaggagtggccacattcccgtaattggcggtgtaaccctacttggtgctggggagtcggcacaggttgtacctgctgtggggtggatgtaaaagacctctttacagaccacatgttcgtgaagtggaaagttgagtacatcaagactgaagctatagtctgcgtggagctgaccagtcaggaacgacaatgtagcttaattgaggccggcacgagatttaatctgggacccgtgaccatcacactttcggaaccaaggaacattcagcagaagttgccccctgagatcataactctccatccaaaaatcgaggaaggcttctttgatctgatgcacgtccagaaggttctatccgcatctaccgtgtgcaaactgcaaagctgcacacacgggattccgggagacctccaggtgtatcatatcggtaatctgcttaagggcgatcgcgtaaacgggcacttgattcataaaatcgagccccacttcaatacttcatggatgagttgggacggatgtgatctggactactactgcaacatgggcgattggccttcctgtacctatacgggtgtcacacagcacaatcatgccgcttttgtgaacttactcaatatagaaaccgactacactaagacattccacttccattctaaacgggttaccgcgcacggggatactccacagctggaccttaaggcaagacccacctatggcgccggagagattacagtgctggtcgaagtggctgatatggagttgcatacgaagaaagttgagatcagcggcctcaagtttgcctccctggcatgcaccgggtgttacgcctgctcaagcggaatcagttgtaaagtgaggattcacgtagacgaacctgatgagctaactgtccacgtgaagtcttccgacccagacgtggtcgctgccggcacaagcctgatggcacgcaaactcgaatttggtaccgattcgacatttaaggcgttctcagctatgcccaagacttctctgtgcttttatatcgttgagaaagagtactgtaagagttgctccgaagacgataccaaaaagtgtgtggacacgaaacttgagcaaccgcagagcattttgatagaacatcgagggacaatcattggaaagcagaacgatacctgcactgccaaggcatcttgctggctggagagcgtaaaatccttcttttatggcttaaagaacatgctcggttcagtgttcggcaactttttcatcgggattctgctttttctggcccctttcgtcctactcgtgctgtttttcatgttcggatggaaaatcttgttttgtttcaagtgctgtcggcgtaccagaggcctgtttaaatacaggcacttaaaggacgatgaagagacagggtaccgccggataatcgagagactcaataataagaaaggaaagaacaggctgcttgacggcgaacgactggctgatcgcaaaattgccgagttgttcagtactaagacccatatcggt

SEQ ID NO: 10477 - RNA, 3495 nt, synthetic construct
  misc_feature 1..3495: note = derived and/or modified CDS sequence (opt3) from CCHVF(CCHVF YL04057)__FJ562094.1__Gn-NSm-Gc
  source 1..3495: mol_type = other RNA
gccgagggcgggagctccgactgcatctctagaacccagctggtgaagacagaagtcgctgagattcacgaagattcatacggaggtcccggcgagaaaataactatctgtaacgggagtacgattgttgaccaaaggctcggacgggaacttggctgctataccatcaatcgcgtgcgaagctacaagctgtgtgagaactccgcatctggtaaatcgtgcgagattgattcaatccctgtaaagtgtaaacaggggttctgcttgaagataacacaggaaggacgtggccatgtgaagttaagcagaggcactgagatcgtcctggacgtgtgtgatagttcctgcgaactaatgattccaaaagggaccggagacatcctcgttgattgttctggtggccagcaacactttctgcagaataaccttattgacctggggtgcccgaatgtgcccttgctcggaaagatggccatctatgtctgtaggatgagcaaccatcctaaaacaaccatggcgttcctgttttggttctcctttggctacgtgataacttgcattgcttgccgggtactgttctatctcttaatcgccattggtacagttgggaagaaactgaagcagtaccgcgagcttaagccacagacctgtatcgtgtgcgagtcagtccccgtgaatgcaatcgatgccgaaatgcacgagttgaactgtagttataatatttgcccttactgtgctagcagactgtctacggacggactaataaggcatgtgactcaatgcccaaaacggcgcgaaaaggtcgaggaaaccgagctctttctgaaccttgagcgaatcccctggctggttagaaaattgctccaggtgtccgaatcaacaggcatggcactgaagaggagctgttggatgattactttactgatcctccttctggtaagtatatctcctgtgcagtccgccccagtcggcaaagagcgggctattgaaacctaccaggcccgtgagacatataccgggatctgcttgttcgtgctaggaagcgttctgtttgcggtgtcgtggctcacgaaggcactgatcgatggtattggcaattctttctttccggggctttccgtctgtaaaacttgctcaatcggaagtattaacggcttcgaaatagagagccacaagtgttactgctccctgttttgctgtccctattgccgcgcctgttctagcgacaagaatacacacagaatgcatttgaacgtgtgcaaaaagaggaaaatgggttcaaatgtaatgctcgctgtttgtaagcggatgtgcttccgagccaccatcgaggcaagtaacaaagctctgttaattcgctccatcatcaacagcactttcgtgatttgtatactgatcctaacaatttgcgtcgtgtctacctcagccgtcgatatggaaaatctccctgcggggatctgggagaaggaagaggacctgacgaacttttgtcaccaagaatgccaggtgaccgagacagagtgtctttgcccatacgaagccatggttttgagaaagcccctgttcctcgacagtattgcaaaaggcaagaaaagcctgcttaattccacttctctggagacctcgttgagcatcgaagctccttggggagccataaacgtgcagtccacatttaagccaactgtatcagctgccaatatcgcactcagttggtctagcgtcgagcataggggcaacaaaattctggtgtccgggcggtcagagagcatcatgaagttagaagaacgcaccggagtttcttggaatctgggtgtggaagatgcctccgagagtaagacactaaccgtcagcgtgatggacctctctcaaatgtattcccccgtattcgaatacctgtcaggcgatagacaggtggaggagtggccgaaagctacttgcacgggggactgtcctgaaaggtgcggatgtacaagttcgacctgccttcacaaggagtggccccacagccgtaactggcggtgttccccaacttggtgctggggcgttggtaccgggtgtacatgctgtggcttggatgtcaaagactttttcaccgattatatgctggtgaagtggaaagtggaatacattaagactgaggcgatcgtctgcgttgaactcacatctcaggagcgacagtgtagcctgatagaggcaggaacgagatttaatttaggccctgtgaccattactctgtcagaacccaggaacgtgcaacagcgccttccacccgagatcgtaacattgcatcctaagattgaagaggggttctttgacctcatgcacgtccagaaaatcctgagtgcctccaccgtgtgcaagctacagtcttgcacacatggagttccaggtgatttccaagtgtaccacgtcggcaatctgctcagaggggacaaagtgaacggacatagcatacacaagatcgaaccgcactttaatacttcctggatgtcatgggatggctgtgacctggactatttctgcaacatgggtgattggcccagctgtacctacacgggggttacccagcataatcgggctgcctttattaacatgcttaacatcgagacagactatactaaaaccttccacttccatagtaagagggtgacagcacacggcgatactcctcagttggacctgaaagcccgcccagcttacggagccggcgaggtaaccgtcttagtggaagtggcagatctcgagctgcacacgaagaaacttgaagtctctgggctgaagattgcgtccttgacatgcagcggatgttatgcttgctcgtcaggcatctcttgtaaggttcgaatacatgtgaatgagcccgacgagtttaccgtacacgtgcggagttccgatcctgacgtcgtggccgcaggtagctctctcatggcccgtaaaattgagttcggggctgatagcacttttaaggccttctcctcaatgccaaaagacagtctgtgcttttacatcgttgagaaggattattgtagctcttgcacagacgatgacacccagaagtgtgtgaacactaaactagaccatccccaatccatcctgattgaacacaagggaaccatcattggcaaacagaatgatacatgctcaacgaagaccagttgctggctcgagagcgtcaaaggtttcttttacggcctgaagaacatgctttccgggatattcggaaatgtgtttttgggcatcctgttattcctcgcaccgtttgttctgcttattttctttttcttctttgggtggagactgctattctgtctcaagtgctgtaggcgcactcggggactgttgaaatacaagcatctgaaagacgaagaggaggctggctataagaaaatcattgaaagattaaacggtaagaaggggaaatctcagctctttgatggagagaggctggccgaccgaaagatcgcggaacttttctcgacaaaaatacacatcggc

SEQ ID NO: 10478 - RNA, 3495 nt, synthetic construct
  misc_feature 1..3495: note = derived and/or modified CDS sequence (opt3) from CCHVF(CCHVF V42/81)__GU477490.1__Gn-NSm-Gc
  source 1..3495: mol_type = other RNA
agcaaggagcccggcgacgattgcatctccagaacccagctgatgaggacagaaactgccgagattcacgacgataactacgggggacctggtgacaaaataacgatctgtaatggctctaccattgtggatcaacggctcgggtcagaacttggatgctatacaatcaaccgcgtcaagagtttcaaactgtgtgagaatagcgctactggcaaggcatgcgaagttgactccaccccagtgaaatgtcgacagggtttttgcttgaagattacacaggaggggcgtggacatgtaaagttatctagaggctcggaggtggtcctggatgcctgtgactcaagctgcgaagtgatgatcccgaaaggcaccggggatatcctagttgactgtagtggaggtcagcaacacttcctcaaggataacctgatcgaccttgagtgcccccatattcctctgttgggcaaactcgcgatctacatttgtaggatgtccaatcacccacggactacaatggcttttctgttctggtttgggttcggatatgtgataacctgcatactgtgcaaggccctcttttactctttaattatcattggcacgctgggtaaaaagatcaagcagtatcgcgaacttaaaccccagacttgtaccatctgcgagacagcacctgtcaacgccattgatgctgagatgcatgacttgaattgtagctacaacatatgcccatattgtgcatccagactgacttcagacgggctagccaggcacgtgacccagtgccccaagcggaaagaaaaggtagaggaaacagagctctacctgaatcttgaacgcatcccttggattgttcgaaaactgttgcaagtgagtgagagcaccggagtcgtgctcaagagatcttcctggctgatcgtgttactggtcctccttacggtttcactgagcccagtgcagagtgctccggtaggccacggcaaaactatagagacataccagaccagggaagggttcacttctatttgtttgtttatgctaggatccatcctgttcatcgtgagctgcattgtcaagggtctcgtggattcggtttctgactcctttttccccggcctgtcagtgtgtaagacatgcagtatcagctccattaacgggtttgagatagaatctcataaatgttattgcagccttttctgctgtccttactgccggcactgttcagccgatcgtgagatccatcagctgcacttgagtatttgccgcaagagaaggaccggatccaatgtcatgctcgcggtgtgtaaacggatgtgcttccgagcaacgatcgaagtaagccgcagagccctgttaatcaggtctattataaacaccacatttgttatctgtattctgactctaaccatctgcgtggtctcaacaagtgctgtggagatggagaatctcccagccggcacttgggaacgggaggaagacctgaccaacttctgtcaccaagagtgccaggtcacagaaaccgagtgtctttgcccctatgaggcattggtgctgcgcaagcctctctttctggatagcattgttaaaggtaagaagaatcttctgaactccacttctttggaaacgtcgctcagcatcgaggctccatggggcgccataaacatccagtccacattcaaacccaccgtgtcagcggccaatattgcactgagttggtctagcgtagaacatagagggaacaagatcttagtctccggaaggtcagagagcattatgaaactggaggaacgtactggcgtgtcttggaatctaggggttgaggacgcttccgaaagtaagctcctgaccgtgagcatcatggatctttctcaaatgtactccccggtctttgagtatttgtcaggagaccgacaggtggaagagtggcctaaagccacatgcaccggtgattgtcccgagcggtgcggctgtacttcaagcacatgcctgcacaaggaatggccacattcgagaaactggaggtgtaatcctacgtggtgctggggagtagggaccggctgtacttgctgtggtgtggacgttaaggatctcttcatagaccacatgtttgtcaaatggaaggtggagtacattaaaacagaagctatcgtgtgcgtcgagctgacctcccaggaacgccagtgttctttaattgaggccgggacacggttcaacctgggccccgttactatcacccttagcgagccaagaaatatacaacagaagttgccccctgaaatcattacgctccatccaaaaatcgaggaaggatttttcgacctgatgcacgtgcagaaggtgctatcagcaagtaccgtatgcaagctgcagtcctgcacacacggcattccgggggatctccaagtctatcatatcggaaacctgcttaaaggtgacagggtgaatggccacttgatacataagattgagccccactttaacacttcttggatgagctgggatgggtgtgacctggattactactgcaatatgggagactggccttcctgtacctatacaggcgttactcagcacaaccatgccgctttcgtgaatttactcaacatcgaaaccgattacacgaaaacatttcacttccattcaaagcgcgtcaccgcgcacggtgagactccacagctggaccttaaagcacgacccgcctatggggctggcgagatcacagtgctggttgaagtggccgatatggagttgcataccaagaaagtagaaattagcggactcaagttcgcaagtctggcctgcactggctgttacgcttgttcttccgggatcagctgcaaggtccggattcacgtggacgagcctgatgagctaaccgtgcacgtcaaatcgaatgacccagatgttgtggccgcatcaacatctctgatggcgcgtaagctcgaaagtggaacggactccacctttaaggctttcagcgccatgcccaagacttctctgtgcttttatatagtagagagagaatactgtaaaagctgctccgaggacgatacacagaagtgtgtggaaaccaaacttgagcaaccgcagtcaatcttgattgagcataaaggcacaatcattggtaagcagaacgacacttgcaccgcaaaagccagttgctggctggaaagcgtcaagtctttcttttatgggctcaaaaacatgttaggatccgtgttcggcaactttttcatcggtatactgctttttctggctcctttcgttctactcgtgctgtttttcatgtttggctggaagatcttgttctgtttcaagtgctgtaggcgcacgcgggggctgtttaaatacagacacttaaaggaggatgaagagacaggatacaggcgaattatcgaacgcctcaatagtaaaaagggcaaaaatcggctgcttgacggggagagactggccgataggaagattgcagagttgttcagtaccaagactcatatcgga

SEQ ID NO: 10479 - RNA, 3495 nt, synthetic construct
  misc_feature 1..3495: note = derived and/or modified CDS sequence (opt3) from CCHVF(CCHVF 79121M18)__GU477493.1__Gn-NSm-Gc
  source 1..3495: mol_type = other RNA
gccgagggcgggagctccgactgcatctctagaacccagctggtgaagacagaagtcgctgagattcacgaagattcatacggaggtcccggcgagaaaataactatctgtaacgggagtacgattgttgaccaaggactcggcagcgaacttggttgctataccatcaatagggtgcggtcctacaagctgtgtgagaactctgcatcggggaaatcatgcgagattgatagcatccctgtaaagtgtaaacagggattctgcttgaagataacacaggaaggccgcggccatgtgaagttaagtcgagggactgagatcgtcctggacgtgtgtgattcctcttgcgaactaatgattccaaaaggaaccggtgacatcctcgttgattgtagcggcgggcagcaacactttctgcagaataaccttattgacctgggatgcccgaatgtgcccttgctcggcaagatggccatctatgtctgtcgtatgtccaaccatcctaaaacaaccatggcgttcctgttttggttctcatttggttacgtgataacttgcattgcttgcagagtactgttctatctcttaatcgccattgggacagttggaaagaaactgaagcagtacagggagcttaagccacagacctgtatcgtgtgcgagagtgtccccgtgaatgcaatcgatgccgaaatgcacgagttgaactgtagctataatatttgcccttactgtgcttctcggctgtccacggacggcctaatacgccatgtgactcaatgcccaaaaagaagggaaaaggtcgaggaaaccgagctctttctgaaccttgagcggatcccctggctggttcgcaaattgctccaggtgtcagaaagcacaggcatggcactgaagcgaagttgttggatgattactttactgatcctccttctggtatctatatcccctgtgcagagcgccccagtcgggaaagagagagctattgaaacctaccaggccagggagacatataccggaatctgcttgttcgtgctaggttcggttctgtttgcggtgtcttggctcacgaaggcactgatcgatggcattggaaattccttctcaccggggcttagtgtctgtaaaacttgcagcatcggctccattaacggttttgaaatagagtctcacaagtgttactgcagcctgttctgctgtccctattgccgggcctgttcaagtgacaagaatacacaccgtatgcatttgaacgtgtgcaaaaagcgcaaaatggggtccaatgtaatgctcgctgtttgtaagagaatgtgctttagggccaccatcgaggcaagcaacaaagctctgttaattcggtctatcatcaactcaactttcgtgatttgtatactgatcctaacaatttgcgtcgtgagtaccagcgccgtcgatatggaaaatctccctgcgggcatctgggagaaggaagaggacctgacgaacttctgtcaccaagaatgccaggtgaccgagacagagtgtctttgcccatacgaagccatggttttgcgaaagcccctgtttctcgactccactgcaaaaggaatgaagtctctgcttaattcgaccagcctggagacatccttgtcaattgaagctccttggggcgccatcaacgtgcagagtactttcaaaccaaccgtatctgctgccaatatagcactcagctggtcctcagtcgagcatcgcgggaacaagatcctggtgagcggaagatctgagtccattatgaaattagaagagaggacaggtgttagttggaatctgggcgtggaagatgccagcgagtctaagaccctaactgtctccgtgatggacctctcacaaatgtatagtcccgtatttgaatacctgagcggggatcgccaggtggaggagtggccgaaggctacgtgcacaggagactgtcctgaacggtgcggctgtacctcgtccacttgccttcacaaagagtggccccactctagaaactggaggtgtaatccaacctggtgctggggtgttgggacaggctgtacctgctgtggattggatgtcaaggacttctttactgattatatgctggtgaaatggaaggtggaatacatcaaaacagaggcgattgtctgcgttgaactcacgagccaggagcgtcagtgttcactgatcgaggcaggcacccggttcaacttagggcctgtgactataacactgagtgaaccccgaaatgtgcaacagagacttccacccgagattgtaaccttgcatcctaagatcgaagagggatttttcgacctcatgcacgtccagaagattctgtccgcctctacagtgtgcaaactacagagctgcactcatggtgttccaggcgattttcaaatctaccacgtggggaacctgctcaggggagacaaggtcaatggccattccatacacaaaatcgaaccgcacttcaacacctcatggatgagctgggatggttgtgacctggactatttttgcaatatgggggattggcccagttgtacgtacaccggcgtgacacagcataaccgcgctgccttcattaacatgcttaatatcgagactgactataccaagacatttcacttccattctaaacgggttactgcacacggagatacccctcagttggacctgaaggccagaccagcttacggcgccggggaggtgacggtattagtcgaagtggcagatctcgagctgcacacaaagaaacttgaagtgtccggactgaagattgcgagcttgacctgctcgggctgttatgcttgctcatctggtatcagttgtaaagtcaggatacatgttaacgagcccgacgagttcactgtgcacgtacgctccagcgatcctgacgtggtcgccgcagggtctagcctcatggcccgaaagattgaatttggagctgattccacattcaaagccttttcaagtatgccaaaggacagcctgtgcttctacatcgtggagaaagattattgttcttcctgcaccgacgatgacactcagaagtgtgttaataccaagctagaccatccccaatcaatcctgattgaacacaaaggcacaatcattggtaagcagaacgatacgtgcagtaccaaaactagctgctggctcgagtccgtgaagggctttttctacgggctgaaaaatatgctttctggaatatttggcaacgtcttcttggggatctttctgttcttagcaccgtttgtgctcctgattttctttttcttctttggatggcggcttctgttctgtctaaagtgctgtcgtagaacaaggggcctcctgaagtacaaacatttgaaggacgaagaggaggctggttataaaaagatcattgaacgcctgaatgggaaaaagggaaagtcgcagttatttgatggcgagcggctcgccgacagaaaaatcgcggaactgttcagcaccaagatacacatcggt

SEQ ID NO: 10480 - RNA, 3495 nt, synthetic construct
  misc_feature 1..3495: note = derived and/or modified CDS sequence (opt3) from CCHVF(CCHVF Afg09-2990)__HM452306.1__Gn-NSm-Gc
  source 1..3495: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgcgatccttcaaattgtgtgaaaattccgctactggtaagtcttgcgagattgattcgatccctgtaaaatgtaagcaggggtactgcttaaaaattacccaggagggacgtggccatgtgaagctgtcaagaggcagcgaagtcgtgctagacgtttgtgatagttcctgcgaggtgatgatcccaaaggggacaggagacatactcgtcgattgttctggtggccagcaacactatctgaaagacaaccttgtggatctggggtgcccgaagatccccttgctcggaaaaatggcaatttacatctgtaggatgagcaatcatcctaagaccactatggcctttctgttctggttttccttcggctatgtaattacatgcatcctgtgcaaagcgatatttttcctcttaattatctttggtaccctggggaagcggttcaagcagtaccgcgaacttaaaccacagacgtgtactatttgcgagaccacacccgttaacgctatcgacgccgagatgcacgatttgaattgttcatataacatctgcccttactgtgcaagtagactgactagcgacggactagccaggcatgtgacccagtgcccacggcgcaaggaaaaagtcgaggaaacagagctctacctgaatcttgaacgaataccctgggtggtgagaaagctgttgcaagtctctgagtccaccggcacggttctcaaaaggtcaagctggctgattgtgttactggtactctttactgtgagtctttctcctgtccagtccgctccaatcggccacgggaagacaattgagacctatcgggtgcgtgaagagtacactagcatctgtctgttcgttttgggatcgatactatttattgtgtctttcctgatgaaaggtctcgtcgacggcgtggggaacatctttttcccgggactgtccgtatgcaagacatgttcaatcggcagtattaatggtttcgaaatcgagagccacaagtgctattgttccctgttttgctgcccctactgtcgccattgctctgcagatggggaaattcaccagcttcatttgagcatatgtaaaaagagaaaaaccggctcaaacgttatgctcgccgtgtgcaagaggatgtgtttccgggctacgatggaggtcagtaataaagccctgtttatccgatccattatcaacaccacattcgtggtctgcatcttaattctggcggtgtgtgttgtgagcacttctgcagtagagatggaatcactacctgccggaacctgggagcgcgaagaggacctcacaaatttttgccaccaggaatgtcaagtcactgagaccgagtgcctgtgtccatatgaagctcttgtgttgagaaggcccctgttcctcgatagtatagttaagggcatgaagaacctgcttaacagcacatccctggagacctctttgtcgatcgaagccccttggggtgcaattaatgtgcagagcacttacaaaccaacggtctccacagctaacatcgccctctcatggagttctgtggagcaccggggaaataaggtactggtgagcggtcgctccgagtcaattatgaaattagaagagagaaccggcatcagctgggacctgggggttgaagatgcgtctgagtccaagctactcactgtcagtgtgatggacctgagccagatgtattctcccgtgtttgaatacctttccggagataggcaagtcgaggagtggccgaaagcaacctgcacaggcgactgccctgaacgttgtggttgcacctcaagtacttgtttgcataaggagtggccccacagccggaactggcgatgcaatccaacatggtgttggggcgttgggacgggatgcacctgttgcggcctggatgtgaaggacctcttcactgattacatgtttgtgaaatggaaggtagaatatataaaaacagaggccatcgtctgtgtggaactgacctcgcaggagagacagtgctccttaattgaggctgggacaaggttcaacctgggatctgttactatcacccttagcgaacctcgcaatattcagcaaaagttgcccccagagatcataacgctccatcccaaaattgaagaggggtttttcgacctgatgcacgtgcagaaggtcctatcagccagtaccgtgtgtaagctgcagtcctgcacacatggcgttcctggggacctccaggtgtaccacatcggaaacctgcttaaaggcgatcgggtaaatggtcacttgattcataagatcgaacaacactttaacacttcttggatgagctgggacgggtgcgatctggactattactgtaatatgggcgattggccatcctgcacctatacaggagtcactcagcataaccacgcttcattcgtgaatttactcaacatagagaccgactacacgaaaacattccactttcatagcaagagagtgaccgcccacggcgatactccgcagctggaccttaaagcaaggcccacatatggggccggagagatcaccgtcctggttgaagtggctgatatggagttgcatactaagaaaattgaaatcagtggcctcaagttcgcgggtctgacctgtacagggtgctacgcatgttcttccggaattagctgcaaggtacgcatccacgtggacgagcctgatgagctaacggtccatgtgaaatcggacgatccagacgttgtggccgcttcatctagtctgatggcccgaaagctcgaatttggcaccgactccactttcaaagcatttagcgccatgcccaagacatctctgtgtttctacatagtcgagcgggaatattgcaaaagctgttccaaggaggatacccagaagtgcgtgaatacaaaacttgaacaacctcagtcaattttgatcgagcacaagggtactatcattggcaaacagaacaacacctgtacggctaaggccagttgctggctggagagcgttaaatctttcttttacgggttaaagaatatgctcggaggcatctttgggaacgtgttcattggaatatttacattcctgaccccatttatccttctgattctattcttcatgtttggctggcgtatcctcttctgctttaagtgttgcagaaggactcgcggtctgttcaaatatcggcacttgaaggacgatgaagagaccgggtacagaaaaattatcgaaaggctgaataacaagaaaggaaagaatcgattactcgacggcgagcgcctggcagatcggaagatagcggaactttttagcacaaaaactcatatcggt

SEQ ID NO: 10481 - RNA, 3495 nt, synthetic construct
  misc_feature 1..3495: note = derived and/or modified CDS sequence (opt3) from CCHVF(CCHVF Sudan Al-Fulah 3-2008)__HQ378184.1__Gn-NSm-Gc
  source 1..3495: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaagagcttcaagttgtgtgaaaattccgctactggcaaatcttgcgttattgattcggtgccagtaaagtgtcgacagggttactgcttacgtatcacccaggaggggagaggacatgtgaaactgtcaaggggcagcgaggtcgtgctagacgcatgtgatacaagttgcgaaataatgatcccgaagggcaccggggacattctcgttgattgttccggaggtcagcaacactttctgaaggacaaccttgtggatctgggctgccccaaaatccctttgctcgggaagatggccatttatatctgtcggatgtctaatcatccaaaaactacaatggcgttcctgttttggttcagctttggatacgtcataacctgcattctgtgcaaggctatcttctatctcttaattatcatcggcacgctgggtaaacgctttagacagtacagggagcttaagccccagacttgtaccatttgcgaaacaactcctgtgaacgccatagacgcagagatgcacgatttgaattgttcctataacatctgcccatactgtgcctcacggctgaccagtgacgggctagctcgccatgtaacacagtgccccaagcgaaaagagaaggttgaagagaccgaactctacctgaatcttgagaggattccttgggtggtcagaaaactgttgcaagtgagcgaatctacgggagtggcactcaagcggtcctcatggctgatcgtcttactggttctcttcactgtgagccttagtccagtacagtctgccccgataggccacggcaaaacaattgaggcttatcgtgcccgcgaggggtacacctccatctgtctgtttgtgttgggaagcatcctattcattgtctcgtgcctgatgaagggtctcgtggactctgttggcaactcctttttccccgggctgtcaatctgtaaaacttgcagtattagctccataaatggatttgaaatcgagtctcacaagtgttattgcagccttttctgctgtccttactgcagacattgttcagcggataaggaaattcacaaactgcatttgagtatctgcaagaaaaggaagacaggctccaacgtgatgctcgcagtctgtaaacggatgtgcttccgagccaccatggaggtgagcaatcgcgctctgtttatcagatctattataaacacgaccttcgtattatgtatcctgattctagccgtttgcgtggtctcaacaagtgcagtggaaatggagaatctcccagctggtacttgggagagggaagaggacctgaccaacttttgtcaccaggaatgccaggtcacagagactgaatgtctttgcccctatgaggccttggtgctgcggcgccctctcttcctggatagcatcgttaaggggatgaagaaccttctcaattccacctctttggagacatcgctcagcattgaagcgccatggggcgccatcaacgtgcaatccacctacaaacccactgtatcaacggcaaatatagctctgagttggtctagcgtcgagcacagaggaaacaagatcttagtgtccggcaggtcagaaagcattatgaaactggaggagcgtacagggatctcttgggacctaggagttgaagatgcctccgagagtaagctcctgaccgtgagcgtcatggacctttctcagatgtattccccggtgtttgaatacttgtcaggtgatcggcaggtagaggaatggcctaaagctacttgcaccggcgactgtcccgagcgatgcgggtgtacaagttcgacctgcctgcataaggagtggccacacagcagaaattggaggtgtaaccctacttggtgctggggagtgggcacaggttgtacgtgctgtgggctcgatgttaaggacctgttcaccgattacatgtttgtcaaatggaaggtggaatatattaaaactgaggccatcgtgtgcgtcgaattaacatcccaagagcgccagtgttctctgatagaagcaggcacccggttcaatcttggacccgttacaattactttgagcgagccaagaaacatccagcagaagctgccccctgagattatcaccctgcatccaaggatagaagagggctttttcgacctaatgcacgtgcaaaaagtgctgtcagccagtacggtatgcaagctccagtcctgcacccatggggtcccgggagacctccaggtgtaccacatcggtaatcttttgaagggcgataaagttaacgggcacctgattcataagatcgaaccccactttaatacatcttggatgagctgggacggatgtgatttagactattactgcaacatgggcgattggccttcctgtacttataccggtgtgacacagcataatcacgcttcattcgtcaacctcctgaatattgagactgactacaccaaaaactttcacttccatagcaagcgcgtgacggcgcacggggatacaccacaacttgacctgaaagcacgacccacctatggcgccggagaaatcactgttttggtggaggtagctgatatggagctccatacaaagaaaatagaaattagtggcctgaagttcgcctctctaacctgcactgggtgttacgcatgctccagcggaatctcgtgtaaggtccggatccacgtggacgagcctgatgaactgaccgtgcatgtcaaatcagacgatccagacgttgtggccgcttctagttccctcatggcccgtaagctggagtttggcacagacagcacgttcaaagcattttctgcgatgcccaagaccagcctttgcttctacattgtagagaaagaatattgtaagtcctgctcagaggaagatactaagaaatgtgtgaacacaaagttggagcagccgcagagtatcctgattgaacacaaaggtaccataatcgggaagcagaatagcacatgcactgctaaagtctcttgctggttagagtccgccaagtcatttttctacggactcaaggacatgctgagtggcatttttggtaacgtgttcatcggcatttttcttttcctggcaccttttgttctactcgtgctgttctttatgttcgggtggagaatcttgctgtgtttcaggtgctgtcgccggaccagaggattatttaaatataggcacctcaaggatgacgaggaaacgggctaccgacgcataatcgagcggctgaataacaaaaaggggaaaaataaacttctggatggagaaagattggccgacaggaagattgctgagctgttcagcacaaaaacccatatcggc

SEQ ID NO: 10482 - RNA, 3495 nt, synthetic construct
  misc_feature 1..3495: note = derived and/or modified CDS sequence (opt3) from CCHVF(CCHVF Sudan AB1-2009)__HQ378187.1__Gn-NSm-Gc
  source 1..3495: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaagagcttcaagttgtgtgaaaattccgctactggcaaaaactgcgagattgattctgttccagtgaagtgtcgacagggttactgcttacgtatcacccaggaggggagaggacatgtaaaactgtcgaggggctcagaagtggtcctagacgcatgtgatacaagctgcgagataatgatcccgaagggcaccggggacattctcgtggattgtagtggaggtcagcaacactttctgaaggacaatcttatcgatctgggctgccccaaaattcctttgctcgggaagatggccatctatatatgtcggatgtccaaccatccaaaaactacaatggcgttcctgttttggttctcttttggatacctgattacctgcatcctctgcaaggctattttctatttactgatcatcattggcacgcttggtaaacgcttgaagcagtacagagaactgaagccccagacttgtaccatatgcgagacaactcctgttaatgccatcgacgcagagatgcacgatctaaactgtagctataatatttgcccatactgtgcctccaggctcacctcagacgggctggctcggcatgtgatccagtgccccaaacgcaaggaaaaagtcgaggaaacagagctttacctgaacttggaacgaataccttgggtggtaagaaagctcctgcaagttagtgagagcaccggagtggcattaaaaaggtcttcctggctgattgtcctccttgtgctgtttacggtgtcattgagcccagtccagagtgccccgatcggccagggcaagactatcgaggcttatcgggcccgtgaagggtacacatctatttgtctattcgttctgggatccatcctctttattgtgagctgcctgatgaaaggtcttgtagactcggtgggcaattctttctttcccgggctgtccatatgtaagacctgctcaatcagtagcattaacggattcgagatcgaatcccacaagtgttattgctctttgttttgctgtccttactgccgccactgtagcactgataaagagatccataagctccacctgtcaatttgcaaaaagagaaaaacaggcagtaatgtcatgttagcggtgtgtaagaggatgtgcttccgggcaaccatggaagtttccaaccgagccctgttcatacgcagcatcattaatacgacctttgtgctatgtatcctcattctggctgtctgcgtggtatctacatcagccgttgagatggagaaccttccagcaggtacttgggaaagagaggaagacttgaccaacttctgtcatcaggagtgccaagtgacagaaactgagtgtctgtgcccctatgaggctctcgtcctgaggaagcctctttttctggatagtatcgccaaagggatgaagaatttgctcaacagcacctccctggaaacatctttatcgatagaggcgccatggggcgccatcaatgtgcagagcacctacaaacccactgtctccacggcaaacattgctctgtcatggagttctgtggaacaccggggaaataagatcctagttagcggccgctccgagtcaattatgaaactcgaggaaagaacagggatcagctgggacctgggagtggaggatgcctctgaatccaaacttttgaccgtaagtgtcatggacctgagccagatgtattctccggtgttcgagtacctctccggtgataggcaagttgaagagtggcctaaggctacttgcaccggcgactgtcccgagcgttgcgggtgtacatcaagtacctgcctgcacaaagaatggccacatagccggaactggcgatgtaatcctacttggtgctggggagtgggcacaggttgtacgtgctgtgggttagatgtcaaggacctgtttaccgattacatgttcgtgaaatggaaggtagagtatataaaaactgaagccattgtgtgcgttgagcttacatcgcaggaaagacagtgttccttgatcgaggcaggcaccaggtttaacctcggacccgtcacaattactctgtctgagccacgcaatatccagcaaaagctaccccctgaaataatcaccctgcacccacggattgaggaaggcttctttgacctcatgcatgtgcagaaggtgctgagcgcctcaacggtctgcaaacttcagagttgcacccacggggttccgggagacctccaggtgtaccatatcggtaacctgttaaagggcgataaagtgaatgggcacctcattcacaagatcgagccccatttcaacacatcctggatgtcttgggacggatgtgatctggactattactgcaatatgggcgattggcctagctgtacttataccggtgtaacacaacacaaccatgcttcctttgtcaatcttctgaacatagaaactgactacaccaaaaacttccactttcactcaaagagagtgacggcgcatggggatacaccacagttggacctcaaagcaaggcccacctatggcgccggagagattactgttctggtggaggtcgctgatatggaactacacacaaagaagatcgagatcagcggcctgaaattcgccagtttgacctgcactgggtgttacgcatgttcttccggaattagctgcaaggtgcgcatccatgttgacgaacctgatgagctgaccgtgcacgtaaaatcggacgatccagacgtcgtggccgcttcatctagtcttatggcccgaaagttggagttcggcacagactccacgtttaaagcattcagcgcgatgcccaagacctctctgtgcttttacattgtggaacgggagcattgtaagagctgcaatgaagaggatactaaaaagtgtgtcaacacaaaattagaacagccgcagtccatactcatcgagcacaagggtaccattatcgggaaacaaaattcaacatgcactgctcgtgccagttgctggctggagagcgttaagtctttcttttatggacttaagaacatgctgtccggcattttcggtaatgtgtttatgggcatcttcctatttctcgcacctttcatactgttgatcctgtttttcatgtttgggtggagaattttattctgtttcaaatgctgtaggcgcacccggggactctttaagtacagacacctgaaagacgatgaagagacgggctataggcgaatcattgaacgccttaacaataagaaagggaagaacaagctgttggacggagagcggctcgccgatagaaggatcgctgaactgttctcaacaaaaacccatataggc

SEQ ID NO: 10483 - RNA, 3495 nt, synthetic construct
  misc_feature 1..3495: note = derived and/or modified CDS sequence (opt3) from CCHVF(CCHVF NIVA 118595)__JN572083.1__Gn-NSm-Gc
  source 1..3495: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgaaatccttcaagttgtgtgaaaatagcgctactggtaaatcttgcgagattgattcgatccctgtaaagtgtcgacaggggtactgcttaaaaattacccaggagggacgtggccatgtgaagctgtcaagaggcagcgaagtcgtgctagacgcatgtgatagttcctgcgaggttatgatcccaaaggggacaggagacatactcgtggattgttctggtggccagcaacactttctgaaagacaaccttatcgatctggggtgcccgaagattcccttgctcggaaaaatggccatctatatttgtaggatgagcaatcatcctaagaccactatggcgttcctgttttggttctcctttggctacgtcatcacatgcatactgtgcaaagtgattttctatctcttaatcatttttggtaccctggggaagcggttcaagcagtaccgcgaacttaaaccacagacgtgtactatctgcgagaccacacccgtaaacgctatcgacgccgagatgcacgatttgaattgttcatataacatttgcccttactgtgcaagtagactgactagcgacggactagccaggcatgttacccagtgcccaaagcggaaagaaaaggtggaggaaacagagctctacctgaatcttgaacgcataccctgggtcgtgcgaaaactgttgcaagtgtctgagtccaccggcatcgctctcaagagatcaagctggctgattgtcttactggttctctttacggtgagtatcactcctgtacagtctgcaccaataggccacgggaaaacaattgaggcctatagggctcgggaagagtacacctccatctgtcttttcgtgctgggaagcgtcttgtttgtggtttcgtgcctaatgaagggtctggtggactctgtcggcaacatcttctttccggggctgttcatttgtaagacttgctccatcggatcaattaatggcttcgaaatagagagtcacaaatgttattgcagcctgttttgctgtccctactgccgtcattgttccgccgatcgcgaaatccaccagcttcatctgtctatttgcaagaaaagaaagacaggtagcaacgtgatgttggcggtatgtaaaaggatgtgcttccggaccacgatggaggtttcaaataaggcactctttgtgcgaagtatcatcaacaccacattcgtcgtgtgtattctgatattagccgtctgcgtggtttccactagcgctgtggagatggaatctctgcctgccgggacctgggagcgcgaagaggacctaacaaatttttgtcaccaggaatgccaagtaactgagaccgagtgtctctgcccatatgaagcactggtccttagaaggcccttgttcctggattcaatcgtgaagggcatgaaaaacctcctgaacagtacaagccttgagacctccctgtctattgaagctccttggggagccatcaatgttcagtcgacttacaagccaacggtgagcgcggccaacattgcattgtcctggtcaagtgtcgagcaccggggcaataaaatcctcgtgtctgggcgcagcgagtccataatgaagctggaagagagaacaggaatctcatgggacttaggtgtagaagatgctagcgagtctaaactgctaaccgtgtccgttatggacctcagtcagatgtatagccccgtctttgaatacctgtctggcgataggcaagtggaggagtggccgaaggccacttgcaccggggactgtcctgaacgttgcggatgtacatcctcaacctgccttcataaggagtggccccacagtcggaactggcgatgtaatccaacttggtgctggggcgtgggtacagggtgtacgtgctgtggcttggatgtcaaagacctgttcaccgattacatgtttgttaagtggaaagtggaatatattaagactgaggctatcgtgtgcgtagaactcacaagccaggagagacagtgttcgctgattgaggccggaaccaggttcaacttaggctccgtcacaatcactctgtctgaacctcgcaatatacagcaaaaacttcccccagagattatcaccttgcatccccggattgaagaggggtttttcgacctcatgcacgtgcagaaggttctgagcgcatcaacggtgtgcaagctacagagttgcacccatggagtccctggtgacctccaggtgtaccacatcggcaacctcctgaaaggggatagagttaatggacaccttatacataagatcgaacaacacttgaacacatcctggatgtcttgggacggctgtgatctggactattactgcaatatgggtgattggccaagctgtacttataccggggtgacacagcataaccacgcctcctttgtaaatttactcaacattgagactgactacaccaaaacgttccacttccattcaaagagggtcacagctcacggcgataccccgcagctggaccttaaagcgcgccccacttatggagcaggcgagatcacagtgctggtggaagtcgccgatatggagttgcataccaagaaaattgaaatcagcgggctcaagtttgctagtctgtcttgcactggatgttacgcctgctccagcggcatatcgtgtaaggttcggattcacgtggacgagcctgatgagctaaccgtacatgtgaaatcagacgatccagacgtcgtggcagcctctagttccctgatggctcgaaagctcgaaagcggtacagactctacgttcaaagcctttagcgcaatgcccaagacctccctgtgcttctacatcgttgagcgtgaatattgtaaagggtgctcaaaggaggatactcagaagtgtgtgaatacaaaacttgaacaacctcagagtatcttgattgagcacaagggaaccatcattggcaaacagaacaacacatgcactgcgaaggctagctgctggctggagtctgtcaaatcctttttctacggtttaaagaatatgctctcaggcatatttgggaacgtgttcctgggaatctttagtttccttgccccatttgttctgctaattctcttctttatgttcggctggagaatcctgttctgttttaagtgctgtaggcgcacccgggggttgttcaaatatagacacctgaaggacgatgaagagacgggatacaggaaaattatcgaacgattaaataacaagaaaggcaagaataagctcctggacggtgagcgccttgcagatcggaaaatagccgaactgtttagcacaaagacccatatcggg

SEQ ID NO: 10484 - RNA, 3495 nt, synthetic construct
  misc_feature 1..3495: note = derived and/or modified CDS sequence (opt3) from CCHVF(CCHVF NIV 112143)__JN572085.1__Gn-NSm-Gc
  source 1..3495: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgaaatccttcaagttgtgtgaaaatagcgctactggtaaatcttgcgagattgattcgatccctgtaaagtgtcgacaggggtactgcttaaaaattacccaggagggacgtggccatgtgaagctgtcaagaggcagcgaagtcgtgctagacgcatgtgatagttcctgcgaggttatgatcccaaaggggacaggagacatactcgtggattgttctggtggccagcaacactttctgaaagacaaccttatcgatctggggtgcccgaagattcccttgctcggaaaaatggccatctatatttgtaggatgagcaatcatcctaagaccactatggcgttcctgttttggttctcctttggctacgtcatcacatgcatactgtgcaaagtgattttctatctcttaatcatttttggtaccctggggaagcggttcaagcagtaccgcgaacttaaaccacagacgtgtactatctgcgagaccacacccgtaaacgctatcgacgccgagatgcacgatttgaattgttcatataacatttgcccttactgtgcaagtagactgactagcgacggactagccaggcatgttacccagtgcccaaagcggaaagaaaaggtggaggaaacagagctctacctgaatcttgaacgcataccctgggtcgtgcgaaaactgttgcaagtgtctgagtccaccggcatcgctctcaagagatcaagctggctgattgtcttactggttctctttacggtgagtatcactcctgtacagtctgcaccaataggccacgggaaaacaattgaggcctatagggctcgggaagagtacacctccatctgtcttttcgtgctgggaagcgtcttgtttgtggtttcgtgcctaatgaagggtctggtggactctgtcggcaacatcttctttccgggactcttcatttgtaagacttgctccatcgggtcaattaatggcttcgaaatagagagtcacaaatgttattgcagcctgttttgctgtccctactgccgtcattgttccgccgatcgcgaaatccaccagcttcatctgtctatttgcaagaaaagaaagacaggtagcaacgtgatgttggcggtatgtaaaaggatgtgcttccgggcaaccatggaggtttcaaataaggccctctttgtgcgaagtatcatcaacacgaccttcgtcgtgtgtattctgatattagctatctgcgtcgtgtccacaagcgccgttgagatggaatctctgcctgcagggacttgggagcgcgaagaggacctaaccaatttttgtcaccaggaatgccaagtgacagagactgagtgtctctgcccatatgaagctctggtacttagaaggcccttgttcctggattcaattgtcaagggcatgaaaaacctcctgaacagtaccagccttgagacatccctgtctatcgaagccccttggggagcgattaatgtgcagtcgacctacaagccaactgttagcgccgcaaacatcgctttgtcctggtcaagtgtggagcaccggggcaataaaatactcgtctctgggcgcagcgagtccatcatgaagctggaagagagaacgggaatttcatgggacttaggtgtggaagatgccagcgagtctaaactgctaacagtatccgtgatggacctcagtcagatgtatagccccgtttttgaatacctgtctggcgataggcaagtcgaggagtggccgaaggctacctgcactggggactgtcctgaacgttgcggatgtacctcctcaacatgccttcataaggagtggccccacagtcggaactggcgatgtaatccaacctggtgctggggcgtgggtactgggtgtacatgctgtggcttggatgtgaaagacctgttcacggattacatgtttgtcaagtggaaagttgaatatatcaagaccgaggccattgtgtgcgtggaactcactagccaggagagacagtgttcgctgatcgaggcaggaacaaggttcaacttaggctccgtaaccataacactgtctgaacctcgcaatattcagcaaaaacttcccccagagatcattactttgcatccccggatcgaagaggggtttttcgacctcatgcacgtccagaaggtgctgagcgcctcaaccgtttgcaagctacagagttgcacgcatggagtgcctggtgacctgcaggtctaccacataggcaacctcctgaaaggggatagagtgaatggacaccttatccataagattgaacaacacttgaacacctcctggatgtcttgggacggctgtgatctggactattactgcaatatgggtgattggccaagctgtacatatactggggttacccagcataaccacgcttcctttgtgaatttactcaacatcgagacagactacactaaaaccttccacttccattcaaagagggtaacggcgcacggcgatacaccgcagctggaccttaaagcacgccccacctatggagccggcgagattactgtcctggtggaagtggctgatatggagttgcatacaaagaaaatcgaaataagcgggctcaagtttgccagtctgtcttgcaccggatgttacgcatgctccagcggcatttcgtgtaaggtccgaatccacgttgacgagcctgatgagctaactgtgcatgtaaaatcagacgatccagacgtggtcgccgcttctagttccctgatggcccggaagctcgagttcggtaccgacagcacatttaaagcattctctgcgatgcccaagacgagcctgtgcttttacatcgtggaacgtgaatattgtaaagggtgctccaaggaggatacccagaagtgtgttaatactaaacttgaacaacctcagtcaattttgatcgagcacaagggaacaattataggcaaacagaacaatacctgcacagctaaggccagttgctggctggagagcgtgaaatctttcttttacggtttaaagaacatgctctccggcatcttcgggaacgtctttctgggaattttctcatttcttgcaccattcgtgctgctaatcctctttttcatgttcggctggaggattctgttttgtttcaagtgctgtagacgcactcgggggttgtttaaatatagacacctgaaggacgatgaagagaccggatacaggaaaatcatagaacgattaaataacaagaaaggcaagaataagctcctggacggtgagcgccttgccgatcggaaaatcgctgaactgttcagtacgaagacacatattggg

SEQ ID NO: 10485 - RNA, 3495 nt, synthetic construct
  misc_feature 1..3495: note = derived and/or modified CDS sequence (opt3) from CCHVF(CCHVF SCT ex Afghanistan)__KC344856.1__Gn-NSm-Gc
  source 1..3495: mol_type = other RNA
agcgaggaatccggcgacgattgcatctctagaacccagctgctcaggacagagactgccgaagtgcacaacgacaattacgggggacccggtgataagattacgatatgtaacggctcaaccatcgtcgaccaacggcttgggagtgagctgggatgctatacaattaatcgcgttaagagcttcaagttgtgtgaaaactccgctactggcaaatcttgcaagatcgattcgacccctgtgaaatgtcgacagggtttttgcttaaagattacacaggaggggcgtggacatgtaaagctgtcaagaggcagcgaggtggtcctagacgcatgtgatagttcctgcgaaatcatgataccaaaaggcaccggggacatcctcgtggattgttctggaggtcagcaacacttcctgaaggacaatcttattgatctgggctgcccgaacatccccttgctcgggaaaatggccatttacatctgtaggatgagcaatcatcctaagactacaatggcgtttctgttctggttttccttcggatatgttataacctgcatcttttgcaaagtgattttctacctgctcattgtcgtgggcacgttaggtaagaagtttaaacagtatcgggagctgaagccacagacttgtaccatctgcgaaacaactcccaccaacgctatcgacgccgagatgcacgatcttaattgttcatacaacatttgcccttattgtgcaagtcgcttgacaagcgacgggctggccagacatgtaacccagtgcccaaaaaggaaggagaaagttgaagagacggaactatacctcaatctggagcggataccctggatcgtgcgcaaacttctgcaagtctctgaatccactggagtggctttgaaacgatcaagctggctcattgtgctgttagtcctgctcacagttagtctttctcctgtgcagtccgcaccaatcggccacggcaagaccatagagacttaccagacaagagaggggtatattagcgtatgtctgttcgtgttgggaggtatcctatttgtcgtgtcgtgcctgatcaagggcctcgttgactctgtggggaactccttctttccgggactgtcaatttgtaaaacctgcagtatcggcagcgtcaatggtttcgaaattgagtcccacaagtgttactgctctcttctgtgctgtccctattgcaggcattgtagcacggatcgggaaatacaccagttgcatctctcaatctgcaaaaagcgtcgcaccgggggcaacgtgatgctggccgtatgtaaaagaatgtgcttcagggctacaatggaggttagtaataaggtgttatttattcggaacatcatcaacactaccttcgtcatttgtatactgatcctagccgtgtgcgtcgtgtccacaagcgcggttgaaatggagtctctccctgcaggaacttgggagcgagaagaggacctgaccaatttttgtcaccaagaatgccaggtgacagagaccgaatgtctttgcccatacgaggccttggtactgcgcaagcccctcttcctgaactcaattgtcaaaggcatgaagaatcttctgaacagtactaatttggagacgagcctctccatcgaagctccttggggagccattaacgtgcagtctacatttaaaccaaccgtttcgactgcaaatatcgctctgagctggtcctcagtggagcacagagggaacaagatattagtcagtggtaggtctgaaagcatcatgaaactggaggagcggaccggcatttcctgggatctaggggtggaagacgcctcagagagcaagtctctcacagtatccgtgatggatctgagtcaaatgtatagccccgttttcgaatacctttctggagaccgccaggtcgaggaatggccgaaggcgacctgcactggcgattgtcctgagagatgcggttgtacatcctcaacgtgcttgcataaagagtggccccacagtaggaattggcgttgtaacccaacctggtgctggggcgtggggactggatgtacatgctgtggcctggacgtgaaggatctctttaccgactatatgttcgtcaaatggaaggttgaatacatcaaaacagaggccattgtgtgcgtggaactgactagccaggagcggcagtgttcgttaatcgaagcagggacccgatttaatctgggacctgtaacgataaccctttccgagcccagaaacattcaacagaagttgccacccgagatcattacactccatcctaggatcgaagagggtttctttgatctgatgcacgtccagaaggtgctatctgctagcactgtttgcaaactgcagtcatgcacccatggcgtgccaggggacctccaagtctaccacataggaaatctgcttaagggcgacaaattgaacggtcacatgatccataagattgaaccgcacttcaatacaagttggatgtcctgggatgggtgtgacctggattattactgcaacatgggcgactggccctcttgtacttataccggagtgacgcagcataaccacgccgcttttgttaatttactcaacatcgagacagattacaccaaaaatttccacttccatagcaagcgcgtgactgcccacggcgacacacctcagctggatcttaaagcacggccaacctatggggccggagaaattactgtactggtcgaggtggctgacatggagttgcataccaagaagatcgatatatccggcctcaaatttgcgtcactgacatgcgcaggttgttacgcctgcagcagtgggatttcttgtaaggtgagaatccacgtcgacgaacccgatgagctaacggttcatgtgaaatccgaagaccctgatatcgtagctgccagcacctcgctgattgcaaggaagctcgagctgggaactgactcaacattcaaagccttttctgctatgccaaagaccagtctttgcttctatatcgtggagcgcgaatactgtaagtcctgcagcaaagaggacacacagaagtgtgtcaacactaaattggaacacccccaaggcattctgatagagcacaagggtaccatcattggcaaacagaatgatacgtgcacagccaaggcagggtgctggttagaatctgttaagagctttttctacggactcaaaaacatgctgtccggcatctttgggaatgtgttcattggaatctttcttttcctggcgccgtttgtgctactcatactgttctttatgttcggctggcgattgctgttctgttttaagtgctgtcggcgtaccagaggtttattcaaatataggcatctcaaggaggacgaggaatcagggtaccgccggatcattgagagactgaacaataaaaagggaaagaacaaacttctggatggcgaaaggttggctgaccgacgcatcgccgagctctttagtactaagacccacattggt

SEQ ID NO: 10486 - RNA, 3495 nt, synthetic construct
  misc_feature 1..3495: note = derived and/or modified CDS sequence (opt3) from CCHVF(CCHVF Zahedan 2007)__KC867273.1__Gn-NSm-Gc
  source 1..3495: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgcgtagcttcaaattgtgtgaaaattccgctactggtaagtcttgcgagattgattcgatccctgtaaaatgtaagcaggggttttgcttaaaaattacccaggagggacgaggccatgtgaagctgtcaagaggcagcgaagtcgtgctagacgtttgtgatagttcctgcgaggtgatgatcccaaaggggacaggagacatactcgtcgattgttctggtggccagcaacacttcctgaaagacaaccttgtggatctggggtgcccgaagatccccttgctcggaaaaatggcaatttacatctgtaggatgagcaatcatcctaagaccactatggcctttctgttctggttttccttcggctatgtaattacatgcatcctgtgcaaagcgatatttttcctcttaattatctttggtaccctggggaagcggttcaagcagtaccgcgaacttaaaccacagacgtgtactatttgcgagaccacacccgttaacgctatcgacgccgagatgcacgatttgaattgttcatataacatctgcccttactgtgcaagtagactgactagcgacggactagccaggcatgtgacccagtgcccacggcgcaaggaaaaagtcgaggaaacagagctctatctgaatcttgaacgaataccctgggtggtgagaaagctgttgcaagtctctgagtccaccggcacggttctcaaaaggtcaagctggctgattgtgttactggtactctttactgtgagtctttctcctgtccagtccgctccaatcggccacgggaagacaattgagacctaccgggtgcgtgaagagtacactagcatctgtctgttcgttttgggatcgatactatttattgtgtctttcctgatgaaaggtctcgtcgacggcgtggggaacatcttctttccgggactgtccgtatgcaagacatgttcaatcggcagtattaatggtttcgaaatcgagagccaccgctgctattgttccttattttgctgcccctactgtagacattgctctgcagatggggaaattcaccagctgcatttgagcatatgtaagaaaaggaagaccggctcaaacgttatgctcgccgtgtgcaaacggatgtgtttccgagctacgatggaggtcagtaataaggtgctgtttatccgctccattatcaacaccacattcgtcgtgtgcatcttaattctggccgtttgtgtggtaagcacttctgcggtcgagatggaatcactacctgcaggaacctgggagagagaagaggacctcacaaatttttgccaccaggaatgtcaagtgactgagaccgagtgcctgtgtccatatgaagcccttgttttgaggcggcccctgttcctcgatagtatagtgaaagacatgaagaacctgcttaacagcacatccctggagacctctttgtcgatcgaagctccttggggcgccattaatgtccagagcacttacaagccaacggtgtccacagcaaacatcgctctctcatggagttctgtagagcaccgcgggaataaagtgctggttagcggaagatccgagtcaattatgaagttagaagagaggaccggtatcagctgggatctgggcgtcgaagacgcctctgagtccaaactactcactgtgagtgtgatggatctgagccagatgtattctcccgtctttgaatacctttccggggaccgtcaagttgaggagtggccgaaggcgacctgcacaggagattgccctgaacggtgtggctgcacctcaagtacttgtttgcataaagagtggccccacagccgaaactggagatgcaatccaacatggtgttggggtgtggggacgggctgcacctgttgcggactggacgtgaaggatctcttcactgactatatgtttgtaaagtggaaagtcgaatacataaagacagaggccatcgtgtgtgttgaactgacctcgcaggagaggcagtgctccttaattgaggcaggcacacgcttcaacctggggtctgtgactatcacccttagcgaacctcggaatattcagcaaaaattgcccccagagatcataacgctccatcccaagattgaagagggatttttcgacctgatgcacgtccagaaagtgctatcagctagtaccgtttgtaagctgcagtcctgcacacatggtgtgcctggcgatctccaggtataccacatcgggaacctgcttaagggagacagagtcaatggccacttgattcataaaatcgaacaacacttcaacacttcttggatgagctgggatggttgcgacctggattattactgtaatatgggggactggccatcctgcacctatacaggcgtgactcagcataaccacgcctcatttgtgaatttactcaacatagagaccgattacacgaagacattccactttcatagcaaaagggtcaccgctcacggagacactccgcagctggatcttaaggcccgccccacatatggcgcaggggagatcaccgttctggtggaagtagccgacatggagttgcatactaaaaagattgaaatcagtggactcaaattcgctggcctgacctgtacaggttgctacgcgtgttcttccgggattagctgcaaggtgcgaatccacgtcgatgagcctgacgagctaacggtgcatgttaagtcggatgacccagacgtggtcgcagcctcatctagtctgatggctcggaaactcgaatttggaaccgattccactttcaaggcctttagcgcaatgcccaaaacatctctgtgtttctatatagtggagcgtgaatactgcaagagctgttccaaagaggacacccagaagtgcgttaatacaaaacttgaacaacctcagtcaattttgatcgagcacaagggcactatcattggtaagcagaacaacacctgtacggccaaagctagttgctggctggagagcgtgaagtcctttttctacggccttaaaaatatgctcgggggaatctttggcaacgtcttcattgggatatttacattcctgaccccattcatccttctgatctttttctttatgttcggatggaggattctattttgcttcaagtgttgcagacgcactcggggcctctttaagtatagacacctgaaagatgacgaagagaccggttacaggaagattatcgaacgattgaataacaaaaaggggaaaaatcgcctgttagatggagagcggctcgccgacagaaagatagcagaactgttctctacaaagactcatatcggc

SEQ ID NO: 10487 - RNA, 3495 nt, synthetic construct
  misc_feature 1..3495: note = derived and/or modified CDS sequence (opt3) from CCHVF(CCHVF SPU 44/08)__KJ682805.1__Gn-NSm-Gc
  source 1..3495: mol_type = other RNA
agcgaggaatccaacgacgattgcctgtctagaacccagctccttaggacagagaatgccgaaatccactcagacaactacggcgggcccggagataagattactatatgtaatggtagtacgatcgtggaccaacggctgggcagcgagttggggtgctataccattaaccgcgtcaaatccttcaagttatgtgaaaattctgctacaggaaaatcgtgcgagatcgattcaactcctgttcgatgtcgtcagggcttttgcctgaagattacccaggagggtagagggcatgtgaaactaagcaggggaagtgaagtagtgctcgacgcatgtgattcctcttgcgagatcatgataccaaagggcacaggcgacatcctggtcgattgtagcgggggacagcaacacttccttaaggacaacctggtggatttgggttgcccgaatattcccctcctgggcaaaatggccatctacatttgtcggatgtccaaccatcctaagaccactatggcgtttctgttctggttttcattcgggtatgttatcacatgcatactctgcaaagctatcttttacttactgattgtggtcggaacccttggcaagaaattcaagcagtatcgcgaattgaagccacagacgtgtactatttgcgagaccaatcccgtgaacgccatcgacgcagagatgcacgatctgaattgtagttacaacatctgcccttattgtgccagcagactaacatctgacggtctcgctaggcatgtaatgcagtgcccaaaacggaaggagaaaattgaagaaactgagctgtaccttaatctggaacgcataccctgggttgtgcgaaagttgctccaagtctccgagtcaaccggggtggcactgaaaagaagcagttggttagtgatcctgctcgtccttctgacagtttctttgtcccctgtgcagagcgccccaatttcgcacggagagaccgtagaagtgtaccagacgagggagggctatacttctatctgtctatttgtcctgggctccatactcttcctggtgtcatgccttatgcgggggctggttgacagtgtgagcaactcctttttcccgggattgtctatttgtaagacatgcagcatcggttcaatcaatggctttgaaattgagagtcacaaatgttactgctccctcttctgctgtccctattgccgtcattgtagcgctgatatcgaaattcacaagctgcatttatctatatgcaagaaacgcaagaccgggtcaaacgtcatgctggccgtgtgtaaaagaatgtgcttcagggcgactgtagaggttagtaacaaggcactactcatccggaatattatcaacacaacctttgtggtctgtatcctgattcttgccgtgtgcgtcgtgagcacgtccgctgttgagatggaaaatttgcctgccggaacctgggagaaagaagaggacctgacaaacttctgtcaccaggaatgccaagtgactgagaccgagtgtctctgcccatacgaagcactggtacttcgaaagcccctgtttttggattctatagtcaagggcatgaaaaatctcctgaactcgacaagtttagagacttccctgtcaatcgaagctccttggggtgccattaatgtgcagagtaccttcaagccaacagtttctgcggccaacatcgcactaagctggtcctcagtggagcaccgcgggaataaaattctcgtcagcggcagatctgagtccatcatgaagctggaagagaggaccggaataagttgggaccttggcgtggaagatgctagcgagtctaaattgctgactgtatccgtgatggacctctcacagatgtatagtcccgtttttgaatacctgagcggggatcggcaagtcgaggagtggccgaaggccacgtgcacaggagactgtcctgaacgctgcggttgtacctcgtccacttgcttacataaggagtggccccactctagaaactggaggtgtaatccaacctggtgctggggcgtggggacaggatgtacctgctgtggcctggatgtgaaagaccttttcactgattatatgtttgtcaagtggaaagttgactacatcaagacagaagctattgtgtgcgtggagttgacgagccaggaacgtcagtgttcactcatcgaggccggtacccggttcaacctggggcctgtaactattacactaagtgagccccgaaatatccagcaaaaactgccacccgaaatagtcaccctccatcctagaattgaggaaggctttttcgacctgatgcacatccagaaggtgctttccgcatctacagtttgcaagttgcagagctgcactcatggagtgccaggcgatctgcagatttaccacatcgggaacttactcaaaggagacaaggtcaatggtcacctgatacataaaatcgagccgcactttaacacctcctggatgtcatgggatggctgtgaccttgattattactgcaacatgggggactggcccagctgtagttatacgggagtgacccaacataatcacgccgctttcgttaacatgctgaatattgaaacagattacactaagaactttcacttccattctaaaagggtgaccgcgcacggcgacacacctcagttggatctcaaggcacgcccaacttatggtgccggggagatcaccgtactggtcgaggtggctgacatggaactacatacgaaaaagattgagatctccggcctgaagttcgccagcctcacatgcaccggatgttacgcatgctcgtcaggcatatcttgtaaagtgcggattcacgtcgatgaacccgacgagctgactgttcatgtgaagagtgaggatcctgacatcgtagccgcttccagctctcttatggccagaaaattggaatttgggacagacagcaccttcaaggcattttccgcgatgccaaaaacttcactgtgcttctatatcgtggagagggaatactgtaagagttgcagcaaggaggatacccagaaatgtgtcaatacaaagttagaacagccccaatctattctcatcgagcacaaaggaacgattataggcaagcagaacgatacctgcactgctaaagcctcctgctggctggagtcaatcaagagctttttctacggtcttaagaatatgctgagcgggatttttggaaacgtgttcatcggcatttttctattcctcgcaccgtttatcatgctgatattgttctttatgttcggttggcgcatcctgttctgttttaaatgctgtcgacggacacgtggcttattcaagtatagacacctcaaagacgacgaagagattgggtacaggaagatcattgaacgcctgaataacaaaaagggaaagaataaacttctggatggcgagcggttggccgacagaaagatcgctgaactcttttccaccaaaacacatataggg

SEQ ID NO: 10488 - RNA, 3495 nt, synthetic construct
  misc_feature 1..3495: note = derived and/or modified CDS sequence (opt3) from CCHVF(CCHVF SPU 383/87)__KJ682806.1__Gn-NSm-Gc
  source 1..3495: mol_type = other RNA
agcgaggaatccaacgacgattgcctgtctagaacccagctccttaggacagagaatgccgaaatccactcagacaactacggcgggcccggagataagattactatatgtaatggtagtacgatcgtggaccaacggctgggcagcgagttggggtgctataccattaaccgcgtcaaatccttcaagttatgtgaaaattctgctacaggaaaatcgtgcgagatcgattcaactcctgttcgatgtcgtcagggcttttgcctgaagattacccaggagggtagagggcatgtgaaactaagcaggggaagtgaagtagtgctcgacgcatgtgattcctcttgcgagatcatgataccaaagggcacaggcgacatcctggtcgattgtagcgggggacagcaacacttccttaaggacaacctggtggatttgggttgcccgaatattcccctcctgggcaaaatggccatctacatttgtcggatgtccaaccatcctaagaccactatggcgtttctgttctggttttcattcgggtatgttatcacatgcatactctgcaaagtgatcttttacttactggtcgtggtaggaacccttggcaagaaattcaagcagtatcgcgaattgaagccacagacgtgtactatttgcgagaccaatcccgttaacgctattgacgccgagatgcacgatctgaattgtagttacaacatctgcccttattgtgcaagcagactaacatctgacggtctcgccaggcatgtgatccagtgcccaaaacggaaggagaaaattgaagaaactgagctgtaccttaatctggaacgcataccctgggtcgtgcgaaagttgctccaagtgtccgagtcaaccggggtcgctctgaaaagaagcagttggttagttatcctgctcgtgcttctgacagtatctttgtcccctgtgcagagcgcaccaatttcgcacggagagaccgtcgaagtgtaccagacgagggagggctatacttctatctgtctatttgttctgggctccatactcttcctggtgtcatgccttatgaaggggctggtcgacagtgtgggaaacagctttttcccgggtttgtccatttgtaaaacatgctctatcggcagcatcaatgggtttgaaattgagtcacacaagtgttactgcagtctcttctgctgtccctattgccggcattgttccgccgatatcgaaattcaccgtctgcatttaagcatatgcaagaaacgcaagaccggatctaacgtaatgctggctgtttgtaaaagaatgtgcttcagggccactgtggaggtctcaaacaaggcgctactcatccggaatattatcaacacaacctttgtggtctgtatcctgattcttgcagtgtgcgttgtgagtacgagcgccgtagagatggaaaatttgcctgctggcacctgggagaaagaagaggacctgacaaacttctgtcaccaggaatgccaagtcactgagaccgagtgtctctgcccatacgaagccctggtgcttcgaaagcccctgtttttggattccatagttaagggtatgaaaaatctcctgaactctacatcgttagagactagcctgtccatcgaagcaccttggggcgctattaatgtgcagtcaaccttcaagccaacagtcagtgccgcgaacatcgccctatcttggagctccgtggagcaccgcgggaataaaattctcgtatcaggaagaagcgagtctatcatgaagctggaagagaggaccggcatatcctgggaccttggggtggaagatgcaagtgagagcaaattgctgactgtttctgtcatggacctctcccagatgtattcacccgtgtttgaatacctgagtggagatcggcaagtggaggagtggccgaaggctacgtgcacaggtgactgtcctgaacgctgcggctgtaccagctcgacttgcttacataaggagtggccccactccagaaactggaggtgtaatccaacctggtgctggggagtcgggacaggctgtacctgctgtggtctggatgttaaagaccttttcactgattatatgtttgtgaagtggaaagtggactacatcaagacagaagccattgtatgcgtcgagttgacgtctcaggaacgtcagtgtagcctcatcgaggctgggacccggttcaacctgggccctgtgactattacactatcagagccccgaaatatccagcaaaaactgccacccgaaatagttaccctccatcctagaattgaggaaggatttttcgacctgatgcacatccagaaggtgcttagtgcctccacagtctgcaagttgcagtcttgcactcatggcgtgccaggggatctgcagatttaccacatcggaaacttactcaaaggtgacaaggttaatggccacctgatacataaaatcgagccgcactttaacaccagctggatgtcctgggatgggtgtgaccttgattattactgcaacatgggagactggccctcatgtagctatacgggcgtgacccaacataatcacgcagccttcgtaaacatgctgaatattgaaacagattacactaagaactttcacttccatagtaaaagggtcaccgctcacggtgacacacctcagttggatctcaaggcgcgcccaacttatggggcaggcgagatcaccgtgctggtggaggtcgccgacatggaactacatacgaaaaagattgagatctctggactgaagttcgcttccctcacatgcaccggctgttacgcctgcagctcggggatatcatgtaaagttcggattcacgtggatgaacccgacgagctgactgtacatgtgaagtctgaggatcctgacatcgtcgcagccagttccagccttatggctagaaaattggaatttggaacagactctaccttcaaggcctttagcgcaatgccaaaaacttccctgtgcttctatatcgtggagagggaatactgtaagtcatgcagtaaggaggatacccagaaatgtgttaatacaaagttagaacagccccaaagcattctcatcgagcacaaaggcacgatttttggtaagcagaacgatacctgcactgcgaaggcttcttgctggctggagtccgtgaaatcattcttttacgggcttaagaatatgctgagtggaatattcggcaacgtctttatcggtgtgttcctatttctcgccccgttcattatgctgatcttgtttttcatgttcggctggcgcattctgttttgtttcaaatgctgtcgacggacacgtgggttatttaagtatagacacctcaaagacgacgaagagatcggatacaggaagataatcgaacgcctgaataacaaaaagggcaagaataaacttctggatggggagcggttggcagacagaaagattgccgaactcttcagcaccaaaacacatatcgga

SEQ ID NO: 10489 - RNA, 3495 nt, synthetic construct
  misc_feature 1..3495: note = derived and/or modified CDS sequence (opt3) from CCHVF(CCHVF SPU 130/89)__KJ682807.1__Gn-NSm-Gc
  source 1..3495: mol_type = other RNA
agcgaggaacccaactacgactgcctgtccagaacccagctccttaggacagagaatgccgaaatccactctgataactatggcgggcctggagacaagattactatatgtaatggttcaacgatcgtggatcaacggctgggcagtgagttggggtgctacaccattaaccgcgtcaaaagtttcaagttatgtgaaaattccgctacaggaaaatcttgcgagatcgactcgactccagttcgatgtcgtcagggcttttgcctgaagattacccaggagggtagagggcatgtgaaactatcaaggggaagcgaagtagtgctcgatgcatgtgacagttcctgcgagatcatgataccgaagggcacaggcgatatcctggtcgactgttctgggggacagcaacacttccttaaggataacctggtggacttgggttgccccaatattcctctcctgggcaaaatggccatctatatttgtcggatgagcaaccatccaaagaccactatggcgtttctgttctggttttccttcgggtacgttatcacatgcatactctgcaaagtgattttctatttactgatcgtcgtgggaacccttggcaagaaattcaagcagtaccgcgaattgaagccccagacgtgtactatttgcgagaccaatcctgtaaacgctatcgatgccgagatgcacgacctgaattgttcatataacatctgcccatactgtgcaagtagactaacaagcgatggtctcgccaggcatgttatgcagtgccccaaacggaaggagaaaattgaagaaactgagctgtaccttaatctggaacgcataccttgggtggtccgaaagttgctccaagtgtctgagtccaccggggtggctctgaaaagatcaagctggttagtcgttctgctcgtgcttctgacagtaagtttgtctccagtgcagtccgcaccgatcagccacggagagaccgtcgaagtgtatcagacgagggagggctacacttcgatttgtctatttgttctgggctctatcctcttcctggtgtcctgccttatgaaggggctggtcgactcagtgggaaacagctttttccccggtttgagcatatgtaaaacatgctccattggctctatcaatgggtttgaaatcgagagccacaagtgttattgctcactcttctgctgtccttactgccggcattgtagtgccgacattgaaatccacaagctgcatttatccatttgcaaaaagcgtaaaaccggaagcaacgtaatgctggctgtttgtaagcgcatgtgcttcagagccactgtggaggtctctaacaaagcgctactcataaggaatatcattaacacaacctttgtggtctgtatcctgatccttgcagtgtgcgttgtgtcaacgagtgccgtagagatggaaaatttgccagctggcacctgggagaaggaagaggatctgacaaacttctgtcaccaggaatgccaagtcactgagaccgagtgtctctgcccctatgaagccctggtgcttcggaagcctctgagcttggactccattgttaaaggtatgaagaatctcctgaactctacatcgttagagactagcctgtccatagaagcaccatggggcgctatcaatgtgcagtcaacctttaaacccacagtcagtgccgcgaacattgccctatcttggagctccgtggagcaccgagggaataagatcctcgtatcaggacgcagcgagtctattatgaaactggaagagagaaccggcatctcctgggatcttggggtggaagacgcaagtgagagcaagttgctgactgtttctgtcatggatctctcccagatgtactcaccggtgttcgaatatctgagtggagacaggcaagtggaggagtggcctaaggctacgtgcacaggtgattgtcccgaacggtgcggctgtaccagctcgacttgcttacataaagagtggccacactcccgcaactggagatgtaatcctacctggtgctggggagtcgggacaggctgtacctgctgtggtctggacgttaaggatctttttactgactacatgttcgtgaaatggaaggtggattacataaaaacagaagccatcgtatgcgtcgagttgacgtctcaggaaaggcagtgtagcctcattgaggctgggacccgttttaacctgggccccgtgactatcacactatcagagccacggaatattcagcaaaagctgccccctgaaatcgttaccctccatccacgaatagaggaaggattctttgacctgatgcacattcagaaggtgcttagtgcctccacagtctgcaaattgcagtcttgcactcatggcgtgccgggggacctgcagatctatcacattggaaacttactcaagggtgataaagttaatggccacctgatccataagatagagccccacttcaacaccagctggatgtcctgggacgggtgtgatcttgactactattgcaacatgggagattggccttcatgtagctacacgggcgtgacccaacataatcacgcagcctttgtaaacatgctgaatatcgaaacagactatactaaaaacttccactttcatagtaagagagtcaccgctcacggtgatacaccacagttggacctcaaagcgaggcccacttacggggcaggcgagattaccgtgctggtggaggtcgccgatatggaactacatacgaagaaggttgagatctctggactgaaattcgcttccctcacatgcaccggctgttatgcctgcagctcggggatttcatgtaaggtgcgcatccacgtagacgaacctgatgagctgactgtgcatgtcaaatctgaggacccagatatagtggcagccagttccagccttatggctcggaagttggaatttggaacagactctacctttaaagccttcagcgcaatgcccaagacttccctgtgcttttacattgttgagagagaacactgtaagtcatgcagtaaagaggacacccagaggtgtgtgaatacaaagttagaacagccgcaaagcatcctcatcgagcacaaaggcacgattatcggtaagcagaacgatacctgcactgcgaaggcttcttgctggctggagtccattaaatcattcttttacgggcttaagaatatgctgagtggaatattcggcaacgtctttatcggtgtgttcctatttctcgcccctttcattatcctgattttgtttttcatgtttggctggcgcatcctgttctgtttcaaatgctgtcgacggacacgtgggttactcaagtatagacatctgaaagacgatgaagagataggatacaggaagatcattgaacgccttaataacaaaaagggcaagaataaactgttggacggggagcggctcgcagatagaaagatcgccgaactgtttagcaccaaaacacacattgga

SEQ ID NO: 10490 - RNA, 3495 nt, synthetic construct
  misc_feature 1..3495: note = derived and/or modified CDS sequence (opt3) from CCHVF(CCHVF SPU 497/88)__KJ682808.1__Gn-NSm-Gc
  source 1..3495: mol_type = other RNA
agcgaggaatccaacgacgattgcctgtctagaacccagctccttaggacagagaatgccgaaatccactcagacaactacggcgggcccggagataagattactatatgtaatggtagtacgatcgtggaccaacggctgggcagcgagttggggtgctataccattaaccgcgtcaaatccttcaagttatgtgaaaattctgctacaggaaaatcgtgcgagatcgattcaactcctgttcgatgtcgtcagggcttttgcctgaagattacccaggagggtaaagggcatgtgaagctaagcagaggaagtgaagtagtgctcgacgcatgtgattcctcttgcgagatcatgataccaaagggcacaggcgacatcctggtcgattgtagcgggggacagcaacacttccttaaagacaacctggtggatttgggttgcccgaatattcccctcctgggcaagatggccatctacatttgtaggatgtccaaccatcctaaaaccactatggtttttctgttctggttttcattcgggtatgtgatcacatgcatactctgcaaggtcatcttttacttactgattgtggtaggaacccttggcaaaaagttcaagcagtatcgggaattgaaaccacagacgtgtactatttgcgagaccaatcccgttaacgcgatcgacgctgagatgcacgatctgaattgtagttacaacatctgcccttattgtgccagccgcctaacatctgacggtctcgcaagacatgtgatgcagtgcccaaagaggaaagaaaagattgaggaaactgagctgtaccttaatctggaacggataccctgggtcgtgcgcaaattgctccaagtgtccgagtcaaccggggtcgccctgaagcgaagcagttggttagttatcctgctcgtgcttctgacagtatctttgtcccctgtgcagagcgctccaatttcgcacggagagaccgtcgaagtgtaccagacgagagagggctatacttctatctgtctatttgttctgggcgggatactcttcctggtgtcctgccttatgaaaggactggtcgactcagtgggtaacagctttttcccgggcttgagtatttgtaagacatgctccatcgggtctatcaatggatttgaaattgagagccacaagtgttactgctcactcttctgctgtccctattgcaggcattgtagtgcagatatcgaaattcacaaactgcatttatccatatgcaagaaacggaagacctggagcaacgtaatgctggccgtttgtaaacgtatgtgcttccgcgctactgtggaggtctctaacaaggccctactcatcagaaatattatcaacacaacctttgtggtctgtatcctgattcttgcgatatgcgtggtttcaacgagtgcagtggagatggaaaatttgcctgccggcacctgggagaaggaagaggacctgacaaacttctgtcaccaggaatgccaagtaactgagaccgagtgtctctgcccatacgaagctctggtccttaggaaacccctgtttttggatagcatcgtgaagggtatgcggaatctcctgaactccacatctttagagacttcgctgagcattgaagccccttggggcgcaatcaatgttcagtccaccttcaaaccaacagtgtcagctgccaacattgcgctaagttggtctagcgtcgagcaccgagggaataagatcctcgtgtccggacgctcagagagcataatgaaactggaagagagaaccggcatctcttgggaccttggggtagaagatgcctccgagagtaagttgctgactgtgagcgttatggacctctctcagatgtattcccccgtctttgaatacctgtcaggagataggcaagtggaggagtggccgaaggcaacgtgcacaggtgactgtcctgaacggtgcggctgtaccagtagcacttgcttacataaagagtggccccactcgcgcaactggagatgtaatccaacctggtgctggggagtggggacaggctgtacctgctgtggtctggatgtcaaggaccttttcactgattatatgtttgttaaatggaaggtggactacattaaaacagaagctatcgtgtgcgtagagttgacgtcccaggaaaggcagtgttctctcattgaggccgggacccgtttcaacctgggccctgtcactatcacactaagcgagccccggaatatacagcaaaagctgccacccgaaattgtgaccctccatcctcgaatcgaggaaggatttttcgacctgatgcacattcagaaggttctttcagctagtacagtgtgcaaattgcagtcctgcactcatggcgtcccaggggatctgcagatctaccacataggaaacttactcaagggtgacaaagtgaatggccacctgatccataagattgagccgcactttaacacctcttggatgagctgggatgggtgtgaccttgattattactgcaacatgggagactggccctcctgttcatatacgggcgttacccaacataatcacgccgcattcgtgaacatgctgaatatcgaaacagattacactaaaaactttcacttccatagcaagagagtaaccgcccacggtgacacacctcagttggatctcaaagctaggccaacttatggggcgggcgagattaccgtcctggtggaggtggcagacatggaactacatacgaagaagatcgagataagtggactgaaattcgcctctctcacatgcaccggctgttacgcttgctccagcgggatttcgtgtaaggtccgcatccacgttgatgaacccgacgagctgactgtgcatgtaaaatcagaggatcctgacatcgtggccgcatctagttcccttatggcccggaagttggaatttggaacagacagcaccttcaaggctttttctgccatgccaaaaactagcctgtgcttctatattgtcgagagagaatactgtaagtcctgctcaaaagaggatacccagaagtgtgtgaatacaaaattagaacagccccaaagtatcctcattgagcacaagggcacgataatcggtaaacagaacgatacctgcactgcaagggcgagctgctggctggagtctattaagtcctttttctacgggcttaagaatatgctgtcaggaatctttggcaacgttttcattggtatctttctattctttgctccgttcataatgctcatcctgtttttcatgttcggctggcgcattttgttttgtttcaaatgctgtcgacggacacgtgggctgtttaagtatagacacttaaaagacgacgaagaggtgggatacaggaagatcattgaacgcctcaataacaaaaagggcaagaataaactgcttgatggggagcggctggccgacagaaagatcgcagaattgttcagtaccaaaacacatatagga

SEQ ID NO: 10491 - RNA, 3495 nt, synthetic construct
  misc_feature 1..3495: note = derived and/or modified CDS sequence (opt3) from CCHVF(CCHVF SPU 18/88)__KJ682810.1__Gn-NSm-Gc
  source 1..3495: mol_type = other RNA
agcgaggaatccaacgacgattgcctgtctagaacccagctccttaggacagagaatgccgaaatccactcagacaactacggcgggcccggagataagattactatatgtaatggtagtacgatcgtggaccaacggctgggcagcgagttggggtgctataccattaaccgcgtcaaatccttcaagttatgtgaaaattctgctacaggaaaatcgtgcgagatcgattcaactcctgttcgatgtcgtcagggcttttgcctgaagattacccaggagggtagagggcatgtgaaactaagcaggggaagtgaagtagtgctcgacgcatgtgattcctcttgcgagatcatgataccaaagggcacaggcgacatcctggtcgattgtagcgggggacagcaacacttccttaaggacaacctggtggatttgggttgcccgaatattcccctcctgggcaaaatggccatctacatttgtcggatgtccaaccatcctaagaccactatggggtttctgttctggttttcattcggatatgttatcacatgcatactctgcaaagtgattttctacttactgatcgtcgtgggcacccttggtaagaaattcaagcagtatcgcgaattgaagccacagacgtgtactatttgcgagaccaatcccgtaaacgcgatcgacgctgagatgcacgatctgaattgtagttacaacatctgcccttattgtgccagcagactaacatctgacgggctcgcaaggcatgttatgcagtgcccaaaacggaaggaaaagattgaggaaactgagctgtaccttaatctggaacgcataccctgggtggtccgaaagttgctccaagtgtccgagtcaaccggagtggccctgaaaagaagcagttggttagtcatcctgctcgttcttctgacagtgtctttgtcccctgtacagagcgctccaatttcgcacggcgagaccgtggaagtctaccagacgagggagggctatacttctatctgtctatttgtgctggggtccatactcttcctggtttcatgccttatgaagggactggtggacagtgtcggtaacagcttttccccgggcttgtctatttgtaaaacatgcagcatcgggtcaatcaatggattcgaaattgagagtcacaagtgttactgctccctcttttgctgtccctattgccggcattgtagcgcagatatcgaaattcacaagctgcatttatctatatgcaaaaagcgtaaaaccggctcaaacgtgatgctggccgtatgtaagcgcatgtgcttcagagctactgttgaggtgagtaacaaagccctactcatcaggaatattatcaacacaaccttcgtcgtgtgtatcctgattcttgcggtctgcgtggttagcacgtccgcagtggagatggaaaatttgcctgccggtacctgggagaaggaagaggacctgacaaacttttgtcaccaggaatgccaagtaactgagaccgagtgtctctgcccatacgaagctctggtccttcggaagcccctgttcttggattctatagtgaaagggaagaaaaatctcctgaactcgaccagcttagagacttccctgtcaatcgaagccccttggggcgcaattaatgttcagagtacctttaagccaacagtgtctgctgccaacatcgcgctaagctggtcctcagtcgagcaccgaggaaataaaattctcgtgagcggccgctctgagtccatcatgaagctggaagagagaaccgggataagttgggaccttggagtagaagatgccagcgagtctaagttgctgactgtgtccgttatggacctctcacagatgtatagtcccgtcttcgaatacctgagcggtgataggcaagtggaggagtggccgaaagcaacgtgcacaggcgactgtcctgaacggtgcgggtgtacctcgtccacttgcttacataaggagtggccccactctcgcaactggagatgtaatccaacctggtgctggggagtgggcacaggttgtacctgctgtgggctggatgtcaaagacctttttactgattatatgttcgttaagtggaaagtggactacatcaagacagaagctattgtgtgcgtagagttgacgagccaggaaaggcagtgttcactcatcgaggccggcacccgttttaacctgggacctgtcactattacactaagtgagccccggaatatccagcaaaagctgccacccgaaatagtgaccctccatcctcgaattgaggaaggcttctttgacctgatgcacatccagaaagttctttccgcttctacagtgtgcaagttgcagagctgcactcatggggtcccaggagatctgcagatttaccacatcggtaacttactcaaaggcgacaaggtgaatgggcacctgatacataaaatcgagccgcacttcaacacctcctggatgtcatgggatggatgtgaccttgattattactgcaacatgggcgactggcccagctgtagttatacgggtgttacccaacataatcacgccgcatttgtgaacatgctgaatattgaaacagattacactaagaacttccactttcattctaaaagagtaaccgcccacggggacacacctcagttggatctcaaggctaggccaacttatggcgcgggagagatcaccgtcctggtggaggtggcagacatggaactacatacgaagaaaattgagatctccggcctgaagttcgccagcctcacatgcaccgggtgttacgcttgctcgtcaggaatatcttgtaaagtccgcattcacgttgatgaacccgacgagctgactgtgcatgtaaagagtgaggatcctgacatcgtggccgcatccagctctcttatggcccggaaattggaatttggcacagacagcacctttaaggctttctccgccatgccaaagacttcactgtgcttttatatcgtcgagagagaatactgtaaaagttgcagcaaggaggatacccagaaatgtgtgaatacaaagttagaacagccccaatctattctcatcgagcacaaaggtacgattatagggaagcagaacgacacatgcactggaaaggcaggctgctggctggagtccatcaaatcattcttttacggtcttaagaatatgctgagtggcattttcgggaacgtttttatcggaattttcctatttctcgcgccgttcatcatgctgatattgtttttcatgtttggctggaggatcctgttctgtttcaaatgctgtcgccgaacacgggggttatttaagtatcgtcacctcaaagatgacgaagagattggatacagaaagatcattgaaaggctgaagaataaaaagggcaaaaacaaacttctggatggtgagcgcttggctgaccggaaaatcgccgaactcttcagcaccaagacacatataggg

SEQ ID NO: 10492 - RNA, 3495 nt, synthetic construct
  misc_feature 1..3495: note = derived and/or modified CDS sequence (opt3) from CCHVF(CCHVF SPU 556/87)__KJ682811.1__Gn-NSm-Gc
  source 1..3495: mol_type = other RNA
agcgaggaatccgacggcgattgcatctctagaacccagctgctcaggacagagactgccgaaattcactcagacaactacgggggacccggtgataagataacgatctgtaatggcagtaccattgtggaccaacggcttgggagcgagctgggatgctatacaatcaaccgcgtcaaatccttcaagttgtgtgaaaattctgctactggcaaatcgtgcgagattgattcaacccctgttaagtgtcgacagggtttttgcttaaaaatcacacaggaggggcgtggacatgtgaagctgagcagaggcagtgaaatagtactagacgcatgtgattcctcttgcgagatcatgattccaaagggcaccggggacatcctcgtggattgtagcggaggtcagcaacacttcctgaaagacaaccttattgatctgggctgcccgaatatccccttgctcgggaggatggccatatacatttgtcggatgtccaaccatcctaagactacaatggcgtttctgttctggttttcattcggatatgtcatcacatgcattctgtgcaaagtgatcttttacctcttaatcgttgctggcacggtgggtaagaaattcaagcagtatcgcgaactgagaccacagacttgtaccatttgcgagacaactcccgtcaatgccatagacgcagagatgcacgatcttaactgtagttacaatatctgcccttattgtgccagcaggttgacctctgacgggctggctcggcatgtgatgcagtgcccaaagcgcaaagaaaagattgaggaaacagagctatacctcaacctggaacgaatcccctgggtagttagaaaacttctgcaagtgtccgagtcaaccggagtcgcattgaagaggagcagttggctcacggtgctgttagtgctgctcatagtctctctttcccctgttcagagcgccccaattggccacggcaaaactatcgagacataccaggctcgggaagggtatacctcgttttgtctgttcatcttgggatctattctatttatcgtgtcctgcctggtaaagggtctcattgactcagtgggcaatagtttctttccggggctgagcatatgtaaaacttgctccatcggatctgtcaacggcttcgagattgaaagccacaagtgttactgctcacttttctgctgtccctattgccgtcattgtagtgccgatcgcgagatccacaagctgcatttgtccatctgcaaaaagagaaaaacaggtagcaatgtgatgtctgcggtttgtaagaggatgtgctttcgggcaaccattgaagtgtcaaaccgagccctcctgatacgcagtatcattaatacgaccttcgctgtctgtatcttaacactggccgtgtgcgtagttagcacttccgcagtggagatggagtctctacctgctgggacctgggaaagagaggaagacctcacaaacttttgtcaccaggagtgccaagtcactgaaaccgagtgtctgtgcccatacgaggcccttgtgttgaggaaacccctgttcctcgattcgattgtcaagggcaagaaaaacctgcttaatagcacatccctggaaacctcattgagtatcgaggcgccttggggagccataaacgtgcagtctacttttaagccaacggttagcgcagctaatatcgccctctcctggtcaagcgtggaacaccggggcaacaaaattctggtatctgggcgctccgagagtatcatgaagttagaggaaagaacaggaattagctgggacctgggtgtcgaggatgcttctgaatccaaactactcaccgtgtcagttatggacctgagtcagatgtatagccccgtgttcgagtacctttcgggcgataggcaagtcgaagagtggccgaaggccacttgcaccggggactgtcctgagcgttgcggatgtacatcctctacctgcttgcataaggaatggccccacagccggaattggcgatgtaacccaacttggtgctggggcgtgggtacagggtgtacgtgctgtggcctggatgtaaaagacctctttaccgattatatgttcgtgaagtggaaagttgagtacatcaagactgaagcaatagtctgcgtggagctgacatcacaggaaagacagtgtagtttaattgaggccggaaccaggtttaatctgggccctgtgacaatcactctttccgagccccgcaacattcagcaaaaattgccacccgaaatcataaccctccatcctcggatcgaggaagggttctttgacctgatgcacgtccagaaggttctatctgctagcacggtgtgcaagctgcagtcctgcacccatggagtgccaggtgacctccaggtataccacattggcaatctgcttaaaggggataaggtcaacggacacttgatccataaaattgagccgcacttcaatacatcatggatgagctgggacggctgtgatctggactattactgcaacatgggtgattggcccagttgtacttataccggggtgacacaacataatcacgcggcatttgttaacttactcaatatcgaaactgactacaccaagaacttccacttccattctaaaagagtgacggcccacggcgatacacctcagctggaccttaaggctaggccaacctatggagccggcgaggtcactgtgctggttgaggtggcagatatggaattgcataccaaaaagatagagatttccgggctcaagtttgccagcctgtcgtgcaccggatgttacgcttgctcatctggcatcagttgtaaagtacgcatccacgtcgacgaacccgatgagctaactgtgcatgtgaagtccgaggaccctgatattgtcgccgcaggtagctctctgatggcgcgaaaactcgagttcggggctgacagcacctttaaggccttctccgcaatgccaaaaacatcactgtgcttttatatcgttgaacgggaatactgtaagagttgcagccgtgaggacacgcagaagtgtgtgaacaccaaacttgaaagaccccagtctattttgatagagcacaagggaactatcattggcaaacaaaatgatacatgcaccgccaaggcttcctgctggctggagtcagtaaaaagtttcttttacggtttaaagagcatgctctccggcatcttcgggaacgtgtttattggaatcttcctgtttatagccccgttcgtccttctgatcctatttttcatgttcggctggaggattctcttttgtttcaagtgctgtcgccggacaagagggctgtttaaatataggcacttgaaggacgatgaagagactggataccgaaaaatcattgaacgcctgaataacaagaaaggcaagaataagttactcgacggtgagcggctggcagatagaaaaatcgctgaacttttctctaccaagtcgcatataggg

SEQ ID NO: 10493 - RNA, 3495 nt, synthetic construct
  misc_feature 1..3495: note = derived and/or modified CDS sequence (opt3) from CCHVF(CCHVF SPU 431/85)__KJ682812.1__Gn-NSm-Gc
  source 1..3495: mol_type = other RNA
agcgaggaatccgacggcgattgcatctctagaacccagctgctcaggacagagactacggaaattcactcagacaactacgggggacccggtgataagataaccatctgtaatggcagtacaattgtggaccaacggcttgggagcgagctgggatgctatactatcaaccgcgtcaaatccttcaagttgtgtgaaaattctgccaccggcaaatcgtgcgagattgattcaacacctgttaagtgtcgacagggtttttgcttaaaaatcacccaggaggggcgtggacatgtgaagctgagcagaggcagtgaaatagtactagacgcttgtgattccaactgcgagatcatgattccaaagggcactggggacatcctcgtggattgttctggaggtcagcaacacttcctgaaagacaatcttattgatctgggctgcccgaacatccccttgctcgggaagatggcaatatacatttgtaggatgagcaatcatcctaaaacaaccatggcctttctgttctggttttccttcggatatgtcatcacgtgcattctgtgcaaggtgatcttttacctcttaatcgttgcgggcactgtgggtaaaaagttcaagcagtatcgggaactgcgcccacagacctgtacaatttgcgagactatacccgtcaacgctatcgacgccgagatgcacgatcttaattgttcatacaacatttgcccttattgtgcaagtagattgaccagcgacgggctggccaggcatgtgatgcagtgcccaaaacggaaggaaaaagtagaggaaacagagctatacctcaatctggaacgcatcccctgggttgtgcgaaaacttctgcaagtctctgagtccaccggagtggctttgaaaagatcaagctggctcacggtgctgttagtcctgctcatagttagtctttctcctgtgcagtccgcaccaattggccacggcaagactatcgagacataccaggccagggaagggtataccagcttttgtctgttcatcttgggatcgattctatttgtagtgtcttgcctggtcaaaggtctcatcgactccgtgggcaactcattctttccggggctgagtatttgtaagacttgcagcataggatccatcaatggcttcgagattgaatctcacaagtgttactgcagccttttctgctgtccctattgccggcattgtcctgctgatcgtgagatccacaaactgcatttgtcaatctgcaagaaacgcaagacaggtagtaacgttatgctcgccgtgtgtaaaagaatgtgctttagggcgaccattgaagtctccaatcgggcactgttaatacgaaacatcattaacacgaccttcgtggtatgtatcctgacactagccgtttgcgtggtcagcacttctgctgtggagatggagtcactcccagccgggacctgggaaaaggaggaagacctgacaaatttttgtcaccaggagtgccaagtcactgaaaccgagtgtctttgcccctacgaggcattggtgctgcgcaagcctctcttcctggatagtattgttaaaggcagaaagaaccttctgaatagcacatccttggaaacctctctctcgatcgaggctccatggggagccataaacgtgcagagcacttttaaacccacggtatccgcggccaatatcgcactgtcatggagttctgtcgaacacaggggcaacaagattttagtgagcgggcggtccgagtcaatcatgaaactggaggaacgcacaggaattagctgggacctaggtgttgaggatgcttctgaatccaagctcctgaccgtgagtgtcatggaccttagccagatgtattctccggtgttcgagtacttgtccggcgatagacaagtagaagagtggcctaaggccacttgcaccggggactgtcccgagaggtgcggatgtacatcaagtacctgcctgcataaagaatggccacacagccgtaattggcggtgtaaccctacttggtgctggggcgtgggtacagggtgtacgtgctgtggcctcgatgttaaggacctgtttaccgattatatgttcgtcaaatggaaggtggagtacatcaaaactgaagctatagtgtgcgtcgagttaacatcgcaggaacgacagtgttccctgattgaggccggaaccagatttaatcttggccccgttacaatcactttgtctgagccaaggaacattcagcaaaagctgccccctgaaatcataaccctgcatccacgcatcgaggaagggttctttgacctaatgcacgtgcagcgggtgctgagcgcatcaacggtatgcaagctccagagttgcacccatggagtcccgggtgacctccaggtgtaccacattggcaatcttttgaaaggggataaggttaacggacacctgatccataaaattgagccccacttcaatacatcctggatgtcttgggacggctgtgatttagactattactgcaacatgggtgattggcctagctgtacttataccggggtgacacaacataatcacgccgcttttgtcaacctcctgaacatcgaaactgactacaccaagaatttccacttccattccaaaagagtgacggcgcacggcgatacaccacagcttgacctgaaggcaaggcccacctatggagccggcgaggttactgtgttggtagaggtcgctgatatggaactccatacaaagaagatagagatttcagggctgaagtttgccagcctaacctgcactggatgttacgcatgcagttctggcatctcctgtaaagtgaagatccacgtggacgaacctgatgagctgaccgtccatgttaaaagcgaggacccagatattgtggccgctggttcgtcactcatggcccgcaagctggagttcggggcagactctacatttaaagcgttcagtgctatgcccaagacgtccctttgcttttatatcgtagaacgagaatactgtaagagctgctctcgggaggacacccgtaaatgtgtgaacactaagttggatagaccgcagagcattctgatagaacacaaaggaacaatcattggcaagcagaataatacctgcacagccaaagcatcctgctggttagagtcagtcaagagtttcttttacggtctcaagaacatgctgagcggcatcttcgggaacgtgtttattggaatcttcctttttatagcccctttcgttctgctaatcctctttttcatgttcggctggaggattctgttttgtttcaaatgctgtcgccggactagagggttgtttaagtataggcacctgaaagacgatgaggaaaccggataccgaaagatcattgagcgcttaaataacaaaaagggcaagaataaactcctggacggtgaacggcttgctgatagaaagatcgccgagctgttctctacgaaatcccatataggg

SEQ ID NO: 10494 - RNA, 3495 nt, synthetic construct
  misc_feature 1..3495: note = derived and/or modified CDS sequence (opt3) from CCHVF(CCHVF SPU 48/90)__KJ682813.1__Gn-NSm-Gc
  source 1..3495: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaagagcttcaagttgtgtgaaaattccgctactggcaaatcttgcgttattgattcggtgccagtaaagtgtcgacagggttactgcttacgtatcacccaggaggggagaggacatgtgaaactgtcaaggggcagcgaggtcgtgctagacgcatgtgatacaagttgcgaaataatgatcccgaagggcaccggggacattctcgttgattgttccggaggtcagcaacactttctgaaggacaaccttatcgatctgggctgccccaaaattcctttgctcgggaagatggccatctatatatgtcggatgtctaatcatccaactacaaccatggcgttcctgttttggttcagctttggatacgtgattacgtgcatcctgtgcaaagctattttctatctcttaatcatcattggcactctgggtaagcgctttagacagtacagggagcttaaaccccagacctgtacaatatgcgaaactacccctgtcaacgccatcgacgcagagatgcacgatttgaattgttcctataacatttgcccatactgtgcctcacggctgacaagtgacgggctagctcgccatgtgacccagtgccccaagcgaaaggagaaagtagaagagacggaactctacctgaatcttgagagaatcccttgggttgtgaggaagctgttgcaagtcagcgaatctactggagtggcactcaaacggtcctcatggctgatagtgttactggtcctcttcacagttagccttagtccagtgcagtctgccccgattggccacggcaagaccatcgaggcttatcgtgcccgcgaggggtacacttccatctgtctgtttgtattgggaagcattctattcgtggtctcgtgcctgatgaaaagactcgtggactctgttggtaactcctttttccccggcctgtcaatctgtaagacatgcagtattagctccataaatgggtttgaaatcgagtctcacaaatgttattgcagccttttctgctgtccttactgcaggcattgttcagcggataaggaaattcacaagctgcatttgagtatctgcaaaaagcggaaaaccggatccaacgtgatgctcgcagtctgtaagcgaatgtgcttccgcgccacgatggaggtgagcgacagagctctgtttatcaggtctattataaataccacattcgtattatgtatcctgattctagccgtttgcgtggtctcaaccagtgcagtggaaatggagaacctcccagctggcacttgggagcgggaagaggatctgacaaatttttgtcaccaggaatgccaggtcactgagaccgaatgtctttgcccctatgaggccttggtgctgcgcaaacctctcttcagagacagcatcgttaagggtatgaagaacctgcttaactccacatctctggagacctcgttgagcattgaagcgccatggggcgccatcaatgtgcaatccacttacaaacccacggtatcaacagcaaacatagctctcagttggtctagcgtcgagcacagggggaataagatcctggtgtccggacgttcagaaagcattatgaaattagaggagcggaccggcatctcttgggatctgggggttgaagacgcctccgagagtaagctactcactgtgagcgtcatggatctgtctcagatgtattccccggtgtttgaatacctttcaggagaccgacaggtagaggaatggcctaaagctacctgcacaggtgattgtcccgagagatgcggctgtaccagtagcacttgcttgcataaggagtggccacactcgaggaactggcgctgtaatcctacatggtgctggggagtggggacgggctgtacctgctgtggtctggacgttaaggatctcttcactgactacatgtttgtcaaatggaaggtggaatatattaaaacagaggccatcgtgtgcgtcgaactgacctcccaagagcggcagtgttctttaatagaagcagggacaagattcaacctgggccccgttactattacccttagcgagccaaggaatatccagcagaagttgccccctgagattatcacgctccatccacgcatagaagagggatttttcgacctgatgcacgtgcaaaaagtgctatcagccagtaccgtatgcaagctgcagtcctgcacacatggcgtcccgggggatctccaggtgtaccacatcggaaacctgcttaagggtgacaaagttaatggccacttgattcataagatcgaaccccactttaacacttcttggatgagctgggatgggtgtgacctggattattactgcaatatgggagactggccttcctgtacctatacaggcgtgactcagcataaccgagcttcattcgtcaatttactcaacattgagaccgattacacgaaaaattttcacttccacagcaagcgggtgacagcgcatggtgacaccccacaactggatcttaaagcacgtcccacttatggggccggcgaaatcacagttctggtggaggtagctgacatggagttgcacaccaagaaaatagaaattagtggactcaagttcgcctctctgacttgcaccggctgttacgcatgctccagcgggatctcgtgtaaggtcagaatccatgtggatgagcctgacgaactaacagtgcacgtcaaatcagatgacccagacgttgtggccgcttctagttccctgatggccaggaagctcgagtttggaacggatagcaccttcaaagcattttctgcgatgcccaagactagcctgtgcttctacattgtagagaaagaatattgtaagtcctgctcagaggaagacacaaagaaatgtgtgaacaccaaacttgagcagccgcagagtatcttgattgaacataaaggcacaataatcggtaagcagaacagcacttgcaccgctaaagtctcttgctggctggagtccgccaagtcatttttctacgggttaaaggatatgctcagtggaatttttggcaatgtgttcatcggtatttttctgttccttgcaccttttatcctgctaatactcttctttatgttcggctggcgcatcctgttgtgtttcaaatgctgtcggagaacgagggggctgtttaagtatcgacacttaaaagacgatgaggaaacaggataccgccggattatcgagagactcaacaataagaaaggcaagaacaagctgcttgacggggaaaggctggccgatcgtcgcattgctgagttgttcagcaccaaaactcacatcgga

SEQ ID NO: 10495 - RNA, 3495 nt, synthetic construct
  misc_feature 1..3495: note = derived and/or modified CDS sequence (opt3) from CCHVF(CCHVF SPU 187/90)__KJ682814.1__Gn-NSm-Gc
  source 1..3495: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaaatctttcaagttgtgtgaaaattccgctactggcaaatcttgcgagattgattcggttccagtgaagtgtcgacagggttactgcttacgtatcacccaggaggggagaggacatgtaaaactgtcaaggggcagcgaagtggtcctagacgcatgtgatacaagttgcgagataatgatcccgaagggcaccggggacattctcgtggattgttccggaggtcagcaacactttctgaaggacaaccttatcgatctgggctgccccaaaattcctttgctcgggaagatggccatctatatatgtcggatgtctaatcatccaaaaactacaatggcgttcctgttttggttcagctttggatacgttattacctgcatcctgtgcaaggctattttctatctcttaatcatcattggcacgctgggtaaacgctttaagcagtacagagaacttaagccccagacttgtaccatatgcgagacaactcctgtgaacgccatcgacgcagagatgcacgatttgaattgttcctataacatttgcccatactgtgcctcaaggctgaccagtgacgggctagctcggcatgtcacacagtgccccaaacgcaaggaaaaagtggaggaaaccgagctctacctgaatcttgaacgaatcccttgggtagttagaaagctgttgcaagtgagcgagtctacgggagtcgcactcaaaaggtcctcatggctgatagtgttactggtcctcttcactgtgagccttagtccagttcagtctgccccgattggccacggcaagacaatcgaggcttatcgggcccgtgaagggtacacctccatctgtctgtttgtgttgggaagcattctattcgtagtgtcgtgcctgatgaaaggtctcgtcgactctgtgggcaactcctttttccccgggctgtcaatctgtaagacttgcagtattggaagcataaatggctttgagatcgaatcccacaagtgttattgctctcttttctgctgtccttactgccgccattgtagcgcggataaagagattcacaagctgcatttgtcaatctgcaaaaagagaaaaacaggtagtaacgttatgctcgcagtgtgtaagaggatgtgcttccgggccaccatggaagtctccaatcgagctctgtttatccgcagcattataaacacgaccttcgtgttatgtatcctgattctagccgtatgcgttgtgtctacatcagcagtcgagatggagaatctcccagctgggacttgggaaagagaggaagacctgaccaacttttgtcaccaggagtgccaggtgacagaaactgagtgtctttgcccctatgaggccttggtcctgaggcggcctctcttcctggatagtatcgtgaagggcatgaaaaaccttctgaatagcacctccttggaaacatctctctcgattgaggcgccatggggagccatcaacgttcaaagcacctacaagcccactgtgtccacggcaaatatagctctgtcatggagttctgtagaacaccgcggcaacaaaatcttagtcagcgggagatccgagtcaattatgaagctggaggaaaggacaggaatcagctgggacctaggtgtggaggatgcctctgaatccaaactcctgaccgttagtgtgatggaccttagccagatgtattctccggtctttgagtacttgtccggcgatcgtcaggtggaagagtggcctaaggctacttgcaccggggactgtcccgagcggtgcggatgtacatcaagtacctgcctgcataaggaatggccacacagccgaaattggagatgtaaccctacttggtgctggggcgtaggtacagggtgtacgtgctgtggcctcgatgtgaaagacctgttcaccgattacatgtttgttaagtggaaagtcgagtatattaagactgaagccatcgtgtgcgtggagttaacatcgcaagaaaggcagtgttccctgatagaggcaggaacccgcttcaatcttggccccgtcacaattactttgtctgagccacggaacatccagcagaaactgccccctgaaattatcaccctccatccaagaatagaggaagggtttttcgacctaatgcacgttcaaaaggtgctgagcgcctcaacggtgtgcaagctccagagttgcacccatggagtaccgggtgacctgcaggtctaccacatcggcaatcttttgaaaggggataaggtgaacggacacctgattcataaaatcgagccccactttaatacatcctggatgtcttgggacggctgtgatttagactattactgcaacatgggtgattggcctagctgtacttataccggggttacacagcataatcacgcttccttcgtgaacctcctgaatattgaaactgactacaccaagaactttcacttccattcaaaaagggtcacggcgcacggcgatacaccacaacttgacctgaaggcacgccccacctatggagccggcgagatcactgtgttggttgaggtggctgatatggaactccataccaaaaagatagagattagcgggctgaagttcgccagtctaacatgcactggatgttacgcatgcagctccggcatcagctgtaaagtacgaatccacgtcgacgaacctgatgagctgaccgtgcatgtgaagtcggacgatccagacgtcgttgccgcttcatctagtctcatggcccggaaactggagtttggtacagactccattttcaaggcatttagcgcgatgcccaaaacgtctctttgcttctacatcgtggaacgtgagcactgtaagagctgctccgaagaggataccaagaaatgtgtaaacactaagttggaacagccgcagtcaattctgatagagcacaaagggacaatcattggaaagcagaatagtacctgcacagctaaaactagctgctggttagagtctgtgaagtcctttttctatggcctcaagaacatgctgtcaggtatctttggcaatgtcttcattgggatctttcttttcctggccccttttatactactcatcctgttctttatgttcggatggagaattttgttctgttttaaatgctgtaggcgcacccggggcctgttcaagtacagacatttaaaagacgatgaagagacggggtataggcgaatcattgaacgcctcaacaataagaaaggaaagaacaagctgcttgacggcgagcggctggcagatagaaggatcgccgaattgtttagtacaaaaacccacataggt

SEQ ID NO: 10496 - RNA, 3495 nt, synthetic construct
  misc_feature 1..3495: note = derived and/or modified CDS sequence (opt3) from CCHVF(CCHVF Haskovo-V46/13)__KR092379.1__Gn-NSm-Gc
  source 1..3495: mol_type = other RNA
agcgaggaactgggcgacgattgcatctccagaacccagctccttaggacagagactgccgaaattcacgacgataactacgggggacccggtgacaagataacgatctgtaatggctctaccattgtggatcaacggctggggtcagagttgggatgctatacaatcaaccgcggcaaaagtttcaagttatgtgaaaatagcgctactggtaaaacctgcgagattgactccacacctgtcaagtgtcgacaggggttttgcctgaaaatcacccaggagggacgtggccatgttaagctatctagaggctcggaagtggtactcgatgcatgtgactcaagctgcgaggtgatgataccaaaggggactggagatatcctggtcgactgtagtggtggccagcaacacttccttaaagataacctgattgacttggggtgcccgcatatccccctcctgggaaagatggccatttacatctgtaggatgtccaatcaccctcggacaaccatggcgtttctgttctggttttctttcggctatgtgataacgtgcatcttttgcaaagctctcttctacagcttaattattatcggtactctggggaagaaaatcaagcagtatcgcgaacttaagccacagacctgtacaatttgcgagactacccccgttaacgccatagatgcagagatgcatgacttgaattgttcctacaacatctgcccttattgtgcctcaagactgacaagtgacggactagctaggcacgtgacccagtgcccaaaacggaaggaaaaagtcgaggaaacggagctctacctgaatcttgaacgcattccctggatcgtgcgaaagctgttgcaagtaagcgagtctactggcgttgcactcaaaagatcctcatggctgatagtgttactggtcctccttcctgtgagcctgagtccagtgcagtctgccccggtcggccacgggaagacaattgagacctaccagactagggaaggatttacatccatctgtttgttcatgctaggtagcatcctgtttattgtttcgtgcctcgtgaaaggcctggtagattctgtgggggactccttctttcccggactttcagtctgtaagacctgcagtatcggcagcattaacggtttcgagatagaatcccataagtgttattgctctctgttctgctgtccttactgccggcactgtagcgctgatcgtgagatccatcagttgcacctctcaatttgcaaaaagcgcaaaacggggagtaatgtgatgctggccgtttgtaagagaatgtgctttagggcgaccatcgaagcatcccggcgagccttactgatccgcagcattataaacacaactttcgctatgtgtatcctaaccctcacaatttgcgtggtctctacttcagccgtggagatggagaatctgccagcaggcacctgggaaagagaggaagaccttacaaacttttgtcaccaagagtgccaggtaaccgaaactgagtgtttgtgcccctatgaggctctggttctcaggaaacctctgttccttgatagtatcgtgaagggaatgaagaatctgttgaacagcacgtccctcgaaacatctctgtcgattgaggccccatggggcgcgatcaacgtccagagcacctttaaacccactgtgtccaccgccaatatagcattatcatggagttctgtcgaacatcgggggaacaagatcctggtgacaggacgcagcgagtccattatgaaactagaggaaagaaccggtgtttcatgggacctcggcgtggaggatgctagcgaatctaagctgcttactgtatccatcatggacttgagtcaaatgtacagcccggtcttcgagtatctgtctggggatcgtcaggtggaagagtggcctaaagccacatgcacgggagactgtcccgagaggtgcggctgtacctcctcaacttgcctccacaaggaatggccacatagtcggaattggcgatgtaaccctacatggtgctggggtgttgggaccggctgtacatgctgtggagtggatgtcaaggacctgtttactgaccacatgttcgtgaaatggaaggtagagtacattaaaaccgaagctatcgtgtgcgttgagttaacgagccaggaaagacagtgttcgctgatagaggccggcaccaggtttaatcttgggcccgtcacaattactttgtccgagccacgcaacatccaacagaagctgccccctgaaattatcaccctccatccaaaaatagaggaaggattctttgatctaatgcacgtgcagaaggtgctgtctgcaagcacagtctgcaagctccagtcatgcactcacggtatcccgggcgacctgcaagtttatcatattgggaatcttttgaaaggagatcgggtgaacggccacctgatccataagattgagccccacttcaataccagttggatgtcctgggacggttgtgatttagactactactgcaacatgggggattggccttcttgtacgtatacaggcgtgacccagcacaatcatgccgcttttgtaaacctcctgaatatcgaaactgactacacaaaaaccttccacttccatagcaagagagtcactgcgcacggagataccccacagcttgacctgaaagcaaggcccacatatggcgccggggagataacggtgttggttgaggtggctgatatggaactccataccaagaaagtcgagatttccggactgaagtttgcctcactaacttgcacaggctgttacgcatgcagcagtggtatctcttgtaaggtgcgcatccacgttgacgaacctgatgagctgaccgtgcacgtaaaatccagcgacccagacgtcgtggccgctgggacatcgctcatggcccgaaagctggagttcggaactgattcaacctttaaagcattctctgcgatgcccaagacgagtctttgcttttatattgtggaacgggagtactgtaaatcctgcagcgaagacgatacacagaagtgtgtcgacaccaagttggagcaaccgcagtctatcctgattgaacataaaggcactataatcggtaagcagaacgatacctgcacagctcgtgccagctgctggttagagtccgttaaatcattcttttatggcctcaagaatatgctggggagtgtgttcggaaactttcttattggcatcctgctattcctcgcaccttttgtactgttggtgctgttctttatgttcgggtggaaaattttattctgttttaagtgctgtagaaggactcgcggactcttcaagtaccggcacctgaaagacgatgaggaaaccggctacagaaggatcatagagcgacttaacagcaagaaaggtaagaatcgcctgttggacggggaacggctcgccgatagaaaaatcgctgagctgttttctacaaagacgcatattgga

SEQ ID NO: 10497 - RNA, 3495 nt, synthetic construct
  misc_feature 1..3495: note = derived and/or modified CDS sequence (opt3) from CCHVF(CCHVF 24-R-2012)__KR814856.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgacacttcatgcgaggtcatgataccgaagggcacaggggatatcctcgtggactgtagcggaggtcagcaacacttcctgaaagataaccttattgacctgggctgcccccatatccctttgctcgggaagatggccatttacatctgtaggatgagtaatcacccacggaccacgatggcgtttctgttctggttttccttcggatatgttataacttgcatcttttgcaaagctctgttctactctctcattattatcggcaccttaggtaagaaaatcaagcagtatcgcgaactgaagccccagacatgtactatttgcgagaccgcccctgtgaacgcaatagatgccgagatgcatgaccttaattgtagctacaacatctgcccatattgtgcttccagattgacatcagacgggctggcaaggcacgtcccccagtgccctaaacggaaggaaaaagtggaggaaaccgagctatacctcaatctggaacgcattccatggatcgtacgaaaacttctgcaagttagtgagagcacgggagtggccttgaagagatcttcctggctcatagtcctgttagtgctgctcactgtgtcacttagcccggtccagagtgctcccgttggccacggcaagacaattgagacctaccagactagggaagggtttacatctgtgtgtctgttcatgttgggatccatcctatttctggtaagctgcctcgtgaaaggtctggtcgattcggtgtctgactccttctttcctggcctttcagtttgtaagacctgcagtatcgggagcattaacggattcgagatcgaatcccataagtgttattgctctctgttctgctgtccatactgccggcactgtagcgccgatcgtgagattcatcagttgcacctctcaatatgcaaaaagcgcaaaatgggcagtaatgtgatgctggcggtctgtaagagaatgtgctttagggcaacgatcgaagcctcccggcgagctttactgattcgcagcatcatcaacaccacattcgtgatttgtatactaactctcaccatctgcgtagtttctacatcagccgtggagatggagaatctgcccagtggtacttgggaaagagaggaagaccttaccaacttttgtcaccaagagtgccaggtcacagaaaccgagtgtttgtgcccttatgaggcactggtgctcaggaaaccactgttccttgatagcattgtcaaggggatgaagaatctgttgaactccacttctctcgaaacgtcgctgagcatcgaggctccctggggcgccattaacgtgcagtccacatttaaaccgaccgtttcaactgcgaatatcgccttaagttggtctagcgtggaacatcggggaaacaagatactggtaaccggccgctccgagtcaatcatgaaactagaggaaagaacaggggtcagctgggacctcggagtggaggatgcatctgaatccaagctgcttaccgttagtattatggacttgagccaaatgtactctcctgtgttcgagtatctgtccggtgataggcaggtcgaagagtggcccaaagctacttgcacaggcgactgtccagagcgttgcgggtgtacgtcaagtacctgcctccacaaggaatggcctcatagccggaattggcgatgtaaccccacttggtgctggggagtgggcacaggttgtacctgctgtggggtagatgtgaaggacctgtttacagaccacatgttcgttaaatggaaggtcgagtacatcaaaactgaagccattgtgtgcgtggagttaacctcgcaggaaagacagtgttccctgatcgaggctggcacgaggtttaatcttggaccagtcaccataacattgtctgagccccgcaacattcaacagaagctccctccagaaatcattactctgcatccgaaagttgaggaaggcttctttgatctaatgcacgtgcagaaggtgctgagcgcctcaaccgtatgcaagctccagagttgcacacacgggatccccggagacctgcaagtctatcatataggtaatcttttgaaaggcgatcgggtgaacgggcacctgatccataagattgagcctcacttcaatacttcctggatgtcttgggacggatgtgatttagactactactgcaacatgggcgattggccaagctgtacctatacgggtgttacacagcacaatcatgcagcctttgtgaacctcctgaatatcgaaaccgactacactaaaacattccacttccattccaagagagtcaccgctcacggggatactccccagcttgacctgaaagcgaggcctacctatggcgcaggagagattacagtgttggttgaggtggccgatatggaactccatacgaagaaagtagagatctcaggcctgaagtttgctagcctagcctgcaccgggtgttacgcatgcagttctggaatatcctgtaaggtccgcattcacgtggacgaaccagatgagctgactgtgcacgtcaaaagcaacgaccccgacgttgtggccgcttcgacatcactcatggcccgaaagctggagttcggcaccgattctacatttaaagcattcagtgcgatgccgaagacttccctttgcttttatatcgtagaacgggagtactgtaaaagctgctctgaagaggacacccagaagtgtgtggatacgaagttggaacaacctcagagcatcctgattgagcataaaggtacaatcattgggaagcagaatgatacctgcactgctaaagcctcctgctggttagagtcagtcaagagtttcttttatggactcaaaaacatgctgggcagcgtgttcggtaactttttcataggcatccttctgtttctagcaccattcgttctcctggtgttgtttttcatgttcgggtggaagattctgttttgtttcaagtgctgtcgtagaaccaggggattactcaaataccgcctgcttaaggacgacgaagagacaggctaccggagaatcattgaaaggctgaataacaaaaaggggaaaaatcgattgctcgatggagagcgcctggccgaccggaagatcgctgaactattttctactaagacccacataggc

SEQ ID NO: 10498 - RNA, 3495 nt, synthetic construct
  misc_feature 1..3495: note = derived and/or modified CDS sequence (opt3) from CCHVF(CCHVF 36-ST-2014)__KR814857.1__Gn-NSm-Gc
  source 1..3495: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacagcctcattatcatcggcactttaggtaaaaagattaagcagtatcgggaactgaaaccccagacctgtacaatatgcgagactgcccctgttaacgcaatcgatgccgagatgcatgaccttaattgttcctacaacatttgcccatattgtgcttcacgcttgaccagtgacgggctggcaagacacgtgacacagtgccccaagaggaaagaaaaggtcgaggaaaccgagctatacctcaatctggaacggatcccttggatagtgcgcaaacttctgcaagtaagcgagtctacgggagttgccttgaagcgatcctcatggctcattgtgctgttagtcctgctcactgtgagccttagtccagtgcagtctgctccggtcggccacggcaaaacaatcgagacctaccagactagagaagggtttacaaacatctgtctgttcatgttgggatccattctatttatcgttagctgcctggtgaagggtctcgtagattcggtgtctgactccttctttcccggcctgtcagtctgtaagacctgcagtattgggagcataaatggattcgagatcgaatcccataaatgttattgctctcttttctgctgtccttactgcaggcactgtagcgccgatcgggagattcatcagctgcacttgggcatctgcaagaaacgtaagacgggttcaaacgtgatgctcgcggtttgtaaacgcatgtgctttaaggcaaccatcgaagccagtagaagggctctgttaattcggtccataatcaatacaactttcgtgatttgtatcctgaccctagccatttgcgtcgtgagcacatctgcagtagagatggagaacctcccagctgggacttgggaacgagaggaagacctgaccaatttttgtcaccaagagtgccaggtttcagaaacagagtgtctttgcccctatgaggccttggtgctgcgcaagcctctcttcctggatagtatcgtcaaaggcatgaagaaccttctgaacagcacctccttggaaacttctctctcgatagaggcgccatggggagccatcaatgtgcagagcacgtttaaacccacagtctccaccgcaaacattgctctgtcatggagttctgtggaacatagaggcaataagatcttagttactgggaggagcgagtccattatgaaactggaggaacggaccggagtgtcatgggacctaggtgtagaggatgccagcgaatctaagctcctgacagtctccatcatggaccttagtcaaatgtacagcccggtgttcgagtatttgtctggcgatcgccaggttgaagagtggcctaaggctacctgcactggggactgtcccgagagatgcggatgtacatcctcaacgtgcctgcacaaagaatggccacatagtaggaactggcgttgtaatcctacctggtgctggggcgtgggtactgggtgtacatgctgtggcgtcgatgtgaaggacctctttaccgaccacatgttcataaaatggaaggtagagtacattaaaacagaagccatcgtgtgcgttgagctgactagccaggaacggcagtgttcgttaattgaggcaggaacccgatttaacctgggccccgtcacgatcaccctttccgagccaagaaatatacaacagaagttgccccctgaaatcattacactccatccaaagatcgaggaagggttctttgatctgatgcacgtgcagaaagtgctatctgccagcactgtctgcaagctgcagtcatgcacccacggtattccgggagacctccaaatctatcatataggcaacctgcttaaaggggataggttgaatggacacctgattcataagatcgagccccacttcaacacaagttggatgtcctgggacggctgtgatttagactactactgcaatatgggtgattggccttcttgtacttataccggggttacgcagcacaaccatgctgcgtttgtgaatctcctgaacatcgaaacagactacaccaaaactttccacttccatagcaagcgcgtgacagcacacggcgataccccacagcttgacctgaaagcccggcccacttatggagctggcgagattaccgtattggtcgaggtggccgatatggaactccatacaaagaaggttgagatctccgggctgaaatttgcatcactagcctgcacgggatgttacgcttgcagcagtggcatttcttgtaaggtgagaatacacgtcgacgaacctgatgagctgaccgtgcacgttaaatccagcgacccagacgtggtagccgcatcgacttcactcatggcgaggaagctggagttcggtacagattctacctttaaggctttcagtgccatgcccaaaacatccctttgcttttatatcgtcgaacgcgagtactgtaagagctgctctgaagacgatactaaaaagtgtgtggacaccaaattggatcagccgcaaagcattctgatcgagcataaggggacgattatcggaaaacagaatgacacatgcaccgcaaaggcctcctgctggttagaatcagtgaagagtttcttttatggcctcaaaaacatgctgggtagcgtcttcggcaactttttcgttgggatacttctgtttctagctcctttcgtgctcctggtattgtttttcatgtgtggatggaagttcctgttttgcttcaaatgttgccgacggactcgtggcttatttaagtacagacacctcaaagatgacgaggagaccgggtacaggcgcatcattgaacggcttaattctaagaagggcaaaaacagactgctggatggagagaggttggccgaccgaaagatcgcagaactcttctccacaaaatcacatattggt

SEQ ID NO: 10499 - RNA, 3495 nt, synthetic construct
  misc_feature 1..3495: note = derived and/or modified CDS sequence (opt3) from CCHVF(CCHVF 37-R-2013)__KR814858.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgacacttcatgcgaggtcatgataccgaagggcacaggggatatcctcgtggactgtagcggaggtcagcaacacttcctgaaagataaccttattgacctgggctgcccccatatccctttgctcgggaagatggccatttacatctgtaggatgagtaatcacccacggaccacgatggcgtttctgttctggttttccttcggatatgttataacttgcatcttttgcaaagctctgttctactctctcattattatcggcaccttaggtaagaaaatcaagcagtatcgcgaactgaagccccagacatgtactatttgcgagaccgcccctgtgaacgcaatagatgccgagatgcatgaccttaattgtagctacaacatctgcccatattgtgcttccagattgacatcagacgggctggcaaggcacgtcccccagtgccctaaacggaaggaaaaagtggaggaaaccgagctatacctcaatctggaacgcattccatggatcgtacgaaaacttctgcaagttagtgagagcacgggagtggccttgaagagatcttcctggctcatagtcctgttagtgctgctcactgtgtcacttagcccggtccagagtgctcccgttggccacggcaagacaattgagacctaccagactagggaagggtttacatctgtgtgtctgttcatgttgggatccatcctatttctggtaagctgcctcgtgaaaggtctggtcgattcggtgtctgactccttctttcctggcctttcagtttgtaagacctgcagtatcgggagcattaacggattcgagatcgaatcccataagtgttattgctctctgttctgctgtccatactgccggcactgtagcgccgatcgtgagattcatcagttgcacctctcaatatgcaaaaagcgcaaaatgggcagtaatgtgatgctggcggtctgtaagagaatgtgctttagggcaacgatcgaagcctcccggcgagctttactgattcgcagcatcatcaacaccacattcgtgatttgtatactaactctcaccatctgcgtagtttctacatcagccgtggagatggagaatctgcccagtggtacttgggaaagagaggaagaccttaccaacttttgtcaccaagagtgccaggtcacagaaaccgagtgtttgtgcccttatgaggcactggtgctcaggaaaccactgttccttgatagcattgtcaaggggatgaagaatctgttgaactccacttctctcgaaacgtcgctgagcatcgaggctccctggggcgccattaacgtgcagtccacatttaaaccgaccgtttcaactgcgaatatcgccttaagttggtctagcgtggaacatcggggaaacaagatactggtaaccggccgctccgagtcaatcatgaaactagaggaaagaacaggggtcagctgggacctcggagtggatgacgcatctgagtccaagctgcttaccgttagtattatggatttgagccaaatgtactctcctgtgttcgaatatctgtccggtgacaggcaggtcgaggaatggcccaaagctacttgcacaggcgattgtccagagcgttgcgggtgtacgtcaagtacctgcctccacaaggagtggcctcatagccggaattggcgatgtaaccccacttggtgctggggagtgggcacaggttgtacctgctgtggggtagacgtgaaggacctgtttacagatcacatgttcgttaaatggaaggtcgaatacatcaaaactgaggccattgtgtgcgtggaattaacctcgcaggagagacagtgttccctgatcgaagctggcacgaggtttaatcttggaccagtcaccataacattgtctgagccccgcaacattcaacagaagctccctccagagatcattactctgcatccgaaagttgaagagggcttctttgacctaatgcacgtgcagaaggtgctgagcgcctcaaccgtatgcaagctccagagttgcacacacgggatccccggagatctgcaagtctatcatataggtaatcttttgaaaggcgaccgggtgaacgggcacctgatccataagattgaacctcacttcaatacttcctggatgtcttgggatggatgtgacttagattactactgcaacatgggcgactggccaagctgtacctatacgggtgttacacagcacaatcatgcagcctttgtgaacctcctgaatatcgagaccgattacactaaaacattccacttccattccaagagagtcaccgctcacggggacactccccagcttgatctgaaagcgaggcctacctatggcgcaggagaaattacagtgttggttgaggtggccgacatggagctccatacgaagaaagtagaaatctcaggcctgaagtttgctagcctagcctgcaccgggtgttacgcatgcagttctggaatatcctgtaaggtccgcattcacgtggatgagccagacgaactgactgtgcacgtcaaaagcaacgaccccgatgttgtggccgcttcgacatcactcatggcccgaaagctggagttcggcaccgactctacatttaaagcattcagtgcgatgccgaagacttccctttgcttttatatcgtagagcgggaatactgtaaaagctgctctgaggaagatacccagaagtgtgtggacacgaagttggagcaacctcagagcatcctgattgaacataaaggtacaatcattgggaagcagaatgtgacctgcactgctaaagcctcctgctggttagagtcagtcaagagtttcttttatggactcaaaaacatgctgggcagcgttttcggtaactttttcataggcatccttctgtttctagcaccattcgtgctcctggtcttgtttttcatgttcgggtggaagattctgttttgtttcaagtgctgtcgtagaaccaggggattactcaaataccgcctgcttaaggatgacgaggaaacaggctaccggagaatcattgagaggctgaataacaaaaaggggaaaaatcgattgctcgatggagaacgcctggccgaccggaagatcgctgagctattttctactaagacccacataggc

SEQ ID NO: 10500 - RNA, 3495 nt, synthetic construct
  misc_feature 1..3495: note = derived and/or modified CDS sequence (opt3) from CCHVF(CCHVF 44-ST-2010)__KR814859.1__Gn-NSm-Gc
  source 1..3495: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgctgtggttctcttttggatatgtgattacgtgcatcttctgcaaggctctcttttacagcttaattatcatcggcactctgggtaaaaagattaagcagtatcgggaacttaaaccccagacctgtacaatatgcgagactgcccctgttaacgcaatcgatgccgagatgcatgacttgaattgttcctacaacatttgcccatattgtgcttcacgcctgaccagtgacgggctagcaagacacgtgacacagtgccccaagaggaaagaaaaggtcgaggaaaccgagctctacctgaatcttgaacggatcccttggatagtgcgcaaactgttgcaagtaagcgagtctacgggagttgccctcaagcgatcctcatggctgattgtgttactggtcctccttactgtgagcctgagtccagtgcagtctgctccggtcggccacggcaaaacaatcgagacctaccagactagagaagggttcacaaacatctgtttgtttatgctaggatccattctgttcatcgttagctgcctcgtgaagggtctggtagattcggtgtctgactcctttttccccggcctttcagtctgtaagacctgcagttttgggagcattaatggattcgagatagaatcccataaatgttattgctctctgttctgctgtccttactgcaggcactgtagcgccgatcgggagatccatcagttgcacctcggcatttgcaagaaacgtaagacgggttcaaacgtgatgctggcggtttgtaaacgcatgtgctttaaggcaaccatcgaagccagtagaagggctttactgatccggtccattataaatacaactttcgtgatctgtattctaaccctcgccatctgcgtcgtgagcacatctgcagtagagatggagaacctgccagctgggacttgggaacgagaggaagaccttaccaatttttgtcaccaagagtgccaggtttcagaaacagagtgtttgtgcccctatgaggccctggtgctccgcaagcctctgttccttgatagtattgtcaaaggcatgaagaacctgttgaacagcacctccctcgaaacttctctgtcgatcgaggcgccatggggagccataaatgtgcagagcacgtttaaacccacagtctccaccgcaaacatcgctttatcatggagttctgtggaacatagaggcaataagattctggttactgggaggagcgagtccatcatgaaactagaggaacggaccggagtgtcatgggacctcggtgtagaggatgccagcgaatctaagctgcttacagtctccattatggacttgagtcaaatgtacagcccggtgttcgagtatctgtctggcgatcgccaggttgaagagtggcctaaggctacctgcactggggactgtcccgagagatgcggatgtacatcctcaacgtgcctccacaaagaatggccacatagtaggaactggcgttgtaatcctacctggtgctggggcgtgggtactgggtgtacatgctgtggcgtcgatgtgaaggacctgtttaccgaccacatgttcatcaaatggaaggtagagtacataaaaacagaagccattgtgtgcgttgagttaactagccaggaacggcagtgttcgctgatcgaggcaggaacccgatttaaccttggccccgtcacgattaccttgtccgagccaagaaatatccaacagaagctgccccctgaaataatcacactccatccaaagattgaggaagggttctttgatctaatgcacgtgcagaaagtgctgtctgccagcactgtctgcaagctccagtcatgcacccacggaatcccgggtgacctgcaaatttatcatatcggcaaccttttgaaaggggataggctgaatggacacttaatacataagattgagccccacttcaacacaagttggatgtcctgggacggctgtgatctcgactactactgcaatatgggtgattggccttcttgtacttataccggggttacgcagcacaaccatgctgcgtttgtgaatctgcttaacatcgaaacagactacaccaaaactttccacttccatagcaagcgcgtgacagcacacggcgataccccacagctggacttgaaagcccggcccacttatggagctggcgagatcaccgtactcgtcgaggtggccgatatggaactgcatacaaagaaggttgagatttccgggctaaaatttgcatcactggcctgcacgggatgttacgcttgcagcagtggcatctcttgtaaggtgaggattcacgtcgacgaacctgatgagctcaccgtgcacgttaaatccagcgacccagacgtggtagccgcatcgacttcactgatggcgagaaaacttgagttcggtacagattctacctttaaggctttcagtgccatgcccaagacatccttgtgcttttatatagtcgaacgcgagtactgtaagagctgctctgaagacgatactaaaaagtgtgtggacaccaaactggatcagccgcaaagcatcttaattgagcataaggggacgatcattggaaaacagaatgacacatgcaccgcaaaggcctcctgctggctcgaatcagtgaagagtttcttttatggcctgaaaaacatgcttggtagcgtcttcggcaactttttcgttgggatcctgctatttctcgctcctttcgtgctgttggtactgtttttcatgtgtggatggaagatattattctgctttaaatgttgccgacggactcgtggcctcttcaagtacagacacctgaaagatgacgaggagaccgggtacaggcgcatcattgaacggcttaattctaagaagggcaaaaacagactgttggatggagagaggctcgccgaccgaaagatcgcagaactgttttccacaaaatcacatattggt

SEQ ID NO: 10501 - RNA, 3495 nt, synthetic construct
  misc_feature 1..3495: note = derived and/or modified CDS sequence (opt3) from CCHVF(CCHVF 46-ST-2012)__KR814860.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaaaagatcctcatggctcatagtcctgttagtgctgctcacggtgagccttagtccggtccagtctgctcccgttggccacggcaagactattgagacataccagaccagggaagggtttacttccatctgtctgttcatgttgggaagcatcctatttctggtgtcgtgcctcgtaaaaggtctggtggattctgtctccgactcattctttcctggccttagtgtgtgtaagacatgcagcattgggtccatcaacggattcgagattgaatctcataagtgttattgcagcctgttctgctgtccatactgccggcactgttcagccgatcgtgagatacatcagttgcacctcagtatctgcaaaaagcgcaaaaccggctccaatgttatgctggcggtgtgtaagagaatgtgctttagggcaacgattgaagccagccggcgagctttactgatccgctctatcattaacgccaccttcgtcatatgtatcctaacactcactatttgcgtggtatcaaccagtgcagttgagatggagagcctgcccgctggtacatgggaaagagaggaagaccttactaatttttgtcaccaagagtgccaggtgaccgaaacagagtgtttgtgcccttatgaggccctggtcctcaggaaaccactgttccttgattccatcgtgaaggggatgaagaacctgctcaattctacctcgttggaaactagcctgtccattgaggcgccctggggcgccatcaacgtccagtcaacgtttaaaccgacagtgagtaccgcaaacatagctttatcttggagctccgttgaacatcggggaaataagatcctggtgactggccgctcagagagcattatgaaactagaggaaagaaccggggtatcttgggacctcggagtcgaggatgcctccgaaagtaagctgcttacagtgagcatcatggacttgtctcaaatgtactcccctgttttcgagtatctgtcaggtgatcgtcaggtggaagagtggcccaaagctacctgcactggcgactgtccagagaggtgcgggtgtacaagtagcacgtgcctccacaaggaatggcctcattcgcggaactggcgatgtaatcccacctggtgctggggagtcggcactggttgtacatgctgtggggtggatgtaaaggacctgtttaccgaccacatgttcgtgaaatggaaggttgagtacattaaaacagaagccatcgtctgcgtggagttaacttcccaggaaagacagtgttctctgatagaggcaggcaccaggtttaaccttggaccagtgacgattaccttgagcgagccccgcaatatccaacagaagctccctccagaaattatcacactgcatccgaaagtcgaggaaggcttctttgatctaatgcacgttcagaaggtgctgtcagccagtactgtgtgcaagctccagtcctgcacccacgggatacccggagacctgcaagtatatcatatcggtaaccttttgaaaggcgatcggattaatgggcacctgatccataagattgagcctcacttcaacacatcttggatgagctgggacggatgtgatttagactactactgcaatatgggcgattggccatcctgtacttataccggtgtcacgcagcacaaccatgctgcgtttgtgaatctcctgaacatcgaaacagactacaccaaaactttccacttccattcaaagagagttacagcacacggggatactccccagcttgacctgaaagccaggcctacttatggcgctggagagataaccgtgttggtcgaggtggccgatatggaactccatacaaagaaagttgagattagcggcctgaagtttgcaagtctagcctgcacggggtgttacgcttgttcttccggaatcagctgcaaggtgcgcatccacgtagacgaaccagatgagctgaccgtccacgtgaaatcgtcagaccccgacgtggtcgccgcatctaccagtctcatggcgcgaaagctggagttcggcacagattccacctttaaggctttcagcgccatgccgaagacatctctttgcttttatattgttgaacgggagtactgtaaaagctgctccgaagaggacactcagaagtgtgtggatacccgtttggaacaacctcagtcaatcctgattgagcataagggtacgataatcgggaaacagaatgacacatgcaccgcaaaggccagttgctggttagagagcgtaaaatctttcttttatggactcaagaacatgctgggctccgtgttcggtaactttttcattggcatccttctgtttctagctccattcgtcctcctggtgttgtttttcatgttcgggtggaaaattctgttttgtttcaagtgctgtagaaggactcgcggattactcaagtaccggcacctgaaagatgacgaagagaccggctacagaaggatcatagaacgacttaataacaagaaagggaagaatcgcctgttggatggagagcggctcgccgacagaaaaatcgcagaactgttttcaacaaagactcatattggc

SEQ ID NO: 10502 - RNA, 3495 nt, synthetic construct
  misc_feature 1..3495: note = derived and/or modified CDS sequence (opt3) from CCHVF(CCHVF 47-ST-2013)__KR814861.1__Gn-NSm-Gc
  source 1..3495: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtaagaatagcgctactggcaaaacctgcgaaattgactccacaccagttaagtgtcgccagggtttttgcttaaagatcacccaggaggggcgaggacatgtgaaactgtctcgtggctcggaggtagtgctagatgcatgtgactcaagctgcgaaataatgatcccgaagggcactggggatattctcgtcgactgtagtggaggtcagcaacacttcctgaaagataaccttatcgacctgggctgcccccatattcctttgctcgggaagatggccatctacatatgtagaatgtccaatcacccaaggacaaccatggcgtttctgttctggttttctttcggatatgtgattacgtgcatcttttgcaaagctctgttctacagcctcattatcatcggcactttaggtaagaagattaaacagtatcgggagctgaagccccagacctgtacaatatgcgaaactgcccctgttaacgcaatcgatgccgagatgcatgaccttaattgttcctacaacatttgcccatattgtgcttcacgcttgaccagtgacgggctggcaagacacgtgacacagtgccccaaaaggaaggagaaagtcgaagagaccgaactatacctcaatctggagcggatcccttggatagtgcgcaaacttctgcaagtaagcgaatctacgggagttgccttgaaacgatcctcatggctcattgtgctgttagtcctgctcactgtgagccttagtccagtgcagtctgctccggtcggccacggcaagacaatcgagacctaccagactagagaggggtttacatccatctgtctgttcatgttgggaagcattctatttatcgtttcgtgcctggtgaagggtctcgtagattctgtgtccgactcattctttcccggcctgagtgtctgtaggacctgcagcattgggtccataaacggattcgaaatcgagtctcataaatgttattgcagccttttctgctgtccttactgccggcactgttcagccgatcgtgaaattcatcagctgcacttgagtatctgcaagaaacgcaagacgggctccaatgtgatgctcgcggtttgtaaaagaatgtgctttaaggcaaccatcgaggccagcaggcgggctctgttcattcgatctataatcaacacaacttttgtgacctgtattttaacactggccatctgcgtcgtgtcaaccagtgcagtagaaatggaggacctaccagctggtacttgggagcgcgaagaggatctcacaaatttctgtcaccaagaatgccaggttaccgagactgaatgtctgtgcccctatgaggcccttgtgttgagaaagcctctgtttctcgacagcattgtcaaagggatgaagaacctgcttaattccacgtctctggagacatcgttgagcatcgaagcgccatggggcgccataaacgtgcagtccaccttcaaacccactgtctcaaccgcaaacatcgctctcagttggtctagcgtggagcataggggaaataagattctggttacaggccggtccgaatcaatcatgaaattagaggagcgcaccggggtgagctgggatctgggagtagaagacgcctctgagtccaagctactcactgtcagtattatggatctgagccaaatgtactctccggtgtttgaatatctttccggtgacagacaggttgaggaatggcctaaggctacatgcacgggcgagtgtcccgagaggtgcgggtgtacctcaagtacttgcttgcacaaagaatggccacatagccgtaactggcggtgtaatcctacatggtgctggggagtgggcaccggttgtacatgctgtggggtcgatgtgaaggacctgttcactgaccacatgtttatcaaatggaaggtagagtacataaaaaccgaagccattgtgtgcgttgagctcacgtcgcaggaacgacagtgttccctgatcgaggcaggcaccagattcaacttaggacccgtcacaattactctgtctgagccaaggaatatccaacagaaacttccccctgaaataatcaccttgcatccaaagattgaggaaggctttttcgatctcatgcacgtgcagaaggtgctgagcgcctcaacagtctgcaagctacagagttgcactcacgggatcccgggagacctgcaaatttatcatatcggtaacctcctgaaaggcgatcgcgttaatgggcaccttatacataagattgagccccactttaacacctcctggatgtcttgggacggatgtgatttggactactactgcaatatgggcgattggcctagctgtacgtatacaggtgtgacccagcacaaccatgctgcgttcgtgaatctgttaaacatcgaaactgactacacaaaaaccttccactttcattccaagcgggtaactgcacacggggataccccacagctcgacctgaaagccagacccacatatggcgctggagagatcacggtccttgtggaggttgccgatatggaactgcataccaagaaggtggaggtctcaggcttgaaattcgcaagcctcgcctgcactgggtgttacgcttgcagttctggaatttcctgtaaggtgaggatccacgttgacgaacctgatgagctgacagtgcacgtaaaaagctcggacccagacgtcgtggccgcatcaacctctctaatggcgcgcaagctggagtttggcacagatagtactttcaaggctttttccgccatgcccaagaccagcctctgcttctatattgtggaacgagagtactgtaagtcttgcagcgaagacgatacgaaaaagtgtgtcgacacaaaactggagcagccgcaatccatacttatcgaacataagggtaccattatcgggaaacagaatgatacttgcaccgcaaaggcctcatgctggttggagagtgttaagagctttttctatggactgaaaaacatgttaggctctgtgtttggtaatttctttgtaggcattctcctgttccttgctccttttgtgctgctagtcctcttcttcatgtttgggtggaagatcctgttctgttttaaatgctgtcggcgtacaagaggattgttcaagtacaggcacctgaaagacgatgaggaaactggctaccgccggataatcgagagattaaactccaagaaggggaaaaacaggctcctggacggagaacgacttgccgatcgcaagattgcagagctgttttcaaccaaaacacatatcggc

SEQ ID NO: 10503 - RNA, 3495 nt, synthetic construct
  misc_feature 1..3495: note = derived and/or modified CDS sequence (opt3) from CCHVF(CCHVF 52-R-2014)__KR814862.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgacacttcatgcgaggtcatgataccgaagggcacaggggatatcctcgtggactgtagcggaggtcagcaacacttcctgaaagataaccttattgacctgggctgcccccatgttcctttgctcgggaagatggccatctacatttgtaggatgagtaatcacccacggaccacgatggcgtttctgttctggttttccttcggatatgtgatcacttgcatattttgcaaagctctgttctactctctcattatcattggcaccttaggtaagaaaatcaagcagtatcgcgaactgaagccccagacatgtactatctgcgagaccgcccctgtcaacgcaattgatgccgagatgcatgaccttaattgtagctacaacatatgcccatattgtgcttccagattgacatcagacgggctggcaaggcacgtgccccagtgccctaaacggaaggaaaaagtagaggaaaccgagctatacctcaatctggaacgcatcccatggattgttcgaaaacttctgcaagtgagtgagagcacgggagtcgccttgaaaagatcttcctggctcatcgtgctgttagtgctgctcactgtctcacttagcccggttcagagtgctcccgtgggccacggcaagacaatagagacctaccagactagggaagggtttacatctgtatgtctgttcatgttgggatccattctatttctggtgagctgcctcgtcaaaggtctggtggattcggtttctgactccttctttcctggcctttcagtgtgtaagacctgcagtatcgggagcatcaacggattcgagattgaatcccataagtgttattgctctctgttctgctgtccatactgccggcactgtagcgccgatcgtgagatccatcagttgcacctctcaatttgcaaaaagcgcaaaatgggcagtaatgtcatgctggcggtgtgtaagagaatgtgctttagggcaacgatagaagcctcccggcgagctttactgatccgcagcattatcaacaccacattcgtaatctgtattctaactctcaccatatgcgttgtgtctacatcagccgtcgagatggagaatctgcccagtggtacttgggaaagagaggaagaccttaccaacttttgtcaccaagagtgccaggtgacagaaaccgagtgtttgtgcccttatgaggcactggtcctcaggaaaccactgttccttgatagcatcgtgaaggggatgaagaatctgttgaactccacttctctcgaaacgtcgctgagcattgaggctccctggggcgccatcaacgttcagtccacatttaaaccgaccgtgtcaactgcgaatattgccttaagttggtctagcgtagaacatcggggaaacaagatcctggtcaccggccgctccgagtcaataatgaaactagaggaaagaacaggggtgagctgggacctcggagttgatgacgcatctgagtccaagctgcttaccgtgagtatcatggatttgagccaaatgtactctcctgtcttcgaatatctgtccggtgaccgtcaggtggaggaatggcccaaagctacttgcacaggcgattgtccagagaggtgcgggtgtacgtcaagtacctgcctccacaaggagtggcctcatagccggaattggcgatgtaaccccacttggtgctggggagtaggcacaggttgtacctgctgtggggtggacgttaaggacctgtttacagatcacatgttcgtcaaatggaaggtggaatacattaaaactgaggccatcgtgtgcgtcgaattaacctcgcaggagagacagtgttccctgattgaagctggcacgaggtttaatcttggaccagttaccatcacattgtctgagccccgcaacatacaacagaagctccctccagagattatcactctgcatccgaaagtggaagagggcttctttgacctaatgcacgtgcagaaggtactgagcgcctcaaccgtctgcaagctccagagttgcacacacgggattcccggagatctgcaagtgtatcatatcggtaatcttttgaaaggcgaccgggttaacgggcacctgatacataagatcgaacctcacttcaatacttcctggatgtcttgggatggatgtgacttagattactactgcaacatgggcgactggccaagctgtacctatacgggtgtgacacagcacaatcatgcagcctttgtcaacctcctgaatattgagaccgattacactaaaacattccacttccattccaagagagtgaccgctcacggggacactccccagcttgatctgaaagcgaggcctacctatggcgcaggagaaatcacagttttggtggaggtagccgacatggagctccatacgaagaaagtcgaaatttcaggcctgaagtttgctagcctagcctgcaccgggtgttacgcatgcagttctggaatctcctgtaaggtgcgcatacacgtggatgagccagacgaactgactgtccacgttaaaagcaacgaccccgatgtggtagccgcttcgacatcactcatggcccgaaagctggagttcggcaccgactctacatttaaagcattcagtgcgatgccgaagacttccctttgcttttatattgtggagcgggaatactgtaaaagctgctctgaggaagatacccagaagtgtgtcgacacgaagttggagcaacctcagagcatcctgatcgaacataaaggtacaattatcgggaagcagaatgatacctgcactgctaaagccggatgctggttagagtccgtgaagtcattcttttatggcctcaaaaacatgctgggtagtgttttcggcaactttttcattgggatacttctgtttctagcaccattcgtgctcctggtcttgtttttcatgttcggatggaagatcctgttttgtttcaagtgctgtcgtagaaccaggggcttactcaaataccgcctgcttaaggacgatgaggaaacagggtaccggagaattatcgagaggctgaataacaaaaagggaaagaatcgattgctcgacggcgaacgcctggccgatcggaagattgctgagctatttagcactaagacccacatcggt

SEQ ID NO: 10504 - RNA, 3495 nt, synthetic construct
  misc_feature 1..3495: note = derived and/or modified CDS sequence (opt3) from CCHVF(CCHVF 75-R-2012)__KR814863.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccgcaccagttaagtgtcgacagggtttttgcttaaaaatcacacaggaggggcgtggacatgtgaagctgtctagaggctcggaagtagtgctagatgcctgtgactcaagctgcgaggtcatgataccgaagggcaccggggatatcctcgtggactgtagtggaggtcagcaacacttcctgaaagataaccttattgacctgggctgcccccatatccctttgctcgggaagatggcgatttacatctgtaggatgtccaatcacccacggactacaatggcttttctgttctggttttctttcggatatgttataacctgcatcttttgcaaagccctgttctacagcctcattattatcggcacgttaggtaagaaaatcaagcagtatcgcgaactgaagccccagacttgtaccatttgcgagacagcacctgtgaacgccatagatgctgagatgcatgaccttaattgttcctacaacatctgcccatattgtgcatcaagattgacttctgacgggctggccaggcacgtcccccagtgccctaaacggaaggaaaaagtggaggaaaccgagctatacctcaatctggaacgcattccatggatcgtacgaaaacttctgcaagttagcgagtctacaggagtggctttgaagagatcctcatggctcatagtcctgttagtgctgctcaccgtgagccttagtccggtccagtctgcccccgttggccacggcaagacgattgagacttaccagacaagggaagggtttacctccatctgtctgttcatgttgggaagcatcctatttctggtgtcgtgcctcgtaaaaggtctggtgaactctgtctccgattcattctttcctggccttagtgtgtgtaagacttgcagcattgggtccatcaatggattcgagattgaatctcataagtgttattgcagcctgttctgctgtccatactgccggcactgttcagcggaccgtgagatacatcagttgcacctcagtatctgcaaaaagcgcaaaacaggctccaacgttatgctggcagtgtgtaagagaatgtgctttagggccaccattgaagctagccggcgagccttactgatccgctctatcattaatacgaccttcgtcatatgtatcctaacactcactatttgcgtggtatcaaccagtgcagttgagatggagaacctgcccagcggtacatgggaaagagaggaagatcttactaatttttgtcaccaagagtgccaggtgaccgaaacagagtgtttgtgcccttatgaggctctggtcctcaggaaaccactgttccttgactccatcgtgaaggggatgaagaacctgttgaactctacctcgctcgaaactagcctgtccattgaggccccctggggcgcgatcaatgtccagtcaacgtttaaaccgacagtgagtaccgccaacatagcattatcttggagctccgttgaacatcggggaaataagatcctggtgactggccgctcagagagcattatgaaactagaggaaagaaccggggtatcttgggatctcggagtcgaggacgcttccgaaagtaagctgcttacagtgagcatcatggatttgtctcaaatgtactcccctgttttcgagtatctgtcaggtgaccgtcaggtggaagagtggcccaaagctacctgcactggcgattgtccagagaggtgcgggtgtacaagtagcacgtgcctccacaaggaatggcctcattcgcggaactggcgatgtaatcccacctggtgctggggagtcggcactggttgtacatgctgtggggtggacgtaaaggatctgtttaccgaccacatgttcgtgaaatggaaggttgagtacattaaaacagaagccatcgtctgcgtggagttaacttcccaggaaagacagtgttctctgatagaggccggcaccaggtttaaccttggaccagtgacgattaccttgagcgagccccgcaatatccaacagaagctccctccagaaattatcacactgcatccgaaagtcgaggaaggcttctttgacctaatgcacgttcagaaggtgctgtcagcaagtactgtgtgcaagctccagtcctgcacccacgggatacccggagatctgcaagtatatcatatcggtaaccttttgaaaggcgaccgggtcaatgggcacctgattcataagatcgagcctcacttcaacacatcttggatgagctgggatggatgtgacttagattactactgcaatatgggcgactggccatcctgtacttataccggtgtgacgcagcacaaccatgccgcttttgttaatctcctgaacattgaaacagattacaccaaaactttccacttccattcaaagagagtgacagcgcacggggacactccccagcttgatctgaaagcaaggcctacttatggcgccggagagatcaccgtcttggtggaggttgctgacatggaactccatacaaagaaagtggagataagcggcctgaagtttgccagtctagcatgcacggggtgttacgcctgcagttccggaattagctgtaaggtacgcatccacgtcgatgaaccagacgagctgaccgtgcacgtgaaatcgtcagatcccgacgtcgttgctgcctctaccagtctcatggcacgaaagctggagttcggcacagactccacctttaaagcgttcagcgctatgccgaagacatctctttgcttttatatcgtggaacgggagtactgtaaaagctgctccgaagaggatactcagaagtgtgtagacaccaagttggaacaacctcagtcaattctgatcgagcataaaggtacgattatagggaagcagaatgatacatgcaccgccaaagcaagttgctggttagagagcgtgaagtctttcctctatggactgaaaaacatgcttggctccgtctttggtaacttctttatcggcattctgctattcctcgccccatttgtgctgttggttctgttctttatgttcgggtggaagatcttattctgttttaagtgctgtcgtagaactaggggactcctgaaataccgccttctgaaggacgatgaagagaccggctaccggagaattatcgaaaggttgaataacaaaaaggggaaaaatcgactcctggacggagagcgcctagctgatcggaagatagccgaactgttctcaacaaagactcacatcggc

SEQ ID NO: 10505 - RNA, 3495 nt, synthetic construct
  misc_feature 1..3495: note = derived and/or modified CDS sequence (opt3) from CCHVF(CCHVF 75-ST-2010)__KR814864.1__Gn-NSm-Gc
  source 1..3495: mol_type = other RNA
agcgaggaatccggcgacgattgcatctctagaacccagctgctcaggacagagactgccgaaattcacgacgataactacgggggacccggtgacaagataacgatctgtaatggctcaaccattgtggatcaacggcttgggagtgagctgggatgctatacaatcaaccgcgtcaagagcttcaagttgtgtgaaaattccgctactggcaaaacctgcgagattgactctacacctgttaagtgtcgacagggtttttgcttaaaaatcacccaggaggggcgtggacatgtgaagctgtcgagaggctcagaagtagtgctagatgcatgtgacagcagttgcgaggtcatgataccaaagggcactggggatatcctcgtggactgttccggaggtcagcaacacttcctgaaagataaccttattgacctgggctgcccgcatatccccttgctcgggaagatggccatttacatctgtaggatgtctaatcaccctcggacaaccatggcgtttctgttctggtttagcttcggatatgttataacgtgcctgttttgcaaagctctcttctactccttaattatcattggcactctgggtaagaaaatcaagcagtatcgcgaacttagaccacagacctgtacaatctgcgagactgcccccgtgaacgcaattgatgccgagatgcatgacttgaattgttcatacaacatatgcccttattgtgctagtaggctgaccagcgacgggctagcacggcacgtcccacagtgccccaagcgcaaagaaaaggtggaggaaacagagctctacctgaatcttgaacgaatcccttggattgtaagaaaactgttgcaagtttctgagtccaccggagtggccctcaagaggtcaagctggctgatcgtcttactggtgctccttacggtgagtctgtctccagtccagtccgctccggttggccacggcaaaactatagagacataccagacccgggaagggtttactagcatttgtttgttcatgctaggatcgatcctgtttctcgtgtcttgcctggtaaagggtcttgtggattccgtctcagacagtttctttcccggcctgagcgtgtgtaaaacatgctccatcgggtctattaacggattcgagatcgaaagccataagtgttattgctcattgctctgctgtccttactgccgtcactgtagtgccgatcgcgagattcatcagctgcacttatccatatgcaagaaaagaaagaccggcagcaatgttatgctggcggtgtgtaaaaggatgtgcttccgggcaacgatcgaagcctctcgacgcgctctactcattagatcaatcatcaacaccacatttgtcatttgtatactgactcttaccatctgcgtggtaagtacaagcgccgttgagatggagaatttgccatccggtacttgggaaaaggaggaagacctgaccaacttctgtcaccaagagtgccaggtgacagaaaccgagtgtctctgcccctatgaggcactggtccttaggaaacctctgtttttggattctattgtgaaggggatgaagaatctcctgaactcgactagcttagaaacgtccctgtcaatcgaggctccatggggcgccattaacgtccagagtacattcaaacccaccgtgtctactgcgaatatcgccctaagctggtcctcagttgaacatcggggaaacaagatactcgtgaccggccgcagcgagtctatcatgaaactggaggaaagaacaggggtatcctgggaccttggagtcgaggatgcaagtgaaagcaagttgctgaccgtgtctattatggacctctcccaaatgtactcaccggtttttgagtatctgagtggtgatcgtcaggtggaagagtggcctaaagctacttgcacaggcgactgtcccgagaggtgcgggtgtacgagctcgacctgcttacacaaggaatggccacattcccggaattggcgatgtaaccctacttggtgctggggagtcggcacaggttgtacctgctgtggggtggatgtaaaggacctgttcacagaccacatgtttgtgaaatggaaggttgagtacatcaaaactgaagccattgtctgcgtggagcttacctctcaggaaagacagtgtagcttgatcgaggctggcacgaggttcaatctcggacccgtgaccataacactgtcagagccacgcaacattcaacagaagctaccccctgaaatcattactctgcatccaaaagtcgaggaaggctttttcgatctcatgcacgttcagaaggtgctgagtgcctccaccgtgtgcaaacttcagtcttgcacacacgggatcccgggagacttgcaagtatatcatataggtaatctgttaaaaggcgatcgggtcaacgggcacctcatccataagattgagccccactttaatactagctggatgtcctgggacggatgtgatctggactactactgcaacatgggcgattggccttcatgtacctatacgggtgtgacacagcacaatcatgcagccttcgttaaccttctgaatatcgaaaccgactacactaaaacatttcacttccatagcaagagagtgaccgctcacggggatactccacagttggacctcaaagcgaggcccacctatggcgcaggagagattacagtcctggtggaggttgccgatatggaactacatacgaagaaagtggagatcagtggcctgaagttcgcttctctcgcctgcaccgggtgttacgcatgctccagcggaatatcgtgtaaggtacgcattcacgtcgacgaacctgatgagctgactgtgcacgtgaaatcatctgacccagacgtcgttgccgctagtacatcccttatggcccgaaagttggagtttggcaccgatagcacattcaaagcattttctgcgatgcccaagactagcctgtgcttctatatcgtggaacgggagtactgtaaatcctgctcagaagaggacacccagaagtgtgtagatacgaagttagaacaaccgcagagtatcctcattgagcataaaggtacaatcattgggaagcagaacgatacctgcactgctaaagccagctgctggctggagtctgtgaagtcctttttctatggacttaaaaatatgctgggctcagtctttggtaacttctttataggcatcctactcttcctggcaccttttgtgttgctggttttattctttatgttcgggtggaagattctcttctgttttaagtgctgtcgtagagccaggggactgcttaaataccgccacctgaaggacgacgaagagaccggctaccggaaaatcattgaaagattgaacaataagaaagggaagaacaggctcctggatggagagcgactagctgaccgcaagatcgccgaactgttcagtacaaaaactcatataggc

SEQ ID NO: 10506 - RNA, 3495 nt, synthetic construct
  misc_feature 1..3495: note = derived and/or modified CDS sequence (opt3) from CCHVF(CCHVF 81-R-2014)__KR814865.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaaaagatcctcatggctcatagtcctgttagtgctgctcacggtgagccttagtccggtccagtctgctcccgttggccacggcaagactattgagacataccagaccagggaagggtttacttccatctgtctgttcatgttgggaagcatcctatttctggtgtcgtgcctcgtaaaaggtctggtggattctgtctccgactcattctttcctggccttagtgtgtgtaagacatgcagcattgggtccatcaacggattcgagattgaatctcataagtgttattgcagcctgttctgctgtccatactgccggcactgttcagccgatcgtgagatacatcagttgcacctcagtatctgcaaaaagcgcaaaaccggctccaatgttatgctggcggtgtgtaagagaatgtgctttagggcaacgattgaagccagccggcgagctttactgatccgctctatcattaacaccacattcgtcatatgtatcctaactctcaccatttgcgtggtatcaacaagtgccgttgagatggagaatctgcccgcaggtacttgggaaagagaggaagaccttaccaacttttgtcaccaagagtgccaggtgacagaaaccgagtgtttgtgcccttatgaggctctggtcctcaggaaaccactgttccttgatagcatcgtgaaggggatgaagaatctgttgaactccacttctctcgaaacgtcgctgagcattgaggccccctggggcgcgatcaacgtccagtccacatttaaaccgaccgtgtcaactgccaatatagcattaagttggtctagcgttgaacatcggggaaacaagatcctggtgaccggccgctccgagtcaattatgaaactagaggaaagaacaggggtaagctgggacctcggagtcgaggatgcttctgaatccaagctgcttaccgtgagtatcatggacttgagccaaatgtactctcctgttttcgagtatctgtccggtgatcgtcaggtggaagagtggcccaaagccacttgcacaggcgactgtccagagaggtgcgggtgtacgtcaagtacctgcctccacaaggaatggcctcatagccggaattggcgatgtaaccccacttggtgctggggagtcggcacaggttgtacctgctgtggggtggatgtaaaggacctgtttacagaccacatgttcgtgaaatggaaggttgagtacattaaaactgaagctatcgtctgcgtggagttaacctcgcaggaaagacagtgttccctgatagaggccggcacgaggtttaatcttggaccagtgaccattacattgtctgagccccgcaacatccaacagaagctccctccagaaattatcactctgcatccgaaagtcgaggaaggcttctttgatctaatgcacgttcagaaggtgctgagcgcatcaaccgtgtgcaagctccagagttgcacacacgggatacccggagacctgcaagtatatcatatcggtaatcttttgaaaggcgatcggattaacgggcacctgatccataagattgagcctcacttcaatacttcctggatgtcttgggacggatgtgatttagactactactgcaacatgggcgattggccaagctgtacctatacgggtgtcacacagcacaatcatgccgcttttgtgaacctcctgaatatcgaaaccgactacactaaaacattccacttccattccaagagagttaccgcgcacggggatactccccagcttgacctgaaagcaaggcctacctatggcgccggagagataacagtgttggtcgaggtggctgatatggaactccatacgaagaaagttgagatttcaggcctgaagtttgccagcctagcatgcaccgggtgttacgcctgcagttctggaatctcctgtaaggtgcgcatccacgtagacgaaccagatgagctgactgtccacgtgaaaagctcggaccccgacgtggtcgctgcctcaacatctctcatggcacgaaagctggagttcggcaccgatagtacatttaaagcgttctccgctatgccgaagactagcctttgcttttatattgttgaacgggagtactgtaaatcttgcagcgaagaggacacccagaagtgtgtggatacgcgtttggaacaacctcagtccatcctgattgagcataagggtacaataatcgggaaacagaacgatacctgcactgccaaggcatcatgctggttagagagtgtaaagagcttcttttatggactcaagaatatgctgggctctgtgttcggtaactttttcattggcatccttctgtttctagccccattcgtcctcctggtgttgtttttcatgttcgggtggaaaattctgttttgtttcaagtgctgtagaaggacccgcggattactcaagtaccggcacctgaaagacgacgaagagacaggctacagaaggatcatagaacgacttaacaataagaaagggaagaaccgcctgttggatggagagcggctcgctgacagaaaaatcgccgaactgttttccactaagacccatattggc

SEQ ID NO: 10507 - RNA, 3495 nt, synthetic construct
  misc_feature 1..3495: note = derived and/or modified CDS sequence (opt3) from CCHVF(CCHVF 3756-ST-2007)__KR814866.1__Gn-NSm-Gc
  source 1..3495: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacagcctcattatcatcggcactttaggtaaaaagattaagcagtatcgggaactgaaaccccagacctgtacaatatgcgagactgcccctgttaacgcaatcgatgccgagatgcatgaccttaattgttcctacaacatttgcccatattgtgcttcacgcttgaccagtgacgggctggcaagacacgtgacacagtgccccaagaggaaagaaaaggtcgaggaaaccgagctatacctcaatctggaacggatcccttggatagtgcgcaaacttctgcaagtaagcgagtctacgggagttgccttgaagcgatcctcatggctcattgtgctgttagtcctgctcactgtgagccttagtccagtgcagtctgctccggtcggccacggcaaaacaatcgagacctaccagactagagaagggtttacatccatctgtctgttcatgttgggaagcattctatttatcgtttcgtgcctggtgaagggtctcgtagattctgtgtccgactcattctttcccggcctgagtgtctgtaagacctgcagcattgggtccataaacggattcgagatcgaatctcataaatgttattgcagccttttctgctgtccttactgcaggcactgttcagccgatcgggagattcatcagctgcacttgagtatctgcaagaaacgtaagacgggctccaatgtgatgctcgcggtttgtaaacgcatgtgctttaaggcaaccatcgaagccagcagaagggctctgttaattcggtctataatcaacacaactttcgtgatttgtatcctgaccctagccatttgcgtcgtgtcaacaagtgcagtagagatggaggacctcccagctggtacttgggaacgagaggaagatctgaccaatttttgtcaccaagagtgccaggttacagaaaccgagtgtctttgcccctatgaggccttggtgctgcgcaagcctctcttcctggacagcatcgtcaaagggatgaagaaccttttaaattccacttctttggaaacgtcgctcagcatagaggcgccatggggcgccatcaacgtgcagtccacatttaaacccaccgtctcaactgcaaacattgctctgagttggtctagcgtggaacatagaggaaataagatcttagttaccggcaggtccgagtcaattatgaaactggaggaacggacaggggtgagctgggatctaggagtagaggacgcctctgaatccaagctcctgaccgtcagtatcatggatcttagccaaatgtactctccggtgttcgagtatttgtccggtgaccgccaggttgaagagtggcctaaggctacttgcacaggcgattgtcccgagagatgcgggtgtacgtcaagtacctgcctgcacaaagaatggccacatagcaggaactggcgttgtaatcctacttggtgctggggagtgggcacaggttgtacctgctgtggggtcgacgtgaaggacctctttacagatcacatgttcataaaatggaaggtagagtacattaaaactgaagccatcgtgtgcgttgagctgacctcgcaggaacggcagtgttccttaattgaggcaggcacgcgatttaacctgggacccgtcaccatcacactttctgagccaagaaatatacaacagaagttgccccctgaaatcattactctccatccaaagatcgaggaaggcttctttgacctgatgcacgtgcagaaagtgctaagcgcctcaaccgtctgcaagctgcagagttgcacacacgggattccgggagatctccaaatctatcatataggtaacctgcttaaaggcgacagggttaatgggcacttgattcataagatcgagccccacttcaacacttcctggatgtcttgggatggatgtgacctggattactactgcaatatgggcgactggcctagctgtacctatacgggtgtgacacagcacaaccatgctgcgtttgtgaatttactcaacatcgaaaccgattacactaaaacattccacttccattccaagcgcgtaaccgcacacggggacactccacagctggatcttaaagcccggcccacctatggcgctggagagattacagtcctggtggaggttgccgacatggaattgcatacgaagaaggtggagatctcaggcctcaaatttgcaagcctgacctgcactgggtgttacgcctgcagttctggaatttcctgtaaggtcagaatacacgtggatgaacctgacgagctaacagttcacgtgaaaagctcggacccagatgtagtcgctgcctcaacctctctgatggcaaggaagctcgagttcggcacagacagtacttttaaagcgttctccgctatgcccaagaccagcctgtgcttttatatcgtggaacgcgagtactgtaagtcttgcagcgaagatgacacgaaaaagtgtgtggatacaaaacttgagcagccgcaatccattttgatcgaacataagggtaccattatcgggaaacagaatgacacttgcaccgccaaggcatcatgctggctggagagtgtcaagagcttcttttatggactgaaaaacatgctcggctctgttttcggttcctttttcgtgggcatactgctttttctgacacctttcgtactactcgtgctgtttttcatgttcgggtggaagatcttgttttgtttcaaatgctgtcgacggactcgtggactgtttaagtacagacacttaaaagatgacgaggaaaccggctacaggcgcattatcgagcggctcaattcaaagaaggggaaaaacagactgcttgatggagaaaggctggccgaccgaaagattgctgagttgttcagtacaaaaacgcatatcggc

SEQ ID NO: 10508 - RNA, 3495 nt, synthetic construct
  misc_feature 1..3495: note = derived and/or modified CDS sequence (opt3) from CCHVF(CCHVF 3809-ST-2007)__KR814867.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaagagatcctcatggctcatagtcctgttagtgctgctcacggtgagccttagtccggtccagtctgctcccgttggccacggcaagactattgagacataccagaccagggaagggtttacttccatctgtctgttcatgttgggaagcatcctatttctggtgtcgtgcctcgtaaaaggtctggtggattctgtctccgactcattctttcctggccttagtgtgtgtaagacatgcagcattgggtccgttaacggattcgagatcgaatctcataagtgttattgcagcctgttctgctgtccatactgccggcactgttcagccgatcgtgagattcatcagttgcacctcagtgtgtgcaaaaagcgcaaaaccggctccaatgtcatgctggcggtgtgtaagagaatgtgctttagggcaacgatagaagccagccggcgagctttactgatccgctctattatcaacaccacattcgtaatctgtattctaactctcaccatatgcgttgtgtcaacaagtgccgtcgagatggagaatctgcccgcaggtacttgggaaagagaggaagaccttaccaacttttgtcaccaagagtgccaggtgacagaaaccgagtgtttgtgcccttatgaggctctggtcctcaggaaaccactgttccttgatagcatcgtgaaggggatgaagaatctgttgaactccacttctctcgaaacgtcgctgagcattgaggccccctggggcgcgatcaacgttcagtccacatttaaaccgaccgtgtcaactgccaatattgcattaagttggtctagcgtagaacatcggggaaacaagatcctggtcaccggccgctccgagtcaataatgaaactagaggaaagaacaggggtgagctgggacctcggagttgaggatgcttctgaatccaagctgcttaccgtgagtatcatggacttgagccaaatgtactctcctgtcttcgagtatctgtccggtgatcgtcaggtggaagagtggcccaaagccacttgcacaggcgactgtccagagaggtgcgggtgtacgtcaagtacctgcctccacaaggaatggcctcatagccggaattggcgatgtaaccccacttggtgctggggagtaggcacaggttgtacctgctgtggggtggatgttaaggacctgtttacagaccacatgttcgtcaaatggaaggtggagtacattaaaactgaagctatcgtgtgcgtcgagttaacctcgcaggaaagacagtgttccctgattgaggccggcacgaggtttaatcttggaccagttaccatcacattgtctgagccccgcaacatacaacagaagctccctccagaaattatcactctgcatccgaaagtggaggaaggcttctttgatctaatgcacgtgcagaaggtactgagcgcatcaaccgtctgcaagctccagagttgcacacacgggattcccggagacctgcaagtgtatcatatcggtaatcttttgaaaggcgatcgggttaacgggcacctgatacataagatcgagcctcacttcaatacttcctggatgtcttgggacggatgtgatttagactactactgcaacatgggcgattggccaagctgtacctatacgggtgtgacacagcacaatcatgccgcttttgtcaacctcctgaatattgaaaccgactacactaaaacattccacttccattccaagagagtgaccgcgcacggggatactccccagcttgacctgaaagcaaggcctacctatggcgccggagagatcacagttttggtggaggtagctgatatggaactccatacgaagaaagtcgagatttcaggcctgaagtttgccagcctagcatgcaccgggtgttacgcctgcagttctggaatctcctgtaaggtgcgcatacacgtggacgaaccagatgagctgactgtccacgttaaaagctcggaccccgacgtggtagctgcctcaacatctctcatggcacgaaagctggagttcggcaccgatagtacatttaaagcgttctccgctatgccgaagactagcctttgcttttatattgtggaaaaagagtactgtcggtcttgcagcgaagaggacacccagaagtgtgtcgatacgaagttggaacaacctcagtccatcctgatcgagcataaaggtacaattatcgggaagcagaacgatacctgcactgccaaagcatcatgctggttagagagtgttaagagcttcttttatggactcaaaaatatgctgggctctgtgttcggtaactttttcattggcatacttctgtttctaaccccattcgtgctcctggtcttgtttttcatgttcgggtggaagatcctgttttgtttcaagtgctgtcgtagaacaaggggattactcaaataccgccacctgaaggacgacgaagagactggctaccggagaattatcgaaaggcttaacaataaaaaggggaaaaaccgactgttggatggagagcgcctcgccgaccggaagattgctgaactgttttccaccaagacacatatcggc

SEQ ID NO: 10509 - RNA, 3495 nt, synthetic construct
  misc_feature 1..3495: note = derived and/or modified CDS sequence (opt3) from CCHVF(CCHVF 3820-ST-2007)__KR814868.1__Gn-NSm-Gc
  source 1..3495: mol_type = other RNA
agcgaggaacccggcgacgattgcatctccagaacccagctgctcaagacagagactgccgaaattcacgacgataactacgggtctcctggagacaaaataacgatctgtaatggttcaaccattgtggatcaaaggcttggcagtgagctggggtgctatacaatcaaccgggtcaagagcttcaaattgtgtgaaaattccgctactggaaagacctgcgagattgactctacaccagttaaatgtcgccagggcttttgcttaaagatcacccaggagggtcgagggcatgtgaagctgtcgcgtggatcagaagtagtgctagatgcatgtgacagcagttgcgagataatgatcccgaaaggcactggcgatattctcgtcgactgttccgggggacagcaacacttcctgaaggataaccttatcgacctgggttgcccccatattcctttgctcggcaaaatggccatctacatatgtagaatgtctaatcacccaaggacaaccatggcgtttctgttctggtttagcttcgggtatgtgattacgtgcatcttttgcaaggctctgttctactccctcattatcatcggaactttaggcaaaaagattaagcagtatcgggaactgaaaccccagacctgtacaatatgcgagactgcccctgttaacgcaatcgatgccgagatgcatgaccttaattgttcatacaacatttgcccatattgtgctagtcgcttgaccagcgacggtctggcaagacacgtgacacagtgccccaagaggaaagaaaaggtcgaggaaaccgagctatacctcaatctggaacggatcccttggatagtgcgcaaacttctgcaagtatctgagtccacgggggttgccttgaagcgatcaagctggctcattgtgctgttagtcctgctcgctgtgagtctttctccagtgcagtccgccccggtcggacacggcaaaactatcgagacataccagaccagagaaggctttactagcatctgtctgttcatgttggggtcgattctatttatcgtttcttgcctggtgaagggactcgtagattccgtgtcagacagtttctttcccggtctgagcgtctgtaagacatgctccattggctctataaacgggttcgagatcgaaagccataaatgttattgctcacttttctgctgtccttactgcaggcactgtagtgcggatcgggagattcatcagctgcacttgtccatctgcaagaaacgtaagaccggaagcaatgtgatgctcgcagtttgtaaacgcatgtgctttaaggccacgatcgaagcctctagaagggccctgttaattcggtcaataatcaacaccacattcgtgatgtgtattctgactctagcaatctgcgtcgtgagtaccagcgctgtagagatggaggacctcccagccggcacatgggaacgagaggaagatctgactaatttttgtcaccaagagtgccaggttaccgaaacagagtgtctttgcccctatgaggcgttggtgctgcgcaagcctctcttcctggactccattgtcaaaggtatgaagaaccttttaaattctacctcgttggaaactagcctctccatcgaggccccatggggcgcaataaacgtgcagtcaacgtttaaacccacagtcagtaccgctaacatcgccctgtcttggagctccgtggaacatagagggaataagattttagttactggaaggtcagagagcatcatgaaactggaggaacggaccggcgtgtcttgggatctaggggtagaggacgcttccgaaagtaagctcctgacagtcagcattatggatctttctcaaatgtactccccggtgttcgagtatttgtcaggagaccgccaggttgaagagtggcctaaggctacctgcactggtgattgtcccgagagatgcggctgtacaagtagcacgtgcctgcacaaagaatggccacattcgaggaactggcgttgtaatcctacctggtgctggggagtggggactggctgtacatgctgtggtgtcgacgtgaaggacctctttaccgatcacatgttcatcaaatggaaggtagagtacataaaaacagaagcaattgtgtgcgttgagctgacttcccaggaacggcagtgttctttaatcgaggccgggacccgatttaacctgggccccgtcacgattacccttagcgagccaagaaatatccaacagaagttgccccctgaaataatcacactccatccaaagattgaggaaggattctttgacctgatgcacgtgcagaaagtgctatcagctagtactgtctgcaagctgcagtcctgcacccacggcatcccgggggatctccaaatttatcatatcggaaacctgcttaaaggtgacagggttaatggccacttgatacataagattgagccccacttcaacacatcttggatgagctgggatgggtgtgacctggattactactgcaatatgggagactggccttcctgtacttataccggcgtgacgcagcacaaccatgcggcatttgtgaatttactcaacatcgaaacagattacaccaaaactttccacttccattcaaagcgcgtaacagcccacggtgacaccccacagctggatcttaaagctcggcccacttatggggccggcgagatcaccgtcctggtggaggttgcagacatggaattgcatacaaagaaggtggagattagcggactcaaatttgccagtctgacgtgcaccggctgttacgcttgttcttccgggatcagctgcaaggtcaggattcacgtggatgaacctgacgagctaactgttcacgtgaaatcgtcagacccagatgtagtcgccgcatctacaagtctgatggcgagaaagctcgagttcggaaccgactccacatttaaggctttcagcgccatgcccaaaacttctctgtgcttttatatagtggaacgcgagtactgtaagagctgctccgaagatgacaccaaaaagtgtgtggatacgaaacttgagcagccgcaatcaatcttgattgaacataagggcacaatcattggtaaacagaatgatacctgcactgcaaaggccagttgctggctggagagcgtcaagtctttcttttatgggctgaaaaacatgctcggatccgttttcggctcatttttcgtgggtatcctgctttttctggctcctttcgtactactcgtgctgtttttcatgttcggctggaagatattgttttgtttcaaatgctgtcgacggacccgtgggctgtttaagtacagacacttaaaagacgacgaggaaacaggatacaggcgcatcattgagcggctcaatagtaagaagggcaaaaacagactgcttgatggggaaaggctggccgaccgaaagatcgcagagttgttcagcactaaaacccatattgga

SEQ ID NO: 10510 - RNA, 3495 nt, synthetic construct
  misc_feature 1..3495: note = derived and/or modified CDS sequence (opt3) from CCHVF(CCHVF 4495-ST-2008)__KR814869.1__Gn-NSm-Gc
  source 1..3495: mol_type = other RNA
agcgaggaatccggcgacgattgcatctctagaacccagctgctcaggacagagactgccgaaattcacgacgataactacgggggacccggtgacaagataacgatctgtaatggctcaaccattgtggatcaacggcttgggagtgagctgggatgctatacaatcaaccgcgtcaagagcttcaagttgtgtgaaaattccgctactggcaaaacctgcgagattgactctacacctgttaagtgtcgacagggtttttgcttaaaaatcacccaggaggggcgtggacatgtgaagctgtcgagaggctcagaagtagtgctagatgcatgtgacagcagttgcgaggtcatgataccaaagggcactggggatatcctcgtggactgttccggaggtcagcaacacttcctgaaagataaccttattgacctgggctgcccgcatatccccttgctcgggaagatggccatttacatctgtaggatgtctaatcaccctcggacaaccatggcgtttctgttctggtttagcttcggatatgttataacgtgcctgttttgcaaagctctcttctactccttaattatcattggcactctgggtaagaaaatcaagcagtatcgcgaacttagaccacagacctgtacaatctgcgagactgcccccgtgaacgcaattgatgccgagatgcatgacttgaattgttcatacaacatatgcccttattgtgctagtaggctgaccagcgacgggctagcacggcacgtcccacagtgccccaagcgcaaagaaaaggtggaggaaacagagctctacctgaatcttgaacgaatcccttggattgtaagaaaactgttgcaagtttctgagtccaccggagtggccctcaagaggtcaagctggctgatcgtcttactggtgctccttacggtgagtctgtctccagtccagtccgctccggttggccacggcaaaactatagagacataccagacccgggaagggtttactagcatttgtttgttcatgctaggatcgatcctgtttctcgtgtcttgcctggtaaagggtcttgtggattccgtctcagacagtttctttcccggcctgagcgtgtgtaaaacatgctccatcgggtctattaacggattcgagatcgaaagccataagtgttattgctcattgctctgctgtccttactgccgtcactgtagtgccgatcgcgagattcatcagctgcacttatccatatgcaagaaaagaaagaccggcagcaatgttatgctggcggtgtgtaaaaggatgtgcttccgggcaacgatcgaagcctctcgacgcgctctactcattagatcaatcatcaacaccacatttgtcatttgtatactgactcttaccatctgcgtggtaagtacaagcgccgttgagatggagaatttgccatccggtacttgggaaaaggaggaagacctgaccaacttctgtcaccaagagtgccaggtgacagaaaccgagtgtctctgcccctatgaggcactggtccttaggaaacctctgtttttggattctattgtgaaggggatgaagaatctcctgaactcgactagcttagaaacgtccctgtcaatcgaggctccatggggcgccattaacgtccagagtacattcaaacccaccgtgtctactgcgaatatcgccctaagctggtcctcagttgaacatcggggaaacaagatactcgtgaccggccgcagcgagtctatcatgaaactggaggaaagaacagggatttcctgggaccttggagtagaggatgcaagtgaaagcaagttgctgaccgtctctatcatggacctctcccaaatgtactcaccggtgtttgagtatctgagtggtgataggcaggttgaagagtggcctaaagctacttgcacaggcgactgtcccgagcgttgcgggtgtacgagctcgacctgcttacacaaggaatggccacattcccggaattggcgatgtaaccctacttggtgctggggagtgggcacaggttgtacctgctgtggggtcgatgtgaaggacctgttcacagaccacatgtttgtaaaatggaaggtggagtacattaaaactgaagccatcgtttgcgtcgagcttacctctcaggaaagacagtgtagcttgatagaggctggcacgaggttcaatctcggacccgtgaccattacactgtcagagccacgcaacatccaacagaagctaccccctgaaattatcactctgcatccaaaagtggaggaaggctttttcgatctcatgcacgtccagaaggttctgagtgcctccaccgtgtgcaaacttcagtcttgcacacacgggataccgggagacttgcaagtgtatcatatcggtaatctgttaaaaggcgatcgggtaaacgggcacctcattcataagatcgagccccactttaatactagctggatgtcctgggacggatgtgatctggactactactgcaacatgggcgattggccttcatgtacctatacgggtgtcacacagcacaatcatgcagccttcgtgaaccttctgaatattgaaaccgactacactaaaacatttcacttccatagcaagagagttaccgctcacggggatactccacagttggacctcaaagcgaggcccacctatggcgcaggagagatcacagtgctggtcgaggtggccgatatggaactacatacgaagaaagttgagataagtggcctgaagttcgcttctctcgcctgcaccgggtgttacgcatgctccagcggaatttcgtgtaaggtgcgcatccacgtagacgaacctgatgagctgactgtccacgtgaaatcatctgacccagacgtggtcgccgctagtacatcccttatggcccgaaagttggagtttggcaccgatagcacattcaaagcattttctgcgatgcccaagactagcctgtgcttctatatcgttgaacgggagtactgtaaatcctgctcagaagaggacacccagcgttgtgtggatacgaagttagaacaaccgcagagtattctcatcgagcataagggtacaattatagggaaacagaacgatacctgcactgctaaggccagctgctggctggagtctgtaaaatcctttttctatggacttaagaatatgctgggctcagtgtttggtaacttctttatcggcattctactcttcctggcaccttttgtcttgctggtgttattctttatgttcgggtggaaaatcctcttctgttttaagtgctgtagaagggcccgcggactgcttaagtaccggcacctgaaagacgacgaagagaccggctacagaaagattatcgaaaggttgaacaataaaaaggggaaaaaccgactcctggatggagagcgcctagctgaccggaagatagccgaactgttcagtacaaagactcatatcggc

SEQ ID NO: 10511 - RNA, 3495 nt, synthetic construct
  misc_feature 1..3495: note = derived and/or modified CDS sequence (opt3) from CCHVF(CCHVF 4691-ST-2009)__KR814871.1__Gn-NSm-Gc
  source 1..3495: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacagcctcattatcatcggcactttaggtaaaaagattaagcagtatcgggaactgaaaccccagacctgtacaatatgcgagactgcccctgttaacgcaatcgatgccgagatgcatgaccttaattgttcctacaacatttgcccatattgtgcttcacgcttgaccagtgacgggctggcaagacacgtgacacagtgccccaagaggaaagaaaaggtcgaggaaaccgagctatacctcaatctggaacggatcccttggatagtgcgcaaacttctgcaagtaagcgagtctacgggagttgccttgaagcgatcctcatggctcattgtgctgttagtcctgctcactgtgagccttagtccagtgcagtctgctccggtcggccacggcaaaacaatcgagacctaccaggccagagaagggtttacttccatctgtctgttcatgttgggaagcattctatttatcgtttcgtgcctggtgaagggtctcgtagattctgtgtccgactcattctttcccggcctgagtgtctgtaagacatgcagcattgggtccataaacggattcgagatcgaatctcataaatgttattgcagccttttctgctgtccttactgcaggcactgttcagcggatcgggagattcatcagctgcacttgagtatctgcaagaaacgtcgcaccggctccaatgtgatgctcgcagtttgtaagagaatgtgctttaaagccacgatcgaagctagcaggcgggccctgttaattcgatctataatcaacaccacattcgtgatttgtatcctgactctagcaatttgcgtcgtgtcaaccagtgctgtagagatggagaatctcccagccggtacatgggaacgcgaggaagacctgactaacttttgtcaccaagagtgccaggttaccgaaacagagtgtctttgcccctatgaggcgttggtgctgagaaagcctctcttcctggatagcatcgtcaaggggatgaaaaatcttctgaactccacctctttggaaacttcgctcagcatagaggccccatggggcgcaatcaacgtgcagtccacgtttaagcccgctgtctcaacagccaatattgctctgagttggtctagcgtggaacataggggaaacaaaatcttagttaccggccggtccgagtcaattatgaagctggaggaacgcactggggtgagctgggacctaggagtagaggatgcctctgaatccaaactcctgaccgtcagtatcatggaccttagccaaatgtactctccggtgttcgagtatttgtccggtgatagacaggttgaagagtggcctaaggcaacatgcaccggcgactgtcccgagaggtgcgggtgtacttcaagtacatgcctgcacaaggaatggccacatagccgtaattggcggtgtaaccctacgtggtgctggggagtgggcaccggttgtacttgctgtggggtcgatgtgaaagacctctttacagaccacatgttcataaagtggaaagtagagtacattaagaccgaagccatcgtgtgcgttgagctgacatcgcaggaacgacagtgttccttaattgaggctggcactagatttaatctgggacccgtcaccatcacgctttctgagccaaggaacatacaacagaaattgccccctgaaatcattaccctccatccaaagatcgaggaaggcttctttgatctgatgcacgtgcagaaggtgctaagcgcgtcaacagtctgcaaactgcagagttgcactcacgggattccgggagacctccaaatctatcatataggtaatctgcttaagggcgatcgcgttaacgggcacttgattcataaaatcgagccccacttcaatacctcctggatgtcttgggacggatgtgatctggactactactgcaacatgggcgattggcctagctgtacatatactggtgtgacccagcacaatcatgcagcctttgtgaacttactcaatatcgaaacggactacacaaagaccttccacttccattccaaacgggtaactgctcacggggatacaccacagctggaccttaaggccagacccacctatggcgcaggagagattactgtcctggtggaggttgccgatatggaattgcataccaaaaaggtggagatctcaggcctcaagtttgctagcctggcctgcacagggtgttacgcatgcagttctggaatttcctgtaaagtcaggatacacgtggacgaacctgatgagctaacggttcacgtaaagagctcggacccagacgtggtcgcggcttcaacctctctgatggcccgcaaactcgagttcggcactgatagtacatttaaggcattctccgccatgcccaaaaccagcctgtgcttttatatcgtggaacgagagtactgtaagtcttgcagcgaagacgatacaaagaaatgtgtggacactaaacttgagcagccgcaatccattttgatcgaacataagggtaccattatcgggaagcagaacgatacgtgcacagctaaagcctcatgctggctggagagtgtcaagagcttcttttatggattaaagaatatgctcggctctgttttcggtaactttttcgtgggcatactgctttttctggcacctttcgtactactcgtgctgtttttcatgttcgggtggaaaatcttgttttgtttcaagtgctgtcggcgtaccagaggactgtttaaatacaggcacttaaaggacgatgaggaaactggctaccgccggattatcgagagactcaactccaaaaaggggaagaataggctgcttgacggagaacgactggctgatcgcaaaattgccgagttgttctcaaccaagacacatatcggc

SEQ ID NO: 10512 - RNA, 3495 nt, synthetic construct
  misc_feature 1..3495: note = derived and/or modified CDS sequence (opt3) from CCHVF(CCHVF 4701-ST-2009)__KR814872.1__Gn-NSm-Gc
  source 1..3495: mol_type = other RNA
agcgaggaacccggcgacgattgcatctccagaacccagctgctcaagacagagactgccgaaattcacgacgataactacgggggacctggtgacaaaataacgatctgtaatggctctaccgtggtcgatcaaaggcttgggtcagagctgggatgctatacaattaaccgggttaagagtttcaaattgtgtgaaaatagcgctactggcaagacctgcgagatcgactccacaccagtgaaatgtcgccagggtttttgcttaaagattacccaggaggggcgaggacatgtaaagctgtctcgtggctcggaagtggtcctagatgcatgtgactcaagctgcgagatcatgataccgaaaggcactggggatatcctcgtggactgtagtggaggtcagcaacacttcctgaaggataaccttattgacctgggctgcccccatatccctttgctcgggaaaatggccatttacatctgtagaatgtccaatcacccaaggacaaccatggcgtttctgttctggttttctttcggatatgttataacgtgcatcttttgcaaggctctgttctacagcctcattattatcggcactttaggtaaaaagatcaagcagtatcgggaactgaaaccccagacctgtacaatttgcgagactgcccctgtgaacgcaatagatgccgagatgcatgaccttaattgttcctacaacatctgcccatattgtgcttcacgcttgaccagtgacgggctggcaagacacgtcacacagtgccccaagaggaaagaaaaggtggaggaaaccgagctatacctcaatctggaacggattccttggatcgtacgcaaacttctgcaagttagcgagtctacgggagtggccttgaagcgatcctcatggctcatagtcctgttagtgctgctcactgtgagccttagtccagtccagtctgctccggttggccacggcaaaacaattgagacctaccagactagagaagggtttacatccatctgtctgttcatgttgggaagcatcctatttattgtgtcgtgcctggtaaagggtctcgtggattctgtctccgactcattctttcccggcctgagtgtgtgtaagacctgcagcatcgggtccattaacggattcgagatagaatctcataaatgttattgcagccttttctgctgtccttactgcaggcactgttcagccgatcgggagatccatcagctgcacttgagtatttgcaagaaacgtaagacgggctccaatgttatgctcgcggtgtgtaaacgcatgtgctttaaggcaaccatcgaagccagcagaagggctctgttaatccggtctattataaacacaactttcgtcatgtgtatcctgaccctagccatttgcgtggtatcaacaagtgcagttgagatggaggacctcccagctggtacttgggaacgagaggaagatctgaccaatttttgtcaccaagagtgccaggtgacagaaaccgagtgtctttgcccctatgaggccttggtcctgcgcaagcctctcttcctggacagcatcgtgaaagggatgaagaaccttttaaattccacttctttggaaacgtcgctcagcattgaggcgccatggggcgccatcaacgtccagtccacatttaaacccaccgtgtcaactgcaaacatagctctgagttggtctagcgttgaacatagaggaaataagatcttagtgaccggcaggtccgagtcaattatgaaactggaggaacggacaggggtaagctgggatctaggagtcgaggacgcctctgaatccaagctcctgaccgtgagtatcatggatcttagccaaatgtactctccggttttcgagtatttgtccggtgaccgccaggtggaagagtggcctaaggctacttgcacaggcgattgtcccgagagatgcgggtgtacgtcaagtacctgcctgcacaaagaatggccacatagcaggaactggcgttgtaatcctacttggtgctggggagtcggcacaggttgtacctgctgtggggtggacgtaaaggacctctttacagatcacatgttcattaaatggaaggtggagtacatcaaaactgaagccatagtttgcgtcgagctgacctcgcaggaacggcagtgttccttaattgaggcaggcacgcgatttaacctgggacccgtgaccatcacactttctgagccaagaaatattcaacagaagttgccccctgaaatcataactctccatccaaagatcgaggaaggcttctttgacctgatgcacgtgcagaaagtcctaagcgcctcaaccgtttgcaagctgcagagttgcacacacgggattccgggagatctccaaatctatcatattggtaacctgcttaaaggcgacagggtgaatgggcacttgatccataagatagagccccacttcaacacttcctggatgtcttgggatggatgtgacctggattactactgcaatatgggcgactggcctagctgtacctatacgggtgtgacacagcacaaccatgctgcgtttgtaaatttactcaacattgaaaccgattacactaaaacattccacttccattccaagcgcgtcaccgcacacggggacactccacagctggatcttaaagcccggcccacctatggcgctggagagatcacagtgctggttgaggtggccgacatggaattgcatacgaagaaggtcgagatctcaggcctcaaatttgcaagcctgacctgcactgggtgttacgcctgcagttctggaatttcctgtaaggtgagaatccacgttgatgaacctgacgagctaacagtgcacgtaaaaagctcggacccagatgtcgtggctgcctcaacctctctgatggcaaggaagctcgagttcggcacagacagtacttttaaagcgttctccgctatgcccaagaccagcctgtgcttttatattgtggaacgcgagtactgtaagtcttgcagcgaagatgacacgaaaaagtgtgtcgatacaaaacttgagcagccgcaatccatattgatcgaacataagggtaccattatcgggaaacagaatgacacttgcaccgccaaggcatcatgctggctggagagtgttaagagcttcttttatggactgaaaaacatgctcggctctgtgttcggtggctttttcgtagggattctgctttttctggcccctttcgtgctactcgtcctgtttttcatgttcggatggaagatcttgttttgtttcaaatgctgtcgacggacacgtggcctgtttaagtacagacacttaaaagatgacgaggaaactgggtacaggcgcataatcgagcggctcaattccaagaagggcaaaaacagactgcttgatggagaaaggctggctgaccgaaagattgccgagttgttctcaaccaaaacacatatcggt

SEQ ID NO: 10513 - RNA, 3495 nt, synthetic construct
  misc_feature 1..3495: note = derived and/or modified CDS sequence (opt3) from CCHVF(CCHVF 5170-R-2011)__KR814873.1__Gn-NSm-Gc
  source 1..3495: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgtctgtgactcaagctgcgagataatgatcccgaaaggcactggggatattctcgtggactgtagtggaggtcagcaacacttcctgaaggataaccttatcgacctgggctgcccccatattcctttgctcgggaaaatggcaatctacatatgtagaatgtccaatcacccaaggacaaccatggcctttctgttctggttttctttcggatatgttattacgtgcatcttttgcaaggcgctgttctacagcctcattatcatcggcactttaggtaaaaagattaagcagtatcgggaactgaaaccccagacctgtacaatatgcgagactgctcctgtgaacgccatcgatgcagagatgcatgaccttaattgttcctacaacatttgcccatattgtgcctcacgcttgaccagtgaagggctggctagacacgtcacacagtgccccaagaggaaagagaaggtggaagagaccgaactatacctcaatctggagcggatcccttggatagtacgcaaacttctgcaagttagcgagtctacgggagtggcattgaagcgatcctcatggctcattgtcctgttagtgctgctcactgtgagccttagtccagtccagtctgccccggttggccacggcaaaacaatcgaaacctaccagactagagaggggtttacatccatctgtctgttcatgttgggaagcattctatttatcgtgtcgtgcctggtaaagggtctcgtggactctgtctccgattcattctttcccggcctgagtgtgtgtaagacctgcagcattgggtccataaacggattcgaaatcgagtctcataaatgttattgcagccttttctgctgtccttactgcaggcactgttcagctgaccgggaaattcatcagctgcacttgagtatctgcaagaaacgtaagacgggctccaatgttatgctcgccgtgtgtaaacgcatgtgctttaaggcgaccatcgaggcaagcagaagggccctgttaattcggtctataatcaacacaactttcgtcatttgtatcctgaccctagctatttgcgtggtatcaacaagtgccgttgagatggaagatctcccagcaggtacttgggagcgagaagaggacctgaccaatttttgtcaccaagaatgccaggtgacagagaccgagtgtctttgcccctatgaggctttggtcctgcgcaagcctctcttcctggatagcatcgtgaaagggatgaagaaccttttaaattccacttctttggagacgtcgctcagcatagaagccccatggggcgcgatcaacgtccagtccacatttaaacccaccgtgtcaactgccaacattgcactgagttggtctagcgttgagcatagaggaaataagatcttagtgaccggcaggtccgagtcaattatgaaactggaagaacggacaggggtaagctgggacctaggagtcgaagatgcttctgagtccaagctcctgaccgtgagtatcatggaccttagccaaatgtactctccggttttcgaatatttgtccggtgatcgccaggtggaggagtggcctaaggccacttgcacaggcgactgtcccgaaagatgcgggtgtacgtcaagtacctgcctgcacaaagagtggccacatagcaggaactggcgttgtaatcctacttggtgctggggagtcggcacaggttgtacctgctgtggggtggatgtaaaggacctctttacagaccacatgttcataaaatggaaggtggaatacattaaaactgaggctatcgtttgcgtcgaactgacctcgcaggagcggcagtgttccttaattgaggccggcacgcgatttaacctgggacccgtgaccatcacactttctgaaccaagaaatatacaacagaagttgccccctgagatcattactctccatccaaagatcgaagagggcttctttgatctgatgcacgtgcagaaagtcctaagcgcatcaaccgtttgcaagctgcagagttgcacacacgggattccgggagacctccaaatctatcatataggtaacctgcttaaaggcgatagggtgaatgggcacttgattcataagatcgaaccccacttcaacacttcctggatgtcttgggacggatgtgatctggactactactgcaatatgggcgattggcctagctgtacctatacgggtgtgacacagcacaaccatgccgcttttgtaaatttactcaacatcgagaccgactacactaaaacattccacttccattccaagcgcgtcaccgcgcacggggatactccacagctggaccttaaagcacggcccacctatggcgccggagagattacagtgctggttgaagtggctgatatggagttgcatacgaagaaggtcgaaatctcaggcctcaaatttgccagcctgacctgcactgggtgttacgcatgcagttctggaatttcctgtaaggtgagaatacacgttgacgagcctgatgagctaacagtgcacgtaaaaagctcggacccagacgtcgtggccgcttcaacctctctgatggccaggaagctcgagttcggcacagatagtacttttaaagcattctccgcgatgcccaagaccagcctgtgcttttatatcgtggaacgcgaatactgtaagtcttgcagcgaggacgatacgaaaaagtgtgtcgacacaaaacttgaacagccgcaatccattttgatcgagcataagggtaccattatcgggaaacagaatgatacttgcaccgctaaggcctcatgctggctggagagtgttaagagcttcttttatggactgaaaaacatgctcggctctgtgttcggttcctttttcgtaggcatactgctttttctggcacctttcgtgctactcgtcctgtttttcatgttcgggtggaagatcttgttttgtttcaaatgctgtcgacggacacgtggactgtttaagtacagacacttaaaagacgatgaagagactggctacaggcgcattatcgaacggctcaattcaaagaaggggaaaaacagactgcttgacggagagaggctggccgatcgaaagattgctgaattgttcagtaccaaaacacatatcggc

SEQ ID NO: 10514 - RNA, 3495 nt, synthetic construct
  misc_feature 1..3495: note = derived and/or modified CDS sequence (opt3) from CCHVF(CCHVF Oman-199809166)__KR864901.1__Gn-NSm-Gc
  source 1..3495: mol_type = other RNA
agcgaggaatccggcgaggactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaagagcttcaagttgtgtgaaaattccgctactggtaaatcttgcgagattgacaacacccctgttaagtgtaaacaggggttttgcttaaagatcacacaggaaggacgaggccatgtgaagctgtcgcgtgattcagaggtagtgctagacgcatgtgatagcagttgcgaaataatgatcccaaaaggcaccggggacattctcgtcgattgttccggaggtcagcaacacttcctgaaggacaatcttatcgatctgggctgcccgaacattcccttgctcgggaaaatggccatctacatatgtagaatgtctaatcatcctaagactacaatggcgtttctgttctggtttagcttcggatatgtgattacctgcatcctgtgcaaagttatcttttacctcttaattgtggtcggcacgctgggtaagaagttcaaacagtatagggagcttaagccacagacttgtaccatctgcgagacaactcccgtgaacgctattgacgccgaaatgcacgatttgaattgttcctacaacatatgcccttattgtgcatcacggctgaccagtgacgggctagcccgccatgtaatgcagtgcccaaaaagaaaggagaaaatcgaagagacagaactctacctgaatcttgagaggattccctgggttgtgcggaagctgttgcaagtcagcgagtctaccggagtggctctcaaacgctcctcatggctgatcgtgttactggtcctccttacggttagcctgagtcctgtgcagtctgcaccaataggccacggcaagactattgaaacataccagacccgagaggggtatacttccatctgtttgtttgtactaggaagcatcctgttcattgtgtcgcacctcatgaagggtctggtcgactctgtgggcaactcctttttcccggggctttcaatctgcaaaacatgtagtattggaagcataaatggctttgaaatcgagtcccataagtgctactgttctctgttctgctgcccctattgtagacactgcagcgccgataaagaaattcataagttgcacctctcaatctgtaaaaagaggaaggctggtagtaacgttatgctggccgtgtgcaaacggatgtgtttccgtgcgaccatggaggtctccaataaggcattactgatccgcagcgtgattaacacgacctttgtagtttgcatactaatcctcgccgtgtgtgtcgtgtctacatcagctgtcgagatggaaagtctgcctgccgggacttgggagagagaagaggaccttaccaacttctgccaccaggaatgtcaagtgacagagactgagtgcttgtgtccatacgaagcactggttctcaggaaacccctgtttcttgatagcattgctaagggcatgaaaaatctgttgaactccacctctctcgagacatcgctgagcatcgaagccccttggggagcgattaatgtgcagtccaccttcaagccaactgtatcaacggccaacatcgcattaagttggtctagcgtcgagcatcggggcaataagatactggtgtccgggcgatcagagagcatcatgaaactagaggagcgcacaggaatttcttgggacctcggtgttgaagatgcttccgagagtaagctgcttaccgtgagcgtcatggacttgtctcagatgtattcccccgtgtttgaatacctgtcaggcgatagacaagtagaggagtggccgaaagccacttgcaccggggactgccctgaaaggtgtggatgcacaagtagcacctgtctccacaaggagtggccccattcgcggaactggcgctgcaatccaacttggtgttggggcgtgggtacagggtgcacgtgttgcggcctggatgttaaagacttattcaccgattatatgtttgtcaagtggaaggtggaatacatcaaaactgaggctattgtgtgtgtcgaactgacatcccaggagagacagtgctctcttatcgaggccggaaccaggttcaacttgggccctgttacaataactctcagcgaaccccgtaatattcagcaaaagctgccacccgagatcgtgaccctacaccctcggattgaagaggggtttttcgacctgatgcatgtgcagaaagtactctcagcaagtacggtctgtaagctgcagtcctgcacccacggagtgccaggtgaccttcaggtttaccacatcggcaacttgctgaaaggggataaggtgaatggacatttaatacacaaagtcgaaccgcattttaacacatcttggatgagctgggacggctgcgatctcgactattactgtaatatgggtgattggccctcctgcacttataccggggtgacacaacacaaccacgccgctttcgttaatctgcttaacatcgagactgactacaccaagaactttcatttccactcaaagcgagtgacggcgcatggcgatacacctcagctggacttgaaagcaagaccaaattatggagccggcgagattaccgtactcgtcgaagtggctgatatggagctgcacactaagaaaatcgaaattagcgggctaaagttcgccagtctgacatgtaccggatgctacgcatgttcttccggcatcagctgcaaagtgaggatacatgtcgacgagcccgatgagctcactgttcacgtgaagtcggaagaccctgatattgtagccgcttcatctagtctgatggcccgcaaacttgagtttggtaccgactccacattcaaagcatttagcgcgatgccaaagacgtctttgtgtttctatatcgtggaacgggagtactgcaaaagctgttccaaggaagacacccagaaatgcgtcaacgctaagctggagagaccccagtcaatcttaattgagcacaaggggactatcattggaaaacaaaatgatacatgtaccgccaaggcaagttgctggctcgaaagcgtgaaatcctttttctacggcctgaagaacatgctttctggtatatttggcaatgttttcatcgggatttttctgttcctagccccgtttatcctcctgattttgttctttatgttcggatggaggatcctgttctgctttaaatgttgccgccgaacacggggcttattcaagtatcgtcatctcaaggacgatgaggaaactgggtacagaaaaataatcgagaggctgaacaataagaaaggaaagaacaaacttctggacggcgaacgcttggctgatcggaagattgccgagctcttttcaaccaaaacgcacatcggt

SEQ ID NO: 10515 - RNA, 3495 nt, synthetic construct
  misc_feature 1..3495: note = derived and/or modified CDS sequence (opt3) from CCHVF(CCHVF 200406546-Turkey)__KR864902.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgtctgtgactcaagctgcgaggtgatgataccgaagggcactggggatatcctcgttgactgtagtggaggtcagcaacacttcctgaaagataaccttattgacctgggctgcccccatgtgcctttgctcgggaggatggcaatctacatttgtcggatgtccaatcacccacgcacaaccatggcctttctgttctggttttctttcggatatgtcatcacgtgcatattttgcaaggcgctgttctacagcctcattatcattggcactttaggtaaaaagtttaaacagtatagagaactgaagccccagacctgtacaatctgcgagactgctcctgtgaacgccatcgatgcagagatgcatgaccttaattgttcctacaacatttgcccatattgtgcctcaaggttgaccagtgacgggctggctcggcacgtaccccagtgccctaagcgcaaagaaaaggttgaggaaacagagctatacctcaatctggaacgaataccatggatcgtgagaaaacttctgcaagtcagcgagtctaccggagtggcattgaagaggtcctcatggctcattgtgctgttagtcctgctcacggttagccttagtccggtgcagtctgcccccgtaggccacggcaaaactatcgagacataccagacccgggaagggttcacttccatatgtctgtttatgttgggaagcattctattcatcgtgtcgtgcctggtcaagggtctcgtggattctgtttccgactcatttttccctggcctgagtgtgtgtaaaacatgcagcatcgggtccattaacggattcgagatcgaatctcataagtgttattgcagcttattttgctgtccatactgccgtcactgttcagctgatcgcgagattcatcagctgcacttgagtatatgcaagaaaagaaagaccggctccaatgtcatgctcgccgtgtgtaaaaggatgtgcttccgggcgacgatcgaagcaagccgacgcgccctgttaattagatctatcatcaacaccacatttgtaatttgtatactgactctaaccatctgcgttgtgtcaacaagtgctgtcgagatggagaatctccccgccggtacttgggaaagggaggaagacctgaccaacttctgtcaccaagagtgccaggtgacagaaaccgagtgtctttgcccttatgaggcattggtcctgcggaagccactctttctggatagcattgtgaaagggatgaagaatcttctgaactccacttctttggaaacgtcgctcagcatcgaggctccctggggcgccattaacgttcagtccacattcaagccgaccgtgtcaactgcgaatatcgccctgagttggtctagcatagaacatcgcggaaacaaaatcttagtaaccggcagatccgagtcaattatgaagctggaggaaaggacaggggtcagctgggacctaggagtggaggatgcatctgaatccaaactcctgaccgttagtatcatggaccttagccaaatgtactctcctgtgtttgagtatttgtccggtgatcgtcaggtcgaagagtggcccaaggctacttgcacaggcgactgtccagagcggtgcgggtgtacgtcaagtacctgcctgcacaaagaatggcctcatagccgaaattggagatgtaaccccacttggtgctggggagtgggcacaggttgtacctgctgtggggtagatgtgaaggacctcttcacagaccacatgtttgttaagtggaaagtcgagtacattaagactgaagccatcgtgtgcgtggagctgacctcgcaggaaaggcagtgttccttaatagaggctggcacgcgcttcaatctgggaccagtcaccattacactttctgagccccggaacatccaacagaaattgcctccagaaattatcactctccatccgaaggttgaggaaggctttttcgatctgatgcacgtgcagaaagtgctaagcgcctcaaccgtatgcaagctgcagagttgcacacacgggatacccggagacctccaagtctatcatatcggtaatctgcttaagggcgatagagtgaacgggcacttgattcataaaatcgagcctcactttaatacttcctggatgtcttgggacggatgtgatctggactactactgcaacatgggcgattggccaagctgtacctatacgggtgttacacagcacaatcatgcagccttcgtgaacttactcaatattgaaaccgactacactaagacattccactttcattccaaaagggtcaccgctcacggggatactccccagctggaccttaaggcgcgccctacctatggcgcaggagagatcacagtgctggttgaggtggccgatatggaattgcatacgaaaaaggtagagatatcaggcctcaaattcgctagcctggcctgcaccgggtgttacgcatgcagttctggaatttcctgtaaggtccgaatccacgtggacgaaccagatgagctaactgtgcacgtcaagagctcggaccccgacgttgtggccgcttcaacatctctgaccgcccggaaactcgagtttggcacagatagtactttcaaggcattttccgcgatgccgaaaaccagcctgtgcttctatatcgtagaaaaggagtactgtaaatcttgcaacgaagacgatacgcagaagtgtgtggacacaaaacttgagcaacctcagagcattttgatcgaacataagggtaccattatagggaagcagaatgatacttgcaccgctaaagcctcctgctggctggagtcagtcaagagctttttctatggacttaaaaacatgctcggcagtgtgtttggtaacttctttatcggcattctgcttttcctggcaccatttgttctactcgtgctgttcttcatgtttgggtggaagatcttgttctgttttaagtgctgtcgtagaacaaggggactgttcaaataccgccacttaaaggacgatgaggaaactggctacaaacggattatcgagagactcaataacaagaaagggaagaataggctgcttgacggagaacgactggccgatcgcaagatagctgagttgttttctaccaaaacacatatcggc

SEQ ID NO: 10516 - RNA, 3495 nt, synthetic construct
  misc_feature 1..3495: note = derived and/or modified CDS sequence (opt3) from CCHVF(CCHVF 1-CR/HU-2015)__KU161584.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcacacagtgccccaaacggaaggaaaaagtggaggaaaccgagctatacctcaatctggaacgcattccttggatcgtacgaaaacttctgcaagttagcgagtctacgggagtggccttgaaaagatcctcatggctcatagtcctgttagtgctgctcactgtgagccttagtccagtccagtctgctccggttggccacggcaagacaattgagacctaccagactagggaagggtttacatccatctgtctgttcatgttgggaagcatcctatttattgtgtcgtgcctggtaaaaggtctcgtggattctgtctccgactcattctttcccggcctgagtgtgtgtcggacctgcagcatcgggtccattaacggattcgagatagaatctcataagtgttattgcagccttttctgctgtccttactgccgtcactgttcagccgatcgcgagatccatcagctgcacttgagtatttgcaagaaaagaaagacgggctccaatgttatgctcgcggtgtgtaaaaggatgtgctttcgggcaaccatggaagccagccgacgcgctctgttaatcagatctatcattaacacaactttcgtcatatgtatcctgaccctaacaatttgcgtggtatcaactagcgccgttgagatggagaatctcccagcaggtacctgggaaagggaggaagacctgacaaacttttgtcaccaagagtgccaggtgaccgaaactgagtgtctttgcccctatgaggctttggtcctgcggaagcctctcttcctggatagcatcgtgaaagggatgaagaatcttctgaactccacgtctttggaaacatcgctcagcattgaggccccatggggcgcgatcaacgtccagtccacctttaagcccactgtgtcaaccgccaatatagcactgagttggtctagcgttgaacatcgcggaaacaaaatcttagtgacaggcagatccgagtcaattatgaagctggaggaaaggaccggggtaagctgggacctaggagtcgaggatgcttctgaatccaaactcctgactgtgagtatcatggaccttagccaaatgtactctccggttttcgagtatttgtccggtgatcgtcaggtggaagagtggcctaaggccacatgcacgggcgactgtcccgagcggtgcgggtgtacctcaagtacttgcctgcacaaagaatggccacatagccgaaattggagatgtaaccctacatggtgctggggagtcggcaccggttgtacatgctgtggggtggatgtaaaggacctctttactgaccacatgttcgtgaagtggaaagttgagtacattaagaccgaagctatcgtctgcgtggagctgacgtcgcaggaaaggcagtgttccttaatagaggccggcacccgctttaatctgggacccgtgacaattactctttctgagccacggaacatccaacagaaattgccccctgaaattatcaccctccatccaaagatagaggaaggcttctttgatctgatgcacgtccagaaagttctaagcgcatcaacagtgtgcaagctgcagagttgcactcacgggatcccgggagacctccaagtgtatcatattggtaatctgcttaagggcgatagagtaaacgggcacttgatccataaaattgagccccacttcaatacctcctggatgtcttgggacggatgtgatctggactactactgcaacatgggcgattggcctagctgtacgtatacaggtgtcacccagcacaatcatgccgcttttgtgaacttactcaatatcgaaactgactacacaaagaccttccacttccattccaaaagggttactgcgcacggggataccccacagctggaccttaaggcacgccccacatatggcgccggagagataacggtgctggtcgaggtggctgatatggaattgcataccaaaaaggttgagatttcaggcctcaaatttgccagcctggcatgcactgggtgttacgcctgcagttctggaatctcctgtaaggtgcgaatccacgtagacgaacctgatgagctaacagtccacgtgaagagttcggacccagacgtggtcgctgcctcaacctctctgatggcacggaaactcgagttcggcacagatagtacttttaaggcgttctccgctatgcccaaaaccagcctgtgcttttatattgttgaacgtgagtactgtaagtcttgcagcgaagacgatacgaaaaagtgtgtggacacaaaacttgagcagccgcaatccatcttgattgaacataagggtaccataatcgggaagcagaacgatacttgcaccgccaaagcatcatgctggctggagagtgtaaagagcttcttttatggattaaagaatatgctcggctctgtgttcggtaactttttcattggcatcctgctttttctggcccctttcgtcctactcgtgctgtttttcatgttcgggtggaagattttgttttgtttcaagtgctgtagaaggacacgcggactgtttaaataccggcacttaaaggacgatgaggaaactggctacagaaggatcatagagcgactcaacaataaaaaggggaaaaaccgcctgcttgacggagaacggctggctgatagaaagatcgccgagttgttctccaccaagacacatattggc

SEQ ID NO: 10517 - RNA, 3495 nt, synthetic construct
  misc_feature 1..3495: note = derived and/or modified CDS sequence (opt3) from CCHVF(CCHVF 1231-CR/TI-2015)__KU161585.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcattttctgcaaagctctgttctacagcctcatcattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcacacagtgccccaaacggaaggaaaaagtggaggaaaccgagctatacctcaatctggaacgcattccttggatcgtacgaaagttgctgcaagttagcgagtctacgggagtggccttgaaaagatcctcatggctcatagtcctgttagtgctgctcactgtgagccttagtccagtccagtctgctccggttggccacggcaagacaattgagacctaccagactagggaagggtttacatccatctgtctgttcatgttgggaagcatcctatttattgtgtcgtgcctggtaaaaggtctcgtggagtctgtctccgattcattctttcccggcctgagtgtgtgtcggacctgcagcatcgggtccattaacggattcgaaatagagtctcataagtgttattgcagccttttctgctgtccttactgccgtcactgttcagccgaccgcgaaatccatcagctgcacttgagtatttgcaagaaaagaaagacgggctccaatgttatgctcgcggtgtgtaaaaggatgtgctttcgggcaaccatggaggccagccgacgcgctctgttaatcagatctatcattaacacaactttcgtcatatgtatcctgaccctaacaatttgcgtggtatcaaccagtgccgttgagatggaaaatctcccagcaggtacttgggagagggaagaggatctgacaaacttttgtcaccaagaatgccaggtgaccgagactgagtgtctttgcccctatgaagctcttgtcctgcggaagcctctcttcctggacagcatcgtgaaagggatgaagaatcttctgaactccacgtctttggagacatcgctcagcattgaagccccatggggcgcgatcaacgtccagtccacctttaagcccactgtgtcaaccgccaatatagcactgagttggtctagcgttgagcatcgcggaaacaaaatcttagtgacaggcagatccgagtcaattatgaagctggaagagaggaccggggtaagctgggatctaggagtcgaagacgcttctgagtccaaactcctgactgtgagtatcatggatcttagccaaatgtactctccggttttcgaatatttgtccggtgaccgtcaggtggaggagtggcctaaggccacatgcacgggcgattgtcccgaacggtgcgggtgtacctcaagtacttgcctgcacaaagagtggccacatagccgaaattggagatgtaaccctacatggtgctggggagtcggcaccggttgtacatgctgtggggtggacgtaaaggatctctttactgaccacatgttcgtgaagtggaaagttgaatacattaagaccgaggctatcgtctgcgtggaactgacgtcgcaggagaggcagtgttccttaatagaggccggcacccgctttaatctgggacccgtgacaattactctttctgaaccacggaacatccaacagaaattgccccctgagattatcaccctccatccaaagatagaagagggcttctttgacctgatgcacgtccagaaagttctaagcgcatcaacagtgtgcaagctgcagagttgcactcacgggatcccgggagatctccaagtgtatcatattggtaatctgcttaagggcgacagagtaaacgggcacttgatccataaaattgaaccccacttcaatacctcctggatgtcttgggatggatgtgacctggattactactgcaacatgggcgactggcctagctgtacgtatacaggtgtcacccagcacaatcatgccgcttttgtgaacttactcaatatcgagactgattacacaaagaccttccacttccattccaaaagggttactgcgcacggggacaccccacagctggatcttaaggcacgccccacatatggcgccggagagataacggtgctggtcgaagtggctgacatggagttgcataccaaaaaggttgaaatttcaggcctcaaatttgccagcctggcatgcactgggtgttacgcctgcagttctggaatctcctgtaaggtgcgaatccacgtagatgagcctgacgagctaacagtccacgtcaagagctcggatccagacgtggtggctgcctcaacctctctgatggcacggaaactcgaatttggcacagacagtacttttaaggcgttctccgctatgcccaaaaccagcctgtgcttttatattgttgagcgtgaatactgtaagtcttgcagcgaggatgacacgaaaaagtgtgtggatacaaaacttgaacagccgcaatccatcttgattgagcataaaggtaccataatcgggaagcagaacgacacttgcaccgccaaagcatcatgctggctggagagtgtaaagagcttcttttatggattaaagaatatgctcggctctgtgttcggtaactttttcattggcatcctgctttttctggcccctttcgtcctactcgtgctgtttttcatgttcgggtggaagattttgttttgtttcaagtgctgtagaaggacacgcggactgtttaaataccggcacttaaaggatgacgaagagactggctacagaaggatcatagaacgactcaacaataaaaaggggaaaaaccgcctgcttgatggagagcggctggctgacagaaagatcgccgaattgttctccaccaagacacatattggc

SEQ ID NO: 10518 - RNA, 3495 nt, synthetic construct
  misc_feature 1..3495: note = derived and/or modified CDS sequence (opt3) from CCHVF(CCHVF Gaib)__KX013445.1__Gn-NSm-Gc
  source 1..3495: mol_type = other RNA
agcgaggaatcctctgacgattgcatctcaagaacccagctgctcaggacagagactgccgaaattcacaacgacaattacggcgggcccggagataagataacgatctgtaacggtagtaccattgtggaccaacggcttggcagcgagctggggtgctatacaatcaatcgcgtcaaatccttcaagttgtgtgaaaactctgctactggaaaatcgtgcgagattgattcaatccctgttaagtgtcgacagggcttttgcttaaaaataacccaggagggtcgtgggcatgtgaagctgagcagaggaagtgaagtagtgctagacgcatgtgattcctcttgcgagatcatgattccaaagggcacaggcgacatcctcgtcgattgtagcgggggacagcaacacttcctgaaagacaatcttattgatctgggttgcccgaacatccccttgctcggcaagatggccatatacatttgtaggatgtccaatcatcctaaaaccactatggcgtttctgttctggttttcattcgggtatgtgatcacatgcatcttttgcaaggctattttctacctgctcatcattgttggaaccttaggcaaaaagtttaagcagtatcgggaactgaaaccacagacgtgtactatatgcgagaccacacccgtgaacgccatcgacgcagagatgcacgatcttaattgtagttacaacatttgcccttattgtgccagccgcttgacttctgacggtctggctagacatgtcgtgcactgcccaaagaggaaagaaaagatcgaggaaaccgagctatacctcaatctggaacgggtaccctgggttgtgcgcaaacttctgcaggtctccgagtcaacaggggtggcattgaagcgaagcagttggctcatagtgctgttagtcctgctcaccgtttctctttcccctgtgcaaagcgccccaattggacacggcaaaacgatcgagacttaccagacaagagaaggctatacctcgatctgtctgttcgtattgggagggattctatttatcgtgtcttgcctgatgaagggtctcgtcgactccgtgggcaacaatttctttccggggctgactatttgtaagacatgctcaataagtagcatcaacggattcgagattgaatcccataaatgttactgctctcttctgtgctgtccctattgcaggcactgtagcgctgatcgggagatccatcagttgcacctctcaatctgcaagaaacgtaagaccggcagtaatgttatgctggccgtgtgtaaacgcatgtgcttaagagtcacgaccgaagtgtccaacagggcgctgttcattcggagcataatcaacacaacttttgtaatttgtatcctaattctcgcagtttgcgtgatctctacctcagccgtcgagatggagaatctgcctgctggtacatgggaacgagaggaagaccttactaacttctgtcaccaggagtgccaagtgaccgaaacagagtgtttgtgcccatacgaggccctggtcctccgcaagcccctgtttagtgatagcatagtgaaggggatgaaaaatcttctgaactccacctctttggaaacttcgctcagcatcgaggcaccttggggcgctattaatgttcagtccacgttcaagccaacagtgtcaaccgccaacatcgcgctgagttggtctagcattgaacatagaggaaataaaatcttagtatccggcaggtcagagagcataatgaagctggaggaacggactgggatttcttgggacctaggagtcgaggatgcctccgaaagtcgcctcctgaccgtgagcgttatggacctttctcagatgtattcccccgtgtttgagtacttgtcaggtgatagacaagtcgaagagtggccgaaagcaacatgcaccggcgactgtcctgagaggtgcgggtgtacaagtagcacatgcctgcacaaggaatggccccattcgcgtaactggcggtgtaatccaacgtggtgctggggagtgggcaccggttgtacttgctgtgggctcgatgtaaaggacctgttcacagattatatgtttgtgaaatggaaggttgagtacatcaaaaccgaagctattgtctgcgtggagttaacatcccaggaacgacagtgttctctgatcgaggccggcactagattcaaccttggacctgtgaccataacgttgagcgagcccaggaatatccagcaaaagctcccacccgaaattatcaccctgcaccctcgcattgaggaaggctttttcgacctaatgcatgtccagaaagttctgtcagctagtacagtgtgcaagctccagtcctgcactcacggggtgccaggagacctgcaggtataccacatcggtaaccttttgaagggcgataaagtcaatgggcatctgatacacaagattgagccgcattttaacacctcttggatgagctgggacggatgtgatttagactattactgcaatatgggcgattggccctcctgtacatatactggtgtgacccaacacaaccacgccgcattcgttaacctcctgaatatcgaaacggactacactaaaaactttcatttccactcaaagcgggtgaccgcccatggggatactcctcagcttgacctgaaagctagaccaacatatggcgcgggagagatcaccgtcttggtggaggttgcagatatggaactccacactaagaaaattgagatcagcggcctgaagttcgccagtctaacctgcacagggtgttacgcttgttcttccggaattagctgcaaggtgaggatacatgtagacgaacccgatgagctgacggtccacgtgaaatcggaggaccctgatatcgtggccgcatcatctagtctcatggcccgcaagctggaatttggcaccgactccactttcaaggcttttagcgccatgccaaaaacatctctttgcttctatattgtcgagcgagaatactgtaaaagctgctcccgggaggacacccagaagtgtgtttcaacaaagttggaacagccccaaagtatcctgattgagcacaaaggtactatcatagggaagcagaataatacctgcacgacaaaaaccacttgctggttagagagcgtgaagtcctttttctacggactcaaaaacatgctgtcttcaatctttggcaacgtattcgtgggtatttttagtttccttgcaccgtttatcctgctaattctcttctttatgttcggctggcgtatcctgttctgttttaagtgctgtagaaggacccgcgggttgttcaagtatcggcatctgaaagatgacgaagagacaggatacagaaggataattgaacgattaaataacaagaaaggcaagagcaaactcctggatggggagcgccttgcggaccggaagatcgctgaactgttttccactaagacccacatcgga

SEQ ID NO: 10519 - RNA, 3495 nt, synthetic construct
  misc_feature 1..3495: note = derived and/or modified CDS sequence (opt3) from CCHVF(CCHVF Hodzha)__KX013448.1__Gn-NSm-Gc
  source 1..3495: mol_type = other RNA
agcgaggaatccggcgacgattgcatctctagaacccagctgctcaggacagagactgccgaaattcacggggacgattacggaggtcccggcgacaagataacgatctgtaacgggtcaaccattgtggatcaacggcttggaagtgagctgggctgctatacaatcaatcgcgtcaagagcttcaagttgtgtgaaaactccgctactggtaaatcttgcgagattgactcgacccctgttaagtgtcgacaggggtactgcttaaaaatcacacaggagggacgtggccatgtgaagctgtcaagaggcagcgaagtagtgctagatgcatgtgacagttcctgcgaggtcatgataccaaaggggaccggagatatcctcgtggactgttctggtggccagcaacactttctgaaagataatcttattgacctggggtgcccgaggatccccttgctcggaaagatggccatttatatctgtcggatgagcaaccatcctgaaactacaatggcgttcctgttttggttctcctttggctacgttataacctgcattctgtgcaaagctatcttctatctcttaattatcgtgggtacgctggggaagcgctttaaacagtacagagagcttaagccacagacttgtaccatctgcgagacaactcccgccaatgcaattgatgccgaaatgcacgacttgaactgttcatataatatatgcccttactgtgctagtaggctgaccagcgacggactagcacggcatgtcacacagtgcccaaagcgcaaagagaaggtggaagagaccgaactctacctgaaccttgagcgaatcccctggattgtaagaaaactgttgcaagtttctgagtccacgggcgtggccctcaagaggtcaagctggctgatcgtcttactggtgcttttcgctgtgagtctttctcctgtccagtccgccccaataggccacgggaaaactattgaaacatatcaggcgcgggaggaatacaccagcatctgtctgtttgttttgggatcgatcctattcattgtgtcttgcctgatgaagggtctcgtagattccatcggcaatattttcttcccggggctgactatatgtaaaacatgctcaatcggaagtattaacggctttgagatcgaaagccacaagtgttattgctcccttctgtgctgtccctactgccgtcattgtcctgcagaccgcgagatccaccagttgcatctctctatttgcaagaaaagaaagaccggtagcaatgtgatgctggccgtctgtaaaaggatgtgcttccgggctacgatggaggtgtcaaacaaggccttactgatacgaagtatcattaataccacattcgttgtgtgtatcctaattctcgcagtctgcgtggtatccactagcgctgttgaaatggagtctctgccagccgggacctgggaacgcgaggaagatcttacaaacttttgtcaccaagagtgccaggtgactgagaccgaatgtttgtgcccctatgaggcgctggtcctcagaaggcctctgttccttgactcaatcgtgaaaggcaagaagaatctgttgaacagtacaagcctcgaaacctccctgtctatagaggccccatggggagcaatcaacgtccagtcgacttacaaacccacggtgagcacagctaatattgccttatcctggtcaagtgttgagcaccggggcaacaagatcctggtgtctgggcgcagcgaatccattatgaaactagaggaaagaaccggaatctcatgggatctcggtgtagaggacgctagcgaatctaagctgcttactgtctccgtgatggatttgagtcaaatgtatagcccggtttttgagtacctgtctggcgaccgtcaggtggaggaatggcctaaagcaacctgcacaggggattgttccgagaggtgcggatgtacctcaagtacttgcctccataaggaatggccccacagccggaattggcgatgtaacccaacatggtgctggggcgtcggtacggggtgtacctgctgtggcctggacgtgaaggatttattcactgactacatgtttgtaaaatggaaggtggactatataaaaacagaggccattgtttgcgtcgaactgacctcgcaggagagacagtgttcccttgtggaggccggaacaaggttcaatttgggccctgtgactatcaccctctctgaaccccgcaacattcaacagaagctgccacccgagatcataacgctacatcctcggatcgaagaggggtttttcgatctgatgcacgtccagaaagttctcagcgcttcaaccgtgtgcaagctgcagagttgcacacatggagtgccaggtgaccttcaagtataccacattggcaatttgctgaagggggataaagtcaacggacacttaatccataagattgaaccgcactttaatacttcctggatgtcttgggacggctgtgatctcgactattactgcaacatgggtgattggcccagctgtacctatacaggggtgactcagcataatcacgcgtccttcgttaacctgcttaatatcgagaccgactacacgaaatcatttcacttccatagcaagagagtgacagcacacggcgatacccctcagctggacttgaaagccaggccaacttatggagctggcgagataacagtcctcgtggaagttgccgatatggagctgcataccaagaaaattgaaatcactgggctaaagtttgcaagtctgacctgcacaggatgttacgcctgttcttccggcatcagctgcaaggtgcgcattcacgtagacgagcccgatgagctcacggtccatgtgaaatcggacgaccctgatgtggtcgctgcctcatctagtctgatggcacgaaagctcgaatttggtaccgactccactttcaaagcgtttagcgctatgccaaagacatctttgtgcttctacatcgttgagcgggaatattgtaaaagctgctccaaggaggatacccagaagtgtgtgaacacaaaactggaacaaccccagtcaattttaatagagcagaaggggactatcattggaaaacagaataatacctgcacggccaaggcaagttgctggctcgagagcgtaaaatcctttttctacggcctgaagaacatgctttctggtatctttggcaacgtgttcgtcgggatttttctgttcctagccccgtttatcctcctgatattgttctttatgttcggatggcgtatcctgttttgtttcaagtgctgtagaaggacacgcggcttattcaaatataagcacctcaaagacgatgaagagaccgggtaccggagaattatcgaaaggctgaacaataagaaaggaaagaacaaacttctggacggcgagcgattggctgatcgccggattgccgaactcttttcaactaaaacccacatcggt

SEQ ID NO: 10520 - RNA, 3495 nt, synthetic construct
  misc_feature 1..3495: note = derived and/or modified CDS sequence (opt3) from CCHVF(CCHVF IbAn7620)__KX013451.1__Gn-NSm-Gc
  source 1..3495: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaaatctttcaagttgtgtgaaaattccgctactggcaaaaactgcgagattgattctgttccagtgaagtgtcgacagggttactgcttacgtatcacccaggaggggagaggacatgtaaaactgtcgaggggctcagaaatagtgctagacgcatgtgatacaagctgcgagatcatgattccgaagggcaccggggacatcctcgtcgattgtagtggaggtcagcaacactttctgaaggacaatcttattgatctgggctgccccaaaatccctttgctcgggaagatggccatatatatttgtcggatgtccaaccatccaaaaactacaatggcgttcctgttttggttctcttttggatacgtgattacctgcattctgtgcaaggctatcttctatctcttaatcattataggcacgctgggtaaacgccttaagcagtacagagaattgaagccccagacttgtaccatctgcgagacaactcctgttaatgccattgacgcagagatgcacgatctgaactgtagctataatatctgcccatactgtgcctccaggctaacctcagacgggctcgctcggcatgtgatacagtgccccaaacgcaaggaaaaagtcgaggaaacagagctgtaccttaacctggaacgaatcccttgggtggtaagaaagttgctccaagttagtgagagcaccggagtggcactgaaaaggtcttcctggttaatcgtcctgctcgtgctttttacggtgtcactgagcccagtccagagtgccccgatcggccagggcaagactacagaggcttatcgggcccgtgaagggtacacctctatttgtttgttcgttctaggatccatcctgtttattgtgagctgcctcatgaaaggtctggtagactcggtgggcaattctttctttcccgggctttccatatgtaagacttgctcaatcagtagcattaacggattcgagatcgaatcccacaagtgttattgctctctgttttgctgtccttactgccgccactgtagcacagataaagagatccataagttgcacctctcaatttgcaaaaagagaaaaaccggcagtaatgtcatgctggcggtgtgtaagaggatgtgcttccgggcaacgatggaagtttccaaccgagccttattcatacgcagcatcattaataccacatttgtgctgtgtatcctaattctcgctgtctgcgtggtatctacttcagccgttgagatggagaacctgccagcaggtacctgggaaagagaggaagaccttacaaacttctgtcatcaggagtgccaagtgactgaaaccgagtgtttgtgcccctatgaggctctggtcctcaggaagcctctgtttcttgatagtatcgccaaagggatgaagaatccactgaacagcacatccttggaaacctctctctcgatagaggcgccctggggcgccatcgacgtgcagagcacttacaaaccgacggtctccacagcaaatattgctctgtcatggagttctgtggaacaccggggaaacaagatcttagttagcggccgctccgagtcaattatgaaactggaggaaagaaccgggatcagctgggatctaggagtggaggacgcctctgaatccaagctcctgactgtaagtgtcatggatcttagccagatgtattctcctgtgttcgagtacttgtccggtgacaggcaagttgaagagtggcccaaggctacctgcacaggcgattgtccagagcgttgcgggtgtacctcaagtacttgcctgcacaaagaatggcctcatagccggaattggcgatgtaaccccacatggtgctggggagtgggcacgggttgtacctgctgtgggctcgacgtcaaggatctgtttactgactacatgttcgtgaaatggaaggtagagtatataaaaacagaagccattgtgtgcgttgagttaacctcgcaggaaagacagtgttccctgatcgaggcaggcacaaggtttaatcttggaccagtcactattaccttgtctgagccccgcaacatccagcaaaagctccctccagaaataatcacgctgcacccgcggattgaggaaggcttctttgacctaatgcatgtgcagaaggtgctgagcgcctcaaccgtctgcaaactccagagttgcacacacggggttcccggagatcttcaggtgtaccatatcggtaatctgttgaagggcgacaaagtgaacgggcacctgattcacaagatcgagcctcatttcaatacttcctggatgtcttgggatggatgtgacttagattattactgcaacatgggcgactggccaagctgtacctatacaggtgtaactcaacacaatcatgcttcctttgtcaacctcctgaatatagaaaccgattacacgaaaaacttccactttcactcaaagagagtgacagcgcatggggacacaccccagcttgatctgaaagcaaggcctacttatggcgccggagagattacagttttggtggaggtcgctaacatggaactccacaccaagaagatcgagatcagcggcctgaaattcgccagtctaacttgcaccgggtgttacgcatgcagctccggaattagctgtaaggtgcgcatccatgttgacgaaccagatgagctgacagtgcacgtaaaatcggacgatcccgacgtcgtggccgcttcatctagtctcatggcccgaaagctggagttcggcacggactccacctttaaagcattcagcgcgatgccgaagacttctctttgcttttacattgtggaacgggagcattgtaagagctgctccgaagaggataccaaaaagtgtgtcaataccaaattggaacagcctcagtcaatactgatcgagcacaagggtacaattatcgggaaacaaaacagtacttgcaccgctaaggccagctgctggttagagtctgttaagtccttcttttatggactcaaaaatatgctgtcaggcattttcggtaacgtgtttatgggcatcttcctttttctggcaccattcatactactcatcctgtttttcatgtttgggtggcgtattttgttctgtttcaagtgctgtagaaggacgcgcggactgtttaaataccggcacttaaaggacgatgaagagacaggctatagaaggatcattgaacgactcaataacaaaaaggggaagaataaactgcttgacggagagcgcctggccgatcggagaatcgctgaattgttcagtaccaagactcatataggc

SEQ ID NO: 10521 - RNA, 3495 nt, synthetic construct
  misc_feature 1..3495: note = derived and/or modified CDS sequence (opt3) from CCHVF(CCHVF K128_76)__KX013454.1__Gn-NSm-Gc
  source 1..3495: mol_type = other RNA
agcgacgagtccggcgatgactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaagagcttcaaattgtgtgagaatagcgctactggtaaatcttgcgaaattgactcgatccctgttaagtgtcgacaggggtactgcttaaaaataacccaggagggacgtggccatgtgaagctgtcaagaggcagcgaggtagtgctagatgcatgtgacagttcctgcgaagtcatgatcccaaaggggacaggagatattctcgtggactgttctggtggccagcaacactttctgaaagataaccttatcgacctggggtgcccgaagattcccttgctcggaaaaatggccatctatatatgtaggatgagcaatcatcctaagaccactatggcgttcctgttttggttctcctttggctacgttattacatgcatcgtgtgcaaagctattttctatctgctcatcatcgtcggtaccttagggaagcggtttaagcagtaccgcgagctgaaaccacagacgtgtactatttgcgaaaccacacccactaacgccatagatgcagagatgcacgaccttaattgttcatataacatctgcccttactgtgccagtagattgaccagcgacggactggctaggcatgtgacacactgcccaaagcggaaagagaaggtagaagagaccgaactatacctcaatctggagcgcattccctgggttgtgcgaaaacttctgcaggtctctgaatccacgggcgtggcattgaagagatcaagctggctcatcgtgctgttagtcctgttcgccgttagtctctctcctgtgcaatccgctccaataagccacggcaaaactattgagacatatcaggtaagggaggaatacacctcgatctgtctttttgtgctggggtctatcttgttcattgtctcctgcctaatgaagggactggtgaactcagttggtaatatctttttcccgggcctcagtatttgtaagacttgcagcatagggtccatcaacggatttgagattgaatctcataaatgttattgcagcctgctttgctgtccctactgccggcactgttcagccgatcgtgagatccatcagctgcacttgagtatctgcaagaaacgcaagacaggctccaatgtgatgctcgcggtctgtaaaagaatgtgcttcagggcaaccatggaagtgagcaacaaggccctgttcattcggtctataatcaatacgacctttgtagtttgtattttaatcctggctgtgtgcgtcgtgtcaacaagtgccgtcgagatggagagcctacctgcaggtacttgggaacgagaggaagacctcaccaacttctgtcaccaggagtgccaagtgacagaaactgagtgtctgtgcccatatgaggctcttgttttgcgcagacccctgtttcaggattccattgtgaaggggatgaaaaacctcctcaattctacctcgcttgaaacaagcctgtccatcgaggccccttggggcgcgataaacgtacagtcaacctacaagccagccgtcagtgcagctaatatcgccttgtcttggagctccgtggaacataggggatcaaaaattctcgttagcggccggtctgagtccatcatgaagctggaggaacgcactgggattagttgggacttaggagtggaggatgctagcgaatctaaactgctaacggtctccgtgatggacctctcacaaatgtatagtcccgtattcgagtacctgagcggtgatagacaggtggaagagtggccgaaggccacatgcaccggcgactgtcctgagaggtgcgggtgtacttcgtctacctgccttcacaaggaatggccccattcccgtaactggcggtgtaatccaacatggtgctggggagttggcaccggttgtacttgctgtgggttggatgtcaaagacctgtttacagattacatgttcgtgaagtggaaagtggagtatatcaagacggaagcaatagtctgcgttgagctcaccagccaggaacgacagtgttcactgattgaggccggcactagatttaacttaggacctgtgacaatcaccctgagtgagcccaggaatattcaacagaaacttccacccgaaatcataacattgcaccctcgcatcgaggaaggcttctttgacctcatgcatgtgcagaaggtactgtccgcttctactgtctgcaagctacagagctgcacccacggggtgccaggagacctgcaagtttaccacattggtaacctcctgaaaggcgatcgggtgaatgggcatcttatccacaagattgagccgcatttcaacacgtcctggatgtcatgggacggatgtgatttggactattactgcaatatgggcgattggcccagctgtacctatacaggtgtcactcagcacaaccacgcgagttttgtgaatctgttaaacatcgaaaccgactacacaaaatctttccattttcactccaagagagttactgcacatggggatacccctcagctcgacctgaaagccaggccaaattatggcgctggagagataacggtgcttgtagaggtcgccgatatggaactgcacacaaagaaaattgagatcagcggcttgaagttcgcatcgctgacctgcactgggtgttacgcctgctcatctggaatcagttgtaaggtgcgcattcatgtggacgaacccgatgagctgacagtccacgttaaatccgacgatcctgacgtggtagctgccagctctagcctaatggcacgaaagctggagttcggcaccgactccacttttaaagcgttctcagctatgccaaagaccagtctctgcttttacatcgtggaacgggagtattgtaaaagctgctctaaggaagatacacagaagtgtgtcaacacgaaactggagcaaccccagtccattcttatagaacacaagggtaccatcattgggaaacagaacaatacttgcacagccaagacctcatgctggttggagagtgtgaaatccttcttttacggactgaagaacatgttatccggcatcttcggtaatgtttttgtgggcattttcctctttctggcaccgttcatccttctgatactatttttcatgtttgggtggcgtatcctcttctgtttcaagtgctgtagaaggacacgcggactgtttcggtataaacatttggagaacgacgaagagactggctacagaaggattatcgaacgactgaataacaagaaagggaagaataaattactcgatggagagcgcctggccgaccggagaattgctgaacttttctctaccaagacgcacatcggc

SEQ ID NO: 10522 - RNA, 3495 nt, synthetic construct
  misc_feature 1..3495: note = derived and/or modified CDS sequence (opt3) from CCHVF(CCHVF K168_40)__KX013457.1__Gn-NSm-Gc
  source 1..3495: mol_type = other RNA
agcgacgagtccggcgatgactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaaatccttcaagttgtgtgagaatagcgctactggtaaatcttgcgaagttgactcgattcctgtgaagtgtcgacaggggtactgcttaaaaatcacccaggagggacgtggccatgtaaagctgtcaagaggcagcgaggtggtcctagatgcatgtgacagttcctgcgaagtgatgataccaaaggggacaggagatatcctcgttgactgttctggtggccagcaacactttctgaaagataaccttattgacctggggtgcccgaagatccccttgctcggaaaaatggccatttatatctgtaggatgagcaatcatcctaagaccactatggcgttcctgttttggttctcctttggctacgtgataacatgcattgtctgcaaagctatcttctatctgctcattatcgtgggtaccttagggaagcggtttaagcagtaccgcgagctgaaaccacagacgtgtactatctgcgaaaccacacccactaacgccattgatgcagagatgcacgaccttaattgttcatataacatatgcccttactgtgccagtagattgaccagcgacggactggctaggcatgtaacacactgcccaaagcggaaagagaaggttgaagagaccgaactatacctcaatctggagcgcatcccctgggtggtccgaaaacttcttcaggtgtctgaatccacgggcgtggcattgaagagatcaagctggctcattgtcctgttagttctgttcgccgtgagtctctctcctgtacaatccgctccaatcggccacgggaaaactatagagacatatcaggtgagggaggaatacaccagcatttgtctttttgtcctgggatcgatcttgttcatcgtgtcttgcctaatgaagggtctggttaactccgtgggcaatatctttttcccggggctctcaatttgtaagacttgcagtattggaagcataaacggctttgagatcgaatcccataaatgttattgctctctgctttgctgtccctactgccggcactgtagcgccgatcgtgagattcatcagctgcacttgtcaatctgcaagaaacgcaagacaggtagtaatgtcatgctcgcggtgtgtaaaagaatgtgcttcagggcaaccgtagaagtttccaacaaggccctgagcatccggtctattataaatacgaccttcgtggtctgtatcttaattctggctgtgtgcgtcgtgtcaacaagtgccgttgagatggagagcctacctgcagggacttgggaacgagaggaagacctcaccaacttttgtcaccaggagtgccaagtgacagaaactgagtgtctgtgcccatatgaggctcttgtattgcgcagacccctgttcctcgatggcatcgtcaagggaatgaaaaacctgcttaattccacctctctggaaacatcgttgagcattgaggccccttggggcgcgatcaacgtgcagtccacctacaagccaactgtttcagccgcaaatatagctctcagttggtctagcgtggaacatagggggaacaaaatcctggtctccggacggtcagagagcattatgaagttagaggaacgcacgggtatctcttgggacctgggcgtggaggatgcctccgaaagtaaactactcacagtaagcgtgatggacctgtctcagatgtattcccccgtttttgagtacctttcaggggatagacaagtcgaagagtggccgaaggctacctgcactggagactgtcctgagaggtgcggctgtaccagtagcacatgcttgcacaaggaatggccccattcgcgtaattggcggtgtaacccaacctggtgctggggtgtggggactggctgtacatgctgtggactggatgtgaaagacctcttcacggattacatgtttgtcaagtggaaagttgagtatattaagaccgaagccatcgtgtgcgtggagctgacttcccaggaacgacagtgttctttaatagaggcaggcacaagattcaatctggggcctgtaaccattacacttagcgagcccaggaacatccagcaaaaattgccacccgaaattatcactctccaccctcgcatagaggaaggatttttcgacctgatgcatgtccagaaggtgctatcagccagtaccgtttgcaagctgcagtcctgcacgcacggtgtgccaggcgacctccaggtctaccacatcgggaatctgcttaaaggagataaggtgaacggccatttgattcacaaaatcgagccgcattttaatacctcttggatgagctgggacggttgtgatctggactattactgcaacatgggggattggccctcctgtacatatactggcgttacccaacacaatcacgcttcattcattaacttactcaatatcgaaacagactacactaagagctttcatttccacagtaaacgggtgaccgcgcatggagatacgcctcagctggaccttaaggcaagaccaaactatggcgccggggagataacagtactggtcgaggtggctgatatggaattgcacaccaaaaagattgagatctctggactcaagtttgcctccctgacttgcacaggctgttacgcatgcagctcgggtatctcatgtaaagtgaggattcatgtcgacgaacccgatgagctaaccgttcacgtgaagtctgacgatcctgacgtagtggccgctagttccagcctgatggcccgcaaactcgagttcgggactgactctaccttcaaggcatttagcgcgatgccaaaaacatccctgtgcttctacatcgtcgaacgagagtattgtaagtcatgcagtaaggaagatacgcagaaatgtgtgaacaccaagctggagcacccccagagcattttgatagaacataaaggaactatcattggcaagcaaaataacacatgcaccgctaaaacatcttgctggctggagtccgttaagtcatttttctacggtttaaagaatatgctcagtggcatctttgggaacgtgttcgtcggaatttttctgttccttgccccgtttatcctgctaatactcttctttatgttcggctggcggatcctgttttgtttcaaatgctgtcgtagaactagggggttgttccgctataagcacctggaggacgatgaagagaccggataccggagaattatcgaaaggttaaataacaaaaagggcaaaaataagctcctggacggtgagcgacttgcagatcgccggattgccgaactgtttagcacgaagacacatatcggg

SEQ ID NO: 10523 - RNA, 3495 nt, synthetic construct
  misc_feature 1..3495: note = derived and/or modified CDS sequence (opt3) from CCHVF(CCHVF K168_125)__KX013460.1__Gn-NSm-Gc
  source 1..3495: mol_type = other RNA
agcgacgagtccggcgatgactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaagagcttcaaattgtgtgagaatagtgctactggtaaatcttgcgaagttgactcgattcctgtgaagtgtcgacaggggtactgcttaaaaatcacccaggagggacgtggccatgtaaagctgtcaagaggcagcgaggtggtcctagatgcatgtgacagttcctgcgaagtgatgataccaaaggggacaggagatatcctcgttgactgttctggtggccagcaacactttctgaaagataaccttattgacctggggtgcccgaaggtgcccttgctcggaaaaatggccatctatatttgtaggatgagcaatcatcctaagaccactatggcgttcctgttttggttctcctttggctacgtcatcacatgcatagtgtgcaaagctattttctatctgctcatcattgtaggtaccttagggaagcggtttaagcagtaccgcgagctgaaaccacagacgtgtactatctgcgaaaccacacccactaacgccatcgatgcagagatgcacgaccttaattgttcatataacatttgcccttactgtgccagtagattgaccagcgacggactggctaggcatgttacacactgcccaaagcggaaagagaaggtggaagagaccgaactatacctcaatctggagcgcataccctgggtcgtgcgaaaacttttacaggtgtctgaatccacgggcgtcgcattgaagagatcaagctggctcatcgttctgttagtgctgttcgccgtaagtctctctcctgtgcaatccgctccaattggccacgggaaaactatcgagacatatcaggtcagggaggaatacaccagcatatgtctttttgtgctgggatcgattttgttcatcgtttcttgcctaatgaagggtctggtgaactccgtcggcaatatctttttcccggggctctcaatttgtaagacttgcagtatcggaagcattaacggctttgagatagaatcccataaatgttattgctctctgctttgctgtccctactgccggcactgtagcgccgatcgtgagatccatcagctgcacttgtcaatttgcaagaaacgcaagacaggtagtaatgtgatgctcgcggtatgtaaaagaatgtgcttcagggcaaccgttgaagtgtccaacaaggccctgagcatccggtctatcattaatacgaccttcgtcgtgtgtatattaatcctggctgtctgcgtggtttcaacaagtgccgtggagatggagagcctacctgcagggacttgggaacgagaggaagacctcaccaacttttgtcaccaggagtgccaagtaacagaaactgagtgtctgtgcccatatgaggctcttgtcttgcgcagacccctgttcctcgattccattgtgaagggcaaaaagaacctgcttaattctacctcgctggaaaccagcttgtccatcgaggccccttggggagcgattaacgttcagtcaacatacaaaccaactgtgagtgccgcaaatatcgctctctcttggagctccgtcgaacataggggcaacaagatactggtgtcagggcggagcgagtctatcatgaaattagaggaacgcacgggaatttcctgggacctgggtgtagaggatgccagtgaaagcaagctactcacagtgtctgttatggacctgtcccagatgtattcacccgtctttgagtaccttagtggcgatagacaagtggaagagtggccgaaggctacctgcactggggactgtcctgagaggtgcggatgtaccagctcgacatgcttgcacaaagaatggccccattcccgtaattggcggtgtaacccaacctggtgctggggcgtgggtactgggtgtacatgctgtggcctggatgtcaaggacctcttcacggattacatgtttgttaaatggaaggtggagtatatcaaaaccgaagccattgtgtgcgtagagctgacttctcaggaacgacagtgtagcttaatcgaggcaggaacaagattcaatctgggccctgtcaccataacactttcagagcccaggaacattcagcaaaagttgccacccgaaatcattactctccaccctcgcatcgaggaagggtttttcgacctgatgcatgtgcagaaggttctaagtgcctccaccgtgtgcaaactgcagtcttgcacgcacggagtcccaggtgacctccaggtgtaccacataggcaatctgcttaagggggataaagttaacggacatttgatccacaagattgagccgcattttaataccagctggatgtcctgggacggctgtgatctggactattactgcaacatgggtgattggccctcatgtacatatactggggtgacccaacacaatcacgctagcttcatcaacttactcaatattgaaacagactacactaaaagttttcatttccactctaagcgggtaaccgcgcatggcgatacgcctcagctggaccttaaagcaagaccaaactatggagccggcgagatcacagtcctggtggaggtggctgatatggaattgcacaccaagaagatagagatttccgggctcaaatttgccagcctgacttgcacaggatgttacgcatgctcgtcaggcatctcttgtaaggtcaggatccatgttgacgaacccgatgagctaaccgtgcacgtaaaaagtgacgatcctgacgtggtcgccgcttccagctctctgatggcccgcaagctcgagttcggtactgacagcaccttcaaagcattttccgcgatgccaaagacatcactgtgcttctacattgtggaacgagagtattgtaagagttgcagcaaagaagatacgcagaagtgtgttaacaccaaacttgagcacccccagtctatcttgattgaacataaggggactataatcggaaaacaaaataacacatgcaccgctaagacatcctgctggctggagtcagtgaagtcctttttctacggcctgaaaaatatgctcagcggtatttttggcaacgtcttcgtggggatctttctgttccttgccccgtttattctgctaatcctcttctttatgttcggatggcggatactgttttgtttcaagtgctgtcgtagaactaggggcttgttccgctataaacacctggaggacgatgaagagaccgggtaccggagaatcattgaaaggttaaataacaagaaaggaaagaataagctcctggacggcgagcgacttgcagatcgccggatcgccgaactgttttccacgaaaacacatattggt

SEQ ID NO: 10524 - RNA, 3495 nt, synthetic construct
  misc_feature 1..3495: note = derived and/or modified CDS sequence (opt3) from CCHVF(CCHVF K229_194)__KX013463.1__Gn-NSm-Gc
  source 1..3495: mol_type = other RNA
agcgaggagcccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaagggcaaccttatcgatctggggtgcccccatattcctttgctcggaaaaatggccatctacatatgtagaatgtccaatcacccaaggacaaccatggcgtttctgttctggttttctttcggctatgtgattacgtgcatcttttgcaaggctctgttctacagcctcattatcatcggtactttagggaaaaagattaagcagtatcgggaactgaaaccccagacctgtacaatatgcgagactgcccctgttaacgcaatcgacgccgagatgcatgatcttaattgttcctacaacatttgcccatattgtgcttcacgcttgaccagtgacggactggcaagacacgtgacacagtgccccaagaggaaagaaaaggtcgaggaaaccgagctatacctcaatctggaacggatcccttggatagtgcgcaaacttctgcaagtaagcgagtctacgggcgttgccttgaagcgatcctcatggctcattgtgctgttagtcctgctcactgtgagccttagtccagtgcagtctgctccggtcggccacgggaaaacaatcgagacctaccagactagagaaggatttacaaacatctgtctgttcatgttgggttccattctatttatcgttagctgcctggtgaagggcctcgtagactcggtgtctgattccttctttcccgggctgtcagtctgtaagacctgcagtattggaagcataaatggcttcgagatcgaatcccataaatgttattgctctcttttctgctgtccttactgcaggcactgtagcgccgaccgggagattcatcagctgcacttgggtatctgcaagaaacgtaagacggggtcaaacgtgatgctcgcggtttgtaaacgcatgtgctttaaggcaaccatcgaagccagtagaagggctctgttaattcggtccataatcaatacaactttcgtgatttgtatcctgaccctagccatttgcgtcgtgagcacatctgcagtagagatggagaacctcccagctggcacttgggaacgagaggaagatctgacctcattttgtcaccaagagtgccaggttacagaaaccgagtgtctttgcccctatgaggccttggtgctgcgcaagcctctcttcctggacagtatcgtcaaaggaaagaaaaatcttctgaacagcacttccttggaaacgtctctctcgatagaggcgccatggggcgccatcaacgtgcagagcacatttaagcccaccgtctccactgcaaatattgctctgtcatggagttctgtggaacatagagggaacaaaatcttagttaccggaaggagcgagtccattatgaagctggaggaacggacaggtgtgtcatgggatctaggcgtagaggacgccagcgaatctaagctcctgaccgtctccatcatggatcttagtcaaatgtacagcccggtgttcgagtatttgtctggggaccgccaggttgaagagtggcctaaagctacttgcacaggagattgtcccgagagatgcggctgtacgtcctcaacctgcctgcacaaggaatggccacatagtaggaattggcgttgtaaccctacttggtgctggggtgtggggacaggctgtacctgctgtggagtcgacgtgaaagatctctttacagaccacatgttcataaagtggaaagtagagtacattaagactgaagccatcgtgtgcgttgagctgaccagccaggaacggcagtgttcgttaattgaggcaggcacgcgatttaatctggggcccgtcaccatcacactttccgagccaagaaacatacaacagaagttgccccctgaaatcattactctccatccaaaaatcgaggaaggattctttgacctgatgcacgtgcagaaggtgctatctgccagcaccgtctgcaaactgcagtcatgcacacacggtattccgggcgatctccaaatctatcatatagggaatctgcttaagggagacaggttgaacggccacctgattcataaaatcgagccccacttcaatactagctggatgtcctgggatggttgtgacttagattactactgcaacatgggggactggccttcttgtacctatacgggcgttacacagcacaatcatgctgcgtttgtgaacctcctgaatatcgaaaccgattacactaagacattccacttccatagcaaacgcgtgaccgcacacggagacactccacagcttgatctgaaggcccggcccacctatggcgctggggagattacagtattggtcgaggtggccgacatggaactccatacgaagaaagttgagatctccggactgaagtttgcatcactagcctgcaccggctgttacagctgcagttctggtatttcctgtaaagtgagaatacacgtcgatgaacctgacgagctgactgtgcacgttaagagctcggatccagacgtggtagctgcctcaacatctctcatggcaaggaaactggagttcgggaccgacagtacatttaaggcgttctccgctatgcccaagactagcctttgcttttatatcgtcgaacgcgagtactgtaaatcttgcagcgaagatgacaccaagaaatgtgtggatacgaagttggagcagccgcaatccattctgatcgaacataaaggaacaattatcggcaagcagaacgatacctgcactgccaaggcatcatgctggttagagagtgtgaaaagtttcttttatggtctcaagaatatgctgggctctgtcttcgggaactttttcgttggaatacttctgtttctagcccctttcgtgctcctggtattgtttttcatgttcggctggaaaatcctgttttgtttcaagtgctgtcgacggacccgtgggttatttaaatacagacacctcaaggacgacgaggaaacaggatacaggaagattatcgagcgcctgaactccaaaaagggcaaaaatcggcttctggatggtgaaagattggctgacaggaagattgccgaactcttctcaactaaaacccatatcggg

SEQ ID NO: 10525 - RNA, 3495 nt, synthetic construct
  misc_feature 1..3495: note = derived and/or modified CDS sequence (opt3) from CCHVF(CCHVF K229_243)__KX013466.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaagagatcctcatggctcatagtcctgttagtgctgctcacggtgagccttagtccggtccagtctgctcccgttggccacggcaagactattgagacataccagaccagggaagggtttacttccatctgtctgttcatgttgggaagcatcctatttctggtgtcgtgcctcgtaaaaggtctggtggattctgtctccgactcattctttcctggccttagtgtgtgtaagacatgcagcattgggtccatcaacggattcgagattgaatctcataagtgttattgcagcctgttctgctgtccatactgccggcactgttcagccgatcgtgagatacatcagttgcacctcagtatctgcaaaaagcgcaaaaccggctccaatgttatgctggcggtgtgtaagagaatgtgctttagggcaacgattgaagccagccggcgagctttactgatccgctctatcattaacaccacattcgtcatatgtatcctaactctcaccatttgcgtggtatcaacaagtgccgttgagatggagaatctgcccgcaggtacttgggaaagagaggaagaccttaccaacttttgtcaccaagagtgccaggtgacagaaaccgagtgtttgtgcccttatgaggctctggtcctcaggaaaccactgttccttgatagcatcgtgaaggggatgaagaatctgttgaactccacttctctcgaaacgtcgctgagcattgaggccccctggggcgcgatcaacgtccagtccacatttaaaccgaccgtgtcaactgccaatatagcattaagttggtctagcgttgaacatcggggaaacaagatcctggtgaccggccgctccgagtcaattatgaaactagaggaaagaacaggggtaagctgggacctcggagtcgaggatgcttctgaatccaagctgcttaccgtgagtatcatggacttgagccaaatgtactctcctgttttcgagtatctgtccggtgatcgtcaggtggaagagtggcccaaagccacttgcacaggcgactgtccagagaggtgcgggtgtacgtcaagtacctgcctccacaaggaatggcctcatagccggaattggcgatgtaaccccacttggtgctggggagtcggcacaggttgtacctgctgtggggtggatgtaaaggacctgtttacagaccacatgttcgtgaaatggaaggttgagtacattaaaactgaagctatcgtctgcgtggagttaacctcgcaggaaagacagtgttccctgatagaggccggcacgaggtttaatcttggaccagtgaccattacattgtctgagccccgcaacatccaacagaagctccctccagaaattatcactctgcatccgaaagtcgaggaaggcttctttgatctaatgcacgttcagaaggtgctgagcgcatcaaccgtgtgcaagctccagagttgcacacacgggatacccggagacctgcaagtatatcatatcggtaatcttttgaaaggcgatcgggtcaacgggcacctgattcataagatcgagcctcacttcaatacttcctggatgtcttgggacggatgtgatttagactactactgcaacatgggcgattggccaagctgtacctatacgggtgtgacacagcacaatcatgccgcttttgttaacctcctgaatattgaaaccgactacactaaaacattccacttccattccaagagagtgaccgcgcacggggatactccccagcttgacctgaaagcaaggcctacctatggcgccggagagatcacagtcttggtggaggttgctgatatggaactccatacgaagaaagtggagatatcaggcctgaagtttgccagcctagcatgcaccgggtgttacgcctgcagttctggaatttcctgtaaggtacgcatccacgtcgacgaaccagatgagctgactgtgcacgtgaaaagctcggaccccgacgtcgttgctgcctcaacatctctcatggcacgaaagctggagttcggcaccgatagtacatttaaagcgttctccgctatgccgaagactagcctttgcttttatatcgtggaaaaagagtactgtaagtcttgcagcgaagaggacacccagaagtgtgtagatacgaaattggaacaacctcagtccattctgatcgagcataagggtacaattatagggaaacagaacgatacctgcactgccaaggcatcatgctggttagagagtgtgaaatctttcttttatggactcaagaatatgctgggcagcgtcttcggtaactttttcatcggcattcttctgtttctaaccccattcgtgctcctggttttgtttttcatgttcgggtggaagatcctgttttgtttcaaatgctgtcggcgtacaagaggattactcaagtacaggcacctgaaagacgacgaagagactggctaccgccggattatcgaaagacttaacaataagaaagggaagaacaggctgttggatggagagcgactcgccgaccgcaagatagctgaactgttttccaccaaaacacatatcggc

SEQ ID NO: 10526 - RNA, 3495 nt, synthetic construct
  misc_feature 1..3495: note = derived and/or modified CDS sequence (opt3) from CCHVF(CCHVF K315_14)__KX013469.1__Gn-NSm-Gc
  source 1..3495: mol_type = other RNA
agcgaggaacccggcgacgattgcatctccagaacccagctgctcaagacagagactgccgaaattcacgacgataactacgggggacctggtgacaaaataacgatctgtaatggctctaccgtggtcgatcaaaggcttgggtcagagctgggatgctatacaattaaccgggttaagagtttcaaattgtgtaagaatagcgctactggcaaaacctgcgaaatcgactccacaccagtgaagtgtcgccagggtttttgcttaaagattacccaggaggggcgaggacatgtaaaactgtctcgtggctcggaggtggtcctagatgtgtgtgactcaagctgcgaaatcatgataccgaagggcactggggatatcctcgttgactgtagtggaggtcagcaacacttcctgaaagataaccttattgacctgggctgcccccatatccctttgctcgggaagatggcaatttacatctgtagaatgtccaatcacccaaggacaaccatggcctttctgttctggttttctttcggatatgtgataacgtgcatcttttgcaaagcgctgttctacagcctcattattatcggcactttaggtaagaagatcaaacagtatcgggagctgaagccccagacctgtacaatttgcgaaactgctcctgtcaacgccatagatgcagagatgcatgaccttaattgttcctacaacatctgcccatattgtgcctcacgcttgaccagtgaggggctggctagacacgtgacacagtgccccaaaaggaaggaaaaagtagaggaaaccgagctatacctcaatctggaacggattccttggatcgttcgcaaacttctgcaagtgagcgagtctacgggagtcgcattgaaacgatcctcatggctcatagtgctgttagtgctgctcactgtcagccttagtccagttcagtctgccccggtgggccacggcaagacaattgagacctaccagactagagaagggtttacatccatctgtctgttcatgttgggaagcatcctatttattgtatcgtgcctggtgaagggtctcgtctattctgtgtccgactcattctttcccggcctgagtgtttgtaaaacctgcagcatcgggtccattaacggattcgagatagaatctcataagtgttactgcagccttttctgctgtccttattgcaggcactgttcagctgatcgggagatccatcagctgcacttgagtatttgcaaaaagcgtaaaacgggctccaatgtgatgctcgccgtctgtaagcgcatgtgctttaaggcgaccatcgaagcaagcagaagggccctgttaatccggtctattataaacacaactttcgtgatctgtattctgaccctagctatctgcgtagtttcaacaagtgccgtggagatggaggacctcccagcaggtacttgggaacgagaggaagatctgaccaatttttgtcaccaagagtgccaggtcacagaaaccgagtgtctttgcccctacgaggctttggtgctgcgcaaacctctcttcctggacagcattgtcaaggggatgaaaaagttactgaactccacttctttggaaacgtcgctcagcatcgaggccccatggggcgcgataaatgtgcagtccacatttaaacccaccgtttcaactgccaacatcgcactgagttggtctagcgtggaacatagaggaaacaagattttagtaaccggcaggtccgagtcaatcatgaagctggaggaacggacaggggtcagctgggatctaggagtggaggacgcttctgaatccaaactcctgaccgttagtattatggatcttagccaaatgtattctccggtgttcgagtacttgtccggtgaccgccaggtcgaagagtggcctaaggccacttgcacaggcgattgtcccgagagatgcgggtgtacgtcaagtacctgcctgcacaaagaatggccacatagcaggaattggcgttgtaaccctacttggtgctggggagtgggcacaggttgtacctgctgtggggtagacgtgaaggatctctttacagaccacatgttcatcaaatggaaggttgagtatataaagactgaagctattgtctgcgtggagctgacctcgcaggaacggcagtgttccttaatcgaggccggcacgcgatttaatctgggacccgtgaccattacactttctgagccaagaaacatccaacagaaattgccccctgaaataatcactctccatccaaagattgaggaaggcttctttgacctgatgcacgtccagaaagttctaagcgcatcaaccgtgtgcaagctgcagagttgcacacacgggatcccgggagatctccaaatttaccatatcggtaatctgcttaaaggcgacagggtgaacgggcacttgatacataagattgagccccacttcaatacttcctggatgtcttgggatggatgtgacctggattactattgcaacatgggcgactggcctagctgtacctacacgggtgtaacacagcacaatcatgccgcttttgtcaacttactcaatatcgaaaccgattatactaaaacattccacttccattccaagcgcgtgaccgcgcacggggacactccacagctggatcttaaggcacggcccacctacggcgccggagagatcacagttctggtggaggtcgctgacatggaattgcatacgaaaaaggtggagatttcaggcctcaaatttgccagcctgacctgcactgggtgttatgcatgcagttctggaatctcctgtaaggttaggattcacgtggatgaacctgacgagctaacagtacacgtcaaaagctcggatccagacgtggtggccgcttcaacctctctgatggccagaaagctcgagttcggcacagacagtacttttaaggcattctccgcgatgcccaaaaccagcctgtgcttttacatagtcgaacgcgagtattgtaagtcttgcagcgaagatgacacgaaaaagtgtgttgatacaaaacttgagcagccgcaatccatcttgattgaacataagggtaccatcattgggaagcagaacgacacttgcaccgctaaagcctcatgctggctggagagtgtaaagagcttcttttacggacttaaaaatatgctcggctctgtgttcggttcctttttcgtgggcatcctgctttttctggcacctttcgtcctactcgtgctgtttttcatgttcgggtggaagatattgttttgtttcaaatgctgtcgacggacacgtggactgtttaagtacagacacttaaaggatgacgaggaaactggctataggcgcatcattgagcggctcaactcaaagaaggggaaaaatagactgcttgatggagaaaggctggccgaccgaaagatcgctgagttgttcagtaccaaaacacatattggc

SEQ ID NO: 10527 - RNA, 3495 nt, synthetic construct
  misc_feature 1..3495: note = derived and/or modified CDS sequence (opt3) from CCHVF(CCHVF K323_27)__KX013472.1__Gn-NSm-Gc
  source 1..3495: mol_type = other RNA
agcgaggagcccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacctcttaattatcatcggcactctgggtaaaaagattaagcagtatcgggaacttaaaccccagacctgtacaatatgcgagactgcccctgttaacgcaatcgatgccgagatgcatgacttgaattgtagctacaacatttgcccatattgtgcttcccgcctgacctcagacgggctagcaagacacgtgacacagtgccccaagaggaaagaaaaggtcgaggaaaccgagctctacctgaatcttgaacggatcccttggatagtgcgcaaactgttgcaagtaagtgagagcacgggagttgccctcaagcgatcttcctggctgactgtgttactggtcctccttacagtgtcactgagcccagtgcagagtgctccggtcggccacggcaacaccattgagacttaccagacaagagaagggtttacctctatctgtttgttcatgctaggatccatcctgtttattgttagctgcctcgtgaaaggtctggtagattcggtgtctgactccttctttcccggcctttcagtctgtaagacgtgcagtatcgggagcattaatggattcgagatagaatcccataagtgttattgctctctgttctgctgtcctcactgcaggcatcggagcgccgatcgtgagatccaccagttgcacctctcaatttgtaaaaagcgcaaaaccggcagtaacgtgatgctggcggtttgcaagagaatgtgtccaaaagcaacaatcgaagcctccaggcgggctttacccatccgaagcattataaatactaccctggtgatgtgcatcctaacactcgccatttgtgtcgtgtctacttcagcagtagagatggaggacctgcctgctggtacctgggaacgcgaggaagatcttacaaacttttgccatcaagagtgtcaggttaccgaaactgagtgcttgtgtccatacgaggccctggtgctcagaaagcccctgttccttgacagtatcgcgaaggggatgaaaaatctgttgaacagcacgtccctcgaaacatctctgtcgattgaggccccgtggggcgcaatcaacgtccagagcacctttaagcctactgtgtccaccgctaatatagccttatcatggagttctgtcgaacacaggggaaacaaaatcctggtgacaggccggagcgagtccattatgaagctagaggaacgcaccggggtttcatgggatctcggagtggaggacgctagcgaatctaaactgcttactgtatccatcatggatttgagtcaaatgtatagccccgtcttcgagtacctgtctggtgacagacaggtggaagagtggccaaaggccacatgcacgggcgattgccctgagaggtgtgggtgcacctcctcaacttgtctccataaggaatggccccacagtcgtaattggcggtgcaacccaacatggtgttggggagttggcaccggttgcacatgttgcggggtggacgtcaaagacctgtttactgatcatatgttcattaagtggaaagtggagtatatcaagaccgaagcaatagtatgtgtggagttaacgggccaggaacgacagtgcagcctgattgaggccggaaccagatttaatcttggccccgttacaatcactttgtcggagcctaggaacattcaacagaaactcccaccggaaatcataaccctgcaccccaagatcgaggaagggttctttgacctaatgcacgtccagaaggtgctgtccgcttctacagtgtgtaaactccagagctgcactcatggtattcctggagatctgcaaatctaccacattggcaatcttttgaagggggaccgcgtcaacggacatctgatccacaaaatagagccacacttcaatacctcatggatgagttgggatggctgcgacttagattattactgtaacatgggtgactggccctcctgcacgtacacaggggttacccagcataatcacgcggcatttgtgaacctcctgaatattgaaactgattatacaaagaccttccattttcactctaaacgggtgactgcccatggcgacacccctcagcttgatctgaaggctagaccaacatacggagccggcgagatcacggtattggtcgaggtggcagacatggaactccacaccaaaaaggttgagatcagcgggctgaagttcgcctccctaacttgtacaggatgctatgcttgttcaagcggcattagttgcaaagtgaggatccacgtcgatgaacccgacgagctgaccgtgcatgttaagtcttccgacccggatgtggtagccgcaagcacatcgctcatggcgcgcaaactggagttcggtactgactcaacctttaaggctttctctgccatgcctaaaacgagtctttgtttttacattgtcgaacgagagtattgcaagtcctgtagcgaagatgacacaaagaaatgcgtggataccaagttggagcagccacaatctatactgatcgaacacaaagggactattatcggaaagcagaacgacacctgtacagcaaaagccagctgctggttagagtccgtgaagtcattcttttacggcctcaagaatatgctgggtagtgtcttcggcagctttttcgttgggattcttctgtttctagctcccttcgtgctcctggtattgtttttcatgtttggatggaaaatcctgttctgcttcaagtgttgccggcgtactagaggcttatttaaatataggcatctcaacgatgacgaggaaaccgggtaccgccggataatcgagagactgaactctaagaaaggaaagaataggcttctggatggcgaacgattggccgaccgcaagattgcagaactcttctccacaaaaacgcacatcggt

SEQ ID NO: 10528 - RNA, 3495 nt, synthetic construct
  misc_feature 1..3495: note = derived and/or modified CDS sequence (opt3) from CCHVF(CCHVF K340_6)__KX013475.1__Gn-NSm-Gc
  source 1..3495: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtgaagagtttcaaattgtgtgaaaatagcactaccggcaagacatgcgagattgactccaccccagttaaatgtcgccagggtttttgcttaaagatcactcaggaggggcgaggacatgtgaagctgtctcgtggctcggaagtagtgctagatgcttgtgactcaagctgcgagataatgatcccgaaaggcacaggggatattctcgtcgactgtagtggaggtcagcaacacttcctgaaggataaccttatcgacctgggctgcccccatattcctccattggggaaaatggcaatctacatatgtagaatgtccaatcaccccaggaccacgatggcctttctcttctggttttctttcggatatgtgattacttgcatcttttgcaaggcgctgttctacagcctgattatcatcggcaccctcggtaaaaagattaagcagtatcgggaattaaaacctcagacatgtactatatgcgagaccgctccagttaacgccatcgatgcagagatgcatgacctgaattgttcctacaacatttgcccctattgtgcctcacgccttacaagtgacgggttggctagacacgtgacccagtgccctaagaggaaagaaaaggtcgaggaaacggagctgtacctaaatctcgaacggatcccatggatagtgcgcaaactgcttcaagtaagcgagtctactggagttgcactgaagcgatcctcatggttgattgtgctcctggtcttactgacagtgagcctcagtccggtgcagtctgcccccgtcggccacggcaaaaccatcgagacttaccagacaagagaagggtttacctccatctgtcttttcatgctgggaagcattttgtttatcgtttcgtgcctagtgaagggtctggtagattctgtgtccgactcattctttcctggcctcagtgtctgtaagacgtgcagcattgggtccataaacggattcgagatcgaatctcataaatgttattgcagcctgttctgctgtccatactgcaggcactgttcagctgatcgggagattcatcagcttcacctgagtatctgcaagaaacgtaagaccggctccaatgtgatgttggccgtttgtaaacgcatgtgctttaaggcgacaatcgaagcaagcagaagggccctcctgattcggtctataatcaacactaccttcgtgatgtgtattttaacactggctatctgcgtcgtgtcaacaagtgccgtagagatggaggacctacccgcaggtacctgggaacgagaggaagatctcacaaatttttgtcaccaagagtgccaggttaccgaaactgagtgtctgtgcccttatgaggctcttgtgttgcgcaagccactgagcctcgactccattgtcaaagggatgaagaacctgcttaattctacgtcgctggaaactagcttgtccatcgaggccccctggggcgcgataaacgtgcagtcaaccttcaaaccgactgtcagtaccgccaacatcgcactctcttggagctccgtggaacatagaggaaataagattctggttacaggcaggtcagagagcatcatgaaattagaggaacggaccggggtgtcttgggatctgggagtagaggacgcttccgaaagtaagctactcactgtcagcattatggatctgtctcaaatgtactcccctgtgtttgagtatctttcaggtgaccgccaggttgaagagtggcccaaggccacatgcacgggcgattgtccagagagatgcgggtgtaccagtagcacttgcttgcacaaagaatggcctcattcgaggaactggcgttgtaatcccacatggtgctggggagtgggcaccggttgtacatgctgtggggtcgacgtgaaggacctgttcactgatcacatgtttatcaaatggaaggtagagtacataaaaaccgaagctattgtgtgcgttgagctcacgtcccaggaacggcagtgttctctgatcgaggccggcacccgattcaacttaggaccagtcacaattactctgagcgagcccagaaatatccaacagaaacttcctccagaaataatcaccttgcatccgaagattgaggaaggctttttcgacctcatgcacgtgcagaaggtgctgtcagcaagtacagtctgcaagctacagtcctgcactcacgggatccccggagatctgcaaatttatcatatcggtaacctcctgaaaggcgacagggttaatgggcaccttatacataagattgagcctcactttaacacctcttggatgagctgggatggatgtgacttggattactactgcaatatgggcgactggccatcctgtacgtatacaggtgtgacccagcacaaccatgccgctttcgtgaatctgttaaacatcgaaactgattacacaaaaacctttcacttccattcaaagcgcgtaactgcgcacggggacactccccagctcgatctgaaagcacggcctacatatggcgccggagagatcacggtccttgtggaggttaccgacatggaactgcatactaagaaggtggagattagcggcttgaaattcgctagtctcacatgcaccgggtgttacgcctgttcttccggaatcagctgcaaggtcaggattcacgtggatgaaccagacgagctgacagttcacgtgaaatcgtcagaccccgatgtagtcgcagcctctaccagtctaatggctagaaagctggagtttggcaccgactccacgttcaaagcctttagcgcaatgccgaagacatctctctgcttctatatagtggaacgcgagtactgtaagagctgctccgaagatgacaccaaaaagtgtgtggatactaaactggagcagcctcaatcaatccttattgaacataagggtaccatcattgggaaacagaatgacacatgcactgcgaaggctagttgctggttggagagcgtcaagtcctttttctatggactgaaaaacatgttaggctctgtttttggttcattctttgtgggcatcctcctgttccttgccccatttgtactgctagtcctcttctttatgttcgggtggaagatactgttctgttttaaatgctgtcgacggacccgtggattgttcaagtacagacactttaaagatgacgaggaaacaggctacaggcgcatcattgagcggctgaatagtaagaaggggaaaaacagattactcgatggagaaaggctggcagaccgaaagatcgccgagcttttcagcacgaaaacccatattggc

SEQ ID NO: 10529 - RNA, 3495 nt, synthetic construct
  misc_feature 1..3495: note = derived and/or modified CDS sequence (opt3) from CCHVF(CCHVF Mamon)__KX013478.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgtcagatgcatgtgacagcagttgcgaggtcatgataccgaagggcactggggatatcctagtggactgttccggaggtcagcaacacttcctcaaagataacctgattgaccttggctgcccccatatccctctgttggggaagatggccatttacatctgtaggatgtctaatcacccacggacaaccgttgcgtttctcttctggtttagcttcggatatgtgataacgtgcatcttttgcaaagctctgttctactccctgattattatcggcactctcggtaagaaaatcaagcagtatcgcgaattaaagccccagacctgtacaatttgcgagactgcccctgtcaacgcaatagatgccgagatgcatgacctgaattgttcatacaacatctgcccatattgtgctagtagacttaccagcgacgggttggcaaggcacgtgccccagtgccctaaacggaaggaaaaagtagaggaaacagagctgtacctaaatctcgaacgcattccatggatcgttcgaaagctgcttcaagtgtctgagtccaccggagtcgccctgaaaagatcaagctggttgatagtgctcctggtgttactgacggtcagtctctctccggttcagtccgctcccgtgggccacggcaagactattgagacataccagaccagggaagggtttactagcatctgtcttttcatgctgggatcgatcttgtttctagtatcttgcctggtgaaaggtctcgtcgattccgtgtcagacagtttctttcctggcctgagcgtttgtaagacatgctccattgggtctatcaacggattcgagattgaaagccataagtgttattgctcacttttctgctgtccatactgccggcactgtagtgccgatcgtgagatacatcagctgcacttgtccatctgcaaaaagcgcaaaaccggcagcaatgtgatgctcgcggtctgtaagagaatgtgctttagggcaacgattgaagcctctcggcgagctctgttaatccgctcaatcattaacaccacattcgtgatatgtatcctgactctaaccatttgcgtagttagtacaagcgccgtggagatggagaatctcccctccggtacttgggaaagagaggaagacctgaccaacttttgtcaccaagagtgccaggtcacagaaaccgagtgtctttgcccttatgaggcattggtgctgaggaaaccactcttcctggattctatcgtcaaggggatgaagaatcttctgaactcgactagcttggaaacgtccctctcaattgaggctccctggggcgccatcaacgtgcagagtacatttaaaccgaccgtttctactgcgaatatagccctgagctggtcctcagtggaacatcggggaaacaagatcttagtaaccggccgcagcgagtctattatgaaactggaggaaagaacaggggtctcctgggacctaggagtggaggatgcaagtgaaagcaagctcctgaccgtttctatcatggacctttcccaaatgtactcacctgtgttcgagtatttgagtggtgataggcaggtcgaagagtggcccaaagctacttgcacaggcgactgtccagagcgttgcgggtgtacgagctcgacctgcctgcacaaggaatggcctcattcccggaattggcgatgtaaccccacttggtgctggggagtgggcacaggttgtacctgctgtggggtagatgtgaaggacctctttacagaccacatgttcgttaaatggaaggtcgagtacattaaaactgaagccatcgtgtgcgtggagctgacctctcaggaaagacagtgtagcttaatagaggctggcacgaggtttaatctgggaccagtcaccattacactttcagagccccgcaacatccaacagaagttgcctccagaaattatcactctccatccgaaagttgaggaaggcttctttgatctgatgcacgtgcagaaggtgctaagtgcctccaccgtatgcaagctgcagtcttgcacacacgggatacccggagacctccaagtctatcatatcggtaatctgcttaaaggcgatcgggtgaacgggcacttgattcataagatcgagcctcacttcaatactagctggatgtcctgggacggatgtgatctggactactactgcaacatgggcgattggccatcatgtacctatacgggtgttacacagcacaatcatgcagcctttgtgaacttactcaatattgaaaccgactacactaaaacattccacttccatagcaagagagtcaccgctcacggggatactccccagctggaccttaaagcgaggcctacctatggcgcaggagagatcacagtgctggttgaggtggccgatatggaattgcatacgaagaaagtagagataagtggcctcaagtttgcttctctggcctgcaccgggtgttacgcatgctccagcggaatttcgtgtaaggtccgcatccacgtggacgaaccagatgagctaactgtgcacgtcaaatcatctgaccccgacgttgtggccgctagtacatccctgatggcccgaaagctcgagttcggcaccgatagcacatttaaagcattctctgcgatgccgaagactagcctgtgcttttatatcgtagaacgggagtactgtaaatcctgctcagaagaggacacccagaagtgtgtggatacgaaacttgaacaacctcagagtattttgatcgagcataaaggtacaattatagggaagcagaacgatacctgcactgctaaaaccagctgctggctggagtctgtcaagtccttcttttatggattaaagaatatgctcggctcagtgttcggtaactttttcatcggcattctgctttttctggccccattcgttctactcgtgctgtttttcatgttcgggtggaagatcttgttttgtttcaagtgctgtcgtagaacaaggggactgttaaaataccgccacctcaaggacgacgaagagactggctaccggagaattatcgaaaggctgaacaataaaaaggggaaaaaccgacttctggatggagagcgcttggcagaccggaagatagccgaactctttagtaccaagacacatatcggc

SEQ ID NO: 10530 - RNA, 3495 nt, synthetic construct
  misc_feature 1..3495: note = derived and/or modified CDS sequence (opt3) from CCHVF(CCHVF Min)__KX013481.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaagagatcctcatggctcatagtcctgttagtgctgctcacggtgagccttagtccggtccagtctgctcccgttggccacggcaagactattgagacataccagaccagggaagggtttacttccatctgtctgttcatgttgggaagcatcctatttctggtgtcgtgcctcgtaaaaggtctggtggattctgtctccgactcattctttcctggccttagtgtgtgtaagacatgcaccattgggagcatcaacggattcgagattgaatcccataagtgttattgctctctgttctgctgtccatactgccggcactgtagcgccgatcgtgagatacatcagttgcacctctcaatctgcaaaaagcgcaaaacgggcagtaatgttatgctggcggtgtgtaagagaatgtgctttagggcaaccattgaagcctcccggcgagctttactgatccgcagcatcattaacacaactttcgtcatatgtatcctaaccctcacaatttgcgtggtatctacttcagccgttgagatggagaatctgcccagtggtacctgggaaagagaggaagaccttacaaacttttgtcaccaagagtgccaggtgaccgaaactgagtgtttgtgcccttatgaggcactggtcctcaggaaaccactgttccttgatagcatcgtgaaggggacgaagaatctgttgaactccacatctctcgaaacctcgctgagcattgaggctccctggggcgccatcaacgtccagtccacttttaaaccgaccgtgtcaacagcgaatatagccttaagttggtctagcgttgaacatcggggaaacaagatcctggtgaccggccgctccgagtcaattatgaaactagaggaaagaactggggtaagctgggacctcggagtcgaggatgcatctgaatccaagctgcttacagtgagtatcatggacttgagccaaatgtactctcctgttttcgagtatctgtccggtgatcgtcaggtggaagagtggcccaaagctacgtgcaccggcgactgtccagagaggtgcgggtgtacttcaagtacatgcctccacaaggaatggcctcatagccggaattggcgatgtaaccccacctggtgctggggagtcggcacaggttgtacttgctgtggggtggatgtaaaggacctgtttaccgaccacatgttcgtgaaatggaaggttgagtacattaaaacggaagccatcgtctgcgtggagttaacctcgcaggaaagacagtgttccctgatagaggctggcacaaggtttaatcttggaccagtgactattaccttgtctgagccccgcaacatccaacagaagctccctccagaaattatcacactgcatccgaaagtcgaggaaggcttctttgatctaatgcacgttcagaaggtgctgagcgcctcaactgtgtgcaagctccagagttgcacccacgggatacccggagacctgcaagtatatcatatcggtaatcttttgaaaggcgatcggattaacgggcacctgatccataagattgagcctcacttcaatacgtcctggatgtcttgggacggatgtgatttagactactactgcaacatgggcgattggccaagctgtacatataccggtgtcactcagcacaatcatgcagcctttgtgaacctcctgaatatcgaaacagactacaccaaaactttccacttccattccaagagagttaccgctcacggggatacaccccagcttgacctgaaagcgaggcctacgtatggcgcaggagagataaccgtgttggtcgaggtggccgatatggaactccatactaagaaagttgagatttcaggcctgaagtttgctagcctagcctgcacagggtgttacgcatgcagttctggaatctcctgtaaggtgcgcatccacgtagacgaaccagatgagctgaccgtccacgtgaaaagctcggaccccgacgtggtcgccgcttcaacatctctcatggcccgaaagctggagttcggcactgatagtacctttaaagcattctccgcgatgccgaagacgagcctttgcttttatattgttgaacgggagtactgtaaatcttgcagcgaagaggacacacagaagtgtgtggataccaagttggaacaacctcagtccatcctgattgagcataaaggtactataatcgggaagcagaacgatacctgcacagctaaagcctcatgctggttagagagtgtaaagagcttcttttatggactcaaaaatatgctgggctctgtgttcggtaactttttcattggcatccttctgtttctagcaccattcgtcctcctggtgttgtttttcatgttcgggtggaagattctgttttgtttcaagtgctgtcgtagaactaggggattactcaaataccgccacctgaaggacgacgaagagaccggctaccggagaatcatagaaaggcttaacaataaaaaggggaaaaaccgactgttggatggagagcgcctcgccgaccggaagatcgctgaactgttttccacaaagacgcatattggc

SEQ ID NO: 10531 - RNA, 3495 nt, synthetic construct
  misc_feature 1..3495: note = derived and/or modified CDS sequence (opt3) from CCHVF(CCHVF Nakiwogo)__KX013484.1__Gn-NSm-Gc
  source 1..3495: mol_type = other RNA
gccgagggcgtgagcaacgactgcgtctccagaacccagctgatcaagacagaagttgctgagattcacgaagattcttacgggggacccggtgagaaaataactatctgtaatggctcaacgattgtggaccaaaggctcgggagtgaacttggatgctataccatcaaccgggtaaagacatacaaactgtgtgagaatagcgcaactgagaagggctgcgaaattgattccgtgcctgtcaaatgtaagcagggtttctgcttgaaggtgacccaggaggggcgcggacatgttaaattatctcgaggcacagaaatcgtgctggacgtctgtgatacctcgtgcgagctaatgataccaaagggcactggggacatcctcgtggattgttcaggaggtcagcaacactttctgcaggacaaccttattgatctgggctgcccgaatgtacccttgctcgggaaaatggccatctatatttgtcgtatgagcaaccatcctaagacaaccatggcgttcctgttttggttcagttttggatacgttatcacgtgcgtggtctgcaaagtgctgttctatctcttaatagtgattggcactctgggtaagaaacttaaacagtacagagagttgaagccacagacctgtatcgtctgcgaatccattcccgttaatgtgatcgacgctgagatgcacgaactgaactgtaattataacatctgcccttactgtgcctctaggctaacaagcgatgggctcgtacggcatgtgactcaatgcccaaaacgcaaggagaaagtcgaagagaccgagctgtaccttaatctggaaaggattccctggttggtgagacggctcctgcaggtttccgagtcaacaggaatggcattaaagcgcagttgttggatgaccacgctgctcatacttctggtggtcagcttgtctcctgtgcagtccgccccagtaggccaggaaaaagctatcgaggtttatcaagtgcgagaatcatacactagcatgtgcctatttgtcctgggcagtgtcctcttcgcagtgtcttggctggtgaaggggcttattgacggaatcggtaactcctttttcccgggcctgagcgtttgtaagacatgctcgatagggtctattaatggatttgagatcgagtcccacaaatgttattgctcattgttctgctgtccctactgcagagcctgtagtagcgataagatcacccacaggatgcatctcaacatttgcaaacggcgtaaggtgggctccaatgtaatgctggctgtctgtaaacgcatgtgctttaaggccactgtggaagcgtctaacagcgcattactgatcagatcaattataaacagtacattcgttatctgtgtgctaattctcgtcatctgcgtggtatccaccagcgccgtggacatggagaatctgcctgctggtatctgggaaagggaggaagaccttacgaacttctgtcaccaggagtgccaggttaccgagacagaatgtttgtgcccatatgaggccctgattctccggaagcccctgtaccttgattctatagcaaaagggatgaagtcactgttgaatagtactaacctcgaaaccagcctgtccatcgaggctccttggggcgccattaatgtccaatctacatttaaaccaactgtgtcggcggccaacatcgcattaagctggtcctcagtggagcatcgaggaaataagattctggtcagtggccgctctgaaagcatcatgaaactagaggaaagaaccgggatatcctggtcactcggagttgaggacgctagcgaatctaagacactgaccgtgtccgtgatggatcttagtcagatgtatagccccgtattcgagtacttgtctggtgacaggcaggtcgaggaatggccgaaggccacttgcacgggcgattgtcctgagcggtgcgggtgtacatcctcaacctgcctgcacaaagaatggccccacagtcgcaactggagatgtaatccaacttggtgctggggagtgggcaccggttgtacatgctgtgggctcgacgttagggatctgtttaccgactacatgatggtgaagtggaaagtcgagtatgtgaagactgaagctatcatgtgcgttgagttaacaagccaggagcgtcaatgttcgctgattgaagccggcacgcggttcaaccttggacctgtgaccatcactttgtccgagccccgaaatgtacagcagagactcccatctgaaattgtcacactgcatcccaaaatcgaggaaggctttttcgatctaatgcacgtgcagaaggtgctgttttgcaagcatagcctccaagcaacctcatgcacacacggggtccctggagacctgcaggtttaccatgtgggtaaccttttgaaaggcgataaggtaaatgggcacagtatacacaaaattgagtcccatttcaacacttcttggatgagctgggacggatgtgacctggattatttttgcaatatgggcgactggccatcctgtacctacacgggtgtgacccagcacaacagggccgctttcgtcaacatgttaaatatcgagacagattatactaagacctttcatttccactcaaaacgcgtgacagcgcacggggacactccgcagctcgatctgaaggcacggcccacctacggcgccggagaagttacggtgcttgtcgaggtggctgacctggaattgcatacaaagaagattgaggttagcggcctcaagtttgccagtctgacctgctctgggtgttatgcatgctccagcggaatctcgtgtaaagtgagaatacacgtcaacgagcctgatgagttcactgtacatgtgaagtcaaatgacccagatgttgtggccgctggctctagtctaatggccaggaaaatcgaactgggtgcagactccacattcaaggcgtttagctctatgcccaaaaacagcctctgcttctacattgtcgaacgcgattactgttcctcatgcaccgacgatgacactcaaaagtgtgtgaataccaagctggagcaccctcagagtatccttattgaacataaagggacaatcataggaaagcagaacgacacgtgcccaaccaaaactagctgctggttggagtctgtaaagtcctttttctatggcctgaaaaatatgttaggtggcatttttgggaacgtgttcctcggaatctttctgttccttgctccctttgccctgctaatcctcttctttttctttggctggcgactgttgttctgtctgaagtgctgtcggcgtacaagagggttactcaagtacaaacagctgaaggatgaggaagaggcaggatataaaaagattatcgaaaggcttaatgacaaaaagggcaagtcacgcctgttcgatggtgagcggttggccgacagaaaaattgctgaactctttagtaccaagacacacataggg

SEQ ID NO: 10532 - RNA, 3495 nt, synthetic construct
  misc_feature 1..3495: note = derived and/or modified CDS sequence (opt3) from CCHVF(CCHVF Saf)__KX013487.1__Gn-NSm-Gc
  source 1..3495: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacactacctgaaagataaccttattgacctgggctgcccccatatccctttgctcgggaagatggccatttatatctgtaggatgtccaatcacccacggacaaccatggcgttcctgttttggttctcttttggatacgttataacgtgcattttctgcaaagctctgttttatagcctcatcattatcggcactttaggtaagaaaatcaagcagtaccgcgaactgaagccccagacctgtacaatttgcgagactgcccctgtgaacgcaatagatgccgagatgcatgaccttaattgttcctataacatctgcccatactgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaaaagatcctcatggctcatagtcctgttagtgctgctcacggtgagccttagtccggtccagtctgctcccgttggccacggcaagactattgagacatatcagaccagggaagggttcacttccatctgtctgtttatgttgggaagcatcctattcctggtgtcgtgcctcgtaaaaggtctggtggattctgtctccgactcatttttccctggccttagtgtgtgtaagacatgcagcattgggtccatcaacggatttgagattgaatctcataagtgttactgcagcctgttctgctgtccatattgccggcactgttcagccgatcgtgagatacatcagttgcacctcagtatctgcaaaaagcgcaaaaccggctccaatgttatgctggcggtgtgtaagagaatgtgcttcagggcaacgattgaagccagccggcgagctttactgatccgctctatcattaacaccacatttgtcatatgtatcctaactctcaccatttgcgtggtatcaacaagtgccgttgagatggagaatctgcccagcggtacttgggaaagagaggaagaccttaccaacttctgtcaccaagagtgccaggtgacagaaaccgagtgtttgtgcccttacgaggcactggtcctcaggaaaccactgttttccgattctatcgtgaaggggatgaagaatcttctgaactcgactagcttggaaacgtccctctcaattgaggctccctggggcgccatcaacgtccagagtacattcaaaccgaccgtgtctactgcgaatatagccctgagctggtcctcagttgaacatcggggaaacaagatcttagtgaccggccgcagcgagtctattatgaaactggaggaaagaacaggggtatcctgggacctaggagtcgaggatgcaagtgaaagcaagctcctgaccgtgtctatcatggacctttcccaaatgtattcacctgtttttgagtacttgagtggtgatcgtcaggtggaagagtggcccaaagctacttgcacaggcgactgtccagagaggtgcgggtgtacgagctcgacctgcctgcacaaggaatggcctcattcccggaattggcgatgtaaccccacttggtgctggggagtcggcacaggttgtacctgctgtggggtggatgtaaaggacctcttcacagaccacatgtttgtgaaatggaaggttgagtatattaaaactgaagccatcgtctgcgtggagctgacctctcaggaaagacagtgtagcttaatagaggctggcacgaggttcaatctgggaccagtgaccattacactttcagagccccgcaacatccaacagaagttgcctccagaaattatcactctccatccgaaagtcgaggaaggctttttcgatctgatgcacgttcagaaggtgctaagtgcctccaccgtgtgcaagctgcagtcttgcacacacgggatacccggagacctccaagtataccatatcggtaatctgcttaaaggcgatcgggtcaacgggcacttgattcataagatcgagcctcactttaatactagctggatgtcctgggacggatgtgatctggactactattgcaacatgggcgattggccatcatgtacctacacgggtgtgacacagcacaatcatgcagccttcgttaacttactcaatattgaaaccgactatatgaaaacttttcacttccatagcaagagagtgacagctcacggggatactccccagctggaccttaaagcgaggcctacctacggcgcaggagagatcaccgtcctggtggaggttgccgatatggaattgcatacaaagaaagtggagataagtggcctcaagttcgtatctctggcttgcacggggtgttatgcctgctccagcggaatttcgtgtaaggtccgcatccacgtggacgaaccagatgagctaaccgtgcacgtcaaatcatctgaccccgacgttgtggcagccagtacttccctgatggctcgaaagctcgagtttggcacagatagcaccttcaaagccttttctgcaatgccgaagacaagcctgtgcttctacatcgtagaacgggagtattgtaaatcctgctcagaagaggacactcagaagtgtgtggataccaaacttgaacaacctcagagtattttgatcgagcataagggtacgattatagggaagcagaacgacacatgcaccgcgaaagctagctgctggctggagtctgtcaagtcctttttctacggattaaagaatatgctcggctcagtgtttggtaacttctttatcggcattctgcttttcctggccccatttgttctactcgtgctgttctttatgttcgggtggaagatcttgttctgttttaagtgctgtcgtagaactaggggactgttaaaataccgccacctcaaggatgacgaagagaccggctatcggagaattatcgaaaggctgaacaataaaaaggggaaaaaccgacttctggatggagagcgcttggcagaccggaagatagccgaactcttcagtacaaagactcatatcggc

SEQ ID NO: 10533 - RNA, 3495 nt, synthetic construct
  misc_feature 1..3495: note = derived and/or modified CDS sequence (opt3) from CCHVF(CCHVF Ast199)__KX056051.1__Gn-NSm-Gc
  source 1..3495: mol_type = other RNA
agcgaggagcccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacagcctcattatcatcggcactttaggtaaaaagattaagcagtatcgggaactgaaaccccagacctgtacaatatgcgagactgcccctgttaacgcaatcgatgccgagatgcatgaccttaattgttcctacaacatttgcccatattgtgcttcacgcttgaccagtgacgggctggcaagacacgtgacacagtgccccaagaggaaagaaaaggtcgaggaaaccgagctatacctcaatctggaacggatcccttggatagtgcgcaaacttctgcaagtaagcgagtctacgggagttgccttgaagcgatgttcctggctcattgtgctgttagtcctgctcactgtgtcacttagcccagtgcagagtgctccggtcggccacggcaaaacaatcgagacctaccagactagagaagggtttacaaacatctgcctgttcatgttgggatctattctatttatcgtttcctgtctggtgaagggtctcgtagatagcgtgtcggactctttctttcccggcctgtccgtctgcaagacctgttcaattgggagtataaatggattcgagatcgaaagccataaatgctattgctcccttttctgttgcccttactgtaggcactgctctgccgatcgggagattcatcagctgcacttgggcatctgtaagaaacgtaagacgggtagcaacgtgatgctcgcggtttgcaaacgcatgtgttttaaggcaaccatcgaagcctcaagaagggctctgttaattcggagtataatcaatacaactttcgtgatttgcatcctgaccctagccatttgtgtcgtgtccacaagcgcagtagagatggagaacctcccagctgggacttgggaacgagaggaagacctgaccaatttttgccaccaagagtgtcaggttacagaaaccgagtgcctttgcccctatgaggccttggtgctgcgcaagcctctcttcctggattctatcgtcaaaggcatgaagaaccttctgaactcaacgagtttggaaactagcctctccatagaggcgccatggggagccatcaatgtgcagtctacatttaaacccaccgtctcgactgcaaacattgctctgagctggtcctcagtggaacatagaggcaataagatcttagttaccgggaggagtgagtctattatgaaactggaggaacggacaggagtgagctgggacctaggtgtagaggatgcctccgaatcaaagctcctgaccgtcagcatcatggacctttctcaaatgtactccccggtgttcgagtatttgagtggcgatcgccaggttgaagagtggcctaaggctacttgtacaggggactgccccgagagatgtggatgcacgagctctacctgtctgcacaaagaatggccacattccaggaactggcgttgcaatcctacttggtgttggggcgtgggtacagggtgcacctgttgcggcgtcgatgtgaaggacctctttacagaccacatgttcataaaatggaaggtagagtacattaaaactgaagccatcgtgtgtgttgagctgacctcacaggaacggcagtgcagtttaattgaggcaggaacgcgatttaacctgggccccgtcaccatcacacttagcgagccaagaaatatacaacagaagttgccccctgaaatcattactctccatccaaagatcgaggaagggttctttgatctgatgcacgtgcagaaagtgctatcggcctccaccgtctgcaagctgcagtcttgtacacacggtattccgggagacctccaaatctatcatataggcaacctgcttaaaggggataggttgaatggacacctgattcataagatcgagccccacttcaacactagctggatgtcatgggacggctgcgatttagactactactgtaatatgggtgattggcctagttgcacctatacgggggttacacagcacaaccatgctgcgtttgtgaatctcctgaacatcgaaaccgactacactaaaacattccacttccattccaagcgcgtgaccgcacacggcgatactccacagcttgacctgaaagcccggcccacctatggagctggcgagattacagtattggtcgaggtggccgatatggaactccatacgaagaaggttgaggtgtctgggctgaaatttgcaagcctagcctgtaccggatgctacgcttgttcctcaggcatcagctgcaaggtcaggattcacgtggacgaacctgatgagctgactgttcacgtgaaaagttctgacccagacgtagtcgccgcatccacaagcctcatggcgagaaagctggagttcggtaccgattcgacatttaaggctttctcagccatgcccaaaacttctctttgtttttatatagtggaacgcgagtactgcaagagttgttccgaagacgataccaaaaagtgcgtggacacgaaattggagcagccgcaaagcatcctgattgaacataaggggacaatcattggaaaacagaatgatacctgcactgcaaaggcctcttgttggttagagagcgtcaagtccttcttttatggcctcaaaaacatgctgggttcagttttcggcaactttttcgtggggatccttctgtttctagctcctttcgtactcctggtgttgtttttcatattcggatggaagatcctgttttgcttcaaatgttgccgacggacccgtggcttatttaagtacagacacctcaaagacgatgaggaaacagggtacaggaagattatcgagcgcctgaatagtaagaaaggaaagaaccggcttctggacggcgaaagattggccgataggaaaattgcagaactcttcagcactaagacccatatcggt

SEQ ID NO: 10534 - RNA, 3495 nt, synthetic construct
  misc_feature 1..3495: note = derived and/or modified CDS sequence (opt3) from CCHVF(CCHVF Ast149)__KX056054.1__Gn-NSm-Gc
  source 1..3495: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacagcctcattatcatcggcactttaggtaaaaagattaagcagtatcgggaactgaaaccccagacctgtacaatatgcgagactgcccctgttaacgcaatcgatgccgagatgcatgaccttaattgttcctacaacatttgcccatattgtgcttcacgcttgaccagtgacgggctggcaagacacgtgacacagtgccccaagaggaaagaaaaggtcgaggaaaccgagctatacctcaatctggaacggatcccttggatagtgcgcaaacttctgcaagtaagcgagtctacgggagttgccttgaagcgatcctcatggctcattgtgctgttagtcctgctcactgtgagccttagtccagtgcagtctgctccggtcggccacggcaaaacaatcgagacctaccagactagagaagggtttacaaacatctgtctgttcatgttgggatccattctatttatcgttagctgcctggtgaagggtctcgtagattcggtgtctgactccttctttcccggcctgtcagtctgtaagacctgcagtattgggagcataaatggattcgagatcgaatcccataaatgttattgctctcttttctgctgtccttactgcaggcactgtagcgccgatcgggagattcatcagctgcacttgggcatctgcaagaaacgtaagacgggttcaaacgtgatgctcgcggtttgtaaacgcatgtgctttaaggcaaccatcgaagccagtagaagggctctgccaattcggtccataatcaatacaactttcgtgatttgtatcttaaccctggccatttgcgtcgtgagcacatctgcagtagagatggagaacctacccgctgggacttgggaacgagaggaagacctcaccaatttttgtcaccaagagtgccaggttacagaaaccgagtgtctgtgcccttatgaggcccttgtgttgcgcaagccactgttcctcgattcaatcgtcaaaggcatgaagaacctgcttaacagtactagcctggaaacgtccttgtctatagaggcgccctggggagccatcaatgtgcagtcgacatttaaaccgaccgtcagcactgcaaacattgctctctcctggtcaagtgtggaacatagaggcaataagatcctggttaccgggaggtctgagagcattatgaaattagaggaacggacaggagtgtcctgggacctgggtgtagaggatgcctcagaaagcaagctactcaccgtctctatcatggacctgtcccaaatgtacagtcctgtgttcgagtatcttagcggcgatcgccaggttgaagagtggcccaaggctacttgcacaggggactgtccagagagatgcggatgtacgtctagtacctgcttgcacaaagaatggcctcattcaaggaactggcgttgtaatcccacttggtgctggggcgtgggtacagggtgtacctgctgtggcgtcgatgtgaaggacctgtttacagaccacatgttcataaaatggaaggtagagtacattaaaactgaagccatcgtgtgcgttgagctcaccagtcaggaacggcagtgtagcctgattgaggcaggaacgcgatttaacttaggcccagtcaccatcacactgtcggagcccagaaatatacaacagaaacttcctccagaaatcattactttgcatccgaagatcgaggaagggttctttgatctcatgcacgtgcagaaagtgctgtccgcctctaccgtctgcaagctacagagctgcacacacggtattcccggagacctgcaaatctatcatataggcaacctcctgaaaggggataggcttaatggacacttgattcataagatcgagcctcacttcaacacttcatggatgagttgggacggctgtgatctggactactactgcaatatgggtgattggccatcctgtacctatacgggggttacacagcacaaccatgctgcgtttgtgaatttactcaacatcgaaaccgactacactaaaacattccacttccattctaagcgcgtgaccgcacacggcgatactccccagctggaccttaaagcccggcctacctatggagctggcgagattacagtactggtcgaggtggccgatatggaattgcatacgaagaaggttgaggtgagcgggctcaaatttgcatccctggcctgcaccggatgttacgcttgctcaagcggcatcagttgtaaggtcaggattcacgtggacgaaccagatgagctaactgttcacgtgaaatcttccgaccccgacgtagtcgccgcaagcacatcgctgatggcgagaaagctcgagttcggtaccgattcaacatttaaggctttctctgccatgccgaagacttccctgtgcttttatatagtggaacgcgagtactgtaagtcctgcagcgaagacgataccaaaaagtgtgtggacacgaaacttgagcagcctcaatctatcttgattgaacataaggggacaatcattggaaaacagaatgatacctgcactgcaaaggccagctgctggctggagtccgtcaagtcattcttttatggcctcaaaaacatgttaggtagtgttttcggcaactttttcgtggggatcctgctttttctggctccattcgtactactcgccctgtttttcatattcggatggaagatcttgttttgtttcaaatgctgtcgacggacccgtggcctgtttaagtacagacacttaaaagacgatgaggaaacagggtacaggaagattatcgagcgcctcaatagcaagaaaggaaagaaccggctgcttgacggcgaaagactggcagataggaaaattgctgagttgttctctactaagacccatatcggt

SEQ ID NO: 10535 - RNA, 3495 nt, synthetic construct
  misc_feature 1..3495: note = derived and/or modified CDS sequence (opt3) from CCHVF(CCHVF Ast137)__KX056057.1__Gn-NSm-Gc
  source 1..3495: mol_type = other RNA
agcgaggagcccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatccacatatgtagaatgtccaatcatccaaggacaaccatggcgtttctgttctggttttctttcggatacgtgattacgtgcatcttttgcaaggctctgttctatagcctcattatcatcggcactttaggtaaaaagattaagcagtaccgggaactgaaaccccagacctgtacaatatgcgagactgcccctgttaacgcaatcgatgccgagatgcacgaccttaattgttcctataacatttgcccatactgtgcttcacgcttgaccagtgacgggctggcaagacacgtgacacagtgccccaagaggaaagaaaaggtcgaggaaaccgagctatatctcaatctggaacggatcccttggatagtgcgcaaacttctgcaagtaagcgagtctacgggagttgccttgaagcgatcctcatggctcattgtgctgttagtcctgctcactgtgagccttagtccagtgcagtctgctccggtcggccatggcaaaacaatcgagacctaccagactagagaagggtttacaaacatctgtctgttcatgttgggatccattctatttatcgttagctacctggtgaagggtctcgtagattcggtgtctgactccttctttcccggcctgtcagtctgcaagacctgtagtattgggagcataaatggattcgagatcgaatcccacaaatgctattgttctcttttctgctgcccttactgtaggcattgcagcgccgatcgggagattcaccagctgcacttgggcatctgtaagaaacgtaagacgggttcaaacgtgatgctcgcggtttgcaaacgcatgtgttttaaggcaaccatcgaagccagtagaagggctctgttaattcggtccataatcaatacaactttcgtgatttgcatcctgaccctagccatttgtgtcgtgagcacatctgcagtagagatggagaacctcccagctgggacttgggaacgagaggaagacctgaccaatttttgccatcaagagtgtcaggttacagaaaccgagtgcctttgtccctatgaggccttggtgctgcgcaagcctctcttcctggattcaatcgtcaaaggcactaagaaccttctgaacagtacgagcttggaaacatccctctctatagaggcgccatggggagccatcaatgtgcagtcgacctttaaacccactgtcagcaccgcaaacattgctctgtcctggtcaagtgtggaacacagaggcaataagatcttagttacagggaggtctgagagcattatgaaactggaggaacggaccggagtgtcctgggacctaggtgtagaggatgcctcagaaagcaagctcctgactgtctctatcatggacctttcccaaatgtacagtccggtgttcgagtatttgagcggcgatcgccaggttgaagagtggcctaaggctacatgcacgggggactgccccgagagatgtggatgcacctcttccacttgtctgcataaagaatggccacactcaaggaactggcgttgcaatcctacatggtgttggggcgtgggtaccgggtgcacatgttgcggcgtcgatgtgaaggacctctttactgaccatatgttcataaaatggaaggtagagtacattaaaaccgaagccatcgtgtgtgttgagctgacgagtcaggaacggcagtgcagcttaattgaggcaggaacccgatttaacctgggccccgtcacaatcactctttcggagccaagaaatatacaacagaagttgccccctgaaatcattaccctccacccaaagatcgaggaagggttctttgatctgatgcacgtgcagaaagtgctatccgcctctacagtctgtaagctgcagagctgcactcatggtattccgggagacctccaaatctatcacataggcaacctgcttaaaggggataggttgaatggacatctgattcacaagatcgagccccacttcaacacctcatggatgagttgggacggctgcgatttagactactactgtaatatgggtgattggccttcctgcacgtatacaggggttacccagcataaccacgctgcgtttgtgaatctcctgaacatcgaaactgactacacaaaaaccttccatttccactctaagcgcgtgactgcacatggcgataccccacagcttgacctgaaagcccggcccacatatggagctggcgagattacggtattggtcgaggtggccgatatggaactccacaccaagaaggttgaggtgagcgggctgaaatttgcatccctagcctgtactggatgctacgcttgttcaagcggcatcagttgcaaggtcaggattcacgtggacgaacctgatgagctgacagttcatgtgaaatcttccgacccagacgtagtcgccgcaagcacctcgctcatggcgagaaagctggagttcggtacagattcaacttttaaggctttctctgccatgcccaaaaccagtctttgtttttatatagtggaacgcgagtactgcaagtcctgtagcgaagacgatacgaaaaagtgcgtggacacaaaattggagcagccgcaatctatcctgattgaacacaaggggaccatcattggaaaacagaatgatacttgtaccgcaaaggccagctgctggttagagtccgtcaagtcattcttttatggcctcaaaaacatgctgggtagtgttttcggcaactttttcgtggggatccttctgtttctagctcctttcgtactcctggtgttgtttttcatattcggatggaagatcctgttttgcttcaaatgttgccgacggacacgtggcttatttaagtacagacatctcaaagacgatgaggaaactgggtacaggaagattatcgagcgcctgaatagcaagaaaggaaagaaccggcttctggacggcgaaagattggccgataggaaaattgcagaactcttctctaccaagacacacatcggt

SEQ ID NO: 10536 - RNA, 3495 nt, synthetic construct
  misc_feature 1..3495: note = derived and/or modified CDS sequence (opt3) from CCHVF(CCHVF Ast133)__KX056060.1__Gn-NSm-Gc
  source 1..3495: mol_type = other RNA
agcgaggaacccgacgatgactgcatctccagaacccagctgctcaagacagagactgccgaaattcacgatgacaactacggcgggcctggagataaaataacgatctgtaatggttctaccattgtggaccaaaggcttggctcagagctggggtgctatacaatcaaccgggtcaagagtttcaaattgtgtgaaaatagcgctactggaaagacctgcgagattgattccacaccagttaaatgtcgccagggcttttgcttaaagatcacccaggagggtcgagggcatgtgaagctgtctcgtggatcggaagtagtgctagacgcatgtgattcaagctgcgagataatgatcccgaaaggcactggcgacattctcgtcgattgtagtgggggacagcaacacttcctgaaggacaaccttatcgatctgggttgcccccatattcctttgctcggcaaaatggccatctacatatgtagaatgtccaatcacccaaggacaaccatggcgtttctgttctggttttctttcgggtatgtgattacgtgcatcttttgcaaggctctgttctacctcttaattatcatcggaactctgggcaaaaagattaagcagtatcgggaacttaaaccccagacctgtacaatatgcgagactgcccctgttaacgcaatcgacgccgagatgcatgacttgaattgtagctacaacatttgcccatattgtgcttcccgcctgacctcagatggtctagcaagacacgtgacacagtgccccaagaggaaagaaaaggtcgaggaaaccgagctctacctgaatcttgaacggatcccttggatagtgcgcaaactgttgcaagtaagtgagagcacgggggttgccctcaagcgatcttcctggctgattgtgttactggtcctccttactgtgtcactgagcccagtgcagagtgctccggtcggacacggcaaaacaatcgagacctaccagactagagaaggctttacatctatctgtttgttcatgctagggtccattctgtttatcgttagctgcctcgtgaagggactggtagactcggtgtctgattccttctttcccggtctttcagtctgtaagacctgcagtattggcagcataaacgggttcgagatcgaatcccataaatgttattgctctctgttctgctgtccttactgcaggcactgtagcgccgaccgggagattcatcagttgcacctctcaatctgcaagaaacgtaagacgggaagtaatgtgatgctggcggtttgtaaacgcatgtgctttaaggcaaccatcgaagcctccagaagggctttactgattcggagcataatcaacacaactttcgtgatgtgtattctaaccctcgccatctgcgtcgtgtctacatcagcagtagagatggaggatctgccagctggcacttgggaacgagaggaagaccttaccaatttttgtcaccaagagtgccaggttacagaaaccgagtgtttgtgcccctatgaggccctggtgctccgcaagcctctgttcagtgatagcattgtcaaaggtatgaagaaccttttaaattccacttctttggaaacgtcgctcagcatcgaggcgccatggggcgccataaacgtgcagtccacatttaaacccaccgtctcaactgcaaacatcgctctgagttggtctagcgtggaacatagagggaataagattttagttaccggaaggtccgagtcaatcatgaaactggaggaacggacaggcgtgagctgggacctaggggtagaggatgcctctgaatccaagctcctgaccgtcagtattatggaccttagccaaatgtactctccggtgttcgagtatttgtccggagatcgccaggttgaagagtggcctaaggctacttgcacaggtgactgtcccgagagatgcggctgtacgtcaagtacctgcctgcacaaagaatggccacatagcaggaactggcgttgtaatcctacttggtgctggggagtggggacaggctgtacctgctgtggtgtcgacgtgaaggatctctttacagaccacatgttcatcaaatggaaggtagagtacataaaaactgaagccattgtgtgcgttgagctgacctcgcaggaacggcagtgttccttaatcgaggcagggacgcgatttaacctgggccccgtcaccattacactttctgagccaagaaatatccaacagaagttgccccctgaaataatcactctccatccaaagattgaggaaggattctttgatctgatgcacgtgcagaaagtgctaagcgcctcaaccgtctgcaagctgcagagttgcacacacggcatcccgggggacctccaaatttatcatatcggaaacctgcttaaaggtgatagggttaatggccacttgatacataagattgagccccacttcaacacttcctggatgtcttgggacgggtgtgatctggactactactgcaatatgggagattggcctagctgtacctatacgggcgtgacacagcacaaccatgctgcgtttgtgaatttactcaacatcgaaaccgactacactaaaacattccacttccattccaagcgcgtaaccgcacacggtgatactccacagctggaccttaaagcccggcccacctatggggctggcgagatcacagtcctggtggaggttgccgatatggaattgcatacgaagaaggtggagatttcaggactcaaatttgcaagcctgacctgcactggctgttacgcctgcagttctgggatctcctgtaaggtcaggattcacgtggacgaacctgacgagctaacagttcacgtgaaaagctcggatccagacgtagtcgctgcctcaacctctctgatggcaagaaagctcgagttcggaacagatagtacttttaaagcgttctccgctatgcccaagaccagcctgtgcttttatatagtggaacgcgagtactgtaagtcttgcagcgaagacgatacgaaaaagtgtgtggacacaaaacttgagcagccgcaatccatcttgattgaacataagggcaccatcattggtaaacagaatgatacttgcaccgccaaggcatcatgctggctggagagtgtcaagagcttcttttatgggctgaaaaacatgctcggatctgttttcggctcctttttcgtgggtatcctgctttttctggcccctttcgtactactcgtgctgtttttcatgttcggctggaagatattgttttgtttcaaatgctgtcgacggacacgtgggctgtttaagtacagacacttaaaagacgatgaggaaactggatacaggcgcatcattgagcggctcaattcaaagaagggcaaaaacagactgcttgacggggaaaggctggctgatcgaaagatcgccgagttgttcagtagcaaaacccatattgga

SEQ ID NO: 10537 - RNA, 3495 nt, synthetic construct
  misc_feature 1..3495: note = derived and/or modified CDS sequence (opt3) from CCHVF(CCHVF SK/2015/human)__KX458183.1__Gn-NSm-Gc
  source 1..3495: mol_type = other RNA
agcgaggaatccggcgacgattgcatctctagaaccaggctgctccggacagagactgccgaaattcacggggactcatacggaggtcccggcgataagataacgatctgtaacgggagtaccattgtggaccagcgccttggaagcgagatgggctgctatacaatcaatcgagtcaaatccttcaagctgtgtgaaaactctgctactggtaaatcgtgcgagattgattcaatccctgttcgttgtagacaagggtactgcttgaagataacccaggagggaaggggccatgtgaaattaagccggggcagtgaagtagtgctggacgcatgtgattcctcttgcgaggtcatgatcccaaaggggacaggagacattctagtggattgtagcggtggccagcagcactttctcaaggacaatctgatcgatcttgggtgcccgaacattcccctgttgggaaaaatggccatctatatatgtcgcatgtccaatcatcctaagaccactatggcgttcctcttttggttctcatttggctacgttattacatgcatcctgtgcaaagctattttctatctgctcatcatcgtgggtaccttagggaagagatttaaacaatacagggaactgaagccacagacgtgtactatttgcgagaccacacccgccaacgcaatagacgccgagatgcacgatcttaattgtagttatactatctgcccttactgtgctagccggttgacctctgacggactggcacgccatgtcacacagtgcccaaagcgaaaagaaaaggtggaggaaaccgagctatacctcaacctggaacgtattccctgggtagttaggaaacttctccaggtgtccgagtcaacgggcgtcgccttgaagcggagcagttggctcatcgtgctgttagtgctgttcactgtctctctctcccctgttcaaagcgctccaataggccacgggaaaacaattgagacctatcaggcccgtgaagagtacactggaatctgtctttttgtgctgggttcgatcttgttcattgtatcttgcctagtgaagggcctggtcgacggggtgggaaatatctttttcccgggcctctccatttgtaaaacatgctcaataggtagtatcaacgggtttgaaattgagagccacaagtgttattgctccctgctttgctgtccctactgccgccattgttctgcggatagagaaatccaccagctgcatttgagcatctgcaagaaaaggaagaccggctcaaatgttatgctcgcagtgtgtaaacggatgtgcttccgagccacgatggaggtcagtaacaaggctctgttaattcgctccataatcaataccacattcgtggtatgtattctgatcctagccgtttgcgtggtcagcacttctgcagtggagatggaatcactccctgctggaacctgggagagagaagaggacctgacaaacttttgtcaccaggaatgccaagtcactgagaccgagtgtctttgcccatatgaagccttggtgctgaggcggcccctcttcctggatagtattgttcgcggcatgaaaaatcttctgaacagcacatccttggagacctctctctcgatcgaagcgccttggggagccataaacgtgcagagcacttacaagccaacggtatccacagcaaatatcgctctgtcatggagttctgtcgagcacagagggaacaagattttagtgagcggtaggtccgagtcaatcatgaaactggaagagagaaccggcgttagctgggacctaggggtggaagatgcctctgagtccaagctcctgactgtcagtgtgatggaccttagccagatgtattctcccgtatttgaatacttgtccggagatcggcaagtggaggagtggccgaaagctacctgcacaggcgactgtcctgaacgatgcggttgtaccacttcaacatgcctgcataaggagtggccccacagtagaaattggaggtgtaacccaacgtggtgctggggcgttgggaccggatgtacttgctgtggcctcgatgtcaaagacctgttcacagattacatgtttgtgaagtggaaggtggaatatattaaaaccgaggccatcgtctgcgttgaattaacaagccaggggcgccagtgttcgctgatagaggcaggaactcggttcaatcttggttccgtgaccattacgttgtctgagcctagaaacatccagcataagctgcccccagaaattatcaccctgcaccccaggatagaggaaggctttttcgacctaatgcatgtgcaaaaagtactgagcgcctcaacagtctgcaagctccagagttgcactcacggggtgcctggagacctgcaggtttaccacatcggcaatcttttgaaaggtgataaggtgaacgggcatctgattcacaagatcgagccacattttaatacctcctggatgtcttgggacggctgtgatttagactattactgcaacatgggagattggccgagctgtacatatactggcgtcacccagcacaatcacgcttccttcgtgaacctcctgaatattgaaacggactacaccaaaaactttcatttccactcaaagcgcgttaccgcgcatggggatactccccaacttgacctgaaagcacgacctacatatggagccggcgagatcaccgtgttggtagaggtcgctgatatggaactccacactaagaaaatagagattagcggtctgaagtttgccagtctaacctgcacagggtgttacgcatgttcttccggaatcagctgcaaagtgcggatccatgtggacgaaccagatgagctgacggtccacgttaagtcggacgatcccgacgtggtagccgcttcatctagtctcatggcccgtaagctggagttcggcaccgactccactttcaaagcatttagcgcgatgcctaagacatctctttgcttctacattgtggaaagagagtattgtaaaagctgctccaaggaagatacccagaaatgtgtcaatacaaagttggagcagccacagtcaatcctgattgaacacaggggtactataatcggcaagcaaaacaacacatgcattgctaaagccagttgctggttagagagcgtgaagtcctttttctacgggctcaaaaatatgctgtctggaatctttggcaaccttttcctggggatttttctattcctcgcaccctttatcctgttgatactgttctttatgttcggatggcgcatcttattttgtttcaagtgctgtcggagaacgaggggcctcttcaaatatcgacatctgaaggacgatgaggaaacaggttaccgccggattatcgagagacttaataacaagaaagggaagaataaactgttggacggagaaaggctcgccgatcgtcgcattgctgagctgttttcaaccaagactcacatcggc

SEQ ID NO: 10538 - RNA, 3495 nt, synthetic construct
  misc_feature 1..3495: note = derived and/or modified CDS sequence (opt3) from CCHVF(CCHVF YL16070)__KY354081.1__Gn-NSm-Gc
  source 1..3495: mol_type = other RNA
gccgagggcgggagctccgactgcatctctagaacccagctggtgaagacagaagtcgctgagattcacgaagattcatacggaggtcccggcgagaaaataactatctgtaacgggagtacgattgttgaccagaggctcggaagcgaacttggctgctataccatcaatcgggtgaagtcctacaaactgtgtgagaactctgcatcgggtaagtcatgcgagattgatagcatccctgtaaaatgtaagcaggggttctgcttgaagataacacaggaaggacgcggccatgtgaaattaagtcgaggcactgagatcgtcctggacgtgtgtgattcctcttgcgaactaatgattccaaaggggaccggagacatcctcgttgattgtagcggtggccagcaacactttctgcagaataaccttattgacctggggtgcccgaatgtgcccttgctcggaaaaatggccatctatgtctgtcgtatgtccaaccatcctaagacaaccatggcgttcctgttttggttctcatttggctacgtgataacttgcattgtatgcagagttctgttctatctcttaatcgctattggtacagtggggaaaaagctgaagcagtacagggagcttaaaccacagacctgtatcgtctgcgagagtgtgcccgtgaatgccatcgatgcagaaatgcacgagttgaactgtagctataatatttgcccttactgtgcctctcggctgtccacggacggactaatacgccatgtcactcaatgcccaaagagaagggaaaaagttgaggaaaccgagctctttctgaaccttgagcggatcccctggctggtgcgcaagttgctccaggtatcagaaagcacaggcatggctctgaaacgaagttgttggatgattactttactgatcctccttctggtgtctatgtcccctgtccagagcgcaccagtgggcaaggagagagccatagaaacctaccaggctagggaggcctatacagggatttgcttgttcgttctaggatcggtgctgtttgcggtctcttggctcaccaaagcactgatcgatggtatcggcaattccttctttccggggctttcagtgtgtaagacgtgcagtattggaagcatcaacggcttcgaaattgagtcccacaagtgttactgctctctgttttgctgtccctattgccgggcctgtagctcagacaaaaatactcaccgtatgcatttgaacgtatgcaagaaacgcaagatgggtagtaatgttatgctcgctgtgtgtaaaagaatgtgcttcagggccacaatagaggcatccaacaaggctctgttaatccggagcattatcaactctaccttcgtcatctgtattctgatactaactatctgcgtggtctcaacaagtgccgtggatatggaaaatctccctgcggggatttgggagaaggaagaggacctgaccaacttttgtcaccaagaatgccaggttacggagaccgagtgtctttgcccatacgaagccatggtgttgcgaaaacccctgttcctcgacagcatcgcaaagggcatgaaatccctgcttaattctacatcgctggagactagcttgtccattgaagctccttggggagccatcaacgtacagtcaacctttaagccaacagtcagtgctgccaatatagcactctcttggagctccgtggagcatcgcggcaacaaaatcctggtttcagggagaagcgagtctattatgaagttagaagagaggactggagtgtcctggaatctgggtgtcgaagatgccagtgagagcaagaccctaacagtgtctgtaatggacctctcccaaatgtattcacccgtgttcgaatacctgagtggcgatcggcaggttgaggagtggccgaaagctacctgcactggggactgtcctgaacgctgcggatgtacgagctcgacatgccttcacaaggagtggccccactccagaaactggaggtgtaatccaacctggtgctggggcgtcggtactgggtgtacctgctgtggcttggatgtgaaagactttttcacagattatatgctggtgaagtggaaagtcgaatacatcaagaccgaggcgattgtttgcgtggaactcacttctcaggagcgtcagtgtagcctgatcgaggcaggaacacggtttaacttaggccctgtgacgataaccctgtcagaaccccgaaatgtacaacagagacttccacccgagattgtcactttgcatcctaagatcgaagaggggttctttgacctcatgcacgtgcagaaaattctgagtgcctccacagtttgcaagctacagtcttgcacccatggagtgccaggtgatttccaagtctaccacgtgggcaacctgctcaggggtgacaaagttaatggacatagcatccacaagatagaaccgcactttaacacatcctggatgtcatgggatggctgtgacctggactatttctgcaatatgggtgattggcccagctgtacttacaccggggtgacgcagcataaccgcgctgcctttatcaacatgcttaatattgagaccgactatacaaaaactttccacttccatagtaagcgggtaaccgcacacggcgatacacctcagttggacctgaaagccagaccagcttacggagccggcgaggtcactgtgttagtggaagtcgcagatctcgagctgcacaccaagaaacttgaagtttctgggctgaaaatcgcgtccttgacgtgcagcggatgttatgcttgctcgtcaggcatttcttgtaaggtgaggatccatgtaaacgagcccgacgagtttacagtgcacgtccgcagttccgatcctgacgtggttgccgcaggtagctctctcatggcccgaaaaatagaatttggggctgatagcacctttaaggccttctcctcaatgccaaaagacagtctgtgcttttacattgtggagaaggattattgtagctcttgcactgacgatgacacacagaagtgtgtcaataccaaactagaccatccccaatccatcctgatcgaacacaagggaactattatcggcaaacagaacgatacctgctcaacaaagacgagttgctggctcaagagcttcaaggggtttttctacggcctgaagaatatgctttccgggatttttggaaacgtgttcttgggcatactgttatttctcgcaccgttcgttctgcttatctttttcttctttttcgggtggcggctgctattttgtctcaaatgctgtaagaaaaccaagggactgttgaaatacaagcatctgaaggacaaagaggaagctggctataagaaaattatcgagcgtttaaatggtaagaaagggaagtctcaactcttcgatggagagagactggccaacaggaaaattgcggaacttttctcgactaagatccacataggc

SEQ ID NO: 10539 - RNA, 3495 nt, synthetic construct
  misc_feature 1..3495: note = derived and/or modified CDS sequence (opt3) from CCHVF(CCHVF Oman_812956)__KY362518.1__Gn-NSm-Gc
  source 1..3495: mol_type = other RNA
agcgaggaatccggcgaggactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaagagcttcaaattgtgtgaaaattccgctactggtaaatcttgcgagattgacaacacccctgttaagtgtaaacaggggttttgcttaaagatcacacaggaaggacgaggccatgtgaagctgtcgcgtgattcagaggtagtgctagacgcatgtgatagcagttgcgaaataatgatcccaaaaggcaccggggacattctcgtcgattgttccggaggtcagcaacacttcctgaaggacaatcttatcgatctgggctgcccgaacattcccttgctcgggaaaatggccatctacatatgtagaatgtctaatcatcctaagactacaatggcgtttctgttctggtttagcttcggatatgtgattacctgcatcctgtgcaaagttatcttttacctcttaattgtggtcggcacgctgggtaagaagttcaaacagtatagggagcttaagccacagacttgtaccatctgcgagacaactcccgtgaacgctattgacgccgaaatgcacgatttgaattgttcctacaacatatgcccttattgtgcatcacggctgaccagtgacgggctagcccgccatgtaatgcagtgcccaaaaagaaaggagaaaatcgaagagacagaactctacctgaatcttgagaggattccctgggttgtgcggaagctgttgcaagtcagcgagtctaccggagtggctctcaaacgctcctcatggctgatcgtgttactggtcctccttacggttagcctgagtcctgtgcagtctgcaccaataggccacggcaagactattgaaacataccagacccgagaggggtatacttccatctgtttgtttgtactaggaagcatcctgttcattgtgtcgcacctcatgaagggtctggtcgactctgtgggcaactcctttttcccggggctttcaatctgcaaaacatgtagtattggaagcataaatggctttgaaatcgagtcccataagtgctactgttctctgttctgctgcccctattgtagacactgcagcgccgataaagaaattcataagttgcacctctcaatctgtaaaaagaggaaggctggtagtaacgttatgctggccgtgtgcaaacggatgtgtttccgtgcgaccatggaggtctccaataaggcattactgatccgcagcgtgattaacacgacctttgtagtttgcatactaatcctcgccgtgtgtgtcgtgtctacatcagctgtcgagatggaaagtctgcctgccgggacttgggagagagaagaggaccttaccaacttctgccaccaggaatgtcaagtgacagagactgagtgcttgtgtccatacgaagcactggttctcaggaaacccctgtttttcgatagcattgctaagggcatgaaaaatcttctgaactccacctctttggagacatcgctcagcatcgaagccccttggggagcgattaatgtgcagtccacctttaagccaactgtatcaacggccaacatcgcactgagttggtctagcgtcgagcatcggggcaataagatattagtgtccgggcgatcagagagcatcatgaaactggaggagcgcacaggaatttcttgggacctaggtgttgaagatgcttccgagagtaagctcctgaccgtgagcgtcatggacctttctcagatgtattcccccgtgttcgaatacttgtcaggcgatagacaagtagaggagtggccgaaagccacttgcaccggggactgccctgaaaggtgtggatgcacaagtagcacctgtctgcacaaggagtggccccattcgcggaactggcgctgcaatccaacttggtgttggggcgtgggtacagggtgcacgtgttgcggcctcgatgttaaagacctgtttaccgattatatgttcgtcaagtggaaggtggaatacatcaaaactgaggctattgtgtgtgtcgaattaacatcccaggagagacagtgctctctgatcgaggccggaaccaggtttaaccttggccctgttacaataactttgagcgaaccccgtaatattcagcaaaagctcccacccgagatcgtgaccctgcaccctcggattgaagaggggttctttgacctaatgcatgtgcagaaagtactgtcagcaagtacggtctgtaagctccagtcctgcacccacggagtgccaggtgacctgcaggtttaccacatcggcaaccttttgaaaggggataaggtgaatggacatctgatacacaaagtcgaaccgcatttcaacacatcttggatgagctgggacggctgcgatttagactattactgtaatatgggtgattggccctcctgcacttataccggggtgacacaacacaaccacgccgcttttgttaatctcctgaacatcgagactgactacaccaagaacttccatttccactcaaagcgagtgacggcgcatggcgatacacctcagcttgacctgaaagcaagaccaaattatggagccggcgagattaccgtattggtcgaagtggctgatatggagctccacactaagaaaatcgaaattagcgggctgaagtttgccagtctaacatgtaccggatgctacgcatgttcttccggcatcagctgcaaagtgaggatacatgtcgacgagcccgatgagctgactgttcacgtgaagtcggaagaccctgatattgtagccgcttcatctagtctcatggcccgcaagctggagttcggtaccgactccacatttaaagcattcagcgcgatgccaaagacgtctctttgtttttatatcgtggaacgggagtactgcaaaagctgttccaaggaagacacccagaaatgcgtcaacgctaagttggagagaccccagtcaatcctgattgagcacaaggggactatcattggaaaacaaaatgatacatgtaccgccaaggcaagttgctggttagaaagcgtgaaatctttcttttacggcctcaagaacatgctgtccggtatattcggcaatgtttttatcgggattttcctttttctggccccgttcatcctactcattctgtttttcatgttcggatggaggatcttgttttgcttcaaatgttgccgccgaacacggggcctgtttaagtatcgtcatttaaaggacgatgaggaaactgggtacagaaaaataatcgagaggctcaacaataagaaaggaaagaacaaactgcttgacggcgaacgcctggctgatcggaagattgccgagttgttctcaaccaaaacgcacatcggt

SEQ ID NO: 10540 - RNA, 3495 nt, synthetic construct
  misc_feature 1..3495: note = derived and/or modified CDS sequence (opt3) from CCHVF(CCHVF UCCR4405)__KY484029.1__Gn-NSm-Gc
  source 1..3495: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgaggtcatgataccgaaaggcactggggatatcctcgtggactgtagtggaggtcagcaacacttcctgaaggataaccttattgacctgggctgcccccatatccctttgctcgggaaaatggccatttacatctgtagaatgtccaatcacccaaggacaaccatggcgtttctgttctggttttctttcggatatgttataacgtgcatcttttgcaaggctctgttctacagcctcattattatcggcactttaggtaaaaagatcaagcagtatcgggaactgaaaccccagacctgtacaatttgcgagactgcccctgtgaacgcaatagatgccgagatgcatgaccttaagtgttcctacaatatctgcccatattgtgcttcacgcttgaccagtgacgggctggcaagacacgtcacacagtgccccaaaaggaaggaaaaagtggaggaaaccgagctatacctcaacctggaacggattccttggatcgtacgcaagctgctgcaagttagcgagtctacgggagtggccttgaaacgatcctcatggctcatagtcctgttagtgctgctcactgtgagccttagtccagtccagtctgctccggttggccacggcaagacaattgagacctaccagactagagaagggtttacatccatctgtctgttcatgttgggaagcatcctatttattgtgtcgtgcctggtaaagggtctcgtggattctgtctccgactcattctttcccggcctgagtgtgtgtaaaacctgcagcatcgggtccattaatggattcgagatagaatctcataagtgttattgcagccttttctgctgtccttactgcaggcactattcagccgatcgggagatccatcagctgcacttgagtatttgtaaaaagcgtaaaacgggctccaacgttatgctcgcggtgtgcaagcgcatgtgttttaaggcaaccatcgaagccagcagaagggctctgttaatccggtctattataaatacaactttcgtcatctgcattctgatcctagccatttgtgtggtatcaaccagtgcagttgagatggagaacctcccagctggtacatgggaacgagaggaagacctgactaatttttgccaccaagagtgtcaggtgaccgaaacagagtgcctttgtccctacgaggccttggtcctgcgcaaacctctcttcctggatagcaccgtgaaggggatgaaaaaccttcttaattccacttctttggaaacgtcgctcagcatcgaggcgccatggggcgccataaacgtccagtccacatttaagcccaccgtgtcaactgcaaacatcgctctgagttggtctagcgttgaacatagaggaaataaaattttagtgaccggcaggtccgagtcaatcatgaagctggaggaacggacaggggtaagctgggacctaggagtcgaggatgcctctgaatccaagctcctgaccgtgagtattatggaccttagccaaatgtattctccggttttcgagtacttgtccggtgatcgccaggtggaagagtggcctaaagctacttgcacaggcgactgccccgagagatgtgggtgcacgtcaagtacctgtctgcacaaggaatggccacatagcaggaactggcgttgcaatcctacttggtgttggggagtcggcacaggttgcacctgttgcggggtggatgtaaaagacctctttacagaccacatgttcgtgaagtggaaagttgagtatatcaagactgaagccatagtctgtgtggagctgacctcgcaggaacggcagtgctccttaattgaggcaggcacgcgatttaacctgggacccgtgaccatcacactttctgagccaagaaatattcaacagaagttgccccctgaaatcataactctccatccaaaaatcgaggaaggcttctttgatctgatgcacgtccagaaggttctaagcgcctcaaccgtgtgtaaactgcagagttgcacacacgggattccgggagacctccaaatctaccatattggtaacctgcttaagggcgatagggtgaatgggcacttgatccataaaatagagccccacttcaacacttcctggatgtcttgggacggatgcgatctggactactattgtaatatgggcaactggcctagctgcacctacacgggtgtaacacagcacaatcatgctgcgtttgtcaacttactcaatattgaaaccgattatactaagacattccacttccattccaaacgcgtgaccgcacacggggacactccacagctggatcttaaggcccggcccacctacggcgctggagagatcacagttctggtggaggtcgccgacatggaattgcatacgaagaaagtggagatctcaggcctcaagtttgcaagcctggtttgtaccgggtgctatgcctgtagttctggaatttcctgcaaagtgagaatccacgtagatgaacctgacgagctaactgtccacgtcaagagctcggatccagacgtggtggctgcctcaacatctctgatggcaaggaaactcgagttcggcaccgacagtatttttaaggcgttctccgctatgcccaagacaagcctgtgtttttacatagttgaacgcgagtattgcaaatcttgtagcgaagatgacactaagaaatgcgtggataccaaacttgagcagccgcaatccatcttgattgaacataaaggtacgatcattgggaagcagaacgacacatgtaccgccaaggcatcatgctggctggagagtgtaaagagcttcttttacggattaaagaatatgctcggctctgtgttcggtaactttttcgtcggcatcctgctttttctggcccctttcgtgctactcgttctgtttttcatgttcgggtggaaaatattgttttgcttcaagtgttgccgacggactcgtggactgtttaaatacagacacttaaaggatgacgaggaaaccggctataggcgcatcattgagcggctcaactccaagaaagggaagaatagactgcttgatggagaaaggctggctgaccgaaaaatcgccgagttgttctcaacaaagactcatattggc

SEQ ID NO: 10541 - RNA, 3495 nt, synthetic construct
  misc_feature 1..3495: note = derived and/or modified CDS sequence (opt3) from CCHVF(CCHVF UCCR4459)__KY484032.1__Gn-NSm-Gc
  source 1..3495: mol_type = other RNA
agcgaggaatccggcgacgattgcatctctagaacccagctttcaaggacagagactgccgaaattcacagtgacaactacgggggacccggtgataagataacgatctgtaatggcagcaccattgtggaccaacggctcgggtccgagcttggatgctatacaatcaaccgcgtcaaatctttcaagctgtgtgaaaattcggctactggcaaatcatgcgagattgatagcacccctatcaagtgtcgacagggtttttgcttgaaaataacacaggaggggcgtggacatgttaagttaagtagaggctccgaagtggtactggacgcatgtgattctagctgcgagatcatgattccaaagggcaccggggacatcctagtggattgttccggaggtcagcaacacttcctcaaagacaacctgattgatcttggctgcccgaatatccccctgttggggaagatggccatatacatttgtaggatgtcaaaccatcctaaaactacaatggcgtttctcttctggtttagtttcggatatgtcattacctgcatcctgtgcaaggtgatcttttacctgctcatcgttgtgggcacgttaggtaaaaagttcaagcagtatcgggaactgaaaccacagacttgtaccatttgcgagacaactcccgtcaatgctatagacgccgagatgcacgatcttaactgtagctacaatatctgcccttattgtgcatctcgcttgacctccgacgggctggccagacatgtgatgcagtgcccaaagaggaaagaaaaggtagaggaaacagagctatacctcaacctggaacggattccctgggttgtgcgcaaacttctgcaagtctcagagagcaccggagtggctttgaagcgaagttcttggctcgtggtcctgttagttctgctcacggtgtcccttagccctgtacagtcggcaccaatcggccacggcaaaactgtggagacataccagaccagagaagggtatacttctatatgtctgtttgtcttgggatccattctattcatcgtgtcatgcctgatgaagggtctcgttgacagtgtgggcaatagctttttcccggggctgtccatctgtaagacatgctctattggaagcatcaacggctttgagattgaatcacacaaatgttactgcagtcttttctgctgtccctattgcaggcattgttccgccgatcgggagatacacaagctgcatttgagcatctgcaaaaagcgtaaaaccggttctaatgtcatgctcgctgtgtgtaagcgcatgtgcttcagagccacggtagaagtttcaaacaaggcgctgttaattaggaatatcatcaacaccacatttgtggtctgtattctgatactagcagtgtgcgtcgtgagtactagcgccgttgagatggagtccctccctgctgggacctgggaacgggaggaagacctgacaaacttctgtcaccaggagtgccaagtgactgaaaccgagtgtctttgcccatacgaggccttggtactgcgaaaacccctcttttctgattcgatcgtcaagggcatgaaaaatctgcttaacagcacatccctggaaacctcattgagtattgaggcaccttggggagctatcaatgtgcagtctactttcaagccaacggttagcgccgcgaacattgccctctcctggtcaagcgtggaacaccgcggcaataaaatcctggtctctgggagatccgagagtataatgaagttagaggaaaggacaggaatcagctgggacctgggtgtggaggatgcatctgaatccaagctactcaccgtatcaattatggacctgagtcagatgtatagccccgtgtttgagtacctttcgggcgatcggcaagttgaagagtggccgaaagctacttgcaccggggactgtcctgagcgctgcggatgtacatcctctacctgcttgcataaggaatggccccacagcagaaactggaggtgtaatccaacttggtgctggggcgtcggtacagggtgtacgtgctgtggcctggatgtgaaagacctcttcaccgattatatgtttgtgaagtggaaagtcgagtacatcaagactgaagccattgtttgcgtggagctgacatcacaggaacgtcagtgtagtttaatcgaggctggaacccggttcaacctgggccctgtgacaataactctttccgagccccgaaatattcagcaaaagttgccacccgaaatcgtaaccctccatcctagaattgaggaagggtttttcgacctgatgcacgtcaaaaaggtgctatctgccagcacggtttgcaaactgcagtcctgcacccatggagtgccaggtgacctccaggtctaccacatcggcaacctgcttaagggggataaagtgaatggacacttgatacataagatcgagccgcactttaacacatcatggatgagctgggacggctgtgatctggactattactgcaatatgggtgattggcccagttgttcttatactggggttacccagcataaccacgcagccttcgtgaatatgttaaacattgaaacagactacactaaaatctttcacttccattccaagagggtaaccgctcacggcgatacgcctcaactcgacctgaaggcgcgcccaacatatggagcaggcgagattaccgtccttgtggaggtggccgatatggaactgcatactaaaaagatcgagataagcgggttgaaattcgcttcgctcacatgcaccggatgttacgcctgctcatctggcattagttgtaaggtccggatccacgttgacgaacccgatgagctgactgtgcatgtaaaatccgaggaccctgatatcgtggcagccagctctagcctaatggctagaaagctggaatttggtaccgactccacattcaaggccttttcagcaatgccaaaaacgagtctctgcttctatattgtcgagagggaatactgtaagagctgctctaaagaggacacccagaagtgtgtgaacactaaactggaacagccccagtccatccttattgagcacaaggggacaataatcggaaagcaaaatgatacctgcacatcaaaagcgggctgctggttggagagtgttaagagctttttctacggtctgaaaaacatgttatccggcatttttgggaatgtgttcatcggaatttttctcttcctggctccgtttatccttctgatactattctttatgttcggctggcgcatcctcttctgttttaagtgctgtcgacggactcgtgggctgttcaaatatagacacttgaaggacgatgaagagaccggatacaggaagattatcgaacgcctgaacaataaaaagggcaaaaacaagttactcgacggtgagcggctggccgatagaaaaattgcagaactgttttctacgaagacacatatcggg

SEQ ID NO: 10542 - RNA, 3495 nt, synthetic construct
  misc_feature 1..3495: note = derived and/or modified CDS sequence (opt3) from CCHVF(CCHVF UCCR4401)__KY484035.1__Gn-NSm-Gc
  source 1..3495: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtccgatctttcaaattgtgtgaaaattccgctactggcaagaactgcgagattgattctgttccagtgaaatgtcgtcagggttactgcttaagaatcacccaggaggggaggggacatgtaaagctgtcgcggggctcagaagtggtcctagacgcatgtgatacaagctgcgagataatgatcccgaaaggcaccggggacattctcgtggattgtagtggaggtcagcaacactttctgaaggacaatcttatcgatctgggctgccccaagattcctttgctcgggaaaatggccatctatatatgtcgcatgtccaaccatccaaagactacaatggcgttcctgttttggttctcttttggatacgttattacctgcatcctgtgcaaagctattttctatctcttaatcatcgtgggcacgctgggtaagagacttaaacagtacagggaattgaagccccagacttgtaccatttgcgagacaactcctgtcaatgccatagacgcagagatgcacgatctgaactgtagctataatatctgcccatactgtgcctcccggctaacctcagacgggctcgctcgccatgtgattcagtgccccaagcgaaaagaaaaggtagaggaaacagagctgtaccttaacctggaaagaatcccttgggttgtgaggaaattgctccaagtcagtgagagcaccggagtggcactgaagcggtcttcctggttaatagtgctgctcgtcctttttacggtttcactgagcccagtgcagagtgccccgattggccagggcaaaactatcgaggcttatcgtgcccgcgaagggtacacatctatctgtttgttcgtactaggatccattctgtttatcgtgagctgcctcatgaagggtctggtcgactcggtgggcaattctttctttcccgggctttccatttgtaaaacctgctcaataagtagcatcaacggattcgagattgaatcccacaagtgttattgctctctgttttgctgtccttactgcagacactgtagcactgataaggagatccataaattgcacctctcaatctgcaagaaaaggaagacaggcagtaatgttatgctggcggtgtgtaaattaatgtgcttccgggcaaccatggaagtctccaaccgagccctgttcattcgcagcataatcaatacgacctttgtgctatgtattctcatcctggctgtatgcgttgtgtctacatcagccgtcgagatggagaaccttccagcaggtacttgggaaagagaggaagacttgaccaacttctgtcatcaggagtgccaagtgacagaaactgagtgtctgtgcccctatgaggctctcgtcctgaggaagcctctttttctggatagtaccgccaaggggatgaaaaatttgctcaacagcacatccctggaaacctctttatcgattgaggcgccatggggcgccatcaatgtgcagagcacttacaagcccacggtttccacagcaaacatagctctgtcatggagttctgtggaacaccggggaaataaaatcctagtaagcggccgctccgagtcaattatgaagctcgaggaaagaaccgggatcagctgggacctgggagtcgaggatgcctctgaatccaaacttttgactgtgagtgttatggacctgagccagatgtattctccggtgttcgagtacctctccggtgataggcaagtcgaagagtggcctaaggctacctgcacaggcgactgtcccgagcgttgcgggtgtacctcaagtacttgcctgcacaaggaatggccacatagccggaactggcgatgtaatcctacatggtgctggggagtgggcacgggttgtacctgctgtgggttagatgtaaaagacctgtttactgattacatgttcgtgaagtggaaagttgagtatattaagacagaagccatcgtctgcgtggagcttacctcgcaggaaagacagtgttccttgatagaggcaggcacaaggtttaacctcggacccgtgactattaccctgtctgagccacgcaatatccagcaaaaactaccccctgaaattatcacgctgcacccacggatagaggaaggcttctttgacctcatgcatgtccagaaggttctgagcgcctcaaccgtgtgcaaacttcagagttgcacacacggggtgccgggagacttgcaggtataccatatcggtaacctgttaaagggcgataaggtcaatgggcacctcattcacaaaatcgagccccatttcaacacttcctggatgtcttgggacggatgtgatctggactattactgcaatatgggcgattggcctagctgtacctatacaggtgtgactcaacacaaccatgcttcctttgttaatcttctgaacattgaaaccgactacacgaagaacttccactttcactcaaaaagagtgacagcgcatggggataccccacagttggacctcaaggcaaggcccacttatggcgccggagagatcacagtcctggtggaggttgctgatatggaactacacaccaaaaagatagagattagcggcctgaagttcgccagtctcgcatgcactgggtgttacgcctgcagctccggaatcagctgtaaagtgcgcatccatgtagacgaacctgatgagctgaccgtccacgtgaagtcggacgatccagacgtggtcgctgcctcatctagtcttatggcacgaaaattggagttcggcacagactccacgtttaaggcgttcagcgctatgcccaaaacctctctgtgcttttacattgttgaacgggagcattgtaagagctgctccgaagaggatactaagaaatgtgtgaatacaaagttagaacagccgcagtcaatcctcattgagcacaaaggtaccataatcgggaagcaaaacagtacatgcactgccaaagcaagctgctggctggagtctgtaaagtccttcttttatggacttaagaatatgctgtcaggcattttcggtaacgtgtttatgggcatcttcctatttctcgcccctttcattctgttgatcctgtttttcatgtttgggtggcgtatattattctgtttcaaatgctgtagaaggacccgcggactctttaagtaccggcacctgaaagacgatgaagagacgggctatagaaggatcattgaaaaacttaataacaagaaggggaagaataaactgttggacggagagcgactcgctgatcgccggatcgccgaactgttcagtacaaagacccatattggc

SEQ ID NO: 10543 - RNA, 3495 nt, synthetic construct
  misc_feature 1..3495: note = derived and/or modified CDS sequence (opt3) from CCHVF(CCHVF UCCR4448)__KY484042.1__Gn-NSm-Gc
  source 1..3495: mol_type = other RNA
agcgaggaaacctccgacgattgcatctctagaacacagctgctcaggactgagacggccgaaattcacggcgacaactacgggggacccggtgataagataaccatctgtaatggctcaacaattgtggaccagcggcttgggagtgagctgggatgctatactatcaaccgcgtcaaatctttcaagttgtgtgaaaattccgctaccggcaaatcttgcgagattgattcggttcctgtgaagtgtcgacagggttactgcttacgtatcacacaggaggggagaggacatgtaaaactgtcaaggggcagcgaagtggtcctagacgcatgtgataccagttgcgagataatgatcccaaagggcactggggacattctcgtggattgttccggaggtcagcaacactttctgaaggacaaccttatcgatctgggctgcccgaaaattcccttgctcgggaagatggccatctatatatgtcggatgtctaatcatcctaaaacaaccatggcgttcctgttttggttcagctttggatacgttattacgtgcatcctgtgcaaggctattttctatctcttaatcatcattggcactctgggtaaacgctttaagcagtacagagaacttaagccacagacctgtacaatatgcgagactacccccgtgaacgccatcgacgcagagatgcacgatttgaattgttcctataacatttgcccttactgtgcctcaaggctgacaagtgacgggctagctcggcatgtcacccagtgcccaaaacgcaaggaaaaagtggaggaaacggagctctacctgaatcttgaacgaatcccctgggtagttagaaagctgttgcaagtgagcgagtctactggagtcgcactcaaaaggtcctcatggctgatagtgttactggtgctgttcacaattagccttagtcctgtccagtctgccccaatctcccacggcaagaccatcgaggcttatcgggcccgtgaaggctacactagcatttgtctgtttgttttggggtcgatcctattcattgtgtcttatctgatgaaaggactcgtagactccgtgggtaactcatttttcccgggcctgagtatatgcaagacatgtagcacctcctctatcaatgggtttgagattgaaagccacaagtgctactgttcacttttctgctgcccctattgtcgccattgcagtgcggataaagagatccacaagctgcatttgtccatctgtaaaaagagaaaaacgggaagcaacgtcatgctcgcagtgtgcaagaggatgtgtttccgggccaccatggaagtttctaatcgagctctgtttattcgctcaataatcaacacaactttcgtgttatgcattctgatcctagccgtctgtgtggtaagtaccagcgcagttgagatggagaatctccctgctggcacatgggaaagagaggaagacctgactaacttttgccaccaggagtgtcaggtgaccgaaacagagtgcctttgtccatacgaggccttggtcctgaggaagcccctcttcctggattccattgtgaaaggtatgaagaaccttctgaatagcacctcgttggaaactagcctctccatcgaggcgccttggggcgccataaacgtccaatcaacgtataaaccaacagtgagtaccgcaaatatcgctctgtcttggagctccgttgaacaccgggggaacaagattttagtgtcaggacgcagcgagtctatcatgaaactggaggaaaagactggcatttcctgggacctaggggtagaggatgccagtgaaagcaagctcctgaccgtctctgtgatggacctttcccagatgtactcacccgtttttgagtacttgagtggagatagacaggtggaagagtggccgaaagctacatgcaccggtgactgccctgagaggtgtggctgcactagctcgacatgtctgcataaggaatggccccactcccgtaattggcggtgcaacccaacgtggtgttggggagtcgggaccggctgcacttgttgcggtctcgatgtgaaagacctgttcacagattatatgtttgtaaagtggaaagtggagtacatcaagaccgaagccatagtttgtgtcgagttaacatctcaagaacgacagtgcagcctgattgaggcagggactagattcaatcttggccctgtgaccatcacgttgtcagagcccaggaacattcagcagaagctcccacccgaaatcataaccctgcatcctcgcatcgaggaaggatttttcgacctaatgcacgtgcaaaaagtcctgagtgcctccacagtttgtaagctccagtcttgcactcatggcgtgccaggggacctccaggtgtatcacattggaaatcttttgaaaggtgataaggtaaacggccacctgatccataaaattgagccgcactttaataccagctggatgtcctgggacgggtgcgatttagactactattgtaacatgggagattggccctcatgcacatacactggcgtcacccagcataatcacgctagcttcgtgaacctcctgaatatcgaaacggactatacaaagaactttcacttccatagtaaacgggttaccgcgcacggtgatactcctcaacttgacctgaaggcaagaccaacatacggggccggcgagataaccgtgttggtcgaggtggctgatatggaactccatactaagaaaattgagatctctggactgaagttcgcctccctaacctgtacaggctgctacgcatgtagctcggggatctcatgcaaagttaggattcacgtggacgaacccgatgagctgacggtacatgtcaagtctgacgatcctgacgtggtggccgctagttccagcctcatggcccgcaaactggagtttggaaccgactctactttcaaggcatttagcgcgatgccaaagacatccctttgtttctatatcgtcgaacgagagcactgcaaatcatgtagtgaagaggataccaagaaatgcgttaacacaaagttggaacagccccagagcattctgatagagcacaaaggcactatcattggtaagcaaaattctacctgtacggctaaggcctcctgctggttagagtcagtgaaaagtttcttttacgggctcaagaacatgctgagcggaatctttggcaatgtattcattggtatctttcttttcctggcaccgtttatactactcatcctgttctttatgttcggctggaaaattttgttctgctttaagtgttgccggcgtacaagagggctgttcaaatataggcatttaaaggacgatgaagagaccggataccgccggatcattgaaagactcaacaataagaaaggcaagaacaaactgcttgacggggagatcctggccgataggcgaatagctgaattgttttccactaagacccacattgga

SEQ ID NO: 10544 - RNA, 3495 nt, synthetic construct; identical to SEQ ID NO: 10460
  misc_feature 1..3495: note = derived and/or modified CDS sequence (opt3) from CCHVF(CCHVF SPU4/81 )__DQ157175.1__Gn-NSm-Gc
  source 1..3495: mol_type = other RNA

SEQ ID NO: 10545 - RNA, 3495 nt, synthetic construct; identical to SEQ ID NO: 10481
  misc_feature 1..3495: note = derived and/or modified CDS sequence (opt3) from CCHVF(CCHVF Sudan Al-Fulah 9-2008)__HQ378185.1__Gn-NSm-Gc
  source 1..3495: mol_type = other RNA

SEQ ID NO: 10546 - RNA, 3495 nt, synthetic construct; identical to SEQ ID NO: 10475
  misc_feature 1..3495: note = derived and/or modified CDS sequence (opt3) from CCHVF(CCHVF NIV161064)__KY213713.1__Gn-NSm-Gc
  source 1..3495: mol_type = other RNA

SEQ ID NO: 10547 - RNA, 3495 nt, synthetic construct; identical to SEQ ID NO: 10497
  misc_feature 1..3495: note = derived and/or modified CDS sequence (opt3) from CCHVF(CCHVF 5180-R-2011)__KR814874.1__Gn-NSm-Gc
  source 1..3495: mol_type = other RNA

SEQ ID NO: 10548 - RNA, 3495 nt, synthetic construct; identical to SEQ ID NO: 10505
  misc_feature 1..3495: note = derived and/or modified CDS sequence (opt3) from CCHVF(CCHVF 4574-ST-2008)__KR814870.1__Gn-NSm-Gc
  source 1..3495: mol_type = other RNA

SEQ ID NO: 10549 - RNA, 3495 nt, synthetic construct; identical to SEQ ID NO: 10457
  misc_feature 1..3495: note = derived and/or modified CDS sequence (opt3) from CCHVF(CCHVF 3010)__DQ019222.1__Gn-NSm-Gc
  source 1..3495: mol_type = other RNA

SEQ ID NO: 10550 - RNA, 3495 nt, synthetic construct; identical to SEQ ID NO: 10457
  misc_feature 1..3495: note = derived and/or modified CDS sequence (opt3) from CCHVF(CCHVF UG3010)__DQ211637.1__Gn-NSm-Gc
  source 1..3495: mol_type = other RNA

SEQ ID NO: 10551 - RNA, 2916 nt, synthetic construct
  misc_feature 1..2916: note = derived and/or modified CDS sequence (opt3) from CCHFV(10200, Artificial)__U39455.2__Gn-4aa-Gc
  source 1..2916: mol_type = other RNA
agcgaggaaccctccgacgattgcgtgtctagaacccagctgctcaggacagagactgccgaaatccacggcgacaactacgggggacctggtgataagattacgatatgtaatggctcaaccatcgtcgaccaacggcttgggagtgagctgggatgctatacaattaaccgcgttcgaagtttcaaattgtgtgaaaattccgctactggcaagaactgcgagatcgattctgtgccagtaaaatgtcgtcagggttactgcttaagaattacccaggaggggaggggacatgtgaagctgtcgcggggctcagaagtcgtgctagacgcatgtgatacaagctgcgagatcatgataccgaaaggcaccggggacatcctcgttgattgtagtggaggtcagcaacactttctgaaggacaatcttattgatctgggctgccccaagatccctttgctcgggaaaatggccatttatatctgtcgcatgtccaaccatccaaagactacaatggcgttcctgttttggttctcttttggatacgtgataacctgcattctgtgcaaagctatcttctatctcttaattatcgtcggcacgctgggtagaaggcttaagcagtaccgggaattgaaaccccagacttgtaccatctgcgagacaactcctgtgaatgccattgacgcagagatgcacgatctgaactgtagctataatatatgcccatactgtgcctcccgcctaacctcagacgggctcgctcgacatgtaatccagtgccccaagagaaaggaaaaagttgaggaaacagagctgtaccttaacctggaaaggattccttgggtggtccggaagttgctccaagtgagtgagagcaccggagtggcactgaaacgttcttcctggttaatcgtcctgctcgttctttttacggtgtcactgagcccagtacagagtgccccgataggccgcaagcccttgttcctagactctactgctaaaggcatgaagaatctgctcaactccacaagcctggagacctcgctttctattgaagccccttggggtgcgatcaatgtgcagtccacttataaaccaacagtctcaaccgcaaacatcgccctgagttggagctccgtggagcacagaggaaataagattttggtttctggtaggagcgaatcaatcatgaagctcgaggaacggacgggcattagttgggatctgggggtggaggacgcttccgagagcaaattactgaccgtctctgtgatggatctatcacagatgtacagtcccgtatttgaatatctcagcggagaccgacaagttgaggaatggcctaaggccacatgtactggcgattgcccagagcgctgtggttgcacctcctctacatgtctgcacaaagaatggccccattcgagaaactggaggtgcaacccgacttggtgctggggcgtggggaccggatgtacatgctgtggccttgacgtcaaggatttgttcaccgactacatgtttgtgaaatggaaggtcgagtatataaagactgaggcaatcgtgtgcgttgaactgacgagccaggagcggcagtgttccctcattgaagctgggacacgcttcaatctgggacctgtgaccatcactctttcagagcccagaaacatccaacagaaactgccacctgagattataaccttgcaccccaggatcgaagaggggtttttcgatctcatgcatgtacagaaggtcctgagtgcctctacagtgtgcaaattacagagctgtacccacggcgttccaggggacctgcaagtgtaccacattggaaatctactcaagggcgataaagtcaacggtcatctgatccacaagattgaaccccatttcaatacttcctggatgtcatgggacgggtgcgaccttgattattactgtaacatgggcgactggcctagctgcacatacacgggagtgacccagcacaatcatgcgtcttttgtaaacttgctgaatatcgagactgattatacaaagaacttccactttcactccaaacgtgtgaccgcccatggcgacacaccacagctcgatctgaaggcacggccgacttacggggctggagaaataaccgttttagtcgaggtggccgacatggagctgcacacgaaaaagatcgaaattagtggtcttaaattcgctagcttggcctgtaccggctgctatgcatgttcttcctcaatcagttgcaaggtgcgaatccatgtcgatgagcccgacgaactcacagttcacgtaaagagcgatgaccctgatgtggtggccgcttcgtcctctctgatggcgagaaaactagagtttgggactgacagcaccttcaaggcattttcagccatgccaaaaacaagtctgtgcttctacattgtcgaaagggagcactgtaagtcctgctctgaggaagatactaaaaagtgtgtgaataccaaactcgagcagccccaaagcatactgattgaacataagggaacgatcattggcaagcagaactccacatgcaccgctaaagcctcatgttggcttgagagcgttaagagctttttctatggtttgaaaaatatgctgtctgggatctttggcaacgtgttcatgggaatatttttattcctcgcacctttcatcctgcttattctgtttttcatgtttggctggcgcatcttgttctgctttaagtgttgccggagaactagggggcttttcaaataccgccacctgaaggacgacgaagagacaggatatcgacggattatcgagaagctaaataacaaaaagggcaaaaacaagctgctcgatggtgaacgtctggccgacgggagaatagctgagctcttttccaccaaaactcatattgga

SEQ ID NO: 10552 - RNA, 2916 nt, synthetic construct
  misc_feature 1..2916: note = derived and/or modified CDS sequence (opt3) from CCHFV(IbAr10200, Artificial)__AF467768.2__Gn-4aa-Gc
  source 1..2916: mol_type = other RNA
agcgaggaaccctccgacgattgcatctctagaacccagcttctcaggacagagactgccgaaattcacggcgacaactacgggggacctggtgataagataacgatctgtaatggctcaaccattgtggaccaacggcttgggagtgagctgggatgctatacaatcaaccgcgtccgtagcttcaaattgtgtgaaaattccgctactggcaagaactgcgagattgattctgttccagtgaaatgtcgacagggttactgcttaagaatcacccaggaggggaggggacatgtaaagctgtcgcggggctcagaagtggtcctagacgcatgtgatacaagctgcgagataatgatcccgaaaggcaccggggacattctcgtggattgtagtggaggtcagcaacactttctgaaggacaatcttatcgatctgggctgccccaagattcctttgctcgggaaaatggccatctatatatgtcgcatgtccaaccatccaaagactacaatggcgttcctgttttggttctcttttggatacgttattacctgcatcctgtgcaaagctattttctatctcttaatcatcgtgggcacgctgggtaagagacttaaacagtacagggaattgaagccccagacttgtaccatttgcgagacaactcctgtcaatgccatagacgcagagatgcacgatctgaactgtagctataatatctgcccatactgtgcctcccggctaacctcagacgggctcgctcgccatgtgattcagtgccccaagcgaaaagaaaaggtagaggaaacagagctgtaccttaacctggaaagaatcccttgggttgtgaggaaattgctccaagtcagtgagagcaccggagtggcactgaagcggtcttcctggttaatagtgctgctcgtcctttttacggtttcactgagcccagtgcagagtgccccgattggccgtaaacccttgttcctagactctactgctaagggcatgaaaaatctgctcaactccacaagcctggagacctcgctttctatcgaagccccttggggagcgatcaatgtacagtccacttataagccaacagtgtcaaccgcaaacattgccctgagttggagctccgtcgagcaccgcgggaataagatcttggtgtctggtagaagcgaatcaattatgaaactcgaggaaaggacgggcataagttgggatctgggggttgaggacgcttccgagagcaagttactgaccgtgtctgtcatggatctatcacagatgtacagtcccgtgtttgaatatctcagcggagaccggcaagtaggcgagtggcctaaagccacatgtactggtgattgcccagaacgatgtgggtgcacctcctctacatgtctgcacaaggagtggccccattcgcgcaactggagatgcaacccgacttggtgctggggcgttggaaccggctgtacatgctgtgggcttgacgtgaaagatttgttcaccgactacatgtttgtcaagtggaaggtggaatatatcaaaactgaggcaattgtctgcgtggagctgacgagccaggaaaggcagtgttccctcatcgaggctggaacacggttcaatctgggtcctgttaccatcactctttcagaaccccgcaacattcaacagaagctgccacctgagataatcaccttgcaccccagaattgaggaaggctttttcgatctcatgcatgtgcagaaagtactgagtgcctctacagtctgcaagttacagagctgtacccacggggtgccaggagacctgcaagtttaccacatcggcaatctactcaaaggtgataaggtgaacgggcatctgattcacaagatcgagccccatttcaatacttcctggatgtcatgggacggctgcgaccttgattattactgtaacatgggagactggcctagctgcacatacacgggcgtcacccagcacaatcatgcgtcttttgtgaacttgctgaatatagaaactgattataccaaaaacttccactttcactccaagagggtaacagcccatggggacacaccacagctcgatctgaaagcacgtccgacttacggagctggtgagatcaccgtgttagttgaagtcgccgacatggagctgcacacgaagaaaattgagatcagtggccttaagttcgctagcttggcctgtaccgggtgctatgcatgctctagcggaatttcatgtaaggtgcggatccatgtggatgaacccgacgagctcacagtccacgttaaaagtgatgaccctgatgtggtggccgctagctcgtccctgatggcgcgaaagctagaatttggcactgactctaccttcaaagcatttagcgccatgccaaagacatcactgtgcttctacatagtagagagagaacactgtaaaagttgctccgaggaggatactaagaaatgtgtcaataccaagctcgaacagccccaatctattctgatcgagcataagggtacgattatcgggaaacagaacagcacatgcaccgctaaggcctcctgttggcttgaatcagtgaaatcctttttctatggcttgaagaatatgctgagtggaatatttggcaacgttttcatggggatctttttattcctcgcacctttcattctgcttatcctgtttttcatgtttggatggaggattttgttctgctttaaatgttgccgccggactagaggcctcttcaagtacaggcacctgaaggacgacgaggaaacaggttatcgccgaatcatagagaaactaaataacaagaaagggaagaacaaactgctcgatggagagcggctggccgaccgtagaattgctgaactgttttctaccaagactcatatcggc

SEQ ID NO: 10553 - RNA, 2916 nt, synthetic construct
  misc_feature 1..2916: note = derived and/or modified CDS sequence (opt3) from CCHFV(Turkey-Kelkit06, Artificial)__GQ337054.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtaaaaatagcgctactggcaagacctgcgaagttgactccacaccagtgaaatgtcgacagggtttttgcttaaagattacccaggaggggcgtggacatgtaaagctgtctagaggctcggaggtggtcctagatgcatgtgactcaagctgcgaagtgatgatcccgaaaggcactggggatatactcgttgactgtagtggaggtcagcaacacttcctgaaggataaccttatcgacctgggctgcccccatattcctttgctcgggaggatggccatctacatttgtcggatgtccaatcacccacgcacaaccatggcgtttctgttctggttttctttcggatatgtgatcacgtgcatattttgcaaagctctgttctacagcctcattatcattggcactttaggtaagaaaatcaagcagtatagagagctgaagccccagacctgtacaatctgcgaaactgcccctgtcaacgcaattgatgccgagatgcatgaccttaattgttcctacaacatatgcccatattgtgcttcaaggttgaccagtgacgggctggcacggcacgtgacacagtgccccaaacgcaaggagaaagtagaagagaccgaactatacctcaatctggagcgaatcccttggattgttagaaaacttctgcaagtgagcgaatctacgggagtcgccttgaagaggtcctcatggctcatcgtgctgttagtgctgctcactgtcagccttagtccagttcagtctgctccggtgggccggaagcccctgtttttggattccatagtaaaaggcatgaagaacctactgaatagcacatcgctcgagacctctctgtccattgaggccccttggggagcgatcaacgtgcagtcaactttcaagccaacagtcagtaccgcaaatatcgcccttagctggtcctctgtggttcaccgtgggaacaaaattctggtgacgggtcgcagcgaatcaatcatgaagttggaggaaagaaccggcgtcagttgggacctcggggtggaggatgcttccgaaagcaaactgttaacagtatctattatggacctgtcacagatgtacagtcccgtttttgagtatctaagcggagataggcaagtggaggaatggcctaaggccacttgtaccggcgactgcccagagcggtgtggttgcacatcctctacttgtctccataaagaatggtcgcacagccgaaattggcgctgcaaccccacctggtgctggggcgtcgggacaggatgtacctgctgtggcgtggatgtcaaggacctgttcactgatcatatgtttgtgaagtggaaagttgagtacataaagacggaagcaatcgtgtgcgtagctcttacatcccaggagagacagtgttcattgattgaggccgggaccaggttcaacctgggaccggtcactatcaccctcagtgaacctcggaatatccaacagaaactgcccccagagattataacacttcaccctaagatcgaagagggtttctttgacctgatgcacgtgcagaaagttttgtctgcgagcaccgtgtgcaagctccagtcctgtactcatggcattcccggggatctgcaagtctatcacatcggaaacttactgaagggcgaccgcgtgaatggtcatctaattcacaaaatcgagtcacatttcaacacaagctggatgtcttgggacgggtgcgatctcgactactattgtaatatgggcgattggccatcctgcacgtacaccggagtaactcagcacaaccacgccgcatttgtgaatctgcttaacatagaaacagactataccaagacattccattttcacagtaaaagagttactgctcatggcgatacaccccagttggacctgaaggccaggcctacgtacggggctggaggtatcaccgtcctcgtggaggtggccgatatggaactgcacaccaaaaaggtcgagattagcggcttaaagttcgcatctctggcctgtactgggtgctacgcttgctcctcaggaatcagttgtaaagttcgtattcacgtggacgaaccagatgagcttaccgtgcatgtaaagagctcggacccggatgtcgtggcggcatccacatctttgatggcccggaaactcgagtttggcactgacagcaccttcaaggctttttcagccatgcccaaaacgagtctgtgcttctatatcgttgaacgagagtactgtaagtcctgctctgaagatgacacacagaaatgtgtggacaccagactagagcaacctcagagcatactgattgaacacaagggtactatcattgggaagcagaatgatacatgcaccgcaaaagcctcctgttggctcgagtcagtcaagagctttttctatggcctgaaaaacatgcttggaagtgtgtttggcaatttgttcatcgggatactgttattcctcgctccatttgttctgcttgtgctgttctttatgttcggatggaagatcttgttttgcttcaaatgttgcaggcgcactcggggcctctttaagtacagacatctgaaggacgatgaggaaaccggttataggcgcattatcgagcgactaaactctaaaaaggggaaaaatcggctgctcgacggagatcgtctggccgacagaaagattgcagaacttttctccacaaaaacgcacatcggc

SEQ ID NO: 10554 - RNA, 2919 nt, synthetic construct
  misc_feature 1..2919: note = derived and/or modified CDS sequence (opt3) from CCHFV(SR3, Artificial)__AJ538199.1__Gn-4aa-Gc
  source 1..2919: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgcgtagcttcaaattgtgtgaaaattccgctactggtaagtcttgcgagattgattcgatccctgtaaaatgtaagcaggggtactgcttaaaaattacccaggagggacgaggccatgtgaagctgtcaagaggcagcgaagtcgtgctagacgtttgtgatagttcctgcgaggtgatgatcccaaaggggacaggagacatactcgtcgattgttctggtggccagcaacactttctgaaagacaaccttgtggatctggggtgcccgaagatccccttgctcggaaaaatggcaatttatatctgtaggatgagcaatcatcctaagaccactatggccttcctgttttggttctcctttggctacgtaattacatgcatcctgtgcaaagcgatattctttctcttaattatcttcggtaccctggggaagcggtttaagcagtatcgcgaacttaaaccacagacgtgtactatttgcgagaccacacccgttaacgctatcgacgccgagatgcacgatttgaattgttcatacaacatctgcccttattgtgcaagtagactgactagcgacggactagccaggcatgtgacccagtgcccacggcgcaaggaaaaagtcgaggaaacagagctctacctgaatcttgaacgaataccctgggtggtgagaaagctgttgcaagtctctgagtccaccggcacggttctcaaaaggtcaagctggctgattgtgttactggtactcttcactgtgagtctttctcctgtccagtccgctccaatcggcctgcggcgtccgttgtttctagacagcattgtgaaggggatgaaaaacctgctcaattcgacatctctggagacctccctttcaatcgaagcaccctggggagccataaacgttcagagtacttacaagcctacagtgagcaccgctaatattgccctgtcctggtctagcgtcgagcaccgcggtaacaaggtgttggtatcaggcagaagtgaatccatcatgaaactcgaggaaaggacggggatcagctgggatctgggagttgaggacgcgtctgagtcaaagttactgaccgtgagtgtcatggatctaagccagatgtattccccagtgttcgaatacctctctggcgaccggcaagtcgaggaatggcccaaagcaacatgtactggtgattgccctgagcgatgtgggtgcacctcgagcacatgtctgcacaaggaatggccacattcccgcaattggagatgcaaccccacttggtgctggggcgtgggaaccggctgtacatgctgtgggcttgacgttaaagatttgtttaccgactatatgttcgtgaagtggaaggtagagtacattaaaactgaggccatcgtctgcgtggaactgacgtcacaggagaggcagtgtagtctcattgaagctggaacacggttcaacctgggttctgttaccataactcttagcgagccgcgcaatatccaacagaagctgcctcccgagattatcaccttgcacccaaaaatcgaagagggctttttcgatctcatgcatgtgcagaaggtcctgtccgcctcaacagtgtgcaaattacagagctgtacccacggggtacctggagacctgcaagtgtatcacattggcaacctactcaagggtgatagagttaatgggcatctgatacacaagatcgaacagcattttaacacttcttggatgtcctgggacggctgcgaccttgattactattgtaatatgggagactggcccagttgcacatacacgggcgtcacccagcacaaccatgctagcttcgtgaatttgctgaacattgagactgattacacaaaaacctttcacttccactctaagagggtgacagcacatggggacactccacagctcgatctgaaagcccgtcccacctatggagcgggtgaaatcacggtcttagttgaggtggccgacatggagctgcacaccaagaaaattgaaatctccggccttaagtttgcagggttgacatgtactggatgctacgcttgctcaagtggcataagctgtaaggtgcggatccatgtagatgagcctgacgaactcaccgtccacgtgaaatcggatgacccagatgttgtggccgcttcctctagcctgatggcccgaaagctagagttcggtacagactcaacttttaaagcattcagtgccatgccgaagacctccctgtgcttttatattgtcgaaagagagtactgtaaatcttgcaataaggaggatacgcaaaaatgtgtgaacacaaagctcgaacagccccagagcatcctgattgagcacaaggggaccatcataggcaaacagaataacacttgcacagctaaggcgtcctgttggcttgaatcagttaagagcttcttttatggattgaaaaatatgctgggcgggattttcggaaacgtgttcatcggcatttttaccttcttaactccttttatcctcctgatacttttctttatgttcggttggaggatcctgttttgcttcaaatgttgccgccggaccagagggttgtttaagtacaggcatctcaaggacgacgaggaaacaggatatcgcaaaattatcgagcgactgaataacaagaaaggcaagaaccggctactggatggtgagcgtctcgcagacagaaaaattgccgaactgttcagtacgaagacccacatcggc

SEQ ID NO: 10555 - RNA, 2919 nt, synthetic construct
  misc_feature 1..2919: note = derived and/or modified CDS sequence (opt3) from CCHFV(UCCR4413, Artificial)__KY484038.1__Gn-4aa-Gc
  source 1..2919: mol_type = other RNA
agcgagtcctctgcctcaggctgcatcagtagaacccagatgattaagagcgaaacagctgagatacacgacgatatctacgggggacccggtgaaaaactgactatttgtaacggcacgaccgtggtcgaccaaaggctcgggtccgagcttggatgctatacaatcaatcggattaagacttacaaactgtgtgaaaactctgttaaggagaaaacctgcgagatcgattcggtgcctgtaaagtgtcgccagggcttgtgcttaaagataacacaggaaggtcgagggcatgtgaaactgtcacgtggaagcgagatcgtcctagacatttgtgatagttcctgcgaactcatgatcccaaagggcaccggcgacattctggtggattgttctgggggacagcaacacttccttcaggacaatctggttgatttgggttgcccgaacatccccctcctgggcaaagtggcaatatatatttgtagaatgagcaatcatcctaagactacaatggcctttctgttctggttttccttcgggtacgtcattacctgcatcctctgcaaaatcttattttatctgcttatcattacgggaactttgggcaagaagctgaaacagtacagggagctaaagccacagacctgtacaatatgcgagtcaactcccgtgaacgcgatcgacgctgaaatgcacgatctcaattgtagttataacatttgcccttactgtgccagccggctgacctctgacggtcttatccgccatgtaaatctgtgcccaaaaagaaaggagaaagttgaagagacagaattgtacctcaacctggagaggataccctggttcgtgcggaagttactgcaagtctccgagtcaaccggggtggcactcaaacgcagcagttggcttctgattttggtgatcctactgacggtctctatgtcccctgttcagagcgccccaatcaatcgaaagccgctctttctgtcgtctattgtgaagggaaagaagaaccttctgaatagtgcttcattggaaacttccctcagcatcgaggcaccctggggcgccattaacgctcagtccacattcaaacctaccatatctactgccaatatcgcgctgagctggtcaagtgtagaacacagaggcaacaaggtgttagtctccgggaggagcgagtctattatgaaactggaggagcggacaggaatctcatggaacctaggtgtggaggatgcaagtgaaagccgtatgctcaccgtttccgtgatggacctgtctcagatgtatcttccagtctttgagtacttgtcgggcgaccgccaagtggaagagtggcccaaggccacgtgtaccggggattgccctgaaagatgtggatgcacaagctccacttgtctgcacaaggagtggccacattcaaggaattggcggtgcaaccccacctggtgctggggcgtaggtacagggtgtacttgctgtggcctcgacgttaaagatctgttcaccgactatatgtttgtgaagtggaaagtcgagtacatcaagacagaagctattgtgtgcgtcgagcttaccagtcaggaacgacagtgttctctgatagaggccggaactcgcttcaatttgggcccggtgacgatcacactcagcgagcctagaaacattcaacagaaactgccctccgaaatcgttaccttacacccaaagattgaggaagggtttttcgatctgatgcatgtgcagaaggtactatcagcaagcactgtctgcaaactccagtcttgtacccacggagtggctggtgacctgcaagtttatcacgtgggcaatcttttgaagggggataaaatcaacggacattccatacacaagatcgagcctcatctgaatacaagttggatgagctgggacggctgcgatctcgactactattgtaacatgggtgattggccctcttgcacctacactggggtcacacagcacaatcatgccgcgttcgtgaacctgttaaatattgaaacggactacaccaaatcctttcacttccactcaaagagggtaactgcccatggcgacacaccacagctggatcttaaggcacggcccatgtatggagctggcgagatcaccgtgttggttgaggtcgccgacatggaactccacagtaaaaacattgagatcagcgggctgaagtttgcttcgctaacatgttccggatgctacgcctgctctagcggtatatcatgtaaagtgcgcattcatgtggatgaacctgacgagctggcagtccacgttaagagtgatgacctcgatgtggtggccgcttcctctagcctgatggcgagaaaaatcgagttcggcactgactccacctttaaggcattctcaagcatgccaaaagaaagtctttgcttttatattgtagagagggatttctgtaagtcttgcgccgctgaagacacgcagaagtgtgtcaaagccaagttggagcaaccgcagtccatcctgatagaacacaaagggaccatcattggaaagcagaatgatacatgcagcactaaaacctcgtgttggttagagtcatttaagtctttcttttacggcctcaagaacatgctgagtggtgtgttcgggtccgcaatcatgggcattcttctgtttttggcccccttcatcctcctgatactattctttttctttggatggcgtattctgttctgcctccggtgttgccgaagaacaaggggcctgtttaaatataagcatatcaaagacgatgaagaggctgggtacaagaaaatcattgagaaacttaataacaagaaaggaggcactagcaagttgctggacggtgaacgcttagccgaccggaaaatcgcagaactcttctctaccaaggcgcacattggg

SEQ ID NO: 10556 - RNA, 2916 nt, synthetic construct
  misc_feature 1..2916: note = derived and/or modified CDS sequence (opt3) from CCHFV(66019, Artificial)__AB069669.1__Gn-4aa-Gc
  source 1..2916: mol_type = other RNA
agcgaggaatccggcgacgattgcatctctagaacccagctgctcaggacagagactgccgaagtgcacggggacaactacggaggtcccggcgataagattacgatatgtaatgggtcaaccatcgtcgaccaacggcttggaagtgagctgggctgctatacaattaaccgcgttaagagcttcaaattgtgtgaaaattccggtactgggaaatcttgcaagatcgataacacccctgtgaaatgtcgacagggattttgcttaaagattacacaggagggccgtggccatgtaaagctgtcgagagggtcagaggtggtcctagacgcttgtgatagcagttgcgaaatcatgataccaaaaggaaccggtgacatcctcgtggattgttccggcgggcagcaacacttcctgaaggacaatcttgttgatctgggatgcccgaacattcccttgctcggcaaaatggcaatctacatttgtaggatgtctaatcatcctaagactacaatggcctttctgttctggtttagcttcggttatgtgataacctgcatcttttgcaaaattatcttctacctgctcattgtcgtggggacgttaggaaagaagtttaaacagtatcgggagctgaagccacagacttgtaccatctgcgaaacaactcccaccaacgcgatcgacgctgagatgcacgatcttaaatgttcctacaatatttgcccttattgtgcctcacgcttgacaagtgacggcctggcaagacatgtaacccagtgcccaaagaggaaagagaaggttgaagagacggaactatacctcaacctggagcggataccctggatcgtgcgcaaacttctgcaagtcagcgaatctactggcgtggccttgaagcgatcctcatggctcattgtgctgttagtcctgctcacagttagccttagtcctgtgcagtctgctccaatcgggagaaagccgctgttctccgacagcatagtaaaaggaatgaagaatttgctaaactcgacctctctggagacttccctctcaattgaggcaccctggggtgccatcaatgtgcagagtacatttaaacctaccgtcagcacggctaacatcgccctgtcctggtctagcgtggaacacaggggcaataagattcttgtttcagggcggagtgagtccatcatgaaactggaggagcgtaccggaattagctgggatttgggcgtggaagacgcgtctgagtcaaagctcctgacagtcagtgtgatggatttaagccagatgtactccccagtattcgagtatctgtctggtgaccgccaagttgaagagtggcccaaggcaacttgtaccgggaactgccctgatagatgtggctgcacatcgagcacttgtctacacaaagaatggccacattccaggaactggcggtgcaatcccacctggtgctggggagtgggcacagggtgtacctgctgtggactcgacgtcaaggatctgtttactgactacatgttcgtgaaatggaaggtcgagtatataaaaacggaagccatcgtgtgcgttgagcttaactcacaggagcgacagtgtagtttgattgaagctggtacacgcttcaatctgggcccggtgaccatcactctctctgagcctagaaacatccaacagaagctgcccagcgaaattataacccttcacccaaggatcgaggaggggtttttcgatctgatgcatgtacagaaggtcttgtccgcctcaacagtgtgcaaactccagagctgtacccacggagttcctggcgacctgcaaatttaccacatcggtaatttactgaagggggatcgggtgaacggccatctaattcacaaaatcgaaccccattttaatacttcttggatgtcctgggacggatgcgacctcgattattactgtaacatgggcgactggccaagttgcacatatacgggggtcacccagcacaatcatgcagctttcgtgaacctgcttaatatagagactgattacacaaagaactttcacttccacagcaaacgcgtaaccgcccatggagacacaccccagttggatctgaaggcgagacctacttacggtgccggcgaaatcaccgtgctcgttgaggtcgcagacatggaactgcacacgaagaaaattgctatctctgggttaaagtttgcctccctgacctgtacaggatgctatgcttgctcaagtggcattagctgtaaagtgaggatccatgtggatgagccagacgagcttactgtccacgttaagtcggaagatccggacatagtggccgcatcctctagcttgatggcccgtaaactcgagttcggtaccgattcaacatttaaggctttcagtgcgatgcccaaaacttccctgtgcttttacattgtggaacgggagtattgtgaatcttgcagcaaggaggacacccagaagtgtgtaaatacgaaactagagcaacctcagtccatcctgattgaacacaaggggacaatcataggcaaacagaacgatacctgcactgcaaaggcctcatgttggctcgagagcgtcaaaagtttcttttacggactgaagaatatgctttctggcatcttcgggaacgtgttcattggaatctttttgttcctggctccatttattttactcatcctgttctttatgttcggctggcgaatactgttttgcttcaagtgttgcagaaggacacgcggtctttttaaatatcggtacttgaaggacgacgaagagtccgggtatagaaggattatcgaacgcctcaacaataaaaagggcaaaaacaagctgctagatggagagcgactggccgaccggcgtatcgcagaactcttcagcaccaagactcatattggt

SEQ ID NO: 10557 - RNA, 2916 nt, synthetic construct
  misc_feature 1..2916: note = derived and/or modified CDS sequence (opt3) from CCHFV(7001, Artificial)__AB069670.1__Gn-4aa-Gc
  source 1..2916: mol_type = other RNA
gccgagggcgggagctccgactgcatctctagaacccagctggtgaagacagaagtcgctgagattcacgaagattcatacggaggtcccggcgagaaaataactatctgtaacgggagtacgattgttgaccaaaggctcggaagcgaacttggctgctataccatcaatcgggtgcgctcctacaagctgtgtgagaactctgcatcgggtaaatcatgcgagattgatagcatccctgtaaagtgtaaacaggggttctgcttgaagataacacaggaaggacgaggccatgtgaagttaagtcgtggcactgagatcgtcctggacgtgtgtgattcctcttgcgaactaatgattccaaaagggaccggagacatcctcgttgattgtagcggtggccagcaacactttctgcagaataaccttattgacctggggtgcccgaatgtgcccttgctcggaaagatggccatctatgtctgtagaatgtccaaccatcctaaaacaaccatggcgttcctgttttggttctcatttggctacgtgataacttgcattgcttgcagggtactgttctatctcttaatcgccattggtacagttgggaagaaactgaagcagtaccgggagcttaagccacagacctgtatcgtgtgcgagagtgtccccgtgaatgcaatcgatgccgaaatgcacgagttgaactgtagctataatatttgcccttactgtgcttctcgcctgtccacggacggactaataagacatgtgactcaatgcccaaaaaggcgggaaaaggtcgaggaaaccgagctctttctgaaccttgagcgcatcccctggctggttcgaaaattgctccaggtgtcagaaagcacaggcatggcactgaagagaagttgttggatgattactttactgatcctccttctggtatctatatcccctgtgcagagcgccccagtcggcaggaaaccgttgttcctagataatattgctaaggggatgaaatcgctgctcaactctacctccctggagacatcacttagtatcgaagccccctggggagcgatcaatgtgcagagcacctttaagcctacggtttccgcagccaacattgctctgtcttggagctcagtggagcaccggggtaataagatcttggtcagtggccgttccgaaagcattatgaaactcgaggagcgcactggggtgtcttggaacctgggagtagaagacgcctcagagagtaagacattaaccgttagcgtgatggatctgtcccaaatgtactctccagtcttcgaatatctatcgggcgacagacaggtggaggaatggcccaaagcaacttgcacaggtgactgtcctgagaggtgcgggtgtaccagctccacgtgcctccacaaggagtggccacattcacggaactggcgatgcaatcccacctggtgttggggcgtcggaacaggctgcacttgttgcgggctggatgtgaaagactttttcaccgattacatgcttgttaagtggaaggtggaatatataaaaacagaggctatcgtatgtgtcgaattgacaagtcaggagcgccaatgctctctgattgaggccggaaccagatttaacctcggtccggtgacaatcaccctgagcgaacctaggaatgttcagcagcggcttcccccagagatcgtgactctgcaccctaagattgaagagggcttcttcgacttgatgcatgtccagaaaatactctccgcgtcaacggtgtgtaagctgcaaagctgcacacacggggtacccggagattttcaggtgtaccacgttggcaacttactgcgcggtgacaaagtcaatgggcattctatccacaagattgaaccacatttcaacacctcctggatgagttgggatggctgtgacctagattatttttgcaatatgggagactggcccagctgtacttacaccggcgtgacacagcacaacagagccgcattcatcaatatgctcaacattgagaccgattatactaagacatttcatttccactctaaaagggtgacggctcacggggacacccctcagctggaccttaaggcccgtccagcttacggagccggtgaggtcactgttttggtggaagtggcagatctggagctccatactaaaaagctggaagtatccggcttaaaaatcgcctcactgacctgcagtgggtgctacgcttgtagctcgggaatatcctgcaaggtccggatccacgtgaatgagccggacgaatttacagttcatgtgcgatctagcgatcccgacgtcgtggcggcaggctcaagtcttatggccagaaagattgagttcggtgctgattccacttttaaagccttctctagcatgcctaaggactccttgtgtttttatatcgttgagaaagattactgctcaagctgtaccgacgatgacacgcaaaagtgcgtgaacaccaaactcgatcacccacagagtattctgatcgaacacaaggggacaataattggcaaacagaatgacacttgttctaccaagacatcctgctggctagagagcgtaaagggattcttttatggcctgaaaaacatgctctcggggatcttcggaaatgtcttcctgggcatttttcttttcttggcaccctttgtgctgttaatcttctttttctttttcggttggaggctcctgttttgtcttaagtgctgtcgccggactagagggctgttgaaatacaagcatctcaaagatgaagaggaagccggatataagaagataatcgagaggctgaacggcaaaaagggtaaatcacagctattcgacggcgagcgcctggctgaccgaaagattgccgaactcttttctaccaaaatccacattggg

SEQ ID NO: 10558 - RNA, 2916 nt, synthetic construct
  misc_feature 1..2916: note = derived and/or modified CDS sequence (opt3) from CCHFV(75024, Artificial)__AB069671.1__Gn-4aa-Gc
  source 1..2916: mol_type = other RNA
agcgaggaatccggcgacgattgcatctctagaacccagctgctcaggacagagactgccgaaattcacggggacaactacggaggtcccggcgataagataacgatctgtaatgggtcaaccattgtggaccaacggcttggaagtgagatgggctgctatacaatcaaccgcgtcaagagcttcaagctgtgtgaaaattccgctactggtaaatcttgcgagattgattcgatccctgttaagtgtcgacaggggtactgcttgaaaataacccaggagggacgtggccatgtgaagttatcaagaggcagcgaagtagtgctggacgcatgtgatagttcctgcgaggtcatgatcccaaaggggacaggagacattctagtggattgttctggtggccagcaacactttctcaaagacaacctgatcgatcttgggtgcccgagcattcccctgttgggaaagatggccatctatatatgtaggatgtccaatcatcctaaaaccactatggcgttcctcttttggttctcatttggctacgttattacatgcatcctgtgcaaggctattttctatctgctcatcatcgtgggtaccttagggaaacggtttaagcagtaccgcgaactgaagccacagacgtgtactatttgcgagaccacacccgccaacgcaatagacgccgagatgcacgatcttaattgtagttataacatctgcccttactgtgctagcagattgacttctgacggactggcaaggcatgtcacccagtgcccaaaacggaaggaaaaagtggaggaaacagagctatacctcaatctggaacgcattccctgggtagttcgaaagttgctgcaagtgtccgagtcaaccggcgtcgccttgaaaagaagcagttggctcatcgtgctgttagtgctgttcgctatatctctctcccctgtccagagcgccccaattggcaggcggccgctttttctggactcgatcgttcgtgggatgaagaaccagcttaattctacgtccctagagacttcactgagtatcgaagcgccctggggagcaattaacgtgcagagcacatataaacctaccgtatccactgccaatatcgctctctcttggagctcagtggagcaccgcggtaacaagattctggtcagtggcagatccgaaagcataatgaaacttgaggaaaggacagggatctcttgggatctgggagtggaggacgcctcagagagtaaattgctcaccgttagcgtgatggatctgtcccaaatgtactctccagtcttcgaatatttatcgggcgaccgacaggtggaggaatggcccaaggcaacgtgtaccggtgattgccctgagcggtgtgggtgcacaactagcacctgtctgcacaaagaatggccacattcccgcaattggagatgcaaccccacatggtgctggggcgtaggaactggctgtacctgctgtgggctagacgttaaggatctctttacagactacatgattgtgaaatggaaggtcgagtatatcaagaccgaggctatcgtgtgcgtcgaactgacttcacaggagaggcaatgtagtcttattgaagccggaacgcggttcaacttgggttctgtgacaataaccctgagcgagccgcgcaatatccagcagaaactccctcccgagattatcactctgcacccaagaattgaagagggctttttcgatcttatgcatgttcagaaggtgctgtccgcgtcaaccgtatgcaaattgcaaagctgtacacacggggtccctggagacctccaggtgtaccacgttggcaacctgttaaagggtgataaagtgaatgggcatctgatccacaagatagaaccccatctaaacacctcttggatgtcctgggacggctgcgacctcgattattactgtaatatgggagactggccaagttgcacttacacaggcgtcacgcagcacaaccatgccagcttcgtgaatctgcttaacatcgagaccgattatactaagtcttttcacttccactccaaaagggtaacagcacatggggacaccccacagttggatctgaaggctcgtcctacatacggagccggtgaaattactgtgctcgttgaggtcgctgacatggagtttacccccaaaaagatcgaaatttcaggcctgaaattcgccagtttaacgtgtaccgggtgctatgcatgcagctcgggaatctcctgtaaggtgcggatacacgtggatgagccggacgaactgacagtccatgttaagtctgatgaccccgatgtggtggccgctagctcaagtcttatggcgcgaaaattggagtttggcactgactccaccttcaaggcattttctgccatgcctaaaacaagcctctgcttctacattgtagaaagagagtattgtaagtcctgctcaaaagaggatactcaaaagtgtgtcaataccaaactggaacagccacagagcatcctaattgagcacaagggtacgatcatagggaagcagaacaatacatgcaccgctaaagccagttgttggctggaatctgtgaagtcctttttctacggcctcaaaaacatgctgagcggaatctttggcaatcttttcatggggatctttttgttcctggcacccttcattttactcattctgtttttcatgtttggatggaggatccttttctgctttaagtgttgccgccggactagaggcctgttcaaatataggcacttgaaggacgacgaggaaacaggttaccgccgaataattgagcggctcaacaataagaaagggaagaacaaactgctagatggagagcgtctggccgacagaaggatcgctgaactcttttcgaccaagactcatatcggc

SEQ ID NO: 10559 - RNA, 2916 nt, synthetic construct
  misc_feature 1..2916: note = derived and/or modified CDS sequence (opt3) from CCHFV(7803, Artificial)__AB069672.1__Gn-4aa-Gc
  source 1..2916: mol_type = other RNA
agcgaggaatccggcgacgattgcatctctagaacccagctgctcaggacagagactgccgaaattcacggggacaactacggaggtcccggcgataagataacgatctgtaatgggtcaaccattgtggaccaacggcttggaagtgagatgggctgctatacaatcaaccgcgtcaaaagtttcaagctgtgtgaaaattccgctactggtaaatcttgcgagattgattcgatccctgttaagtgtcgacaggggtactgcttgaaaataacccaggagggacgtggccatgtgaagttatcaagaggcagcgaagtaatcctggacgcatgtgatagttcctgcgaggtgatgattccaaaggggacaggagacatcctagtcgattgttctggtggccagcaacactttctcaaagacaacctgattgatcttgggtgcccgagcatccccctgttgggaaagatggccatatatatttgtaggatgtccaatcatcctaaaaccactatggcgttcctcttttggttctcatttggctacgtgatcacatgcattctgtgcaaggctatcttctatctgctcatcattgttggtaccttagggaaacggtttaagcagtaccgcgaactgaagccacagacgtgtactatatgcgagaccacacccgccaacgcaatcgacgccgagatgcacgatcttaattgtagttataacatttgcccttactgtgctagcagattgacttctgacggactggcaaggcatgtgacccagtgcccaaaacggaaggaaaaagtcgaggaaacagagctatacctcaatctggaacgcatcccctgggtggtacgaaagctcctgcaagtttccgagtcaaccggcgtggccttgaaaagaagcagttggctcatagtcctgttagtgctgttcgctatttctctctcccctgtgcagagcgccccaatctcgaggcggccgctttttctggactctatcgtccgtggcatgaagaacccccttaattccacgtcactagagactagcctgagcattgaagcgccttggggagcaatcaacgttcagtccacatataaaccaaccgtgtctactgccaatattgctctcagctggtcaagtgtagagcaccgcgggaacaagatactggtgtccggtagaagcgaatctatcatgaagttggaggaaaggacaggcatttcatgggatctgggggtcgaggacgccagtgagagcaaattgctcaccgtgtccgttatggatctgtctcagatgtactcgcccgtgttcgaatatttaagcggagaccggcaagtcgaggaatggcctaaggcaacgtgtaccggcgattgcccagagcgatgtggttgcacaacttccacctgtctgcacaaagaatggccccattcacgcaattggagatgcaacccgacatggtgctggggcgtggggactggatgtacctgctgtggcctagacgtaaaggatctctttacagactacatgatcgttaaatggaaggtggagtatatcaagaccagggggattgtctgcgtggagctgacttctcaggaacggcagtgttctcttatagaggctggaacgcgcttcaacttgggtagcgtcacaatcaccctgtccgaacctagaaatattcaacagaaacttcccccagagatcattactctgcaccctaggatcgaggaaggctttttcgatcttatgcatgtgcagaaggttctgtcagccagcaccgtgtgcaaattgcagtcttgtacacacggggtacccggagacctccaagtctaccacgtgggcaacctgttaaagggtgataaagttaatgggcatctgatacacaagatcgagccacatctaaacacctcctggatgagttgggacggctgcgacctcgattattactgtaatatgggagactggcccagctgcacttacacaggcgtgacgcagcacaaccatgcgtctttcgtcaatctgcttaacattgaaaccgattatactaagtcctttcacttccactcaaaacgtgtgacagcccatggggacacccctcagttggatctgaaggcacggccaacatacggagctggtgagatcactgtactcgtggaagttgccgacatggagtttaccccgaaaaagattgagatcagtggcctgaaattcgctagcttaacgtgtaccgggtgctatgcctgctcgtccggaatatcttgtaaggtccgaatccacgtggatgaacccgacgagctgacagtgcatgtcaagagcgatgaccctgatgttgtggcagcctcaagttcccttatggctagaaaattggaatttggcactgactctaccttcaaggcgtttagcgcaatgccaaaaacatccctctgcttctacattgtggagagggaatattgtaagtcatgcagcaaagaggatactcagaagtgtgtaaataccaaactggagcaaccccagagtattctaatcgaacacaagggtacgataatcgggaagcagaacaatacatgcaccgccaaagctagttgttggctggagtccgtcaagagctttttctacggcctcaaaaacatgctgtcgggaatttttggcaatttctttatggggatcttccttttcttggccccttttattctgttaatcctcttctttatgttcggatggcgcatactgttttgcttcaagtgttgccggagaactaggggcctttttaaatatcgccacctgaaggacgacgaagagacaggttaccgacggattatcgaacgtttgaacaataagaaagggaagaacaaactcctggatggagagagactagcagacaggcgcatcgccgagctgttctcaaccaagactcatattggc

SEQ ID NO: 10560 - RNA, 2916 nt, synthetic construct
  misc_feature 1..2916: note = derived and/or modified CDS sequence (opt3) from CCHFV(79121, Artificial)__AB069673.1__Gn-4aa-Gc
  source 1..2916: mol_type = other RNA
gccgagggcgggagctccgactgcatctctagaacccagctggtgaagacagaagtcgctgagattcacgaagattcatacggaggtcccggcgagaaaataactatctgtaacgggagtacgattgttgaccaaggactcggcagcgaacttggttgctataccatcaatagggtgcggtcctacaagctgtgtgagaactctgcatcggggaaatcatgcgagattgatagcatccctgtaaagtgtaaacagggattctgcttgaagataacacaggaaggccgcggccatgtgaagttaagtcgagggactgagatcgtcctggacgtgtgtgattcctcttgcgaactaatgattccaaaaggaaccggtgacatcctcgttgattgtagcggcgggcagcaacactttctgcagaataaccttattgacctgggatgcccgaatgtgcccttgctcggcaagatggccatctatgtctgtcgtatgtccaaccatcctaaaacaaccatggcgttcctgttttggttctcatttggttacgtgataacttgcattgcttgcagagtactgttctatctcttaatcgccattgggacagttggaaagaaactgaagcagtacagggagcttaagccacagacctgtatcgtgtgcgagagtgtccccgtgaatgcaatcgatgccgaaatgcacgagttgaactgtagctataatatttgcccttactgtgcttctcggctgtccacggacggcctaatacgccatgtgactcaatgcccaaaaagaagggaaaaggtcgaggaaaccgagctctttctgaaccttgagcggatcccctggctggttcgcaaattgctccaggtgtcagaaagcacaggcatggcactgaagcgaagttgttggatgattactttactgatcctccttctggtatctatatcccctgtgcagagcgccccagtcgggagaaaaccgttgttcctagattcgaccgctaagggaatgaaatctctgctcaattccacatcactggagaccagtcttagcattgaagccccctggggtgcgatcaacgtgcagtccacgtttaagcctactgtttctgcagccaatatcgctctgagctggtcaagtgtggagcacaggggcaacaagattttggtctccgggcggagcgaatctatcatgaaactcgaggagcgtacaggagtgtcatggaatctgggcgtagaagacgccagtgagagcaagaccttaactgtttccgtgatggatctgtctcaaatgtactcgccagtcttcgaatatctaagcggtgaccgccaggtggaggaatggcccaaagcaacatgcaccggggactgtcctgagagatgcggctgtacgtcctcaacctgcctccacaaggagtggccacatagtaggaactggcggtgcaaccccacatggtgttggggagtcggcactgggtgcacctgttgcggactggatgtgaaagactttttcacagattacatgcttgttaagtggaaggtggaatatattaaaactgaggctatagtatgtgtcgaattgacctctcaggagcgacaatgcagcctgatcgaggccggtacacgctttaatctcggcccggtgaccattactctgtccgaacctagaaacgttcagcagaggcttcccccagagatcgtgacgctgcaccctaagatcgaagaggggttcttcgacttgatgcatgtccagaaaattctctcagcgagcacagtgtgtaagctgcaatcttgcacccacggagtacccggcgattttcagatataccacgtgggtaatttactgcgcggggacaaagttaacggccattccatccacaagattgaaccacatttcaataccagttggatgagctgggatggatgtgacctagattatttttgcaacatgggcgactggccctcttgtacttacacaggggtcacccagcacaatcgggccgcattcatcaacatgctcaatattgagactgattatacaaagacgtttcatttccactccaaaagagtgaccgctcacggagacactcctcagctggaccttaaggccaggccagcttacggtgccggcgaggtgacagtcttggttgaagtggcagatctggagctccataccaaaaacctggaagtgtcagggttaaagatcgccagtctgacatgcagcggatgctacgcttgttcgtccggcatatcttgcaaagtacgtatccacgtcaatgagccggacgaatttactgtgcatgttcggagctcagatcccgacgtggtcgcggcaggtagttcccttatggcccgaaagattgagttcggggctgattctacctttaaggccttcagctccatgcctaaagactcattgtgtttttatatcgtggagaaggattactgcagcagttgtacggacgatgacacccaaaaatgcgttaacacaaagctcgatcacccacagtctattctgatcgaacacaaaggcactataattggaaagcagaatgacacctgttccacaaaaactagctgctggctagagtcggtgaagggcttcttttatgggctgaagaacatgctctcaggaatcttcggcaatgtattcctgggtatttttcttttcttggcaccctttgtcctgttaatcttctttttctttttcgggtggagactcctgttttgtcttaaatgctgtaggcgcacccggggactgttgaagtacaaacatctcaaggatgaagaggaagccggctataaaaagataatcgagagactgaacggtaagaaaggcaagtctcagctattcgacggggagaggctggctgaccgcaaaattgccgaactctttagtacgaagatccacattgga

SEQ ID NO: 10561 - RNA, 2916 nt, synthetic construct
  misc_feature 1..2916: note = derived and/or modified CDS sequence (opt3) from CCHFV(8402, Artificial)__AB069674.1__Gn-4aa-Gc
  source 1..2916: mol_type = other RNA
agcgaggaatccggcgacgattgcatctctagaacccagctgctcaggacagagactgccgaaattcacaacgacaattacgggggacccggtgataagataacgatctgtaacggctcaaccgtggtcgaccaacggcttgggagtgagctgggatgctatacaattaatcgcgttaagagcttcaagttgtgtgaaaactccgctactggcaaatcttgcgagatcgattcgacccctgtgaagtgtcgacagggtttttgcttaaaaattacacaggaggggcgtggacatgtaaagctgtcaagaggcagcgaagtggtcctagacgcatgtgatagttcctgcgagatcatgataccaaagggcaccggggacatcctcgtggattgttctggaggtcagcaacacttcctgaaagacaatcttattgatctgggctgcccgaacatccccttgctcgggaagatggccatttacatctgtaggatgagcaatcatcctaaaactacaatggcgtttctgttctggttttccttcggatatgttgtgacctgcatactgtgcaaggtcatcttttacctcttaattgtggtaggcacgctgggtaaaaagttcaagcagtatcgggaacttaaaccacagacttgtaccatttgcgagacaactcccgttaacgctatcgacgccgagatgcacgatttgaattgttcatacaacatctgcccttattgtgcaagtcgcctgaccagcgacgggctagccagacatgtgatgcagtgcccaaagaggaaagaaaagattgaggaaacagagctctacctgaatcttgaacggataccctgggtcgtgcgcaaactgttgcaagtgtctgagtccaccggagtcgctctcaagcgatcaagctggctggttgtgttactggtactccttacggtgagtctgtctcctgtccagtccgcaccaatcggcagaaaaccgttgtttagcgactcgattgtgaagggcatgaagaacctactcaattctacttccctggagacatcactgagtatcgaagccccctggggagctataaacgttcagagcaccttcaaacctactgtgtccgccgcgaatattgcactttcttggagctcagtcgagcacagggggaacaagatcctggtgagtggtcggtccgaaagcatcatgaaattggaggaacgtacaggcatttcttgggatctcggggtagaggacgcctcagagagtaagctgttaaccgttagcgtgatggatctgtcccagatgtactctccagtctttgaatatctatcgggagaccgccaagtggaggaatggcccaaagctacgtgtaccggcgattgccctgagagatgtggttgcacaagctccacttgtctccacaaggaatggccacattcaaggaactggcggtgcaatcccacctggtgctggggcgtcgggacaggatgtacttgctgtggcctggacgtgaaggatcttttcaccgactacatgtttatcaaatggaaggttgagtatattaaaacagaggccatagtgtgcgtagaattgaccagtcaggagcgacagtgtactctgatcgaagcagggacgcgcttcaacctcggaccggtcacaattaccctgtctgagcctagaaatatccaacagaaacttcccccagagatcgtgactctgcaccctaggattgaagagggtttctttgatttgatgcatgttcagaaagtgctcagcgcttccaccgtctgcaagctgcagtcatgtacacacggcgtgcccggggacttacaagtataccacataggaaacctgctaaagggcgataaagtgaatggtcatctcatccacaagattgaaccacatttcaacaccagctggatgtcttgggacgggtgcgacctggattattactgtaatatgggcgactggccctcctgcacttatacaggagttacgcagcacaaccatgccgcgtttgtcaatatgcttaacatcgagaccgattacactaaaaatttccactttcacagtaagcgggtgacagcccatggcgacacccctcagttggatctgaaagcacgcccaacatacggggctggagaaattactgtgctcgtcgaggttgccgacatggagctgcacaccaagaagatcgaaataagcggtttaaaattcgcttctctgacgtgtaccggctgctatgcctgctcctcagggatcagttgtaaggtgaggattcatgtggatgagccggacgaacttacagtacacgtcaaaagcgaggatcccgacatcgtggcagcctcgtcctctttgatggctagaaagctcgaatttggaactgatagcaccttcaaagcgttttcagcaatgcctaagacaagtctgtgcttctacattgttgagcgtgagtattgtaaatcctgctctaaggaagacactcagaagtgtgtgaacaccaaactagagcaaccacagagcatcctgatagaacacaagggcacgattatcggtaaacagtccaatacatgcaccgccaaggcttcatgttggctcgagagcgtcaaaagtttcttttacgggctgaagaacatgctttctggcatttttggaaatgtgttcatcggcgttttcttgtttttcgccccctttatactgttaatcctcttctttatgttcgggtggcggattctgttttgcttcaagtgttgccgaagaactaggggactttttaaatatcgccatctgaaggatgacgaagagacaggctaccggaaaatcattgagagattgaacaacaagaaaggtaagaataagctcctggacggggaaaggctagcagatcgcaaaatcgccgagctgttctccaccaagactcacatagga

SEQ ID NO: 10562 - RNA, 2916 nt, synthetic construct
  misc_feature 1..2916: note = derived and/or modified CDS sequence (opt3) from CCHFV(88166, Artificial)__AB069675.1__Gn-4aa-Gc
  source 1..2916: mol_type = other RNA
agcgaggaatccggcgacgattgcatctctagaacccagctgctcaggacagagactgccgaaattcactcagacaactacgggggacccggtgataagataacgatctgtaatggcagtaccgtggtcgaccaacggcttgggagcgagctgggatgctatacaattaaccgcgttaaatccttcaagttgtgtgaaaattctgctactggcaaatcgtgcgagatcgattcaacccctgtgaagtgtcgacagggtttttgcttaaaaattacacaggaggggcgtggacatgtaaagctgagcagaggcagtgaagtggtcctagacgcatgtgattcctcttgcgagatcatgataccaaagggcaccggggacatcctcgtggattgtagcggaggtcagcaacacttcctgaaagacaaccttattgatctgggctgcccgaatatccccttgctcgggaagatggccatttacatctgtaggatgtccaaccatcctaaaactacaatgggatttctgttctggttttcattcggctatgttgtgacctgcatactgtgcaaggtcatcttttacctcttaattgtggtaggtacgctggggaaaaagttcaagcagtatcgggaacttaaaccacagacttgtaccatttgcgagacaactcccgttaatgcgatcgacgctgagatgcacgatttgaactgtagttacaatatctgcccttattgtgccagccgcctgacctctgacggactagcaagacatgtgatgcagtgcccaaagaggaaagaaaagattgaggaaacagagctctacctgaaccttgaacggataccctgggtcgtgcgcaaactgttgcaagtgtccgagtcaaccggcgtcgccctcaagcgaagcagttggctggttgtgttactggtactccttacggtgtctctgtcccctgtccagagcgctccaatcggcagaaaaccgttgttttcggactctattgtgaaggggatgaagaatctactgaactccacttcactcgagacaagtctgagcatcgaagcaccctggggagccataaatgttcagtccaccttcaaacctactatgtctgctgccaacattgcgcttagctggtcaagtgtggagcacaggggtaataagatcctggtctccggccggagcgaatctatcatgaaattggaggaacgtacagggatttcatggaacctcggagtggaggatgcaagtgagagcaagctgttaaccgtatccgttatggacctgtctcagatgtactcgccagtgtttgaatatctaagcggcgatcgccaagtcgaggaatggcccaaagccacgtgtaccggtgactgccctgagagatgtgggtgcacatcctcaacttgtctccacaaggaatggccacatagtaggaactggcggtgcaatcccacctggtgctggggcgtgggaacaggctgtacttgctgtgggctggatgtcaaggaccttttcaccgattacatgtttatcaaatggaaggtggagtatattaaaacagaggctatagtttgcgtggaattgacctctcaggagcgacagtgtactctgatcgaagccggaacgcgcttcaacctcggtccggtaacaattaccctgagcgagcctagaaatatccaacagaaacttcccccagagatcgtcactctgcaccctaggattgaagagggcttctttgacttgatgcatgtgcagaaagttctctccgcatcaaccgtgtgcaagctgcagagctgtacacacggggtccccggagatttacaagtgtaccacataggcaacctgctaaagggtgacaaagtaaatgggcatctcatccacaagattgaaccacatttcaacacctcttggatgtcctgggatggctgcgacctggactattactgtaatatgggagattggcccagttgcacttatacaggcgtgacgcagcacaaccatgctgcctttgttaatatgcttaacatcgagaccgactacactaaaaatttccactttcacagcaagcgggtcacagcgcatggggatacccctcagttggacctgaaagcccgcccaacatacggagctggtgaaattactgtgctcgtggaggtcgcagatatggagctgcacaccaagaagatcgaaatatctggcttaaaattcgcctccctgacgtgtaccgggtgctatgcttgctcaagtggaatcagctgtaaggttaggattcatgtggacgagccggatgaacttacagtgcacgtaaaatcggaggaccccgatttggtcgccgcatcctctagcctcatggccagaaagctggaatttggcactgactcaaccttcaaggcttttagtgcgatgcctaagacatccctatgcttctacatcgtggagcgtgagtattgtaaatcttgcagcaaggaagatactcagaagtgtgttaacaccaaactggagcaaccacagtccattctcatcgaacacaagggtacgataattgggaaacagaataacacatgcaccgcaaaggcctcatgttggctggagagcgtgaaaagtttcttttacggccttaagaatatgttgtctggaatctttggcaacgtcttcattggggtgttcctgtttttcgctccctttatcttactcatactgttctttatgttcggatggcggatcctcttttgcttcaagtgttgccgaagaactaggggcctgtttaaatatcgccatttgaaggacgatgaagagacaggttaccggaaaattatcgagagactcaacaataagaaagggaagaacaagctgctagacggagaaaggctggccgaccgcaaaattgcagagcttttctccaccaagactcacatcggc

SEQ ID NO: 10563 - RNA, 2916 nt, synthetic construct
  misc_feature 1..2916: note = derived and/or modified CDS sequence (opt3) from CCHFV(BA88166, Artificial)__AF338470.1__Gn-4aa-Gc
  source 1..2916: mol_type = other RNA
agcgaggaatccggcgacgattgcatctctagaacccagctgctcaggacagagactgccgaaattcactcagacaactacgggggacccggtgataagataacgatctgtaatggcagtaccgtggtcgaccaacggcttgggagcgagctgggatgctatacaattaaccgcgttaaatccttcaagttgtgtgaaaattctgctactggcaaatcgtgcgagatcgattcaacccctgtgaagtgtcgacagggtttttgcttaaaaattacacaggaggggcgtggacatgtaaagctgagcagaggcagtgaagtggtcctagacgcatgtgattcctcttgcgagatcatgataccaaagggcaccggggacatcctcgtggattgtagcggaggtcagcaacacttcctgaaagacaaccttattgatctgggctgcccgaatatccccttgctcgggaagatggccatttacatctgtaggatgtccaaccatcctaaaactacaatgggatttctgttctggttttcattcggctatgttgtgacctgcatactgtgcaagggtattttctacctcttaatcgtcgtggggacgctgggcaaaaagttcaagcagtatcgggaacttaaaccacagacttgtaccatttgcgagacaactcccgtaaatgcgatcgacgctgagatgcacgatttgaactgtagttacaatatctgcccttattgtgccagccgcctgacctctgacggactagcaagacatgttatgcagtgcccaaagaggaaagaaaagattgaggaaacagagctctacctgaaccttgaacggataccctgggtggtccgcaaactgttgcaagtgtccgagtcaaccggcgtggccctcaagcgaagcagttggctggtcgttttactggtgctccttacggtatctctgtcccctgtgcagagcgctccaatcgggagaaaaccgttgtacctagactcgattgtcaagggaatgaagaatctgctcaactctacttccctggagacatcacttagtatcgaagcaccctggggtgccataaatgtgcagagcacctttaaacctactatgtccgctgccaacattgcgctgtcttggagctcagttgagcacaggggcaataagatcttggtgagtgggcggtccgaaagcatcatgaaactcgaggaacgtacaggaatttcttggaacctgggcgtcgaggatgcatcagagagtaagttactgaccgtgagcgtaatggacctatcccagatgtattctccagttttcgaatacctctcgggtgatcgccaagtggaggaatggcccaaagccacgtgtaccggggactgccctgagagatgtggctgcacaagctccacttgtctgcacaaggaatggccacattcaaggaactggcggtgcaatcccacctggtgctggggagtcggcacagggtgtacttgctgtggacttgatgtgaaggacttgtttaccgattatatgttcatcaaatggaaggtcgagtacattaaaacagaggctatagtgtgcgttgaactgaccagtcaggagcgacagtgtactctcatcgaagccggtacgcgctttaacctgggcccggtgattatcacactttctgagcctagaaatatccaacagaagctgcccccagagattgtaaccttgcaccctaggatagaagaggggttcttcgacctcatgcatgtccagaaagtgctgagcgcatccactgtttgcaagttacagtcatgtacccacggagtgcccggcgatctgcaagtctatcacatcggtaacctactcaagggggacaaagtgaatggccatctgattcacaagatcgaaccacattttaacacaagctggatgtcttgggatggatgcgaccttgactactattgtaatatgggcgattggccctcctgcacctacactggggtaacacagcacaaccatgctgccttcgtgaatatgttgaacattgagacggactacaccaaaaattttcacttccacagtaagcgggttactgcgcatggagatacacctcagctggacctcaaagcccgcccaacctatggtgcaggcgaaatcacagtcctggtggaggtggctgatatggagttacacactaagaagatagaaatcagcgggctgaaatttgcctctcttacctgtacgggatgctacgcttgctcctcaggcattagttgtaaggtcagaatccatgttgacgagccggatgaattgaccgtgcacgtgaaaagcgaggaccccgatattgtagccgcatcgtcctctctcatggccaggaagctggaatttggtacagacagcacttttaaggctttctcagcgatgcctaaaaccagtctatgcttttatatcgtcgagcgtgagtactgtaaatcctgctctaaggaagatacacagaagtgtgtgaacactaaactggagcaaccacagagcatactcattgaacacaaggggaccatcattggcaaacagaataacacgtgcacagcaaaggcctcctgttggctggagtcagttaagagcttcttttatggacttaaaaatatgttgagtggcatcttcgggaacgtgtttataggagtcttcctgttctttgctcccttcatcttactcattctgtttttcatgtttggctggcggatccttttctgctttaagtgttgccgaagaaccaggggtctgttcaaataccgccatttgaaggacgatgaagagactgggtatcggaaaattatcgagagactcaacaataagaaaggaaagaacaagctgctagacggcgaaaggctggccgaccgcaaaatagcagagctcttttctacaaagacccacattggt

SEQ ID NO: 10564 - RNA, 2916 nt, synthetic construct
  misc_feature 1..2916: note = derived and/or modified CDS sequence (opt3) from CCHFV(BA66019, Artificial)__AF350448.1__Gn-4aa-Gc
  source 1..2916: mol_type = other RNA
agcgaggaatccggcgacgattgcatctctagaacccagctgctcaggacagagactgccgaagtgcacggggacaactacggaggtcccggcgataagattacgatatgtaatgggtcaaccatcgtcgaccaacggcttggaagtgagctgggctgctatacaattaaccgcgttaagagcttcaagttgtgtgaaaattccggtactgggaaatcttgcaagatcgataaacatcctgtgaagtgtcgacagggattttgcttaaagattacccaggagggccgtggccacgtaaaactgtcgagagggtcagaggtggtcctagacgcttgtgatagcagttgcgaaatcatgataccaaagggaacaggtgacatcctcgtggattgttccggcgggcagcaacatttcctgaaagacaaccttgttgatctgggatgcccgaatattcccttgctcggcaagatggcaatctacatttgtaggatgtctaaccaccctaaaaccactatggcctttctgttctggtttagcttcggttatgtgatcacatgcatattttgcaagattatcttctacctgctcattgtcgtggggaccttaggaaagaaatttaagcagtatcgggagctgaaaccacagacgtgtactatctgcgaaaccacacccactaatgcgatcgacgctgagatgcatgatcttaagtgttcctacaacatttgcccttattgtgcctcacgcttgaccagtgacggcctggcaagacacgtaacacagtgcccaaaaaggaaggagaaagttgaagagaccgaactatacctcaatctggagcggataccctggatcgtgcgcaaacttctgcaagtcagcgaatctacgggcgtggccttgaagcgatcctcatggctcattgtgctgttagtcctgctcactgttagccttagtcctgtgcagtctgctccaatcgggagaaaaccgctgttctccgacagcatagtaaagggaatgaaaaacttgctaaattcgacatctctggagacctccctctcaattgaggcaccctggggtgccatcaacgtgcagagtacttttaagcctacagtcagcaccgctaatatcgccctgtcctggtctagcgtggaacacaggggcaacaaaattcttgtttcagggcggagtgagtccatcatgaagctggaggagcgtacgggaattagctgggatttgggcgtggaagacgcgtctgagtcaaagctcctgaccgtcagtgtgatggatttaagccagatgtactccccagtattcgagtatctgtctggtgaccgccaagttgaagagtggcccaaagcaacatgtactggggattgccctgacagatgtggctgcacctcgagcacatgtctacataaggaatggccacactccaggaattggcggtgcaaccccacttggtgctggggagtgggcaccgggtgtacatgctgtggactcgatgtcaaagacctgtttaccgattacatgttcgtgaagtggaaagtcgagtatataaagactgaagccatcgtgtgcgttgagcttaactcacaggagcgacagtgtagtttgattgaagctggtacgcgcttcaatctgggcccggtgacaatcaccctctctgagcctagaaacatccaacagaagctgcccccagaaattataactcttcatcctaggatcgaggaggggtttttcgacctgatgcacgtacagaaagtcttgagcgcctccaccgtgtgcaagctccagtcatgtacacacggagttcccggcgatctgcaaatttaccatatcggtaatttactgaaaggggaccgggtgaacggccacctaattcataagatcgaaccacactttaataccagctggatgtcttgggacggatgcgatctcgactattactgtaacatgggcgattggccctcctgcacttatacaggggtcacgcagcataatcacgcagctttcgtgaacctgcttaatatagagaccgactacactaaaaactttcacttccatagtaagcgcgtaacagcccacggagatacccctcagttggacctgaaggcgagaccaacatacggtgccggcgaaatcactgtgctcgttgaggtcgcagatatggaactgcataccaaaaagattgctatcagcgggttaaaatttgcctctctgacgtgtaccggatgctatgcttgctcctcaggcattagttgtaaggtgaggatccacgtggacgagccggatgagcttacagtccacgttaaaagcgaagaccccgatatagtggccgcatcgtcctctttgatggcccgtaagctcgagttcggtactgacagcacctttaaggctttctcagcgatgcctaaaacaagtctgtgcttttacattgtggaacgggagtattgtgaatcctgctctaaggaggatactcagaaatgtgtaaataccaagctagagcaaccacagagcatcctgattgaacataaagggacgatcataggcaagcagaacgacacatgcaccgcaaaagcctcctgttggctcgagtcagtcaagagcttcttttacggactgaagaatatgcttagtggcatcttcgggaacgtgttcattggaatctttttgttcctggctccctttattttactcatcctgttctttatgttcggctggcgaatactgttttgcttcaaatgttgcagaaggactcgcggtctttttaagtatcggtacttgaaagacgatgaagagtctgggtatagaaggattatcgaacgcctcaataacaagaaaggaaagaacaagctgctagacggcgagcgactggccgatcggcgtatcgcagaactcttctccacaaaaacccacattggt

SEQ ID NO: 10565 - RNA, 2916 nt, synthetic construct
  misc_feature 1..2916: note = derived and/or modified CDS sequence (opt3) from CCHFV(BA8402, Artificial)__AF350449.1__Gn-4aa-Gc
  source 1..2916: mol_type = other RNA
agcgaggaatccggcgacgattgcatctctagaacccagctgctcaggacagagactgccgaaattcacaacgacaattacgggggacccggtgataagataacgatctgtaacggctcaaccgtggtcgaccaacggcttgggagtgagctgggatgctatacaattaatcgcgttaacagcttcaatttgtgtgaaaacactgctaccggcaaatcctgcgagatcgattctacacctgtgaagtgtcgacagggtttttgcttaaaaattacccaggaggggcgtggacatgtaaagctgtcgagaggctcagaagtggtcctagacgcatgtgagagcagttgcgaaatcatgataccaaaaggcactggggatatcctcgtggactgttccggaggtcagcaacacttcctgaaggataatcttattgacctgggctgcccgaacatccccttgctcgggaagatggccatttacatctgtaggatgtctaatcatcctaaaacaaccatggcgtttctgttctggtttagcttcggatatgttgtgacgtgcatactgtgcaaggtcatcttttacctcttaattgtggtaggcactctgggtaaaaagttcaaacagtatcgggagcttaagccacagacctgtacaatttgcgagactacccccgttaacgctatcgatgccgaaatgcacgacttgaattgttcctacaacatctgcccttattgtgcatcacgcccaacaagtgatgggctggccagacatgtgatgcagtgccccaagaggaaagagaagattgaagagaccgctctatacctcaatctggaacggataccttgggtcgtgcgcaaacttctgcaagtgagcgagtctacgggagtcgcattgaagcgatcctcatggctcgttgtgctgttagtactgctcactgtgagccttagtccagtccagtctgccccgatcggcagaaaacccctgttttccgacagcattgtgaagggcatgaaaaacttgctaaattcgacatctctggagacctccctctcaatcgaagctccttggggagccataaacgttcagagtactttcaagccaacagtgagcgcggcaaacattgccctgtcctggtctagcgtcgagcacagggggaataagatccttgtgtcaggtcggagtgaatccatcatgaaactggaggaacgtaccggcattagctgggacttgggggtagaggatgcttctgagtcaaagctcctgacggttagtgtgatggacttaagccagatgtactcccccgtctttgaatatctgtctggagatcgccaagtggaggaatggcctaaagccacctgtacaggcgactgcccagagagatgtggttgcacttcgagcacctgtctacacaaggaatggccccattccaggaactggcggtgcaatccgacatggtgctggggcgtcgggactggatgtacctgctgtggcctcgatgtgaaagacctgttcacagattacatgtttatcaagtggaaggttgagtatattaaaaccgaggcaatagtgtgcgtagaacttacttcacaggagcgacagtgtacgttgatcgaagctgggacacgcttcaacctgggacctgtcaccattactctcagtgagcccagaaatatccaacagaagctgccacctgagatcgtgacccttcaccccaggattgaagagggtttctttgacctgatgcatgttcagaaagtgttgtctgccagcacagtctgcaagctccagtcctgtacccacggcgtgccaggggatctgcaagtataccacataggaaacttactgaaaggcgacaaggtgaatggtcatctaatccacaagattgaaccccatttcaacacttcatggatgagctgggatgggtgcgacctccactattactgtaatatgggcgactggccttcttgcacatatacgggagttacccagcataaccacgcggcctttgtcaatatgctgaacatcgagactgattacaccaaaaatttccactttcattccaagcgggtgacagcacacggcgacacaccacagcttgatttgaaagctcgcccgacttacggggccggagaaattaccgtgctggtcgaggttgctgacatggagctccatacgaagaaaatcgaaataagtggtctgaagttcgccagcttaacctgtacaggctgctatgcatgttcttccgggatctcatgcaaggtgaggattcacgtggatgagcccgacgaactgactgtacacgtcaaaagtgaggatcctgacatcgtggccgctagctcgtcccttatggcgagaaagttggaatttggaaccgattctacattcaaagcatttagcgccatgccaaagacttcactctgcttctacattgttgagcgtgagtattgtgaaagttgctccaaagaggacacccagaagtgtgtgaacacgaaactggaacaaccccagtctatcctaatagagcataagggcacaattatcggtaagcagagcaatacctgcactgctaaagcctcctgttggctggaatcagtcaagagctttttctacgggctcaaaaacatgctgagtggcatttttggaaacgtgttcatcggcgttttcttgtttttcgcaccttttatacttctgatcttattctttatgttcgggtggcggattctcttttgcttcaagtgttgccgaagaacaaggggactgtttaaatatcgccaccttaaggatgacgaggagaccggctaccggaagatcattgaaagactgaataacaaaaagggtaaaaataagttgctcgatggggagaggctggccgaccgcaaaatcgctgaactattctctactaagacccatatagga

SEQ ID NO: 10566 - RNA, 2916 nt, synthetic construct
  misc_feature 1..2916: note = derived and/or modified CDS sequence (opt3) from CCHFV(Matin, Artificial)__AF467769.2__Gn-4aa-Gc
  source 1..2916: mol_type = other RNA
agcgaggaatccggcgacgattgcatctctagaacccagctgctcaggacagagactgccgaaattcactcagacagttacgggggacccggtgataagataacgatctgtaacggcagcaccgtggtcgaccaacggcttgggtccgagctgggatgctatacaattaatcgcgttaaatctttcaagttgtgtgaaaactcggctactggcaaatcatgcgagatcgatagcacccctgtgaagtgtcgacagggtttttgcttaaaaattacacaggaggggcgtggacatgtaaagctgagtagaggctccgaagtggtcctagacgcatgtgattctagctgcgagatcatgataccaaagggcaccggggacatcctcgtggattgttccggaggtcagcaacacttcctgaaagacaatcttattgatctgggctgcccgaacatccccttgctcgggaagatggccatttacatctgtaggatgtcaaatcatcctaaaactacaatggtttttctgttctggtttagtttcggatatgtgataacctgcattctgtgcaaggtcatcttttacctcttaattgtggtaggcacgctgggtaaaaagttcaagcagtatcgggaacttaaaccacagacttgtaccatctgcgagacaactcccgttaacgcgatcgacgctgagatgcacgatttgaattgtagctacaacatttgcccttattgtgcctctcgcctgacctccgacgggctagcaagacatgtgatgcagtgcccaaagaggaaagaaaagatagaggaaacagagctctacctgaatcttgaacggatcccctgggtcgtgcgcaaactgttgcaagtgtcagagagcaccggagtcgccctcaagcgaagttcttggctggttgtgttactggtactccttacggtgtccctgagccctgtccagtcggctccaattggcagaaaaccgttgtttctagactctatcataaagggcatgaagaacctgctcaattccacttcactggagacaagtcttagcattgaagcaccctggggagccatcaacgtgcagtccaccttcaaacctactatgtctgctgccaatatcgcgctgagctggtcaagtgttgagcacagggggaacaagattttggtgtccggtcggagcgaatctatcatgaaactcgaggaacgtacaggcatttcatgggatctgggggtcgaggacgcaagtgagagcaagttactgaccgtgtccgtaatggatctatctcagatgtactcgccagtttttgaatatctcagcggagaccgccaagtggaggaatggcccaaagccacgtgtaccggcgattgccctgagagatgtggttgcacatcctcaacttgtctgcacaaggaatggccacatagtaggaattggcggtgcaaccccacctggtgctggggcgtcgggacaggatgtacttgctgtggccttgacgtgaaggatttgttcaccgactacatgtttgtcaaatggaaggtggagtatataaaaacagaggttatcgtgtgcgtagaactgacctctcaggagcgacagtgtagcctcattgaagctgggactcgcttcaacctgggaccggtcacgatcacactttccgagcctagaaatatccaacagaagctgcccccagagattgtgaccttgcaccctaggatagaagagggtttctttgatctcatgcatgttcagaaagtgctgtcagccagcactgtctgcaagttacagtcttgtacccacggcgtgcccggggacctgcaagtataccacatcggaaacctactcaagggcgataaagtgaatggtcatctgattcacaagatcgaaccacatttcaacacatcctggatgagttgggacgggtgcgaccttgattattactgtaatatgggcgactggcccagctgctcttataccggagttactcagcacaaccatgcagcttttgtcaatatgttgtccattgagacagattacacgaaaaacttccactttcactcaaagcgggtgaccgcccatggcgacactcctcagctggatctcaaagcgcgcccaacatacggggccggagaaatcaccgtgctggtcgaggttgcagacatggagttacacacaaagaagatagaaatcagtggtctgaaattcgctagccttacttgtaccggctgctatgcctgctcgtccgggatttcttgtaaggtgagaatccatgtggatgagccggacgaattgacggtacacgtcaaaagcgaggatcccgacattgtggctgcctcaagttccctcatggcaaggaagctggaatttggaaccgattctacattcaaagcctttagcgctatgcctaagacttccctatgcttctacatcgttgagcgtgagtattgtaaatcatgcagcaaggaagacacccagaagtgtgtgaatacaaaactggagcaaccacagagtatactcattgaacacaagggcactatcattggtaaacagaacgatacctgcacggcgaaggcatcttgttggctggagtccgtcaagagctttttctacgggcttaaaaatatgttgtcgggcatctttggaaacgtgttcataggcatcttcctgtttttagcccccttcgctctcctgattctgtttttcatgtttgggtggcggatccttttctgctttaagtgttgccgaagaacaaggggattgttcaaatatcgccatctcaaggacgacgaagagaccggctaccggaaaattatcgagagactgaataacaagaaaggtaagaataagctactggatggggaaaggctcgccgaccgcaaaatagcagagctgttttcaactaagacacacgttgga

SEQ ID NO: 10567 - RNA, 2916 nt, synthetic construct
  misc_feature 1..2916: note = derived and/or modified CDS sequence (opt3) from CCHFV(Baghdad 12, Artificial)__AJ538197.2__Gn-4aa-Gc
  source 1..2916: mol_type = other RNA
agcgaggagtccggcgacgattgcatctctagaaccaggctgctccggacagagactgccgaaattcacggggactcatacggaggtcccggcgataagataacgatctgtaacgggagtaccattgtggaccagcgccttggaagcgagatgggctgctatacaatcaatcgagtcaaatccttcaagctgtgtgaaaactctgctactggtaaatcgtgcaagattgattcaatccctgttaaatgtcgtcaagggtactgcttgaagataacccaggagggaagaggccatgtgaagttaagcaggggcagtgaggtagtgctggacgcatgtgattcctcttgcgaagtcatgatcccaaaagggacaggagacattctagtggattgtagcggtggccagcagcactttctcaaggacaatctgatcgatcttgggtgcccgaacattcccctgttgggaaaaatggccatctatatatgtcggatgtccaatcatcctaagaccactatggcgttcctcttttggttctcatttggctacgttattacatgcatcctgtgcaaagctattttctatctgctcatcatcgtgggtaccttagggaagcgctttaagcaatacagagagctgaaaccacagacgtgtactatttgcgaaaccacacccgtcaacgccatagacgcagagatgcacgatcttaattgtagttataacatctgcccttactgtgccagcaggttgacttctgacggactggctcggcatgtgacccagtgcccaaagcgcaaagagaaggtagaagagacagaactatacctcaatctggagcgaatcccctgggttgtgagaaaacttctgcaggtctccgaatcaaccggcgtggcattgaagaggagcagttggctcattgtgctgttagtcctgctcgccgtttcttccagccctgtgcaatcggctccaataggccggaaaccgcttttcctggactctattgtaaaggggacgaagaacttgctaaattccacttcactggagacaagtctcagcatcgaggccccctggggagcgatcaacgtgcagtccacctataaacctactgtctctacagcaaatattgccctgagctggtcaagtgtggaacaccgtggtaacaagatccttgtttccggccgcagcgagtctattatgaaactggaagagagaaccgggatatcatgggatttgggagtggaagacgctagtgagagcaagctcctgacggtctccgtgatggatttatctcagatgtactcgccagtatttgagtatctgagcggcgacaggcaggttgaagagtggcccaaagccacctgtacaggtgattgccctgaacggtgtgggtgcactacctccacatgtctacacaaggagtggccacattcacgaaattggcgctgcaaccccacttggtgctggggcgtgggaaccggctgtacatgctgtgggctcgacgtcaaggatctgttcaccgactacatgtttgtgaaatggaaggtcgaatatatcaaaactgatgcaattgtgtgcgttgagcttacgagtcaagagagacagtgttctttgatcgaagctggaacaaggttcaacctgggtagcgtgaccatcactctctccgagccgcggaatattcagcaaaagctgcctcccgaaataatcacccttcacccacgcattgaggagggctttttcgacctgatgcatgtacagaaagtcttgtcagccagcacagtgtgcaagctccagtcttgtacccacggggttcctggagatcttcaggtgtaccacatcggcaacttactgaagggtgacaaagtcaatgggcatctaattcacaagatcgaaccccatttcaacacttcctggatgagttgggacggctgcgatctcgactattactgtaatatgggagattggccaagctgcacatacacgggcgtgacccaacacaaccatgcgtcttttgtaaatctgcttaacatagagactgactatacaaaatccttccactttcactcaaagagagtgaccgcccatggggatacaccccagttggacctgaaagttaggcctacttacggagctggtgaaatcaccgtcctcgtggaggtggctgatatggaactgcacacgaagaagattgagatcagtggcttaaaattcgccagcctgacctgtacagggtgctatgcttgctcgtccggaatttcttgtaaggtccgtatccatgttgacgagccagatgaacttactgtgcacgtgaaaagcgacgatccggacgtagtcgccgcatcaagttccttgatggcccggaagctcgagtttggcaccgattctacattcaaagcatttagcgcgatgcccaagacttccctgtgcttctacatagtggaacgagagtattgtaaatcatgcagcaaggaagacacccagaagtgtgttaatacgaaactagagcagcctcaaagtattctgatcgagcacaagggtacaattatcgggaaacagaacaatacctgcactgcaaagacatcttgttggctcgaatccgtgaaatcgtttttctacggcctgaagaacatgcttagcggaatatttggcaatttctttatggggatcttcttgttcctggccccatttattttactcatcctgttctttatgttcggatggaggattctgttttgcttcaagtgttgcagacgcacccggggcctgtttaaatatagacatttgaaggacgatgaggaaactggttacaggcgcatcatagagcgactcaacaataaaaaggggaaaaacaagctgctagacggagaacggctggctgatcgtagaattgccgaactcttctcaaccaagacacacatcggc

SEQ ID NO: 10568 - RNA, 2916 nt, synthetic construct
  misc_feature 1..2916: note = derived and/or modified CDS sequence (opt3) from CCHFV(VLG/TI29414, Artificial)__AY179961.1__Gn-4aa-Gc
  source 1..2916: mol_type = other RNA
agcgaggaacccggcgacgattgcatctccagaacccagctgctcagggccgagcctgctgaaattcacgacgataactacgggggaccaggtgacaagataacaatctgtaatggctctactattgtggatcaacggcttgggtcagagctgggatgctatacgatcaaccgcgtcaaaagtttcaagttgtgtgaaaatagcgcaaccggcaaaacatgcgagattgactccactccggttaagtgtcgacagggtttttgcttaaaaatcacccaggaggggcgtggacatgtgaagctgtctagaggctcggaagtagtgctagatgcctgtgactcaagctgcgaggtcatgatacccaagggcacaggggatatcctcgtggactgtagtggaggtcagcaacacttcctgaaagataaccttattgacctgggctgccctcatatcccattgctcgggaagatggcgatttacatctgtaggatgtccaatcacccccggaccactatggcttttctgttctggttttctttcggatatgttataacatgcatcttttgcaaagccctgttctacagcctcattattatcggcaccttaggtaagaaaatcaagcagtatcgcgaactgaagcctcagacgtgtactatttgcgagaccgcaccagtgaacgccatagatgctgagatgcatgaccttaattgttcctacaacatctgcccctattgtgcatcaagattgacaagtgacgggctggccaggcacgtccctcagtgcccaaaacggaaggaaaaagtggaggaaactgagctatacctcaatctggaacgcattccgtggaacgtacgaaaacttctgcaagttagcgagtctaccggagtggctttgaagagatcctcatggctcatcgtcctgttagtgctgctcacagtgagccttagtcccgtccagtctgcccctgttggcaggaagccactgtttttggattccatagtgaaaggcatgaagaatctactgaacagcaccaatctcgagacgtcgctgtctattgaagcgccctggggagcaatcaacgtacagtccactttcaagcctacagtgtcaaccgccaatatcgctcttagttggagctccgtcgagcaccgggggaacaaaattctggtgactggtcgttctgaaagcatcatgaagttggaggaacgcacaggcgtttcatgggacctcggggtggaggatgccagtgagtccaaactgttaaccgtcagcattatggacctgtctcagatgtactcaccagtgtttgaatatctaagtggagatagacaagtagaggaatggcccaaggcaacgtgtaccggcgactgcccggagaggtgtggttgcacaagctccacttgtctccataaagaatggcctcactctcggaactggcgatgcaatcccacctggtgctgggaggttgggacaggctgtacttgctgtggatggaacgtgaaggatctgttcaccgaccatatgtttgtcaagtggaaagtggagtacataaagacagaagctatcgtctgcgtggagcttacctcgcaggaacgccagtgtagcttgattgaggccggcactagattcaatctggggccagttacgatcacactctccgagcctaggaacatccaacagaaactgcccccagaaattataacccttcaccccaaggtggaggaaggattctttgatctgatgcacgtacagaaagtcttgtcagcgagtactgtgtgcaagctccagtcttgtacccatggtatccctggcgacctgcaagtttatcacattgggaatttactgaagggagatcgggtgaacggccatctaatccacaaaattgagccacatttcaatacaagctggatgtcctgggacggttgcgacctcgattactattgtaacatgggggactggccgtcatgcacctacactggcatgacacagcacaatcacgccgcatttgtcaacctgcttaatatcgaaacggattataccaagactttccattttcacagcaaacgcgtgacagctcatggagacacaccccagttggatctgaaggccagacctacctacggcgctggggagataactgtactcgtggaggttgccgacatggaactgcacaccaaaaaggtcgagatctctggattaaagttcgcatccctggcctgtacgggttgctacgcttgcagtagcggcatttcttgtaaagtgaggatccacgtggatgaaccagacgagcttaccgtccatgttaagtccaacgatcccgacgtgattgcggcatcaacaagtttgatggcccgtaaactcgaatttgggactgatagcaccttcaaggctttttcggccatgcctaaaacatccctgtgcttctatatcgcagagcgggagtactgtaagtcttgcagcgaagaggacactcagaaatgtgtggataccaagctagaacaaccacagtcaatactgattgagcacaagggaacgatcattggcaaacagaatgacacatgcaccgccaaggctagttgttggctcgaatccgtaaaatctttcttttatggtctgaagaacatgcttgggagcgtctttggcaatttcttcatcggaatattgctgtttttagcccccttcgtgctcctggttctgtttttcatgtttggctggaaaatccttttctgctttaagtgttgccgaagaactagggggttgctcaagtaccgcctgctaaaagacgatgaggagacaggatatcggagaattatcgaaaggctgaacaacaagaaaggcaagaatcgcctcctggacggtgagcgacttgcagatcggaaaattgcggaattgttctccaccaagactcatatcggg

SEQ ID NO: 10569 - RNA, 2916 nt, synthetic construct
  misc_feature 1..2916: note = derived and/or modified CDS sequence (opt3) from CCHFV(TADJ/HU8966, Artificial)__AY179962.1__Gn-4aa-Gc
  source 1..2916: mol_type = other RNA
agcgaggaatccggcgacgattgcatctctagaacccagctgctcaggacagagactgccgaaattcacggggacgattacggaggtcccggcgacaagataacgatctgtaacgggtcaaccattgtggatcaacggcttggaagtgagctgggctgctatacaatcaatcgcgtcaagagcttcaagttgtgtgaaaactccgctactggtaaaaattgcgagattgactctgttcctgtgaagtgtcgacaggggtactgcttaaaaatcacccaggagggacgtggccatgtaaagctgtcgagaggctcagaagtggtcctagatgcatgtgacagcagttgcgaggtgatgataccaaaggggacaggagatatctccgttgactgttctggtggccagcaacactttctcaaagataacctgattgaccttgggtgcccgaagatccccctgttgggaaaaatggccatttatatctgtaggatgagcaatcatcctaagaccactatggcgttcctcttttggttctcctttggctacgtgataacacggattctgtgcaaagctatcttctatctgctcattatcgtcggtaccttagggaagcgctttaagcagtacagagaactgaaaccacagacgtgcactatctgtgagaccacacccgccaacgcaattgatgccgagatgcacgaccttaattgctcatataacatatgtccttactgcgctagtaggttgactagcgacggactggcacggcatgtgacccagtgtccaaagcgcaaagaacgagtagaggaaacagagctatacctcaatctggaaagaatcccctggattgttaggaagttgctgcaagtgtctgagtccaccggcgtcgccttgaaacggtcaagctggctcatcgtgctgttagtgctgttcacggtcagtctctctcctgttcagtccgctccaataggccgtcgcccgctttttctggatagcattgtgaaggggatgaaaaacccccttaattcgacttctctagagacatccctgtcaatcgaagccccttggggagcgatcaacgtacagagtacctataagccaactgtgagcacagcaaatattgccctctcctggtctagcatcgagcacagaggtaacaatattctggtctcaggcaggagtgaatccataatgaaacttgaggaacggaccgggatcagcggagacctgggcgtggaggatgcttctgagtcaaaattgctcacggttagtgtgatggacctgagccagatgtactcccccgtcttcgaatatttatctggtgatcgacaagtggaggaatggcctaaggcaacctgcacaggggactgtccagagcgctgcggctgtacttcgtcaacctgcctgcacaaagaatggccccattccagaaactggaggtgtaacccgacatggtgctggggagtaggcactgggtgcacctgttgcggactagatgttaaggacctctttattgattacatgttcgtgaaatggaaggtcgactatatcaagacagaggccatcgtgtgtgtcgagctgacctcacaggaacggcagtgcagtcttgtggaggctggtactcgctttaatttgggccctgttacgattacactgtctgaacccagaaacatacaacagaaactcccacctgagatcattaccctgcaccccaggatcgaggaagggttcttcgatcttatgcatgtgcagaaggtactgagcgcctccactgtctgtaaattgcagtcatgcacccacggagtgccaggcgacctccaagtttaccacattggtaatctgttaaagggggacaaagagaacggccatctgatccacaagatagaaccccattttaatacaagctggatgtcttgggatggatgtgacctagattattactgcaacatgggcgactggccttcctgtacctacactggggtgacacagcacaatcatgcgagtttcgtcaacctcctgaatatcgagacggattataccaagagctttcacttccactctaaacgtgtgactgcccatggagacacaccacagcttgatttgaaggcacggccgacctacggtgctggcgaaattacagtactggtggaggttgccgacatggagctccacactaaaaagatcgaaattaccgggctgaaatttgcttccttaacgtgcaccggatgttatgcctgctcaagtggcatcagctgcaaggtccgaatacatgtggatgagcccgacgaactgacagtgcacgtcaagtcggatgaccctgatgttgtggcagcctcctctagccttatggctagaaaattggagttcggtactgactcaacctttaaggcgttcagtgcaatgccaaaaacatccctctgtttttacattgtggaaagggagtatcgcaagtcttgcagcaaagaggacactcagaagtgtgtaaacaccaaactggaacaaccccagtccatcctaattgagcacaaggggacgatcataggcaagcagaataacacatgcaccgccaaagctagctgttggctggaaagcgtcaagagtttcttttacggactcaaaaatatgctgtctggcatcttcgggaacgtgtttgttggaattttccttttcttggccccttttatcctgttaattctcttctttatgttcggctggcggatcctgtcctgctttaagtgttgcagaaggactcgcggtcttctgaaacatcgacacttgaaggatgacgaggaaacagggtatcggcgtataattgagagactcaataacaagaaaggaaagaacaaactgctagatggcgagaggctggcagaccgccggatcgccgaactcttcagcaccaagactcatatcggt

SEQ ID NO: 10570 - RNA, 2916 nt, synthetic construct
  misc_feature 1..2916: note = derived and/or modified CDS sequence (opt3) from CCHFV(Hodzha, Artificial)__AY223476.1__Gn-4aa-Gc
  source 1..2916: mol_type = other RNA
agcgaggaatccggcgacgattgcatctctagaacccagctgctcaggacagagactgccgaaattcacggggacgattacggaggtcccggcgacaagataacgatctgtaacgggtcaaccattgtggatcaacggcttggaagtgagctgggctgctatacaatcaatcgcgtcaagagcttcaaattgtgtaaaaactccgctactggtaagtcttgcgaaattgactcgacccctgttaaatgtcgacaggggtactgcttaaagatcacacaggagggacgtggccatgtgaagctgtcaagaggcagcgaggtagtgctagatgcatgtgacagttcctgcgaagtcatgataccaaaagggaccggagatatcctcgtggactgttctggtggccagcaacactttctgaaggataatcttattgacctggggtgcccgaggatccccttgctcggaaaaatggccatttatatctgtcggatgagcaaccatcctaagactacaatggcgttcctgttttggttctcctttggctacgttataacctgcattctgtgcaaagctatcttctatctcttaattatcgtgggtacgctggggaagcgctttaagcagtacagagagcttaaaccacagacttgtaccatctgcgaaacaactcccgccaatgcaattgatgccgagatgcacgacttgaactgttcatataatatatgcccttactgtgctagtaggctgaccagcgacggactagcacggcatgtcacacagtgcccaaagcgcaaagagaaggtggaagagaccgaactctacctgaaccttgagcgaatcccctggattgtaagaaaactgttgcaagtttctgaatccacgggcgtggccctcaagaggtcaagctggctgatcgtcttactggtcctcttcgctgtgagtctttctcctgtgcagtccgccccaataggccggcgtccgctgtttttggatagcattgttaaagggactaagaatctactgaactcgacatctctcgagacctccctgtcaatcgaggcgccctggggagcaatcaatgtgcagagtacttataagcctacagtaagcaccgccaacattgctctttcctggtctagcgtggaacaccgcggtaataaaatcctggtctcaggcagaagtgagtccattatgaagttggaagagaggacggggataagctgggacctcggagtggaagatgcctctgagtcaaaactgttaaccgttagtgtgatggacctgagccagatgtactccccagtcttcgagtatctatctggcgatcggcaagtggaagagtggcccaaggcaacatgtactggtgactgccctgaacgatgtgggtgcacctcgagcacatgtctccacaaagagtggccacattcccgcaactggagatgcaatcccacttggtgctggggcgtaggaaccggctgtacatgctgtgggctggatgttaaggacctttttaccgattacatgttcgtgaagtggaaagtcgactatatcaagactgaagctattgtgtgcgtcgagttgacgtcacaggagaggcagtgtagtctggtggaagccggaacacggtttaacctcggtccggttaccatcactctgtctgagcctcgcaacatccaacagaaacttcccccagaaattataaccctgcaccctagaatcgaggagggcttcttcgatttgatgcatgtgcagaaggtactcagcgcgtccacagtctgcaaactgcagtcatgtacccacggggtgcccggagacttacaagtttaccacattggcaatctgctaaagggtgacaaggtgaacgggcatctcatccacaaaattgaaccacattttaatactagctggatgtcttgggatggctgcgacctggattattactgtaacatgggagactggccctcctgcacatacacgggcgtcacccagcacaatcatgccagtttcgtgaaccttttgaatatcgagactgattatacaaagagctttcacttccactctaaaagggtaaccgcacatggggacacacctcagctggatctcaaggctcgtccaacttacggagccggtgaaataaccgtgctggttgaggtcgctgacatggaattacacacgaaaaagatcgagattaccggcctgaagtttgcctcccttacatgtactgggtgctatgcatgctcaagtggaatcagctgtaaagtgcggattcatgtggatgagccggacgaattgaccgtccacgttaagtcggatgaccccgatgtggtggccgcttcctctagcctcatggcgcgaaaactggagttcggcacagactcaacttttaaggcattcagtgccatgcctaaaacctccctatgcttttacatcgtagaaagagagtattgtaagtcttgcagcaaagaagacacgcagaagtgtgtcaacacaaagctggagcaaccacagtccatactcattgagaggaaaggtaccatcattgggaagcagaataacacttgcacagctaaagcctcatgttggctggaaagcgtgaagagtttcttttacggccttaaaaatatgttgtctggaatcttcggcaacgtttttgtggggatattcctgttcttagcaccctttatcctcctgattcttttctttatgttcggatggcgcatcctgttttgcttcaagtgttgccggagaaccaggggcttgtttaagtataaacacctcaaggatgacgaggaaactggttaccgccgaattatcgagcggctgaataacaaaaaggggaaaaataagctactggatggagaacgtctcgccgacagaaggatagctgagctgttctccaccaagacacatattggc

SEQ ID NO: 10571 - RNA, 2916 nt, synthetic construct
  misc_feature 1..2916: note = derived and/or modified CDS sequence (opt3) from CCHFV(Kosovo/9553/2001, Artificial)__AY675511.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatcgcgaggatgtccaatcacccaaaaacaaccatggcttttctgttctggttttctctgggatatgttataacgtgtattctctgcaaggccttattctacagcctgatcattatcggcactcttggtaaaaagatcaagcagtatcgggaattgaaaccccagacctgcacaatttgtgagactgcacctgtgaacgccatagatgctgagatgcatgacctgaattgctcctacaacatctgtccatattgcgcatcacgcctaaccagtgacgggctcgccagacacgtcaagcagtgtcccaaaaggaaggaaaaagtggaggaaacagagctgtaccttaatctggaacggattccttgggtagttcgcaagttgctccaagtgagcgagtctaccggagtcgctctgaaacgatcctcatggttaatcgtgctgctcgtgcttctgacggtcagcttgagtccagttcagtctgccccggtgggcagaaagcccctatttctggattccatagtaaagggcatgaaaaacctcctgaatagcacttcgcttgagacatctctgtccattgaagcgccttggggtgcaatcaacgtgcagtcaaccttcaagccaactgtcagtacagccaatatcgctttgagctggtcctctgtggagcacaggggaaacaaaattctcgttaccggtcggagcgaatcaatcatgaagctggaggaacgtacgggcgtgagttgggacttaggggtcgaggatgcctccgagagcaaactgctaaccgtgtctattatggacctctcacagatgtacagtcccgtatttgaatatctgagcggagatcgccaagttgaggaatggcctaaggcaacatgcactggcgactgtccagagagatgcggttgtacctcctctacatgccttcataaggaatggccccactcgaggaattggcggtgtaacccgacttggtgctggggcgtggggaccggatgcacatgttgcggcgtcgatgtgaaagacttgttcaccgatcatatgtttgtcaagtggaaagtggagtacataaagactgaggctatcgtttgtgtggaactgacgagccaggagcgacagtgctccctcattgaagccgggacacgcttcaacctgggacctgtaaccatcactctttcagagcccagaaatatccaacagaaactgccacctgagattataaccttgcaccccaagatcgaagaggggtttttcgacctcatgcacgtccagaaggtgctgagtgcgtctacagtttgtaaattacagagctgcacccatggcattccaggggatctgcaagtgtatcacatcggaaacctactcaagggcgacagggtcaatggtcatctgattcacaaaatcgaaccccatttcaacacttcctggatgtcatgggacgggtgtgatcttgactactattgcaatatgggcgattggcctagctgtacatacacgggagtgacccagcacaaccacgccgcatttgtaaatttgctgaacatagagactgactatacaaagaccttccattttcactctaaacgggtgacagctcatggcgatactccacagctcgacctgaaggcccgcccgacctacggggctggagaaatcacggttttagtcgaggtggccgatatggagctgcacaccaagaaagtggaaatttccggtcttaagttcgcaagtttggcctgcacaggctgttacgcttgcagctctgggatctcctgcaaagtcaggattcacgttgacgagcccgatgaactcactgtgcatgtgaagtcaagtgaccctgatgtagtcgcggcaagcacctcgctgatggccagaaaactagagtttggaacagactccactttcaaggctttttctgccatgccaaaaaccagcctgtgtttctatatcgtggaaaaggagtactgcaagtcatgtagtgaggatgacacgaaaaagtgcgttgacacaaaactcgaacagccccaatccatactgattgagcaccgtggcaccatcattggtaagcctaatgatacttgtccagcaaaaacatcttgctggcttgaaagcgtgaagtcctttttctatgggttgaagaacatgctgggctcagtctttggaaatttctttatcggcatattactcttcctggcccccttctttctttggatgctgagcttcatgtttgggtggaaaatcttgttctgttttaagtgctgtcggcgaaccagaggactcttcaaatacaggcatctgaaggacgatgaggaaactggctatcgccggattatcgagagactaaacaataaaaagggtaagaacaggctgctcgacggggagcgcctggctgatcgaaaaattgccgaactttttagtaccaagacacacatcgga

SEQ ID NO: 10572 - RNA, 2916 nt, synthetic construct
  misc_feature 1..2916: note = derived and/or modified CDS sequence (opt3) from CCHFV(SPU41/84, Artificial)__AY900142.1__Gn-4aa-Gc
  source 1..2916: mol_type = other RNA
agcgaggaatcctctgacgattgcatctcaagaacccagctgctcaggacagagactgccgaaattcacggcgacaactacgggggacccggtgataagataacgatctgtaatggcagtaccgtggtcgaccaacggcttgggagcgagctgggatgctatacaattaaccgcgttaaaactttcaagttgtgtgaaaattccgctaccggcaaatcttgcgagatcgattcggtgcctgtaaagtgtcgacagggttactgcttaaaaattacacaggaggggcgtggacatgtgaagctgtcaagaggcagcgaagtcgtgctagacgcatgtgataccagttgcgaggttatgatcccaaagggcactggggacatactcgtggattgttccggaggtcagcaacactttctgaaagacaaccttatcgatctgggctgcccgaagattcccttgctcgggaaaatggccatctatatttgtaggatgtctaatcatcctaagacaaccatggcgttcctgttttggttcagctttggatacgtcatcacgtgcataatttgcaaagtgatcttctatctgctcattatcgtaggcactttaggtaagcggtttaagcagtaccgcgaactgaaaccacagacctgtacaatctgcgagactacccccgttaacgctattgacgccgagatgcacgatcttaattgttcctataacatatgcccttactgtgcatcaagattgacaagtgacgggctggccaggcatgtgacccagtgcccaaagcggaaagaaaaggtcgaggaaacggagctatacctcaatctggaacgcatcccctgggtggtgcgaaaacttctgcaagtcagcgagtctactggagttgctttgaagagatcctcatggctcgtggtactgttagtgctgctcacagtcagccttagtcctgtgcagtctgcaccaatttccaggcggccgctgttcttggacagcatcgttaaaggcatgaagaacctactgaatagcacctctctcgagacttccctgtcaatagaagccccctggggcgctattaacgtgcagagtacatataagcctaccgtcagcacggccaatatcgcgctttcctggtctagcgtggagcaccgtgggaacaaaatcctggtatcaggacgcagtgaatccattatgaagttggaggaaagaaccggtatcagctgggatctcggcgttgaggacgcatctgagtcaaaactgttaacagtgagtgtcatggatctgagccagatgtactccccagtgtttgaatatctatctggggacaggcaagtcgaggaatggcccaaggccacttgtaccggagattgccctgagcggtgtggctgcacatcgagcacttgtctccacaaagaatggccacattcccgaaattggcgctgcaaccccacctggtgctggggtgtggggacaggctgtacctgctgtggactggacgttaaggatcttttcactgactacatgtttgtgaagtggaaagtagagtatattaagacggaggctatagtctgcgtggaattgacatcacaggagagacagtgtagtctgatcgaagccggcaccaggttcaacctcgggccggttactattaccctgtctgagcctcggaatatccaacagaaacttcccccagagatcattacactgcaccctcgcatagaagagggatttttcgatttgatgcatgtgcagaaggtcctcagcgcatccaccgtgtgcaaactgcagtcatgtactcacggtgtacccggcgacttacaagtgtaccacatcgggaacctgctaaagggagataaggttaatggccatctcgtccacaaaattgaaccacatttcaacacaagctggatgtcttgggacggttgcgacctggattattactgtaatatgggggactggccctcctgcacgtacaccggcgtgactcagcacaaccatgctagttttgtgaatatgcttaacatcgagacagattataccaagaatttccactttcacagcaaaagagtcacagcccatggagacactcctcagttggatctgaaggcgaggccaacctacggcgccggggaaattacggttctcgtggaggtggcagacatggagctgcacaccaaaaagatcgaaatatctggattaaagttcacatccctgacttgtaccggttgctatgcttgctcaagtggcatcagctgtaaagtacgtattcatgtcgatgagccggacgaacttacagtgcacgttaagtcggaggatcccgacgtggtcgccgcttcctctagcttgatggcccggaaactcgaatttgggactgattcaaccttcaaggcatttagtgccatgcctaaaacgtccctgtgcttctacatcgtggagcgagagtattgtaagtcttgcagcgaagaggacacacagaaatgtgttaacaccaagctagaacaaccacagtccattctgatcgagagaaagggaactataattggcaaacagaataacacatgcaaggctaaagcgggttgttggctcgaatcagtgaagtcgtttttctacgggctgaaaaatatgcttagtggcatctttggaaacgtattcattggcatctttttgttcctggcacccttcatattactcatcctgtttttcatgtttgggtggaggattcttttctgctttaagtgttgccgccggaccagaggactgttcaagtataggcacttgaaagatgacgaggagactggctaccgcaagatcattgaacgactcaataacaaaaagggtaaaaacaagctgctagacggggagcggctggccgatcgtagaatcgctgaactcttttctaccaagacacatatagga

SEQ ID NO: 10573 - RNA, 2916 nt, synthetic construct
  misc_feature 1..2916: note = derived and/or modified CDS sequence (opt3) from CCHFV(UG3010, Artificial)__AY900143.1__Gn-4aa-Gc
  source 1..2916: mol_type = other RNA
gccgagggcgtgagcaacgactgcgtctccagaacccagctgatcaagacagaagttgctgagattcacgaagattcttacgggggacccggtgagaaaataactatctgtaatggctcaacgattgtggaccaaaggctcgggagtgaacttggatgctataccatcaaccgggtaaagacatacaaactgtgtgagaatagcgcaactgagaagggctgcgaaattgattccgtgcctgtcaaatgtaagcagggtttctgcttgaaggtgacccaggaggggcgcggacatgttaaattatctcgaggcacagaaatcgtgctggacgtctgtgatacctcgtgcgagctaatgataccaaagggcactggggacatcctcgtggattgttcaggaggtcagcaacactttctgcaggacaaccttattgatctgggctgcccgaatgtacccttgctcgggaaaatggccatctatatttgtcgtatgagcaaccatcctaagacaaccatggcgttcctgttttggttcagttttggatacgttatcacgtgcatagtgtgcaaagtcctgttctatctcttaattgtgatcggcactctgtccaagaagctgaaacagtacagagagttgaagccacagacctgtattgtgtgcgaatctacacccgtcaatgctatcgacgccgagatgcacgaactgaactgtaattataacatctgcccttactgtgcaagcaggctaacttccgatggtctcgttcggcatgtgaatcaatgcccaaaacgcaaggagaaagtagaagagaccgagctgtaccttaacctggaaaggattccctggttggtgagacggctcctgcaggtctcagagagtacagggatggccttaaagcgcagctgttggatgaccacgctgctcatacttctggtggtttctttgtcccctgtgcagtcagctccagtcggacgaaaaccgctatatctggacagcatcgcaaagggcatgaagagtctccttaattctactaaccttgaaacatccctgagcattgaggccccctggggcgctatcaatgtgcagtcgacctttaaacctactgtatctgccgcgaacatagcattgtcctggtcaagtgttgaacacagagggaacaagattctcgtgagcggaaggtccgagtctatcatgaaactggaggaacggacaggtatcagctggtcattaggcgtcgaggatgccagtgaatccaagaccctgacggtgagcgtcatggacctatctcaaatgtactcaccagtgttcgagtatctcagtggggaccgtcaggttgaagagtggcccaaagctacctgcacaggagattgtcaggagcgctgcggctgtactagctctacctgcctgcacaaggaatggcctcattccagaaattggaggtgcaacccaacatggtgttggggtgtggggactggctgcacctgttgcggacttgacgtacgggatttgtttacagactacatgatggtcaagtggaaagtggagtatgttaagaccgaagccattatgtgtgtggagctgacttcgcaagagcgacagtgcagcctcatcgaagcaggcacgcgcttcaatctggggcccgtcacaattaccctttccgagccgagaaacatacagcagaggctgccttcagaaatcgtgactttgcaccccaaaattgaggaaggatttttcgatctcatgcatgtacaaaaggtgctgagtgcttctaccgtttgtaaattacagagctgcacacacggtgtcccaggcgacctacaggtgtaccacgtggggaatctgctcaagggagataaggtcaacggccattccatccacaaaatcgagtcacattttaataccagctggatgtcttgggacggttgtgatctggactatttctgcaacatgggggattggccttcctgtacttacacaggcgttacgcagcacaatcgggccgcgttcattaacatgcttaatatagagaccgactacactaagacatttcatttccacagtaaacgcgtgaccgcccacggagacacaccccaattggatctgaaggcaagaccaacttatggcgctggggaagtgaccgtactcgtcgaggtggccgacctggaattacatacgaaaaagatcgaggttagcggactgaagtttgcttctcttacctgctccggttgctacgcctgttcaagtggcattagctgcaaagtgaggatccacgtcaacgaacccgatgagttcacagtgcatgttaagtcgtccgaccctgatgtggtagcagccgggtctagcttgatggctcgtaaaattgagtttggagcggactcaactttcaaggcatttagttccatgccgaaaaattctctctgtttctatatcgtcgaacgggattactgcagctcctgtaccaacgacgatacacagaagtgcgtggacactaaactggagcacccacagtcaatactaatcgaacacaagggcaccattatcggtaagcagaatgatacgtgtagcacaaaaaccagttgctggctggagtctgtgaagtcctttttctatgggctcaaaaacatgctgggcggaatttttggcaacgtcttccttgggatctttttgttcctggcccccttcgctttactcatatttttctttttctttggatggcgactgcttttctgtctgaagtgctgtagaaggactcgcggcttgctcaaatacaagcaactgaaggacgaagaggaggccggttataaaaagattatcgaacggctaaatgataaaaaggggaaaagcagactgtttgacggagagaggctcgcagaccgcaagattgccgaactgttctcgacaaagacccatatcggc

SEQ ID NO: 10574 - RNA, 2916 nt, synthetic construct
  misc_feature 1..2916: note = derived and/or modified CDS sequence (opt3) from CCHFV(Hy13, Artificial)__AY900145.1__Gn-4aa-Gc
  source 1..2916: mol_type = other RNA
agcgaggaatccggcgacgattgcatctctagaacccagctgtcaaggacagagactgccgaaattcacagtgacaactacgggggacccggtgataagataacgatctgtaatggcagcaccattgtggaccaacggctcgggtccgagcttggatgctatacaatcaaccgcgtcaaatctttcaagctgtgtgaaaattcggctactggcaaatcatgcgagattgatagcacccctatcaagtgtcgacagggtttttgcttgaaaataacacaggaggggcgtggacatgttaagttaagtagaggctccgaagtggtactggacgcatgtgattctagctgcgagatcatgattccaaagggcaccggggacatcctagtggattgttccggaggtcagcaacacttcctcaaagacaacctgattgatcttggctgcccgaatatccccctgttggggaagatggccatatacatttgtaggatgtcaaaccatcctaaaactacaatggcgtttctcttctggtttagtttcggatatgtcattacctgcatcctgtgcaaggtgatcttttacctgctcatcgttgtgggcacgttaggtaaaaagttcaagcagtatcgggaactgaaaccacagacttgtaccatttgcgagacaactcccgtcaatgctatagacgccgagatgcacgatcttaactgtagctacaatatctgcccttattgtgcatctcgcttgacctccgacgggctggccagacatgtgatgcagtgcccaaagaggaaagaaaaggtagaggaaacagagctatacctcaacctggaacggattccctgggttgtgcgcaaacttctgcaagtctcagagagcaccggagtggctttgaagcgaagttcttggctcgtggtcctgttagttctgctcacggtgtcccttagccctgtacagtcggcaccaatcggcagaaaaccgctgttttctgactccatagtgaagggcatgaagaatttgctaaactcaactagcctggagacaagcctctccattgaagccccctggggagctatcaatgtccagtctaccttcaaacctactgtgagcgccgcgaacatcgcactgtcatggagttccgttgagcacagggggaataagattcttgtgagcggtcggtctgaatcaatcatgaaactggaggaacgtacaggcattagttgggatttgggggtcgaggacgccagcgagtccaagctcctgaccgtgtctataatggatttatcgcagatgtacagcccagtatttgaatatctgtccggagaccgccaagttgaggaatggcccaaagctacgtgtaccggcgattgccctgagagatgtggttgcacatcaagtacttgtctacacaaggaatggccacattctaggaactggcggtgcaaccccacctggtgctggggcgtggggacaggatgtacttgctgtggcctcgacgtcaaggatctgttcaccgaccacatgtttgtgaaatggaaggtcgagtacatcaaaacagaggccattgtgtgcgttgaacttaccagccaggagcgacagtgttccttgatcgaagcagggactcgcttcaatctgggaccggtgacgatcacactctcagagcctagaaacattcaacagaagctgcccccagagatagtaacccttcatcctaggatcgaagagggtttctttgatctgatgcacgtcaaaaaggtgttgagcgcttctactgtttgcaagctccagtcctgtacccacggcgtgcccggggacctgcaggtctatcatattggaaatttactgaaaggcgataaggtgaacggtcacctaatccataaaattgaaccacacttcaatacaagttggatgagctgggacgggtgcgacctcgattactattgtaacatgggcgactggccctcttgctcctacaccggagtaactcaacataatcacgccgcgtttgtgaacatgctgaatatcgagacagattatacgaagatattccactttcattcaaaacgggttaccgcccacggcgacactcctcagcttgatttgaaggcacgcccaacatacggggctggagaaatcaccgtcctggtggaggtggccgacatggagctccatacaaagaaaattgaaatcagtggtctgaagttcgctagcttaacttgtaccggctgctacgcctgctcgtccgggatttcttgtaaagtcagaatccacgttgatgagccggacgaactgacggtgcacgtgaagagtgaggatcccgacatagtagcagcctcaagttcccttatggctaggaaattggaatttggaaccgattctacattcaaggcgtttagcgcaatgcctaaaacttccctctgcttctatattgtcgagcgtgagtactgtaagtcatgcagcaaggaagacacccagaaatgtgtgaacacaaagctggagcagccacaaagtatcctaattgaacataaaggcactatcataggtaagcagaatgatacctgcacgtctaaagccgggtgttggctggagtccgttaagagctttttctatggcctcaagaacatgctgtcgggaatctttggcaatgtgttcattgggatcttcttgtttcttgctcccttcattctgttaatcctctttttcatgtttggatggcggatactgttctgctttaaatgttgccgaagaacaaggggccttttcaagtaccgccacctgaaagacgacgaagagaccggttatcggaagattatcgagagattgaacaataaaaaggggaagaacaaactcctggatggagaaaggctagccgaccgcaagatcgcagagctgttttcaactaaaacacatattggc

SEQ ID NO: 10575 - RNA, 2916 nt, synthetic construct
  misc_feature 1..2916: note = derived and/or modified CDS sequence (opt3) from CCHFV(Semunya, Artificial)__DQ094832.1__Gn-4aa-Gc
  source 1..2916: mol_type = other RNA
gccgagggcgtgagcaacgactgcgtctccagaacccagctgatcaagacagaagttgctgagattcacgaagattcttacgggggacccggtgagaaaataactatctgtaatggctcaacgattgtggaccaaaggctcgggagtgaacttggatgctataccatcaaccgggtaaagacatacaaactgtgtgagaatagcgcaactgagaagggctgcgaaattgattccgtgcctgtcaaatgtaagcagggtttctgcttgaaggtgacccaggaggggcgcggacatgttaaattatctcgaggcacagaaatcgtgctggacgtctgtgatacctcgtgcgagctaatgataccaaagggcactggggacatcctcgtggattgttcaggaggtcagcaacactttctgcaggacaaccttattgatctgggctgcccgaatgtacccttgctcgggaaaatggccatctatatttgtcgtatgagcaaccatcctaagacaaccatggcgttcctgttttggttcagttttggatacgttatcacgtgcgtggtctgcaaagtgctgttctatctcttaatagtgattggcactctgggtaagaagctgaaacagtacagagagttgaagccacagacctgtatcgtctgcgaatccattcccgttaatgctatcgacgccgagatgcacgaactgaactgtaattataacatctgcccttactgtgcatctaggctaacaagcgatgggctcgtgcggcatgtaactcaatgcccaaaacgcaaggagaaagtggaagagaccgagctgtaccttaatctggaaaggattccctggttggtcagacggctccttcaggtgtccgagtcaacaggaatggccttaaagcgcagttgttggatgaccacgctgctcatacttctggttgtgagcttgtctcctgtccagtccgctccagtgggccgaaaaccgctatttctggactcaatcgcaaagggcaagaaaagcctcctgaacagtactaatcttgaaacatctctgtccattgaggccccctggggagctatcaacgtacagagcaccttcaagcctactgtttcggccgcgaatatagcattgtcttggtcctcagtggaacacagagggaacaaaattctcgtcagtggtaggagcgagtccatcatgaagctggaggaacggacaggcatctcttggagcttaggggtggaggatgcctcagaaagtaaaaccctgacggtctccgtgatggacctaagccaaatgtattctccagtttttgagtacctctcaggagaccgtcaggtggaagagtggcccaaggctacctgcacaggcgattgtcctgagcgctgcggttgtactagcagtacctgcctgcacaaggaatggccacattccagaaactggaggtgcaatcccacatggtgttggggcgtagggactggatgcacctgttgcggccttgacgtccgggatttgttcacagactatatgatggtgaaatggaaggttgagtacgtgaaaaccgaagccattatgtgtgtcgagctgacttctcaggagcgacaatgctcgctcatcgaagcagggacgcgctttaacctgggaccggtgacaattacccttagcgagcctagaaatgtacagcagaggctgccctccgaaatagtgactttgcacccaaagatcgaggaaggtttctttgatctcatgcatgttcagaaagtcctgttctgtaagtattcattacaagctaccagttgcacacacggcgtgcctggggacctacaggtgtaccacgtcggaaacctgctcaagggcgataaagttaatggtcattctattcacaagatcgagagccatttcaacacctcctggatgtcatgggacgggtgtgatctggactatttttgcaatatgggcgattggcccagctgtacttacacaggagtgacgcagcacaaccgggccgcgttcgtgaatatgcttaacatcgagaccgactacactaaaacatttcatttccactctaagcgcgtaaccgcccacggcgacacaccacagttggatctgaaagcaagacccacttatggggctggagaagtcaccgtgctcgttgaggtggccgacctggaattacatacgaagaagattgaggtctccggtctgaaatttgctagtcttacctgcagcggctgctacgcctgttcttccgggatatcatgcaaggtgaggatccacgttaatgaacctgatgagttcacagtgcatgtaaaaagtaacgacccagatgtcgtggcagccggaagctcgttgatggctcgtaagattgagtttggcgcggactccactttcaaagcattttctagcatgccgaaaaattcactctgtttctatatcgtggaacgggattactgcagttcctgtaccgacgatgacacacaaaagtgcgtcaacattaagctggagcacccccagtctatcctaatagaacacaagggtactatcattgggaaacagaatgatacctgtcctacgaagacaagctgctggctggagtccgttaaatcatttttctatggcctcaagaacatgctgggaggcatctttgggaacgtgttccttggaattttcttgtttctggccccattcgctttactcatcctgtttttctttttcggctggcgacttctgttttgtttgaaatgctgtagaaggacccgcggtctcctgaagtacaagcagctaaaagacgaagaggaggccgggtataagaaaataattgaacggctgaatgataagaaaggaaagagcagactcttcgacggcgagaggctggcagaccgcaagatcgccaaactttttagtactaagacacatattggt

SEQ ID NO: 10576 - RNA, 2916 nt, synthetic construct
  misc_feature 1..2916: note = derived and/or modified CDS sequence (opt3) from CCHFV(SPU128/81/7, Artificial)__DQ157174.1__Gn-4aa-Gc
  source 1..2916: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaagagcttcaaattgtgtgaaaattccgctactggcaaatcttgcgagattgagtcggttccagtgaagtgtcgacagggttactgcttacgtatcacccaggaagggagaggacatgtaaaactgtcaaggggcagcgaggtggtcctagatgcatgtgacacaagttgcgaaataatgatcccgaagggcaccggggatattctcgtggactgttccggaggtcagcaacactttctgaaggataaccttatcgacctgggctgccccaaaattcctttgctcgggaagatggccatctatatatgtcggatgtctaatcatccaaaaactacaatggcgttcctgttttggttcagctttggatacgttattacctgcatcctgtgcaaggctattttctatctcttaatcatcattggcacgctgggtaaacgctttaagcagtacagagagcttaagccccagacttgtaccatatgcgagacaactcctgtgaacgccatcgatgcagaaatgcacgacttgaattgttcctataacatttgcccatactgtgcctcaaggctgaccagtgatgggctagctcggcatgtcacacagtgccccaaacgcaaggagaaagtggaagagaccgaactctacctgaatcttgagcgaatcccttgggtagttagaaagctgttgcaagtgagcgagtctacgggagtcgcactcaaaaggtcctcatggctgatagtgttactggtcctcttcactgtgagccttagtccagttcagtctgccccgattggccggaagcccctgtttttggactccatcgtgaaaggcatgaagaacctactgaatagcacatcgctcgaaacctctctgtccatcgaggctccttggggagccattaacgtacagtcaacttataagccaacagtgagtaccgcgaatatcgcacttagctggtcctctgtcgaacaccgtgggaacaaaattctggtgagcggtcgctcagagagtataatgaagttggaagagagaacgggcatctcctgggacctcggggttgaggatgccagcgaatctaaactgttaaccgtgtcagtcatggacctgagtcagatgtacagccccgtgttcgagtatctatccggagataggcaagtagaagagtggcctaaggctacatgtactggcgactgcccagaacggtgtggttgcacctcttcgacatgtctccacaaagagtggccccatagccgaaattggcgctgcaacccgacttggtgctggggcgttgggaccggatgtacatgctgtggcctggatgtgaaggacctttttaccgattacatgttcgtcaagtggaaagtggagtatattaagactgaagccatcgtctgcgtggagttgacgtcccaggaaagacagtgttcactgatcgaggcagggacaaggtttaacctcggacctgttaccattactctgagtgagccccggaatatacaacagaaacttccacctgaaatcattaccctgcacccccgcatcgaggaaggtttcttcgacttgatgcatgtgcagaaggtactctctgctagcacagtctgcaaactgcagtcctgtacccacggcgtgccaggggatttacaagtttaccacattggaaacctgctaaagggcgacaaggtgaatggtcatctcatccacaaaatagagccccattttaacacttcatggatgagctgggatgggtgcgacctggactattactgtaatatgggcgattggccttcttgcacatacacgggagtcacccagcacaaccatgcctccttcgtgaatcttttgaacatcgaaactgactatacaaagaattttcacttccacagtaaaagagtaaccgcgcatggcgatacaccacagctggacctcaaggccaggccgacttacggggcaggagagattaccgtgctggttgaggtcgctgatatggaattacacacgaaaaagatcgagattagcggtctgaagtttgcctctcttacctgtacaggctgctatgcttgctcctcagggatcagttgtaaagtgcgtatacatgtggacgaacccgatgagttgactgtccacgttaagagcgacgatcctgacgtggtggccgcatcgtcctctctcatggcccggaaactggaatttggaaccgatagcacatttaaggctttctcagcgatgccaaaaacttccctatgcttttacattgtagagcgagagcactgtaagtcctgctctgaagaggacaccaaaaagtgtgtcaacacgaagctggaacagccccaaagcatcctcattgagcataaaggcacaatcataggtaagcagaatagtacctgcactgcaaaagcctcatgttggctggaaagcgtgaagagtttcttttatgggcttaaaaacatgttgtctggcatcttcggaaatgtttttattggcatcttcctgttcttagggccttttattctcctgatccttttctttatgttcggatggagaatactgttttgcttcaagtgttgcaggcgcacacggggcttgctcaagtacagacacctgaaagaggatgaggaaaccggttataggcgcattatcgagcgactaaacaataagaaagggaagaacaaactgctcgacggagaacggctggctgaccgtagaatcgccgagcttttctccactaagacccatattggc

SEQ ID NO: 10577 - RNA, 2916 nt, synthetic construct
  misc_feature 1..2916: note = derived and/or modified CDS sequence (opt3) from CCHFV(ROS/HUVLV-100, Artificial)__DQ206448.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaagagatcctcatggctcatagtcctgttagtgctgctcacggtgagccttagtccggtccagtctgctcccgttggcaggaagcctctgtttttggattccattgtgaaaggcatgaagaacctactgaatagcacttcgctcgagacatctctgtccatcgaagccccatggggagcgatcaacgtacagtcaaccttcaagcccactgtgagtacagcaaatattgcccttagctggtcctctgtcgagcaccgggggaacaaaatcctggtgaccggtcgtagcgaatcaattatgaagttggaggaacgcacgggcgttagttgggacctcggggtggaggatgcttccgagagcaaactgttaaccgtctctataatggacctgtcacagatgtacagtcctgtgtttgaatatctaagcggagatagacaagtagaggaatggccaaaggccacatgtactggcgactgccccgagaggtgtggttgcacctcctctacatgtctccataaagaatggccgcactcgcggaattggcgatgcaaccctacttggtgctggggcgttgggaccggatgtacatgctgtggcgtggatgtcaaggacctgttcaccgatcatatgtttgtgaagtggaaagtcgagtacatcaagactgaggcaattgtgtgcgttgaacttacgagccaggagcgccagtgttccttgatcgaagctgggacaagattcaacctgggacccgtgaccatcactctctcagagccaaggaatattcaacagaaactgcctcccgagataatcacccttcacccaaaggtagaagagggtttctttgacctgatgcacgtccagaaagtgttgagtgcctctacagtttgcaagctccagagctgtacccatggcattcccggggatctgcaagtgtatcacatcggaaacttactgaagggcgaccgggtcaatggtcatctaattcacaaaatcgaacctcatttcaacacttcctggatgtcatgggacgggtgcgatctcgactactattgtaatatgggcgattggccaagctgcacatacacgggagtgacccagcacaaccacgcggcctttgtaaatctgcttaacatagagactgactatacaaagaccttccattttcactctaaacgcgtgacagcacatggcgatactccgcagttggacctgaaggctagacccacctacggggccggagaaatcacggttctcgtcgaggtggctgatatggagctgcacaccaaaaaggtggaaatttccggtttaaagttcgccagtctggcatgtacaggctgctacgcctgcagctctgggatctcctgtaaagtcaggattcacgttgacgagcctgatgaacttactgtgcatgtgaagtcaagtgacccagatgtagtcgctgcgagcacctcgttgatggcacgtaaactcgagtttggaacagactccactttcaaggccttttctgctatgcccaaaaccagcctgtgcttctatatcgtggaacgggagtactgtaagtcatgcagtgaggaagatacgcagaaatgtgttgacacaaagctagagcaacctcagtccatactgattgaacacaagggcaccatcattggtaaacagaatgacacttgcacagccaaggcatcttgttggctcgagagcgtgaaatcctttttctatgggctgaagaacatgcttggctcagtctttggaaatttcttcatcggcatattgctgtttttagccccattcgtgctcctggttctgtttttcatgtttgggtggaaaatccttttctgctttaagtgttgccgaagaaccaggggattgctcaagtaccgcctgctaaaagatgacgaagagactggctatcggagaattatcgagaggctgaacaataagaaaggtaagaaccgcctcctggatggggaacgacttgctgaccggaaaattgccgagttgttcagcaccaagacacatatcgga

SEQ ID NO: 10578 - RNA, 2916 nt, synthetic construct
  misc_feature 1..2916: note = derived and/or modified CDS sequence (opt3) from CCHFV(AP92, Artificial)__DQ211625.1__Gn-4aa-Gc
  source 1..2916: mol_type = other RNA
agcgagggcggggacggaggttgcatctccagaacccagctgattaagacagaaactgccgaggtgcacggcgatgactacgggggacccggcgagaaaataacgatctgtaacggttctaccattgtcgatcaaaggctcgggtcagagcttggatgctatacaatcaatcggattaagagtttcaaactgtgtgaaaacagcgctcagggcaagaattgcgagatcgactccgcacctgttcagtgtcgccagggctactgcttgaaaatatctcaagaggggcgaggacatgtgaagttatcgcgtggttcagaaatcgtactggatgtgtgtgacactagctgcgagattatgatcccaaagggcaccggggatattctagtcgactgtagtggaggccagcagcactttctccagtccaacctggtggatcttggttgcccgaatatccccctgttggggaaaatggccatatatatttgtagaatgtctaaccatcctaagacaaccatggcgttcctcttttggttcagctttggatacgttatcacttgcattctgtgcaaaacactgttctatatcctcatcattataggcaccttaggcaagaaactgaagcaatacagggaacttaagccacagacgtgtactatctgcgagtccgtgcccgtcaatgctattgacgccgagatgcacgatttgaactgttcatataatatctgcccttactgtgcaagtcggctgaccagcgaagggctaacacgccatgtgaaccagtgcccaaaaagaaaggagaaagtagaagagactgaactctacctgaatcttgagaggataccctggattgttcggaagctgctccaggtgtctgagtccaccggagtcgccttgaaacgctcaagctggatgatcgtgctgttaatcctgctcattgtgagtatgtctcctgtccaatccgctccaatcagccgaaagccgctttttctggactcgattgcaaaaggtgttaagaacttgctaaattctacatccctggaaacctcactcagtatagaggccccctggggcgctatcaacgcccagagcacgtataagcctactgcgtcctctgcaaatattgccctgacatggagctcagtggaacacagagggaacaaaatccttgtaagtggaaggtccgagagcatcatgaagctggaagaacggaccggcatttcttggaacttgggtgtggaggatgcttcagaaagtcgtactctcacaataagcgtcatggacctgtcccagatgtactctccagtgttcgagtatttatcgggggaccgccaagttgaagagtggcccaaagccacctgtacgggcaattgccctgaaagatgtggatgcaccagctccacatgtctgtacaaggagtggccacactcaaggaactggcggtgcaatcccacttggtgctggggcgtggggaccggatgtacatgctgtggtctagatgtcaaagagctctttactgaccatatgctggtgaagtggaaggtagaatatatcaaaaccgaggcaattgtttgcgtggaacttacaagtcaggagcgacagtgttctttgatcgaggctggcacccgcttcagcctggggccggtcactattacgctctccgaacctagaaacatccagcaaaagctgcccccagagcttataacactgcaccctaaaatcgaagatggatactttgacttgatgcatgtgcagaaggtcatgtcagccagcaccgtgtgcaaactccagtcttgtactcacggcgttcccggtgatctgcagatttatcacgtggggaatttactgaagggcgacagggtaaacggacatctaatccacaaggtcgagccacatctcaatacctcctggatgagttgggatggctgcgacctggattacttctgtaacatgggggactggcccagctgcacatacaccggagtgactcaacacaatcatgcggcctttgcaaaccttttgaatattgaaacagattatacgaaaaccttccacttccactctaagcgggttactgctcatggtgacacacctcagctggacctcaaagcccgcccaagatacggcgctggggagatcaccgtgctggtcgaggtggccgatatggaattacacacaaagaaagtagaggtgactggactgaagtttgcatcccttacctgttcaggctgctatgcctgcagtagcggtatatcgtgtaaggttaggattcatgtcgacgaaccggatgagttgacggtgcacgtgaaatcctctgaccccgatatcgtcgctgcgagctcaagtctcatggcacgtaagattgagttcggggttgactccacctttaaagccttctctagcatgcctaaggattccctgtgcttttacatcgtggaacgggactattgtaactcatgcaaaaatgaggaaacacagcgatgtgtgaacgctaagctagagcagccacaaagcatactgatcgaacacactggcaccattatcggaaaacagaatgatacatgcggcagtagaacttcttgttggctcgactccttcaagagctttttctacgggctgaagtcgatgctttcaggaatttttggcaacgtattcttgggtatctttctgttcttagccccctttgcactcctgcttttcttctttttctttgggtggaggatactgttctgctttaaatgttgccgccggaccagaggattgttcaagtataggcatattaaagatgacgaggaagtcggctacaagaaaatcatcgagcgcctcaacaataagaagggtaaacaccgactgctagatggcgagcggctggccgaccgtaagattgctgaactcttttctacgaaaacacatatcggg

SEQ ID NO: 10579 - RNA, 2916 nt, synthetic construct
  misc_feature 1..2916: note = derived and/or modified CDS sequence (opt3) from CCHFV(ArD8194, Artificial)__DQ211626.1__Gn-4aa-Gc
  source 1..2916: mol_type = other RNA
gccgagggcgggagcaacgactgcgtgtccagaacccagctggtcaagacagaagttgctgagatccacgaagattcttacggaggtcccggcgagaaaattactatatgtaatgggtcaacgatcgtggaccaaaggctcggaagtgaacttggctgctataccattaaccgggtacgcacatacaagctgtgtgagaatagcgcaactgagaaatcctgcgaaatcgattctgtgcctgtcaagtgtaaacagggtttctgcttgaagattacccaggaggggcgaggacatgtgaagttatcgcgtggcacagaaatcgttctggacgtgtgtgatacctcatgcgagctaatgataccaaaaggcactggggacatcctcgtcgattgtagcggaggtcagcaacactttctgcaggacaaccttattgatctgggctgcccgaatatccccttgctcgggagaacagccatttatgtgtgtaggatgagtaaccatcctaagaccacgatggcgttcctgttttggttctcctttggatacgtaatcacttgcgttgtgtgcaaagtcctgttctatctcttaatagtgattggcaccctgggtaagcggcttaaacagtaccgcgagttgaagccacagacatgtatcgtgtgcgaatctattcccgtcaatgctatcgacgccgagatgcacgatctgaactgtaattataacatctgcccttactgtgcaagcagactaacttccgacgggctcgttaggcatgtgacccaatgcccaaagcggaaagaaaaggtagaggaaacagagctgtaccttaatctggagcgcattccctggttggtgcgaaaactcctgcaggtctcagaaagtaccggagtggccttaaagagaagctgttggatgataacgctgctcatccttctgactgtttctatgtcccctgtgcagtcagctccagtcggcaggaaaccgttgtttctagatcggattgcaaagggcatgaaaagcctgctcaacagtacatctctggagacctcccttagcatcgaagccccctggggagctataaatgtgcagtcgactttcaagcctacagtatctgccgcgaacattgcactgtcctggtcaagtgttgagcacaaggggaataaaatcttggtgagcggtcgttccgaatctatcatgaagctcgaggagcgcaccggcattagctggtgcctgggggtcgaagacgcctcagagagtaaaacgttaaccgtgtccgtcatggacctgagccaaatgtattctccagtgtttgaatacctatcaggagatagacaggttgaggaatggcccaaggctacatgtactggcgactgccctgagaggtgtggttgcaccagtagcacatgcctccacaaagagtggccacattcccggaactggcgatgtaaccccacttggtgctggggcgtggggaccggatgtacatgctgtggcctggatgtaaaggaccttttcaccgattatatgttggtcaagtggaaagtggaatacatcaagactgaggccattatatgcgttgaactgacgtctcaggagcgccaatgttcgctcatcgaggcagggacaagatttaatctgggaccggtgaccattactcttagcgaacctaggaacgtccagcagcggctgcccccagagatcatcaccttgcaccctaaaattgaagagggtttctttgacctcatgcatgtgcagaaggtaatgtccgcttcaacagtgtgcaaactgcaaagttgtacccacggcgttcccggggatttacaggtctatcacgtgggaaatctgctaaagggcgacaaggtgaacggtcattctatacacaaaatcgaaagccatctcaatacttcctggatgtcatgggatgggtgcgacctggattacttctgtaacatgggcgactggccaagctgcacatatacgggagtcacccagcacaatcatgccgcgttcattaacatgcttaatatcgagactgactacacaaagacctttcacttccactctaaacgcgttacagcccatggcgatactccccagttggacctgaaggcaagacctgcttacggggccggagagattaccgtgctcgtggaagtagctgatctggagttacacacgaaaaagatcgaagtctccggtctgaagtttgccagtcttagctgctctggctgttatgcatgctcctcagggataagttgtaaagtgaggatccatgttaacgagccagacgagttcaccgtgcacgtcaagagcaatgatccggacgtggttgccgctggatcgtccttgatggcgcgtaaaattgaatctggcgcagatagcacatttaaggccttctcaagtatgcccaaaaactccctctgcttttacatcgtggagcgggactattgttctagctgcactgatgacgatacccaaaagtgtgtagacattaaactggaacaccctcagtccatcctaatagagcataagggtacaattatcgggaagcagaatgatacttgcccaaccaaaacgtcatgttggctggaaagcattaagagtttcttttacggcctcaaaaacatgctgtctggaatcttcggcaatgtctttcttgggatgttgctgttcttagctccctttatactcctgatccttttcttctttttcggatggcgactgttgttttgcctcaagtgttgcagaaggacacgcaaactgctaaagtataagcatctgcgggacgaggaagagtccggctacaaaaagattatcgagagactcaacgacaaaaagggtaaaagcaggctgttcgatggggaacgccttgccgaccgaaagattgcagagttgttttcgaccaagactcacatcgga

SEQ ID NO: 10580 - RNA, 2916 nt, synthetic construct
  misc_feature 1..2916: note = derived and/or modified CDS sequence (opt3) from CCHFV(ArD15786, Artificial)__DQ211627.1__Gn-4aa-Gc
  source 1..2916: mol_type = other RNA
gccgagggcgggagcaacgactgcgtgtccagaacccagctggtcaagacagaagttactgagatccacgaagattcttacggaggtcccggcgagaaaattacgatatgtaatgggtcaaccatcgtggaccaaaggctcggaagtgaacttggctgctatacaattaaccgggtacgcacttacaagctgtgtgagaatagcgctaccgagaaatcctgcgaaatcgattctgtgcctgtcaagtgtaaacagggtttctgcttgaagattacacaggaggggcgaggacatgtgaagttatcgcgtggcaccgaaatcgttctggacgtgtgtgatacttcatgcgagctaatgataccaaaaggcacaggggacatcctcgtcgattgtagcggaggtcagcaacactttctgcaggacaaccttattgatctgggctgcccgaatatccccttgctcgggcagaccgcaatttatgtgtgtagaatgagtaaccatcctaagacgactatggccttcctgttttggttctcctttggatacgtaataacctgcgttgtgtgcaaagtcctgttctatctcttaatcgtgattggcacactgggtaagaggcttaaacagtaccgggagttgaagccacaaacttgtatcgtgtgcgaatctattcccgtcaatgcgatcgacgctgagatgcacgatctgaactgtaattataacatctgcccttactgtgccagccgcctaacctccgacgggctcgttagacatgtgacacagtgcccaaagaggaaagaaaaggtagaggaaaccgagctgtaccttaatctggagcggattccctggttggtgcgcaaactcctgcaggtctcagaaagtacgggagtggcattaaagcgaagctgttggataatcactctgctcattcttctgacagtttctatgtcccctgtgcagtcagccccagtcggcagaaaaccgttgagcctagatagtatcgctaagggcatgaaatctctgctcaactccaccagcctggagacttcgctttctatagaagcaccctggggtgccattaatgtgcaatccacatttaagcctaccatctcagctgccaacatcgcgctgagttggagctccgtagagcacaagggaaataaaattttggtttctggtaggagcgaatcaatcatgaagctcgaggagcggacgggcattagttggtgcctgggggtggaagacgcatccgagagcaaaaccttaacagtctctgtgatggacctgtcacagatgtatagtccagtcttcgaatacctaagcggagatcgtcaggtggaggaatggcccaaggccacttgtaccggcgactgccctgagcgctgtggttgcacatcctctacttgcctccacaaagagtggccacattcgagaaactggaggtgtaaccccacctggtgctggggcgttgggacaggatgtacctgctgtggcctggatgtgaaggacctttttactgattatatgttggtaaagtggaaagtcgaatacataaagacggaggctatcatttgcgtggaactgacaagccaagagcggcagtgttccctcatcgaggccgggacccgattcaatctgggaccggttactatcaccctttcagaacctcgcaacgtgcagcagagactgcccccagagattataacattgcaccctaaaatcgaagaggggtttttcgacctcatgcatgtccaaaaggtgatgagtgcatctaccgtatgcaaactgcagagctgtactcacggcgtgcccggggatttacaggtttatcacgtcggaaatctgctaaagggcgacaaggtgaacggtcattccattcacaaaatcgaatcacatctcaatacaagctggatgtcttgggatgggtgcgacctggattacttttgtaacatgggcgactggccatcctgcacgtataccggagtgactcagcacaatagggctgccttcattaacatgcttaatatcgagacagactacaccaagacattccattttcacagtaaacgggtcactgcgcacggcgatacaccccaattggacctgaaggcccgccctacgtacggggcaggagagataaccgttctcgtggaagtggctgatctggagttacataccaaaaagatcgaagtaagcggtctgaagttcgcctctcttacttgctccggctgttatgcttgctcaagtgggattagctgtaaagtcagaatccacgtgaacgagccagacgaatttaccgttcatgtgaagtcgaatgatccggacgtcgtggccgcaggatcctctttgatggccaggaaaattgagagcggcgctgattcaacattcaaggcgtttagttccatgcccaaaaactctctctgcttctacatcgttgagcgtgactattgtagctcctgcactgatgacgatacccagaagtgtgtggacataaaactggaacaccctcagtcaattctaatcgagcacaagggtacgattatcgggaagcagaatgatacatgcccaaccaaaactagctgttggctggaaagtataaagtcctttttctacggcctcaaaaacatgctgtctggaatctttggcaatattttccttgggatgttgctgtttttagcacccttcgtactcctgatcctgtttttcttctttggatggcggcttttgttctgcctcaagtgttgccgaagaacaaggaaactgctaaagtataagcatctgcgcgacgaggaagagagcggctacaaaaagattatcgagcggctcaacgacaaaaagggtaaatcgagactgtttgatggggaaaggcttgccgaccgcaagatagctgagttgttctcaaccaagactcacgtcgga

SEQ ID NO: 10581 - RNA, 2916 nt, synthetic construct
  misc_feature 1..2916: note = derived and/or modified CDS sequence (opt3) from CCHFV(ArD39554, Artificial)__DQ211628.1__Gn-4aa-Gc
  source 1..2916: mol_type = other RNA
agcgagtccaacaataacgactgcgtgtctagaacccagctgatcaagacagaaaatgccgagattcacggcgatgactacgggggacccggtgagaaaataactatctgtaacggctcaacgattgtcgaacaaaggctcgggagtgaacttggatgctataccatcaatcggattaagagcttcaaactgtgtgagaactccgcttctggcaagggttgcgagatcgattcgacacctgttaaatgtaagcaggggttttgcttgaagataactcaggaaggacgcggccatgtgaaattatcacgaggcagcgagatcattctggacgtatgtgatagttcctgcgaaatgatgatcccaaaggggtctggagacattctagtggattgtagcggtggccagcaacacttcctccaggacaatctggtcgatcttgggtgcccgaacgtgcccctgttgggaaaaatggcaatctacatatgtcgtatgtccaatcatcctaagaccacaatggcctttctcttctggttttcattcggctatgttattacctgcatcttttgcaaagtgattttctacgtcctgatcatcattggtactctggggaagagaataaagcagtatagggagctcaaaccacagacatgtaccatctgcgaggcgacgcccgtgaacgctattgacgccgaaatgcacgatttaaattgtagttacaacatctgcccttattgtgcaagccggctgacttctgagggacttgtacgccatgttacccaatgcccaaagagaaaagaaaagatagaggaaacagagttgtacctgaatctagagaggattccctggtttgtgcggaaactcctgcaggtctccgaatcaactggcgtggcccttaagcgcagcagttggctggtgaccttgctcgtcctgttaacagtttctctgtcccctgtgcagagcgctccaatcggccgaaaacccctcttccttgactcgaccgcaaagtctatgaagtccctgttgaactcaacgagtctagagactagcctgtccatcgaagccccgtggggtgctattaatgtacagtctacatttaaacctaccgccagcactgcgaacatcgcactctcatggagttccgtggagcacagaggaaacaagattctggtcacaggtaggagcgaatctataatgaaacttgaggagcggaccggcatctcatggaatctgggggtggaagatgccagtgagagcaagacgttgaccgtttccgtgatggacctctctcaaatgtactcgacagtcttcgaatatctgagcggagaccgtcaggtggaggaatggccaaaagctacttgtaccggcgattgccccgagcgctgtggttgcacatcctcaacttgtttacacaaggcctggcctcatagtagaaactggaggtgcaatccaacctggtgctggggcgtagggacaggatgtacctgctgtggcctggacgttaagaacctatttactgattacatgctcattaaatggaaggtggagttcatcaaaacggaagcaatcgtctgcgtggagctgacatctcaggaacggcaatgtagccttattgaggctgggacccgattcaatttgggacccgtcactataaccctgtccgagccgcgcaacatccagcagaagctccctcccgaactggtgacacttcacccaagagttgaggaagggtttttcgacctgatgcatgtgcagaaagtattgtcagccagcaccgtctgcaagctccaatcttgtactcacggcgtgcctggggatctgcaggtttatcacgtgggaaatttactgaagggcgacaaaattaacggtaattcctttcataagatcgagcccaacctaaatacaagttggatgagctgggatgggtgcgacctcgattactattgtaacatgggcgactggccatcttgcacgtacaccggagtcactcagcacaatcatgcggccttcgtgaacctgcttaatattgaaacagattataccaaaaactttcacttccattccaagagggtaacagcacacggcgagactccccagttggacctgaaagctcggcctaagtacggggccggagaggtgaccgttctcgtcgaagtggctgacatggagctgcacacgaagaaaatcgaaatatcaggtttaaagtttgccagtctgacctgtacaggctgctacgcatgcagctcggggatctcctgtaaagtgcgccttcatgtcgatgagccagacgaattgactgttcacgtgaagtctgatgacccggatgtggtagccgctagctcaagtctcatggcgagaaaaattgagttcggaaccgactccacatttaaggcattctctagcatgcccaaagataagctgtgcttttatatcgtcgagagggactactgttcctcatgcagcaaggaagatactcaaaaatgtgtgaacgccaagctagagcagcctcagagtattctgatcgaacataaaggcaccataattggtaagcagaatgacacgtgcacagttaaagctagctgttggctcgagtccgtgaagtctttcttttatgggctgaagaacatgcttggcggaatcttcggcaatgtcattttggggatcataatgttcctggccccatttgcattactcctgcttttctttctgttcggatggcgtatcttgttttgcctccggtgttgccgaagaaccaggggcctgttcaaatacaagcacattaaagatgacgaagagtcgggttataagcgcatcattgagcggctaaacaataaaaaggggaagaacaaactgtttgatggagaaagactcgccgacaagaaaatcgctgagctgttctcaactaagacacacataggc

SEQ ID NO: 10582 - RNA, 2916 nt, synthetic construct
  misc_feature 1..2916: note = derived and/or modified CDS sequence (opt3) from CCHFV(C-68031, Artificial)__DQ211629.1__Gn-4aa-Gc
  source 1..2916: mol_type = other RNA
agcgaggaatccggcgacgattgcatctctagaacccagctgtcaaggacagagactgccgaaattcacagtgacaactacgggggacccggtgataagataacgatctgtaatggcagcaccattgtggaccaacggctcgggtccgagcttggatgctatacaatcaaccgcgtcaaatctttcaagctgtgtgaaaattcggctactggcaaatcatgcgagattgatagcacccctatcaagtgtcgacagggtttttgcttgaaaataacacaggaggggcgtggacatgttaagttaagtagaggctccgaagtggtactggacgcatgtgattctagctgcgagatcatgattccaaagggcaccggggacatcctagtggattgttccggaggtcagcaacacttcctcaaagacaacctgattgatcttggctgcccgaatatccccctgttggggaagatggccatatacatttgtaggatgtcaaaccatcctaaaactacaatggcgtttctcttctggtttagtttcggatatgtcattacctgcatcctgtgcaaggtgatcttttacctgctcatcgttgtgggcacgttaggtaaaaagttcaagcagtatcgggaactgaaaccacagacttgtaccatttgcgagacaactcccgtcaatgctatagacgccgagatgcacgatcttaactgtagctacaatatctgcccttattgtgcatctcgcttgacctccgacgggctggccagacatgtgatgcagtgcccaaagaggaaagaaaaggtagaggaaacagagctatacctcaacctggaacggattccctgggttgtgcgcaaacttctgcaagtctcagagagcaccggagtggctttgaagcgaagttcttggctcgtggtcctgttagttctgctcacggtgtcccttagccctgtacagtcggcaccaatcggcagaaaaccgctgttttctgactccatagtgaagggcatgaagaatttgctaaactcaactagcctggagacaagcctctccattgaagccccctggggagctatcaatgtccagtctaccttcaaacctactgtgagcgccgcgaacatcgcactgtcatggagttccgttgagcacagggggaataagattcttgtgagcggtcggtctgaatcaatcatgaaactggaggaacgtacaggcattagttgggatttgggggtcgaggacgccagcgagtccaagctcctgaccgtgtctataatggatttatcgcagatgtacagcccagtatttgaatatctgtccggagaccgccaagttgaggaatggcccaaagctacgtgtaccggcgattgccctgagagatgtggttgcacatcaagtacttgtctacacaaggaatggccacattctaggaactggcggtgcaaccccacctggtgctggggcgtggggacaggatgtacttgctgtggcctcgacgtcaaggatctgttcaccgactacatgtttgtgaaatggaaggtcgagtatatcaaaacagaggccattgtgtgcgttgaacttaccagccaggagcgacagtgttccttgatcgaagcagggactcgcttcaatctgggaccggtgacgatcacactctcagagcctagaaacattcaacagaagctgcccccagagatagtaacccttcaccctaggatcgaagagggtttctttgatctgatgcatgtcaaaaaggtgttgagcgcttctactgtttgcaagctccagtcctgtacccacggcgtgcccggggacctgcaggtctaccacattggaaatttactgaaaggcgataaggtgaacggtcatctaatccacaaaattgaaccacatttcaatacaagttggatgagctgggacgggtgcgacctcgattattactgtaacatgggcgactggccctcttgctcctataccggagtaactcaacacaatcatgccgcgtttgtgaacatgctgaatatcgagacagattacacgaagatattccactttcactcaaaacgggttaccgcccatggcgacactcctcagcttgatttgaaggcacgcccaacatacggggctggagaaatcaccgtcctggtggaggtggccgacatggagctccacacaaagaaaattgaaatcagtggtctgaagttcgctagcttaacttgtaccggctgctatgcctgctcgtccgggatttcttgtaaagtcagaatccatgttgatgagccggacgaactgacggtgcacgtgaagagtgaggatcccgacatagtagcagcctcaagttcccttatggctaggaaattggaatttggaaccgattctacattcaaggcgtttagcgcaatgcctaaaacttccctctgcttctacattgtcgagcgtgagtattgtaagtcatgcagcaaggaagacacccagaaatgtgtgaacacaaagctggagcagccacaaagtatcctaattgaacacaaaggcactatcataggtaagcagaatgatacctgcacgtctaaagccgggtgttggctggagtccgttaagagctttttctacggcctcaagaacatgctgtcgggaatctttggcaatgtgttcattgggatcttcttgtttcttgctcccttcattctgttaatcctctttttcatgtttggatggcggatactgttctgctttaaatgttgccgaagaacaaggggccttttcaagtatcgccatctgaaagacgacgaagagaccggttaccggaagattatcgagagattgaacaataaaaaggggaagaacaaactcctggatggagaaaggctagccgaccgcaagatcgcagagctgttttcaactaaaacacacattggc

SEQ ID NO: 10583 - RNA, 2916 nt, synthetic construct
  misc_feature 1..2916: note = derived and/or modified CDS sequence (opt3) from CCHFV(Drosdov, Artificial)__DQ211630.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgaggtcatgataccgaaaggcactggggatatcctcgtggactgtagtggaggtcagcaacacttcctgaaggataaccttattgacctgggctgcccccatatccctttgctcgggaaaatggccatttacatctgtagaatgtccaatcacccaaggacaaccatggcgtttctgttctggttttctttcggatatgttataacgtgcatcttttgcaaggctctgttctacagcctcattattatcggcactttaggtaaaaagatcaagcagtatcgggaactgaaaccccagacctgtacaatttgcgagactgcccctgtgaacgcaatagatgccgagatgcatgaccttaagtgttcctacaatatctgcccatattgtgcttcacgcttgaccagtgacgggctggcaagacacgtcacacagtgccccaaaaggaaggaaaaagtggaggaaaccgagctatacctcaacctggaacggattccttggatcgtacgcaaacttctgcaagttagcgagtctacgggagtggccttgaagcgatcctcatggctcatagtcctgttagtgctgctcactgtgagccttagtccagtccagtctgctccggttggcagaaagcccctgtttttggattccacagtgaagggcatgaaaaatctactgaacagcacctcgctcgagacttctctgtccattgaagccccttggggagcgatcaatgtacagtcaacattcaagccaaccgtgagtacggcaaacatcgcccttagctggtcctctgtcgagcacagggggaataaaattctggtgaccggtcggagcgaatcaatcatgaagttggaggaacgtacaggcgttagttgggacctcggggtggaggatgcttccgagagcaaactgttaactgtctctattatggacctgtcacagatgtacagtcccgtgtttgaatatctaagcggagatcgccaagtagaggaatggcctaaggccacctgtacaggcgactgcccagagagatgtggttgcacttcctctacctgtctccataaggaatggccccactcgaggaactggcggtgcaatccgacatggtgctggggcgttgggaccggatgtacttgctgtggcgtggatgtcaaagacctgttcacggatcatatgtttgtgaagtggaaagtcgagtacatgaagacagaggcaatagtgtgcgttgaacttaccagccaggagcgacagtgttccttgatcgaagctgggactcgcttcaacctgggacctgtgaccattacactctcagagcccagaaacatccaacagaaactgccacctgagatcattacccttcaccccaagatagaagagggtttctttgacctgatgcacgtacagaaggtcttgagtgcctctactgtgtgcaaactccagagctgtacacatggcatcccaggggatctgcaaatttatcacatcggaaatttactgaagggcgacagggttaacggtcatctaattcacaaaatcgaaccccatttcaatacgtcctggatgtcatgggacgggtgcgatctcgactactattgtaacatgggcaattggcctagctgcacctacactggagtgacacagcacaaccacgcggcctttgtcaatctgcttaacatagagaccgattatacaaagactttccattttcactctaaacgggtgaccgcacatggcgacacgccacagttggatctgaaggctcgcccgacctacggggccggagaaatcacagtactcgtggaggttgctgacatggagctgcacactaagaaagtcgaaatttccggtttaaagttcgccagtctggtgtgtaccggctgctacgcatgcagctctgggatctcctgtaaagtgaggattcacgtcgatgagcccgacgaacttacagttcatgtgaagtcaagtgatcctgacgtggtagccgctagcacttcgttgatggcgagaaaactcgagtttggaaccgattccatcttcaaggcattttctgccatgccaaaaacgagcctgtgcttctatatagtcgaacgtgagtactgtaagtcatgcagtgaggacgatacaaagaaatgtgtggacaccaagctagaacagccccaatccattctgatcgagcacaaaggcactattatcggtaagcagaatgacacatgcaccgctaaagcctcttgttggctcgaaagcgttaagtcctttttctatgggctgaagaacatgcttggctcagtgtttggaaatttcttcgtcggcatattgctgtttttagcacctttcgtgctcctggttctgtttttcatgtttgggtggaaaatccttttctgctttaagtgttgccggcgaactagaggattgttcaaatacaggcatctcaaggatgacgaggaaaccggctatcgccggattatcgagagactgaacagcaaaaagggtaagaataggctactggatggggagcgcctcgccgaccgaaaaattgctgaactgtttagtacaaagacgcacatcgga

SEQ ID NO: 10584 - RNA, 2916 nt, synthetic construct
  misc_feature 1..2916: note = derived and/or modified CDS sequence (opt3) from CCHFV(Kashmanov, Artificial)__DQ211631.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaagagatcctcatggctcatagtcctgttagtgctgctcacggtgagccttagtccggtccagtctgctcccgttggcaggaagcctctgtttttggattccattgtgaaaggcatgaagaacagcctaaattcgacttctctggagacatccctctcaatcgaagccccatggggagcgatcaacgtacagagtaccttcaagcccactgtgagcacagcaaatattgccctgtcctggtctagcgtcgagcaccgggggaacaaaatccttgtgaccggtcgttcagaaagtattatgaagctggaggaacgcacgggcgtttcctgggacttgggggtggaggatgctagcgagtctaaactcctgaccgtctcaataatggacttaagtcagatgtacagccctgtgtttgaatatctgtccggagatagacaagtagaggaatggccaaaggccacatgtactggcgactgccccgagaggtgtggttgcacctcttcgacatgtctacataaagaatggccgcacagccggaattggcgatgcaaccctacttggtgctggggcgttgggaccggatgtacatgctgtggcgtggatgtcaaggacctcttcaccgatcatatgtttgtgaagtggaaagtcgagtacatcaagactgaggcaattgtgtgcgttgaactgacgtcccaggagcgccagtgttcacttatcgaagctgggacaagattcaacttgggacccgtgaccatcactctgagtgagccaaggaatattcaacagaaactccctcccgagataatcaccctgcacccaaaggtagaagagggtttctttgaccttatgcacgtccagaaagtgctgtctgccagcacagtttgcaagttgcagtcctgtacccatggcattcccggggatctccaagtgtatcacatcggaaacctgttaaagggcgaccggattaatggtcatctgatccacaaaatagaacctcatttcaacacttcatggatgagctgggacgggtgcgatctagactactattgtaatatgggcgattggccatcttgcacatacacgggagtcacccagcacaaccacgcggcctttgtgaatctcctgaacatcgagactgactatacaaagaccttccattttcactccaaacgcgtaacagcacatggcgatactccgcagcttgacttgaaggctagacccacctacggggccggagaaattacggtgctggttgaggtcgctgatatggagctccacaccaaaaaggtggaaatcagtggtctgaagttcgccagcttagcatgtacaggctgctacgcctgttcttccgggatttcatgcaaagtgaggatccacgtcgacgagcctgatgaactgactgttcatgtgaagagtagcgacccagatgtggtagctgcgtcgacctcccttatggcacgtaaattggagtttggaacagactctactttcaaggcctttagcgctatgcccaaaacctcactctgcttctatatagtcgaacgggagtactgtaagagttgctccgaggaagatacgcagaaatgtgtggacacaaagctggagcaacctcagtctattctaatcgaacacaagggcaccattatcggtaaacagaatgacacttgcacagccaaggcaagctgttggctggagtccgttaaatcatttttctatgggctcaagaacatgctgggcagcgtgtttggaaatttcttcataggcatccttttgtttctggccccattcgtcttactcgtgctgtttttcatgtttgggtggaaaattcttttctgctttaagtgttgccgaagaaccaggggactgttgaagtaccgccatctcaaagatgacgaagagactggctatcggagaatcattgagaggctgaacaataagaaaggtaagaaccgcctactggatggggaacgactcgctgaccggaaaatcgccgagctgttcagtaccaagacacacatagga

SEQ ID NO: 10585 - RNA, 2916 nt, synthetic construct
  misc_feature 1..2916: note = derived and/or modified CDS sequence (opt3) from CCHFV(Oman, Artificial)__DQ211632.1__Gn-4aa-Gc
  source 1..2916: mol_type = other RNA
agcgaggaatccggcgaggactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaaatctttcaagttgtgtgaaaattccgctactggtaaatcttgcgagattgacaacacccctgttaagtgtaaacaggggttttgcttaaagatcacacaggaaggacgaggccatgtgaagctgtcgcgtgattcagaggtagtgctagacgcatgtgatagcagttgcgaaataatgatcccaaaaggcaccggggacattctcgtcgattgttccggaggtcagcaacacttcctgaaggacaatcttatcgatctgggctgcccgaacattcccttgctcgggaaaatggccatctacatatgtagaatgtctaatcatcctaagactacaatggcgtttctgttctggtttagcttcggatatgtgattacctgcatcctgtgcaaagttatcttttacctcttaattgtggtcggcacgctgggtaagaagttcaaacagtatagggagcttaagccacagacttgtaccatctgcgagacaactcccgtgaacgctattgacgccgaaatgcacgatttgaattgttcctacaacatatgcccttattgtgcatcacggctgaccagtgacgggctagcccgccatgtaatgcagtgcccaaaaagaaaggagaaaatcgaagagacagaactctacctgaatcttgagaggattccctgggttgtgcggaagctgttgcaagtcagcgagtctaccggagtggctctcaaacgctcctcatggctgatcgtgttactggtcctccttacggttagcctgagtcctgtgcagtctgcaccaataggccgaaagccgttgtttctagactccattgccaagggcatgaaaaacctgctcaatagcacttcgctggaaacatctctttccatcgaggctccctggggagccatcaacgtacagtcaaccttcaagcctactgtgagtacagcgaatattgcactgagctggtcctctgtcgaacacagagggaacaaaatcttggtgagcggtaggtcagagagtattatgaagctcgaggagcggaccggcatatcctgggatctgggggttgaggacgccagcgaatctaaattactgacggtgtcagtcatggatctaagtcagatgtacagcccagtgtttgagtatctctccggagaccgtcaagtagaagagtggcccaaggctacctgtacaggcgattgccctgaacgctgtggttgcacttcttcgacctgtctgcacaaggagtggccacatagcagaaactggaggtgcaatcccacatggtgctggggcgttgggactggatgtacctgctgtggccttgacgtgaaagatttgttcacagactacatgtttgtcaagtggaaagtggagtatatcaagaccgaagccattgtctgcgtggagctgacttcccaggaacggcagtgttcactcatcgaggcagggacgcgattcaacctgggaccggttacaatcacccttagtgagcctcgcaatattcaacagaaactgcccccagaaatagtgactttgcaccctagaatcgaggaaggtttctttgatctcatgcatgtacagaaggtcctgtctgctagcaccgtgtgcaagttacagtcctgtacacacggcgttcccggggacctgcaagtgtaccacattggaaacctactcaaaggcgataaggtcaatggtcatctgatccacaaagtggagccacatttcaacacctcatggatgagctgggacgggtgcgaccttgattattactgtaatatgggcgactggccctcttgcacttatacaggagtaacgcagcacaaccatgccgcgtttgtgaatttgctgaacattgaaaccgattacactaagaatttccactttcactccaaaagggttacagcccatggcgacacccctcagctcgatctgaaggcacggccaaactacggggctggagaggtcacagtgttagtggaggtcgccgacatggaactgcacactaagaaaatcgagataagtggtcttaagttcgctagcttgacctgtacgggctgctatgcctgcagctccgggatctcatgtaaagttcgcattcatgtggatgaaccggacgagctcaccgtgcacgtaaagagtgaagatcccgacatcgtcgcagccagctcgtccctgatggctagaaaactagagtttggaacagattctactttcaaggcgtttagcgcaatgcctaaaacctcactgtgcttctacattgtggagagggaatattgtaagagttgctccaaggaggacacacagaaatgtgttaatgccaagctcgaacgtccacaatctatcctgatagagcacaaaggcactattatcggtaagcagaacgatacctgcacggctaaagccagctgttggcttgaatccgtgaagtcatttttctacgggttgaagaatatgctgagcggcatttttggaaacgtcttcatcggcatattcttatttctcgcacccttcatcctgcttattctgtttttcatgtttgggtggcggatcttgttctgctttaaatgttgccgaagaacaaggggactcttcaagtatcgccatctgaaagacgacgaggagaccggctaccggaagattatcgaaagactaaacaataaaaagggtaagaacaaactgctcgatggggagaggctggccgaccgcaagatagctgaactttttagtactaaaacacacattgga

SEQ ID NO: 10586 - RNA, 2916 nt, synthetic construct
  misc_feature 1..2916: note = derived and/or modified CDS sequence (opt3) from CCHFV(SPU97/85, Artificial)__DQ211633.1__Gn-4aa-Gc
  source 1..2916: mol_type = other RNA
agcgaggaatccgacggcgattgcatctctagaacccagctgctcaggacagagactgccgaaattcactcagacaactacgggggacccggtgataagataacgatctgtaatggcagtaccattgtggaccaacggcttgggagcgagctgggatgctatacaatcaaccgcgtcaaatccttcaagttgtgtgaaaattctgctactggcaaatcgtgcgagattgattcaacccctgttaagtgtcgacagggtttttgcttaaaaatcacacaggaggggcgtggacatgtgaagctgagcagaggcagtgaaatagtactagacgcatgtgattcctcttgcgagatcatgattccaaagggcaccggggacatcctcgtggattgtagcggaggtcagcaacacttcctgaaagacaaccttattgatctgggctgcccgaatatccccttgctcgggaggatggccatatacatttgtcggatgtccaaccatcctaagactacaatggcgtttctgttctggttttcattcggatatgtcattacctgcatcctgtgcaaagtgatcttttacctcttaatcgttgctggcacggtgggtaagaaattcaagcagtatcgcgaactgagaccacagacttgtaccatttgcgagacaactcccgtcaatgccatagacgcagagatgcacgatcttaactgtagttacaatatctgcccttattgtgccagcaggttgacctctgacgggctggctcggcatgtgatgcagtgcccaaagcgcaaagaaaagattgaggaaacagagctatacctcaacctggaacgaatcccctgggtagttagaaaacttctgcaagtgtccgagtcaaccggagtcgcattgaagaggagcagttggctcacggtgctgttagtgctgctcatagtctctctttcccctgttcagagcgccccaattggccggaaaccgctgtttttggactcgatcgtgaagggcaaaaagaatctactgaactctacttccctcgagacatcactgagtatcgaagctccctggggagccattaatgtacagagcaccttcaagcctactgtgtccgcggcaaacatcgccctttcttggagctcagtcgagcaccgtgggaataaaattctggtgagtggtcgctccgaaagcataatgaagttggaggaaagaacaggcatctcttgggatctcggggttgaggacgcttcagagagtaaactgttaaccgtgagcgtcatggatctgtcccagatgtactctccagtgtttgaatatctatcgggagacaggcaagtagaggaatggcccaaggccacgtgtaccggcgattgccctgagcggtgtggttgcacaagctccacttgtctccacaaagaatggccacattcacgaaactggcgctgcaaccccacctggtgctggggcgttgggacaggatgtacttgctgtggcctggacgtgaaggatcttttcaccgactacatgtttgtcaagtggaaagtggagtatattaagacagaggcaatcgtctgcgtggaattgaccagtcaggagagacagtgttctctgatcgaagctgggactaggttcaatctcggaccggttacgattacactgagcgagcctcggaacatacaacagaaacttcccccagagatcattaccctgcaccctcgcatcgaagagggtttctttgatttgatgcatgtgcagaaggtactctccgcctcaactgtctgcaaactgcagagctgtacccacggcgtgcccggggacttacaagtttaccacattggaaatctgctaaagggcgataaggtgaacggtcatctcatccacaaaatagaaccacatttcaatacatcttggatgtcctgggacgggtgcgacctggattattactgtaacatgggcgactggcccagttgcacctatactggagtcacacagcacaatcatgcggcctttgtgaaccttttgaatatcgagacggattacaccaagaacttccactttcacagcaaaagagtaactgcacatggcgacacacctcagctggatctcaaggctaggccaacctacggggccggagaagtgacagttctggtcgaggtggctgacatggagttacacactaaaaagattgaaatctctggtctgaagttcgcctccctttcatgtaccggctgctatgcatgcagtagcgggatttcgtgtaaagtgcgtatccatgtcgatgagccggacgaattgacggttcacgtgaagtccgaggatcccgacatagtggccgctggatctagcctcatggcgcggaaactggaatttggcgcagattcaaccttcaaggcctttagtgctatgcctaaaacatccctatgcttctacattgtagagcgagagtattgtaagtcttgcagcagagaagacactcagaaatgtgtcaataccaagctggagaggccacaatccatcctcattgaacacaagggtacaatcatagggaaacagaacgatacttgcaccgccaaggcatcatgttggctggagagcgtgaaaagtttcttttacggccttaagtctatgttgtccggaatctttggcaatgttttcattgggatcttcctgtttattgcccccttcgtgttactcatcctgtttttcatgtttggatggcgcatacttttctgctttaaatgttgccggagaacgaggggcctgttcaagtatcgccatttgaaggacgacgaagagacaggttaccgaaaaattatcgagcggctcaacaataagaaagggaagaacaaactgctagatggagaacgtctggctgacagaaagatcgccgagctctttagcaccaagtcgcacattggc

SEQ ID NO: 10587 - RNA, 2916 nt, synthetic construct
  misc_feature 1..2916: note = derived and/or modified CDS sequence (opt3) from CCHFV(SPU103/87, Artificial)__DQ211634.1__Gn-4aa-Gc
  source 1..2916: mol_type = other RNA
agcgaggaatcctctgacgattgcatctcaagaacccagcttctcaggacagagactgccgaaattcacggcgacaactacgggggacccggtgataagataacgatctgtaatggcagtaccattgtggaccaacggcttgggagcgagctgggatgctatacaatcaaccgcgtcaaaactttcaagttgtgtgaaaattccgctaccggcaaatcttgcgagattgattcggttcctgtgaagtgtcgacagggttactgcttaaaaatcacacaggaggggcgtggacatgtaaagctgtcaagaggcagcgaagtggtcctagacgcatgtgataccagttgcgaggtgatgataccaaagggcactggggacatcctcgttgattgttccggaggtcagcaacactttctgaaagacaaccttattgatctgggctgcccgaagatccccttgctcgggaaaatggccatttatatctgtaggatgtctaatcatcctaagacaaccatggcgttcctgttttggttcagctttggatacgtgataacgtgcgtcctgtgcaaagctattttctatctcttaatcattgtgggcactctgggtaagcggcttaagcagtaccgcgaattgaaaccacagacctgtacaatctgcgagactacccccgtaaacgccatcgacgcagagatgcacgatctgaattgttcctataacatttgcccttactgtgcctcaagactaacaagtgacgggctcgctaggcatgttacccagtgcccaaagcggaaagaaaaggtggaggaaacggagctgtaccttaatctggaacgcataccctgggtcgtgcgaagattgctccaagtgagcgagtctactggagtcgcactgaaaaggtcctcatggttaatcgttctgctcgtgctttttacagtaagcctgagtcctgtgcagtctgccccaatttcccggcgtccgttgttcctagacaacatcgtcaagggcatgaaaaatctgctcaacagcacctcgctggagacttctctttccatagaagctccctggggcgccattaatgtgcagtcaacatataagcctaccgttagtacggcgaacatcgcactgagctggtcctctgtggagcaccgcgggaataagatcttggtcagcggaagatcagaaagtattatgaaactcgaggaaaggaccggtatctcctgggatctgggcgtggaggacgccagcgagtctaagttactgacagtatcagttatggatctaagtcagatgtacagcccagtgtttgaatatctctccggggaccggcaagtcgaggaatggcccaaagctacttgtaccggagattgccctgagcgatgtggctgcacatcttcgacttgtctgcacaaggaatggccacatagccgcaactggagatgcaaccccacctggtgctggggtgtggggacaggctgtacctgctgtggacttgacgtcaaagatttgttcactgactacatgtttgtgaagtggaagattgagtatataaaaacggaggccatcgtttgcgtggaactgacatcccaggagaggcagtgttcactcattgaagcaggcacccggttcaatctggggccggtaactatcacccttagtgagcctcgcaacatccaacagaagctgccctctgagattataacattgcacccaagaatcgaagagggatttttcgatctcatgcatgtccagaaagtgctgagcgcttccaccgtttgcaagttacagtcatgtactcacggtgtgcctggcgacctgcaagtctaccacattgggaatctactcaaaggagataaggtgaacggccatctggtacacaagatcgaaccccatttcaatacaagctggatgtcttgggacggttgcgaccttgattattactgtaacatgggggactggccatcctgcacgtacaccggcgtgactcagcacaatcatgccagttttgttaacttgctgaatattgagacagattataccaaaaacttccactttcacagcaagagggtcacagcgcatggagacactccccagctcgatctgaaagcccgtcctacctacggcgcaggggaaatcacggtgttagtggaggtcgctgacatggagctgcacaccaagaaaatagaaatctctggacttaagttcacatccttgacttgtaccggttgctatgcctgctcaagtggcattagctgtaaggttcggatccatgtggatgagccagacgaactcacagtgcacgtaaaatcggatgacccggatgtcgtggctgcctcctctagcctgatggcacgaaagctagagtttgggactgactcaaccttcaaagcctttagtgctatgcccaagacgtccctgtgcttctacattgttgaaagagagtattgtaaatcttgcagcgaggaagatacacagaagtgtgtgaataccaaactcgagcaacctcagtccatcctgatagaacacaagggaactattatcggcaagcagaacaatacatgcaaagcgagggcaggttgttggcttgagtcagtcaagagctttttctacgggttgaaaaacatgctgagtggcatttttggaaatgtgttcatcggcatatttttattcctcgccccattcatcctgcttattctgtttttcatgtttgggtggcgcatcttgttctgctttaagtgttgccggagaaccaggggactcttcaaatatcgccatctgaaggacgacgaagagactggctaccgaaagattatcgagcggctaaacaacaaaaagggtaaaaataagctgctcgatggggaacgtctggctgacagaaggatagccgagctgttttctaccaaaacacacattgga

SEQ ID NO: 10588 - RNA, 2916 nt, synthetic construct
  misc_feature 1..2916: note = derived and/or modified CDS sequence (opt3) from CCHFV(SPU415/85, Artificial)__DQ211635.1__Gn-4aa-Gc
  source 1..2916: mol_type = other RNA
agcgaggaatccgacggcgattgcatctctagaacccagctgctcaggacagagactacggaaattcactcagacaactacgggggacccggtgataagataaccatctgtaatggcagtacaattgtggaccaacggcttgggagcgagctgggatgctatactatcaaccgcgtcaaatccttcaagttgtgtgaaaattctgccaccggcaaatcgtgcgagattgattcaacacctgttaagtgtcgacagggtttttgcttaaaaatcacccaggaggggcgtggacatgtgaagctgagcagaggcagtgaaatagtactagacgcttgtgattccaactgcgagatcatgattccaaagggcactggggacatcctcgtggattgttctggaggtcagcaacacttcctgaaagacaatcttattgatctgggctgcccgaacatccccttgctcgggaagatggcaatatacatttgtaggatgagcaatcatcctaaaacaaccatggcctttctgttctggttttccttcggatatgtcatcacgtgcattctgtgcaaggtgatcttttacctcttaatcgttgcgggcactgtgggtaaaaagttcaagcagtatcgggaactgcgcccacagacctgtacaatttgcgagactatacccgtcaacgctatcgacgccgagatgcacgatcttaattgttcatacaacatttgcccttattgtgcaagtagattgaccagcgacgggctggccaggcatgtgatgcagtgcccaaaacggaaggaaaaagtagaggaaacagagctatacctcaatctggaacgcatcccctgggttgtgcgaaagctgctgcaagtctctgagtccaccggagtggctttgaaaagatcaagctggctcacggtgctgttagtcctgctcatagttagtctttctcctgtgcagtccgcaccaattggcaggaagccgctgtttttggacagcatcgtaaaaggcatgaagaacctacttaattcgacttctctcgagacatccctgtcaatcgaagccccctggggagctattaacgtgcagagtaccttcaagcctactgtcagcgccgcgaatatcgcactttcctggtctagcgtggagcaccgggggaacaaaattctggtttcaggtcgtagtgaatccataatgaagttggaggaacgcacaggcatcagctgggatctcggggtggaggacgcctctgagtcaaaactgttaaccgtcagtgtgatggatctgagccagatgtactccccagtatttgaatatctatctggagacagacaagttgaggaatggcccaaggctacgtgtaccggcgattgccctgagaggtgtggttgcacatcgagcacttgtctccacaaagaatggccacattcccggaactggcgatgcaatcccacctggtgctggggcgtggggacaggatgtacttgctgtggcctggacgtcaaggatcttttcaccgactacatgtttgtgaagtggaaagtcgagtatattaagacagaggccatcgtgtgcgttgaattgacctcacaggagcgccagtgtagtctgatcgaagcagggactagattcaacctcggaccggtgacgattacactgtctgagcctaggaatatacaacagaaacttcccccagagatcattaccctgcaccctcggatcgaagagggtttctttgatttgatgcatgtacagcgcgtcctcagcgcttccactgtgtgcaagctgcagtcatgtacccacggcgttcccggggacttacaagtgtaccacattggaaacctgctaaaaggcgataaggtcaatggtcatctcatccacaagatagaaccacatttcaacacaagctggatgtcttgggacgggtgcgacctggattattactgtaatatgggcgactggccctcctgcacctatactggagtgacacagcacaaccatgccgcgtttgtaaatcttttgaacatcgagacggattacaccaaaaatttccactttcacagtaagagagtgactgcccatggcgacacacctcagctggatctcaaagcaaggccaacctacggggctggagaagttacagtcctggtggaggtggccgacatggagttacacactaagaaaattgaaatcagcggtctgaagttcgcttctcttacctgtacgggctgctatgcctgctcctcagggattagttgtaaggtcaaaatccatgttgatgagccggacgaattgaccgtgcacgtaaagagcgaggatcccgacatagtggcagccggatcgtccctcatggctcgtaaactggaatttggcgcggattctacattcaaggcatttagcgccatgcctaaaacttcactatgcttctacattgtcgagcgggagtattgtaagagttgctcccgagaagacaccagaaaatgtgtgaacacaaagctggataggccacagtctatcctcattgagcacaagggtactatcatagggaaacaaaataatacctgcacggctaaggccagctgttggctggaatccgttaaatcatttttctacggccttaagaacatgttgagcggaatctttggcaacgtgttcattgggatcttcctgtttattgcacccttcgtcttactcatcctgtttttcatgtttggatggcgcatacttttctgctttaaatgttgccggagaacaaggggcctgttcaagtatcgccatttgaaggacgacgaggaaaccggttaccgaaaaattatcgagcggctcaacaataagaaagggaagaacaaactgctagatggagagcgtctggccgacagaaagatcgctgaactctttagtactaagtctcacattggc

SEQ ID NO: 10589 - RNA, 2916 nt, synthetic construct
  misc_feature 1..2916: note = derived and/or modified CDS sequence (opt3) from CCHFV(Turkey200310849, Artificial)__DQ211636.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgaggttgactccacaccagtgaagtgtcgacagggtttttgcttaaaaattacccaggaggggcgtggacatgtaaagctgtctagaggctcggaagtggtcctagatgcatgtgactcaagctgcgaggtgatgatcccgaagggcactggggatatactcgttgactgtagtggaggtcagcaacacttcctgaaagataaccttatcgacctgggctgcccccatattcctttgctcgggaagatggccatctacatttgtaggatgtccaatcacccacggacaaccatggcgtttctgttctggttttctttcggatatgtgatcacgtgcataagctgcaaagctctgttttactccctcattatcattggcactttaggtaagaaaatcaagcagtatcgcgaactgaagccccagacctgtacaatctgcgagactgcccctgtcaacgcaattgatgccgagatgcatgaccttaattgttcatacaacatatgcccatattgtgctagtagattgaccagcgacgggctggcaaggcacgtgacacagtgccccaaacggaaggaaaaagtagaggaaaccgagctatacctcaatctggaacgcatcccttggattgttcgaaagctgctgcaagtgtctgagtccacgggagtcgccttgaaaagatcaagctggctcatcgtgctgttagtgctgctcactgtcagtctttctccagttcagtccgctccggtgggcaggaagcccctgttcttggatagcatagtaaaaggcatgaagaacctacttaattcgacatctctcgagacctccctgtcaattgaagccccttggggagcgatcaacgtgcagagtacttttaagccagcagtcagcacagccaatatcgctctttcctggtctagcgtggagcaccgggggaacaaaattctggttaccggtcgttcagaaagtatcatgaagttggaggaacgcacgggcgtgtcctgggacctcggggtcgaggatgccagcgagtctaaactgttaaccgtgtcaattatggacctgagtcagatgtacagccccgtattcgaatatctatccggagatagacaagttgaggaatggcctaaggcaacatgtactggcgactgcccagagaggtgtggttgcacctcttcgacatgtctccataaagaatggccccacagccggaattggcgatgcaacccgacttggtgctggggcgtggggaccggatgtacatgctgtggcgtcgatgtgaaggacctgtttaccgatcatatgttcgtcaagtggaaagtggagtacataaagactgaggctatcgtttgcgtggaacttacgtcccaggagcgccagtgttcattgattgaagccgggacaagatttaacctgggacctgtaaccatcactctcagtgagcccaggaatatccaacagaaactgccacctgagattataacccttcaccccaagatcgaagagggtttcttcgacctgatgcacgtccagaaagtgttgtctgcgagcacagtttgcaagctccagtcctgtacccatggcattccaggggatctgcaagtgtatcacatcggaaacttactgaagggcgaccgggtcaatggtcatctaattcacaaaatcgaatcacattttaacactagctggatgtcttgggacgggtgcgatctcgactactattgtaatatgggcgattggccctcctgcacatacacgggagtgacccagcacaaccacgccgcattcgtaaatctgcttaacatagagactgactatacaaagacctttcatttccacagtaaacgcgtgacagctcatggcgatactcctcagttggacctgaaggccagaccaacctacggggctggagaaatcacggttctcgtcgaggtggccgatatggagctgcacaccaaaaaggtggaaattagcggtttaaagtttgcatctctggcctgtacaggctgctacgcttgctcctcagggatcagttgtaaagtcaggattcacgttgacgagccggatgaacttactgtgcatgtgaagtcctcggaccccgatgtagtcgcggcatccacctctttgatggcccgtaaactcgagttcggaacagacagcacttttaaggctttctcagccatgcctaaaaccagtctgtgcttttatatcgtggaacgggagtactgtaagtcctgctctgaggatgacacgcagaaatgtgttgacacacgactagaacaaccacagagcatactgattgagcacaagggcaccatcattggtaagcagaatgatacttgcacagcaaaagcctcctgttggctcgaatcagtcaagagcttcttttatgggctgaaaaacatgcttggcagtgtgttcggaaatttgtttatcggcatactgttattcctcgctcccttcgtgctgcttgttctgtttttcatgtttgggtggaagatcttgttctgctttaaatgttgcagaaggacccgcggactcttcaagtaccggcatctgaaggacgatgaggaaactggctatagaaggattatcgagcgcctaaactctaaaaagggtaaaaatcgactgctcgacggggatcggctggccgaccgtaagattgcagagctttttagcaccaaaacacacatcgga

SEQ ID NO: 10590 - RNA, 2916 nt, synthetic construct
  misc_feature 1..2916: note = derived and/or modified CDS sequence (opt3) from CCHFV(Iran-52, Artificial)__DQ446215.1__Gn-4aa-Gc
  source 1..2916: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgcgatcgttcaaattgtgtgaaaattccgctactggtaagtcttgcgagattgattcgatccctgtaaaatgtaagcaggggtactgcttaaaaattacccaggagggacgtggccatgtgaagctgtcaagaggcagcgaagtcgtgctagacgtttgtgatagttcctgcgaggtgatgatcccaaaggggacaggagacatactcgtcgattgttctggtggccagcaacactttctgaaagacaaccttgtggatctggggtgcccgaagatccccttgctcggaaaaatggcaatttatatctgtaggatgagcaatcatcctaagaccactatggccttcctgttttggttctcctttggctacgtaattacatgcatcctgtgcaaagcgatattctttctcttaattatcttcggtaccctggggaagcggtttaagcagtatcgcgaacttaaaccacagacgtgtactatttgcgagaccacacccgttaacgctatcgacgccgagatgcacgatttgaattgttcatacaacatctgcccttattgtgcaagtagactgactagcgacggactagccaggcatgtgacccagtgcccacggcgcaaggaaaaagtcgaggaaacagagctctacctgaatcttgaacgaataccctgggtggtgagaaagctgttgcaagtctctgagtccaccggcacggttctcaaaaggtcaagctggctgattgtgttactggtactcttcactgtgagtctttctcctgtccagtccgctccaatcggccggcgtccgctgtttttggacagcattgtgaaggggatgaaaaacctactgaatagcacatctctcgagacctccctgtcaatcgaagcaccctggggagccataaacgttcagagtacttacaagcctacagtgagcaccgctaatattgccctttcctggtctagcgtcgagcaccgcggtaacaaggtgctggtatcaggcagaagtgaatccatcatgaaattggaggaaaggacggggatcagctgggatctcggagttgaggacgcgtctgagtcaaagctgttaaccgtgagtgtcatggatctgagccagatgtattccccagtgttcgaatacctatctggcgaccggcaagtcgaggaatggcccaaagcaacatgtactggtgattgccctgagcgatgtgggtgcacctcgagcacatgtctccacaaggaatggccacattcccgcaattggagatgcaaccccacttggtgctggggcgtgggaaccggctgtacatgctgtgggctggacgttaaagatctttttaccgactatatgttcgtgaagtggaaggtagagtacattaaaactgaggccatcgtctgcgtggaattgacgtcacaggagaggcagtgtagtctgattgaagctggaacacggttcaacctcggttctgttaccataactctgagcgagccgcgcaatatccaacagaagctccctcccgagattatcaccctgcacccaaaaatcgaagagggctttttcgatttgatgcatgtgcagaaggtcctctccgcctcaacagtgtgcaaactgcagagctgtacccacggggtacctggagacttacaagtgtatcacattggcaacctgctaaagggtgatagagttaatgggcatctcatacacaagatcgaacagcattttaacacttcttggatgtcctgggacggctgcgacctggattactattgtaatatgggagactggcccagttgcacatacacgggcgtcacccagcacaaccatgctagcttcgtgaatcttttgaacattgagactgattacacaaaaacctttcacttccactctaagagggtgacagcacatggggacactccacagctggatctcaaagcccgtcccacctatggagcgggtgaaatcacggtcctggttgaggtggccgacatggagttacacaccaagaaaattgaaatctccggcctgaagtttgcagggcttacatgtactggatgctacgcttgctcaagtggcataagctgtaaggtgcggatccatgtagaggaacctgatgagttgaccgtccacgtgaaatcggacgatccagacgttgtggccgcttcctctagcctcatggcccgaaagctggaatttggtacagattcaacttttaaagcattcagtgccatgccgaagacctccctatgcttttatattgtcgagagagagtactgtaaatcttgcagcaaggaagacacgcaaaaatgtgtgaatacaaagctggagcagccccagtccatcctcattgaacacaaggggaccatcataggcaaacagaacaatacttgcacagctaaggcgtcatgttggctggagagcgttaaaagtttcttttatggacttaagaacatgttgggcgggattttcggaaatgtgttcatcggcatttttaccttcctgactccttttatcttactcatactgttctttatgttcggttggaggatccttttctgcttcaaatgttgccgccggaccagagggctgtttaagtacaggcatttgaaggatgacgaagagacaggatatcgcaaaattatcgagcgactcaacaataagaaaggcaagaaccggctgctagacggtgaacgtctggcagatagaaaaattgccgagcttttctctacgaagacccacatcggc

SEQ ID NO: 10591 - RNA, 2916 nt, synthetic construct
  misc_feature 1..2916: note = derived and/or modified CDS sequence (opt3) from CCHFV(Iran-53, Artificial)__DQ446216.1__Gn-4aa-Gc
  source 1..2916: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgcgtagcttcaaattgtgtgaaaattccgctactggtaagtcttgcgagattgattcgatccctgtaaaatgtaagcaggggtactgcttaaaaattacccaggagggacgaggccatgtgaagctgtcaagaggcagcgaagtcgtgctagacgtttgtgatagttcctgcgaggtgatgatcccaaaggggacaggagacatactcgtcgattgttctggtggccagcaacactttctgaaagacaaccttgtggatctggggtgcccgaagatccccttgctcggaaaaatggcaatttatatctgtaggatgagcaatcatcctaagaccactatggccttcctgttttggttctcctttggctacgtaattacatgcatcctgtgcaaagcgatattctttctcttaattatcttcggtaccctggggaagcggtttaagcagtatcgcgaacttaaaccacagacgtgtactatttgcgagaccacacccgttaacgctatcgacgccgagatgcacgatttgaattgttcatacaacatctgcccttattgtgcaagtagactgactagcgacggactagccaggcatgtgacccagtgcccacggcgcaaggaaaaagtcgaggaaacagagctctacctgaatcttgaacgaataccctgggtggtgagaaagctgttgcaagtctctgagtccaccggcacggttctcaaaaggtcaagctggctgattgtgttactggtactcttcactgtgagtctttctcctgtccagtccgctccaatcggccggcgtccgctgtttttggacagcattgtgaaggggatgaaaaacctacttaattcgacatctctcgagacctccctgtcaatcgaagcaccctggggagccataaacgttcagagtacttacaagcctacagtgagcaccgctaatattgccctttcctggtctagcgtcgagcaccgcggtaacaaggtgctggtatcaggcagaagtgaatccatcatgaaattggaggaaaggacggggatcagctgggatctcggagttgaggacgcgtctgagtcaaagctgttaaccgtgagtgtcatggatctgagccagatgtattccccagtgttcgaatacctatctggcgaccggcaagtcgaggaatggcccaaagcaacatgtactggtgattgccctgagcgatgtgggtgcacctcgagcacatgtctccacaaggaatggccacattcccgcaattggagatgcaaccccacttggtgctggggcgtgggaaccggctgtacatgctgtgggctggacgttaaagatctttttaccgactatatgttcgtgaagtggaaggtagagtacattaaaactgaggccatcgtctgcgtggaattgacgtcacaggagaggcagtgtagtctgattgaagctggaacacggttcaacctcggttctgttaccataactctgagcgagccgcgcaatatccaacagaaacttcctcccgagattatcaccctgcacccaaagatcgaagagggctttttcgatttgatgcatgtgcagaaggtcctctccgcctcaacagtgtgcaaactgcagagctgtacccacggggtacctggagacttacaagtgtatcacattggcaacctgctaaagggtgatagagttaatgggcatctcatacacaagatcgaacagcattttaacacttcttggatgtcctgggacggctgcgacctggattactattgtaatatgggagactggcccagttgcacatacacgggcgtcacccagcacaaccatgctagcttcgtgaatcttttgaacattgagactgattacacaaaaacctttcacttccactctaagagggtgacagcacatggggacactccacagctggatctcaaagcccgtcccacctatggagcgggtgaagtcacggttctggtggaggtggccgacatggagttacacaccaagaaaatcgaaatttccggcctgaagtttgcagggcttacatgtactggatgctacgcttgctcaagtggcatcagctgtaaggtacggatacatgtcgatgagcctgacgaattgaccgtgcacgttaaatcggatgacccagatgtggtcgccgcttcctctagcctcatggcccgaaagctggagttcggtacagactcaacttttaaagcattcagtgccatgccgaagacctccctatgcttttatatcgtggaaagagagtactgtaaatcttgcagcaaggaggatacgcaaaaatgtgttaatacaaagctggaacagccccagtccattctcatcgagcacaaggggaccattatcggcaaacagaacaatacttgcacagctaaggcgtcatgttggctggaaagcgtgaaaagtttcttttatggacttaagaacatgttgggcgggatattcggaaatgtattcattggcatctttaccttcctgactccttttattttactcatcctgttctttatgttcggttggaggatactgttttgcttcaaatgttgccgccggaccagagggctgtttaagtacaggcatttgaaggacgacgaggaaacaggatatcgcaaaatcattgagcgactcaacaataagaaaggcaagaaccggctgctagatggtgagcgtctggcagacagaaaaatcgccgaactcttctctacgaagacccacattggc

SEQ ID NO: 10592 - RNA, 2916 nt, synthetic construct
  misc_feature 1..2916: note = derived and/or modified CDS sequence (opt3) from CCHFV(Kosova Hoti, Artificial)__EU037902.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccagaaggggcgtggacatgtgaagctgtctagaggctcggaggtagtgctagatgcatgtgactcaaactgcgaagtcatgataccgaaaggcactggggatatcctcgtggactgtagcggaggtcagcaacacttcctgaaggataatcttattgacctgggctgcccccatatccctttgctcgggaaaatggccatttacatctgtaggatgagtaaccacccaaagacaaccatggcgtttctgttctggttttccttcggatatgttataacgtgcatcttttgcaaagctctgttctactctctcattattatcggcactttaggtaagaagatcaaacagtatcgggagctgaagccccagacctgtacaatttgcgaaactgcccctgtgaatgcaatagatgccgagatgcatgaccttaactgtagctacaatatctgcccatattgtgcttcccgcttgacctcagacgggctggcaagacacgtcaaacagtgccccaagaggaaagagaaggtggaagagacagaactatacctcaacctggagcggattccttgggtagttcgcaaacttctgcaagtgagtgaaagcaccggagtcgccttgaagcgatcttcctggctcatcgtgctgttagtgctgctcacggtctcacttagcccagttcagagtgctccggtgggcagaaagcccctgtttttggattctatagtaaaaggcatgaagaatctactgaactccactagcctcgagacatcgctgtctattgaggccccttggggagcgatcaatgtgcagtccaccttcaaaccaactgtctcaacagcaaacatcgcccttagttggagctccgtggaacacagggggaataagattctggttaccggtcggtctgagagcatcatgaaattggaggaacgtacgggcatttcatgggacctcggggtggaagatgctagtgagtccaagctgttaaccgtcagcataatggacctgtctcagatgtactcacccgtgtttgagtatctaagtggagatcgccaagtagaagagtggcctaaggccacatgtactggcgactgcccacagagatgtggttgcaccagctccacatgtctccataaagaatggccccactctaggaactggcggtgcaacccgacttggtgctggggcgttgggaccggatgtacatgctgtggcgtggatgtcaaggacctgttcaccgatcatatgtttgtgaaatggaaggtcgagtacatcaaaactgaagcaattgtgtgcgttgagcttacgtcgcaggagcgacaatgtagcttgatcgaagctgggacacgcttcaatctgggacctgtgaccatcactctctccgagcccagaaacattcagcagaagctgccacctgaaataatcacccttcaccccaagattgaggagggtttctttgacctgatgcacgtacagaaagtcttgtcagccagtacagtgtgcaagctccaatcttgtacccatggcatcccaggggatctgcaggtttatcacattggaaatttactgaaaggcgacagggtgaacggtcatctaatccacaagatagaaccccatttcaatactagctggatgtcctgggacgggtgcgatctcgactactattgtaacatgggcgattggccttcatgcacatacacgggagtcacccagcacaatcacgcggcctttgtgaacctgcttaatatcgagactgactatacaaaaaccttccattttcacagcaagcgggtaacagcacatggcgatactccacagttggacctgaaggctcgcccgacctacggggccggagaaattacggtgctcgttgaggtcgctgatatggaactgcacaccaaaaaggtggagatctctggtttaaaattcgcctccctggcatgtacaggctgctacgcctgcagtagcgggatttcttgtaaggtgagaatccacgtcgacgagcccgatgaacttactgttcatgtgaaatcctcagaccctgatgtggtagctgcgggaaccagtttgatggcaaggaagctcgagtttggcacagacagcactttcaaagccttttcggctatgccaaagacctccctgtgcttctatatagtcgaaaaggagtactgtaaatcttgcagcgaagatgacacgaagaaatgtgtggacacaaagctagagcaaccccagtcaattctgatcgagcaccgtggtaccattatcgggaaacagaacgatacttgcacagccaaggcaagttgttggctcgaatccgttaagagctttttctatggcctgaaaaatatgcttggatctgtgtttggcaacttcttcatagggatcttgctgtttttagcccctttcgtcctcctggtgctgtttttcatgtttggatggaagattcttttctgctttaaatgttgccggcgaaccagaggcttgttcaagtacaggcatctcaaagacgatgaggaaactggttatcgccggatcattgagagactgaataacaagaaggggaaaaataggctactggacggagaacgcctcgctgatcgaaagatcgccgagctgttttccaccaaaacacacataggc

SEQ ID NO: 10593 - RNA, 2916 nt, synthetic construct
  misc_feature 1..2916: note = derived and/or modified CDS sequence (opt3) from CCHFV(YL04057, Artificial)__FJ562094.1__Gn-4aa-Gc
  source 1..2916: mol_type = other RNA
gccgagggcgggagctccgactgcatctctagaacccagctggtgaagacagaagtcgctgagattcacgaagattcatacggaggtcccggcgagaaaataactatctgtaacgggagtacgattgttgaccaaaggctcggacgggaacttggctgctataccatcaatcgcgtgcgaagctacaagctgtgtgagaactccgcatctggtaaatcgtgcgagattgattcaatccctgtaaagtgtaaacaggggttctgcttgaagataacacaggaaggacgtggccatgtgaagttaagcagaggcactgagatcgtcctggacgtgtgtgatagttcctgcgaactaatgattccaaaagggaccggagacatcctcgttgattgttctggtggccagcaacactttctgcagaataaccttattgacctggggtgcccgaatgtgcccttgctcggaaagatggccatctatgtctgtaggatgagcaaccatcctaaaacaaccatggcgttcctgttttggttctcctttggctacgtgataacttgcattgcttgccgggtactgttctatctcttaatcgccattggtacagttgggaagaaactgaagcagtaccgcgagcttaagccacagacctgtatcgtgtgcgagtcagtccccgtgaatgcaatcgatgccgaaatgcacgagttgaactgtagttataatatttgcccttactgtgctagcagactgtctacggacggactaataaggcatgtgactcaatgcccaaaacggcgcgaaaaggtcgaggaaaccgagctctttctgaaccttgagcgaatcccctggctggttagaaaattgctccaggtgtccgaatcaacaggcatggcactgaagaggagctgttggatgattactttactgatcctccttctggtaagtatatctcctgtgcagtccgccccagtcggccggaaaccgttgttcctagatagcattgctaaggggaaaaagtcgctgctcaattctacctccctggagacatcacttagtatcgaagccccctggggagcgatcaacgtgcagagcacctttaagcctacggtttccgcagccaatattgctctgtcttggagctcagtggagcaccgtggtaacaaaatcttggtcagtggccgctccgaaagcattatgaagctcgaggagagaactggggtgtcttggaatctgggagtagaagacgcctcagagagtaaaacattaaccgttagcgtgatggatctgtcccaaatgtactctccagtcttcgaatatctatcgggcgacaggcaagtggaggaatggcccaaggcaacttgcacaggtgactgtcctgagcggtgcgggtgtaccagctccacgtgcctccacaaagagtggccacattcacgaaactggcgctgcagtcccacctggtgttggggcgtcggaacaggctgcacttgttgcgggctggatgtgaaggactttttcaccgattacatgcttgttaagtggaaagtggaatatataaagacagaggctatcgtatgtgtcgaattgacttctcaggagagacagtgcagcctgattgaggccggaaccaggtttaacctcggtccggtgacaatcaccctgtccgaacctcggaatgttcagcagcgccttcccccagagatcgtgactctgcaccctaaaattgaagagggcttcttcgacttgatgcatgtccagaagatactctcagcgagcacggtgtgtaaactgcaatcttgcacacacggggtacccggagattttcaggtgtaccacgttggcaacttactgagaggtgacaaggtcaatgggcattccatccacaagattgaaccacatttcaacaccagttggatgagctgggatggctgtgacctagattatttttgcaatatgggagactggccctcttgtacttacaccggcgtgacacagcacaacagggccgcattcatcaatatgctcaacattgagaccgattatactaaaacatttcatttccactccaagcgtgtgacggctcacggggacacccctcagctggaccttaaagcccggccagcttacggagccggtgaggtcactgttttggtggaagtggcagatctggagctccatacaaagaaactggaagtatcaggcttaaagatcgccagtctgacctgcagcgggtgctacgcttgttcgtccggaatatcttgcaaggtccgaatccacgtgaatgagccggacgaatttacagttcatgtgagaagctcagatcccgacgtcgtggcggcaggcagttcccttatggccaggaaaattgagttcggtgctgattctacttttaaggccttcagctccatgcctaaagactcattgtgtttttatatcgttgagaaggattactgcagcagttgtaccgacgatgacacgcaaaaatgcgtgaacaccaagctcgatcacccacagtctattctgatcgaacacaaagggacaataattggcaagcagaatgacacttgttccaccaagacaagctgctggctagagtcggtaaaaggattcttttatggcctgaagaacatgctctcagggatcttcggaaatgtcttcctgggcattcttttgtttctggcacccttcgtgttactcatctttttctttttctttggttggcgcctgcttttctgtctgaaatgctgtcggagaactagggggttgctcaagtacaaacatctgaaggatgaagaggaagccggatataagaaaataatcgagcgcctaaacggcaagaaaggtaagtctcagctgtttgacggcgagcgactcgctgaccggaaaattgccgaactgttcagtaccaagatccacattggg

SEQ ID NO: 10594 - RNA, 2916 nt, synthetic construct
  misc_feature 1..2916: note = derived and/or modified CDS sequence (opt3) from CCHFV(V42/81, Artificial)__GU477490.1__Gn-4aa-Gc
  source 1..2916: mol_type = other RNA
agcaaggagcccggcgacgattgcatctccagaacccagctgatgaggacagaaactgccgagattcacgacgataactacgggggacctggtgacaaaataacgatctgtaatggctctaccattgtggatcaacggctcgggtcagaacttggatgctatacaatcaaccgcgtcaagagtttcaaactgtgtgagaatagcgctactggcaaggcatgcgaagttgactccaccccagtgaaatgtcgacagggtttttgcttgaagattacacaggaggggcgtggacatgtaaagttatctagaggctcggaggtggtcctggatgcctgtgactcaagctgcgaagtgatgatcccgaaaggcaccggggatatcctagttgactgtagtggaggtcagcaacacttcctcaaggataacctgatcgaccttgagtgcccccatattcctctgttgggcaaactcgcgatctacatttgtaggatgtccaatcacccacggactacaatggcttttctgttctggtttgggttcggatatgtgataacctgcatactgtgcaaggccctcttttactctttaattatcattggcacgctgggtaaaaagatcaagcagtatcgcgaacttaaaccccagacttgtaccatctgcgagacagcacctgtcaacgccattgatgctgagatgcatgacttgaattgtagctacaacatatgcccatattgtgcatccagactgacttcagacgggctagccaggcacgtgacccagtgccccaagcggaaagaaaaggtagaggaaacagagctctacctgaatcttgaacgcatcccttggattgttcgaaaactgttgcaagtgagtgagagcaccggagtcgtgctcaagagatcttcctggctgatcgtgttactggtcctccttacggtttcactgagcccagtgcagagtgctccggtaggcaggaaacccttgttcctagattctatagtgaagggcaagaaaaacctgctcaattccactagcctggagacatcgctttctattgaagccccttggggagcgatcaacatccagtccacctttaagccaactgtctcagcagccaatattgctctgagttggagctccgtggagcaccgggggaacaaaatcttggtttctggtcgtagcgaatcaattatgaagctcgaggaacgcacaggcgtgagttggaatctgggggtcgaggacgcctccgagagcaaattactgaccgtgtctataatggatctatcacagatgtacagtcccgtattcgaatatctcagcggagacagacaagttgaggaatggcctaaggcaacgtgtaccggcgattgcccagagaggtgtggttgcacatcctctacttgtctgcataaggaatggccccactcgcggaactggcgatgcaacccgacctggtgctggggcgtggggacaggatgtacttgctgtggcgtcgacgtgaaagatctttttatcgaccatatgttcgtcaagtggaaagtggagtacattaagaccgaggctatcgtttgcgtggaattgacaagccaggagcgccagtgttccctgatcgaagccgggaccagatttaatctcggacctgtaactattacgctgtcagagcccaggaacatacaacagaaacttccacctgagatcattacactgcaccccaagatcgaagagggtttcttcgatttgatgcacgtccagaaggtgctcagtgcgtctaccgtttgcaaactgcagagctgtactcatggcattccaggggacttacaagtgtatcacatcggaaatctgctaaagggcgatcgggtcaacggtcatctcatacacaaaatcgaaccccattttaatacctcctggatgtcatgggacgggtgcgacctggattactattgtaacatgggcgactggcctagctgcacatacaccggagtgactcagcacaatcacgccgcattcgtaaaccttttgaatattgagacagattatacgaagacctttcatttccactctaaacgcgtgactgctcatggcgaaacaccacagctggacctcaaggccagaccggcttacggggccggagagatcaccgttctggtcgaggtggcagatatggaattacacacaaagaaagtggagatttccggtctgaagtttgccagtcttgcttgtactggctgctacgcgtgcagctctgggatctcctgtaaagtcaggatacacgttgacgaacccgatgagttgaccgtgcatgtgaagtcaaacgaccctgatgtagtcgcagccagtacgagcctcatggctcgtaaactggaatcgggaaccgactccacattcaaggccttttctgcaatgccaaaaactagcctatgcttctatattgtggagcgggagtactgtaagtcatgcagtgaagatgacacccagaagtgtgttgagacaaaactggaacaaccccagtccatcctcattgagcacaagggcactatcataggtaaacagaatgatacctgcacggccaaggcttcttgttggctggaaagcgtgaaatcctttttctatgggcttaagaacatgttgggctcagtctttggaaatttctttatcggcattctgttattcctcgcccctttcgtgctgcttgttctgtttttcatgtttgggtggaagatcttgttctgctttaaatgttgccgaagaacaaggggactcttcaagtaccgccatctgaaagaggacgaggaaaccggctatcggagaattatcgagaggctaaacagcaagaaaggtaagaatcgcctgctcgacggggaacgactggcagatcggaagatagcggagctttttagtactaaaacacacattgga

SEQ ID NO: 10595 - RNA, 2916 nt, synthetic construct
  misc_feature 1..2916: note = derived and/or modified CDS sequence (opt3) from CCHFV(79121M18, Artificial)__GU477493.1__Gn-4aa-Gc
  source 1..2916: mol_type = other RNA
gccgagggcgggagctccgactgcatctctagaacccagctggtgaagacagaagtcgctgagattcacgaagattcatacggaggtcccggcgagaaaataactatctgtaacgggagtacgattgttgaccaaggactcggcagcgaacttggttgctataccatcaatagggtgcggtcctacaagctgtgtgagaactctgcatcggggaaatcatgcgagattgatagcatccctgtaaagtgtaaacagggattctgcttgaagataacacaggaaggccgcggccatgtgaagttaagtcgagggactgagatcgtcctggacgtgtgtgattcctcttgcgaactaatgattccaaaaggaaccggtgacatcctcgttgattgtagcggcgggcagcaacactttctgcagaataaccttattgacctgggatgcccgaatgtgcccttgctcggcaagatggccatctatgtctgtcgtatgtccaaccatcctaaaacaaccatggcgttcctgttttggttctcatttggttacgtgataacttgcattgcttgcagagtactgttctatctcttaatcgccattgggacagttggaaagaaactgaagcagtacagggagcttaagccacagacctgtatcgtgtgcgagagtgtccccgtgaatgcaatcgatgccgaaatgcacgagttgaactgtagctataatatttgcccttactgtgcttctcggctgtccacggacggcctaatacgccatgtgactcaatgcccaaaaagaagggaaaaggtcgaggaaaccgagctctttctgaaccttgagcggatcccctggctggttcgcaaattgctccaggtgtcagaaagcacaggcatggcactgaagcgaagttgttggatgattactttactgatcctccttctggtatctatatcccctgtgcagagcgccccagtcgggagaaaaccgttgttcctagattcgaccgctaagggaatgaaatctctgctcaattccacatcactggagaccagtcttagcattgaagccccctggggtgcgatcaacgtgcagtccacgtttaagcctactgtttctgcagccaatatcgctctgagctggtcaagtgtggagcacaggggcaacaagattttggtctccgggcggagcgaatctatcatgaaactcgaggagcgtacaggagtgtcatggaatctgggcgtagaagacgccagtgagagcaagaccttaactgtttccgtgatggatctgtctcaaatgtactcgccagtcttcgaatatctaagcggtgaccgccaggtggaggaatggcccaaagcaacatgcaccggggactgtcctgagagatgcggctgtacgtcctcaacctgcctccacaaggagtggccacatagtaggaactggcggtgcaaccccacatggtgttggggagtcggcactgggtgcacctgttgcggactggatgtgaaagactttttcacagattacatgcttgttaagtggaaggtggaatatattaaaactgaggctatagtatgtgtcgaattgacctctcaggagcgacaatgcagcctgatcgaggccggtacacgctttaatctcggcccggtgaccattactctgtccgaacctagaaacgttcagcagaggcttcccccagagatcgtgacgctgcaccctaagatcgaagaggggttcttcgacttgatgcatgtccagaaaattctctcagcgagcacagtgtgtaagctgcaatcttgcacccacggagtacccggcgattttcagatataccacgtgggtaatttactgcgcggggacaaagttaacggccattccatccacaagattgaaccacatttcaataccagttggatgagctgggatggatgtgacctagattatttttgcaacatgggcgactggccctcttgtacttacacaggggtcacccagcacaatcgggccgcattcatcaacatgctcaatattgagactgattatacaaagacgtttcatttccactccaaaagagtgaccgctcacggagacactcctcagctggaccttaaggccaggccagcttacggtgccggcgaggtgacagtcttggttgaagtggcagatctggagctccataccaaaaagctggaagtgtcagggttaaaaatcgccagtctgacatgcagcggatgctacgcttgttcgtccggcatatcttgcaaggtacgtatccacgtcaacgagccggacgaatttactgtgcatgttcggagctcagatcccgacgtggtcgcggcaggtagttcccttatggcccgaaagattgagttcggggctgattctacctttaaagccttcagctccatgcctaaggactcattgtgtttttatatcgtggagaaagattactgcagcagttgtacggacgatgacacccaaaagtgcgttaatacaaaactcgatcacccacagtctattctgatcgaacacaagggcactataattggaaaacagaacgacacctgttccacaaagactagctgctggctagagtcggtgaagggcttcttttatgggctgaaaaatatgctctcaggaatcttcggcaacgtattcctgggtatttttcttttcttggcaccctttgtcctgttaatcttctttttctttttcgggtggagactcctgttttgtcttaagtgctgtaggcgcacccggggactgttgaaatacaagcatctcaaagatgaagaggaagccggctataagaagataatcgagagactgaatggtaaaaagggcaaatctcagctattcgacggggagaggctggctgaccgcaagattgccgaactctttagtacgaaaatccacattgga

SEQ ID NO: 10596 - RNA, 2916 nt, synthetic construct
  misc_feature 1..2916: note = derived and/or modified CDS sequence (opt3) from CCHFV(Afg09-2990, Artificial)__HM452306.1__Gn-4aa-Gc
  source 1..2916: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgcgtagcttcaaattgtgtgaaaattccgctactggtaagtcttgcgagattgattcgatccctgtaaaatgtaagcaggggtactgcttaaaaattacccaggagggacgaggccatgtgaagctgtcaagaggcagcgaagtcgtgctagacgtttgtgatagttcctgcgaggtgatgatcccaaaggggacaggagacatactcgtcgattgttctggtggccagcaacactatctgaaagacaaccttgtggatctggggtgcccgaagatccccttgctcggaaaaatggcaatttacatctgtaggatgagcaatcatcctaagaccactatggcctttctgttctggttttccttcggctatgtaattacatgcatcctgtgcaaagcgatatttttcctcttaattatctttggtaccctggggaagcggttcaagcagtaccgcgaacttaaaccacagacgtgtactatttgcgagaccacacccgttaacgctatcgacgccgagatgcacgatttgaattgttcatataacatctgcccttactgtgcaagtagactgactagcgacggactagccaggcatgtgacccagtgcccacggcgcaaggaaaaagtcgaggaaacagagctctacctgaatcttgaacgaataccctgggtggtgagaaagctgttgcaagtctctgagtccaccggcacggttctcaaaaggtcaagctggctgattgtgttactggtactctttactgtgagtctttctcctgtccagtccgctccaatcggccggcgtccgctgttcttggacagcattgtgaaggggatgaaaaacctacttaattcgacatctctcgagacctccctgtcaatcgaagcaccctggggagccataaacgttcagagtacttataagcctacagtgagcaccgctaatattgccctttcctggtctagcgtcgagcaccgcggtaacaaggtgctggtatcaggcagaagtgaatccatcatgaaattggaggaaaggacggggatcagctgggatctcggagttgaggacgcgtctgagtcaaagctgttaaccgtgagtgtcatggatctgagccagatgtactccccagtgtttgaatatctatctggcgaccggcaagtcgaggaatggcccaaagcaacatgtactggtgattgccctgagcgatgtgggtgcacctcgagcacatgtctccacaaggaatggccacattcccgcaattggagatgcaaccccacttggtgctggggcgtgggaaccggctgtacatgctgtgggctggacgttaaagatcttttcaccgactacatgtttgtgaagtggaaggtagagtatattaaaactgaggccatcgtctgcgtggaattgacgtcacaggagaggcagtgtagtctgattgaagctggaacacggttcaacctcggttctgttaccataactctgagcgagccgcgcaatatccaacagaagctgcctcccgagattatcaccctgcacccaaaaatcgaagagggcttctttgatttgatgcatgtgcagaaggtcctctccgcctcaacagtgtgcaaactgcagagctgtacccacggggtacctggagacttacaagtgtaccacattggcaacctgctaaagggtgatagagttaatgggcatctcatacacaagatcgaacagcatttcaacacttcttggatgtcctgggacggctgcgacctggattattactgtaatatgggagactggcccagttgcacatacacgggcgtcacccagcacaaccatgctagctttgtgaatcttttgaacattgagactgattatacaaaaaccttccactttcactctaagagggtgacagcacatggggacactccacagctggatctcaaagcccgtcccacctacggagcgggtgaaatcacggtcctggttgaggtggccgacatggagttacacaccaagaaaattgaaatctccggcctgaagttcgcagggcttacatgtactggatgctatgcttgctcaagtggcataagctgtaaggtgcggatccatgtagatgagcctgacgaattgaccgtccacgtgaaatcggatgacccagatgttgtggccgcttcctctagcctcatggcccgaaagctggagtttggtacagactcaactttcaaagcatttagtgccatgccgaagacctccctatgcttctacattgtcgaaagagagtattgtaaatcttgcagcaaggaggatacgcaaaaatgtgtgaatacaaagctggaacagccccagtccatcctcattgagcacaaggggaccatcataggcaaacagaacaatacttgcacagctaaggcgtcatgttggctggaaagcgttaaaagtttcttttacggacttaagaacatgttgggcgggatttttggaaatgtgttcatcggcattttcacctttctgactcctttcatcttactcatactgtttttcatgtttggttggaggatccttttctgctttaaatgttgccgccggaccagagggctgttcaagtataggcatttgaaggacgacgaggaaacaggataccgcaaaattatcgagcgactcaacaataagaaaggcaagaaccggctgctagatggtgagcgtctggcagacagaaaaattgccgaactcttttctacgaagacccacatcggc

SEQ ID NO: 10597 - RNA, 2916 nt, synthetic construct
  misc_feature 1..2916: note = derived and/or modified CDS sequence (opt3) from CCHFV(Sudan Al-Fulah 3-2008, Artificial)__HQ378184.1__Gn-4aa-Gc
  source 1..2916: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaagagcttcaaattgtgtgaaaattccgctactggcaaatcttgcgttattgattcggtgccagtaaagtgtcgacagggttactgcttacgtatcacccaggaggggagaggacatgtgaaactgtcaaggggcagcgaggtcgtgctagacgcatgtgatacaagttgcgaaataatgatcccgaagggcaccggggacattctcgttgattgttccggaggtcagcaacactttctgaaggacaaccttgtggatctgggctgccccaaaatccctttgctcgggaagatggccatttatatctgtcggatgtctaatcatccaaaaactacaatggcgttcctgttttggttcagctttggatacgtcataacctgcattctgtgcaaggctatcttctatctcttaattatcatcggcacgctgggtaaacgctttagacagtacagggagcttaagccccagacttgtaccatttgcgaaacaactcctgtgaacgccatagacgcagagatgcacgatttgaattgttcctataacatctgcccatactgtgcctcacggctgaccagtgacgggctagctcgccatgtaacacagtgccccaagcgaaaagagaaggttgaagagaccgaactctacctgaatcttgagcggattccttgggtggtcaggaaactgttgcaagtgagcgaatctacgggagtggcactcaagcggtcctcatggctgatcgtcttactggttctcttcactgtgagccttagtccagtacagtctgccccgataggccgtcgccccctgtttttggactccattgtgaaaggcatgaagaacctactgaatagcacatcgctcgagacctctctgtccatcgaggctccttggggagccatcaacgtccagtcaacttataaaccaacagtgagtaccgcgaatattgcacttagctggtcctctgttgaacacagagggaacaagatcctggtgagcggtaggtcagagagtattatgaagttggaagagagaacgggcatatcctgggatctcggggtcgaagacgccagcgagtctaaactgttaaccgtgtcagtaatggatctgagtcagatgtacagccccgttttcgagtatctatccggagaccgacaagtggaagagtggcctaaggctacatgtactggcgattgcccagaacgctgtggttgcacctcttcgacatgtctccacaaagagtggccccatagcagaaattggaggtgcaacccgacttggtgctggggcgtcgggaccggatgtacatgctgtggcctggacgtgaaggatctttttaccgactacatgttcgtcaaatggaaggtggaatatatcaagactgaggccattgtttgcgtggagttgacgtcccaggaacggcagtgttcactgatcgaggcagggacacgctttaacctcggacctgtaaccatcactctgagtgaacccagaaatattcaacagaaacttccacctgagataatcaccctgcaccccaggattgaggaaggtttcttcgatttgatgcatgtccagaaggtgctctctgctagcacagtttgcaaactgcagtcctgtacccacggcgtgccaggggacttacaagtctaccacatcggaaacctgctaaagggcgataaagtgaatggtcatctcattcacaagatcgagccccattttaacacttcatggatgagctgggacgggtgcgacctggattattactgtaatatgggcgactggccttcttgcacatacacgggagtaacccagcacaaccatgcctccttcgtgaatcttttgaacatagaaactgattatacaaagaattttcacttccacagtaaacgtgttaccgcgcatggcgacacaccacagctggatctcaaggcccggccgacttacggggcaggagagatcaccgtcctggtggaagtggctgacatggagttacacacgaaaaagattgagatcagcggtctgaaatttgcctctcttacctgtacaggctgctatgcttgctcctcagggattagttgtaaggtccgaatccatgttgatgaacccgacgagttgactgtgcacgtaaagagcgatgaccctgatgtggtcgccgcatcgtcctctctcatggccagaaaactggaatttggaaccgacagcacatttaaggctttctcagcgatgccaaaaacttccctatgcttttacatagtggagaaggaatattgtaaatcctgctctgaggaggataccaagaaatgtgttaacacgaagctggaacagccccaaagcattctcatcgagcacaagggcacaattatcggtaaacagaatagtacctgcactgcaaaggtgtcatgttggctggaaagcgccaaaagtttcttttacgggcttaaggacatgttgtctggcatattcggaaacgtctttatcggcattttcctgttcttagctccttttgtgctcctggttcttttctttatgttcgggtggaggatcctgttgtgctttcgctgttgccggagaacaaggggactcttcaaatatcgccatctgaaggacgatgaggaaaccggctaccgacggattatcgagcgtctaaataacaagaaaggtaagaataaactgctcgacggggagagactggccgataggaagatagcagaacttttctccactaaaacccacattgga

SEQ ID NO: 10598 - RNA, 2916 nt, synthetic construct
  misc_feature 1..2916: note = derived and/or modified CDS sequence (opt3) from CCHFV(Sudan AB1-2009, Artificial)__HQ378187.1__Gn-4aa-Gc
  source 1..2916: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaaatctttcaagttgtgtgaaaattccgctactggcaaaaactgcgagattgattctgttccagtgaagtgtcgacagggttactgcttacgtatcacccaggaggggagaggacatgtaaaactgtcgaggggctcagaagtggtcctagacgcatgtgatacaagctgcgagataatgatcccgaagggcaccggggacattctcgtggattgtagtggaggtcagcaacactttctgaaggacaatcttatcgatctgggctgccccaaaattcctttgctcgggaagatggccatctatatatgtcggatgtccaaccatccaaaaactacaatggcgttcctgttttggttctcttttggatacctgattacctgcatcctctgcaaggctattttctatttactgatcatcattggcacgcttggtaaacgcttgaagcagtacagagaactgaagccccagacttgtaccatatgcgagacaactcctgttaatgccatcgacgcagagatgcacgatctaaactgtagctataatatttgcccatactgtgcctccaggctcacctcagacgggctggctcggcatgtgatccagtgccccaaacgcaaggaaaaagtcgaggaaacagagctttacctgaacttggaacgaataccttgggtggtaagaaagctcctgcaagttagtgagagcaccggagtggcattaaaaaggtcttcctggctgattgtcctccttgtgctgtttacggtgtcattgagcccagtccagagtgccccgatcggccggaagcccctattcctggactctatcgctaaaggcatgaagaatctcctgaactccactagccttgagacatcgctgtctattgaagccccttggggtgcgatcaatgttcagtccacctataagccaactgtgtcaacagcaaacattgccttgagttggagctccgtagagcaccgtggaaataaaatactcgtgtctggtcgcagcgaatcaatcatgaagctggaggaaagaaccggcattagttgggatttaggggtcgaggacgcttccgagagcaaactgctaacggtgtctgttatggatctctcacagatgtacagtcccgtgtttgaatatctgagcggagacaggcaagtcgaggaatggcctaaggccacctgtacaggcgattgcccagagcggtgtggttgcacttcctctacctgtcttcacaaagaatggccccattcgcgaaactggcgctgcaacccgacatggtgctggggcgtggggactggatgtacctgctgtggcttggacgtaaaggatctgttcacagactacatgtttgttaagtggaaagtggagtatatcaagaccgaggcaatcgtctgcgtggaactcactagccaggagagacagtgttccctgattgaagctgggacgaggttcaatcttggacctgtcacaataaccctgtcagagccccggaacatccaacagaaattgccacctgagattatcactctccacccccgcattgaagaggggtttttcgatctgatgcatgtgcagaaggttttaagtgcctctaccgtgtgcaaactgcagagctgtacacacggcgtaccaggggacctacaagtctaccacatcggaaatctcctgaagggcgataaggtgaacggtcatcttatacacaaaatcgaaccccatttcaatacctcctggatgtcatgggacgggtgcgacttggattattactgtaacatgggcgactggcctagctgcacttacacaggagttacgcagcacaatcatgcgtcttttgtgaacctgctcaatattgagaccgattatactaagaacttccactttcactccaaaagagtcacagcccatggcgacaccccacagctggatttaaaggcaaggccgacatacggggctggagaaatcactgtgctggtagaggtggccgacatggagcttcacaccaaaaagattgaaatcagtggtttgaagttcgctagcctcacgtgtaccggctgctatgcctgttcttccgggatatcatgcaaagttcgtattcatgtcgatgagcccgacgaactgacagtgcacgtgaagagtgatgaccctgatgtcgttgcagccagctcgtccctaatggctcggaaactggagtttggaactgactctaccttcaaggcgtttagcgcaatgccaaaaacatcactctgcttctacatcgtggaacgagagcactgtaagagttgcaatgaggaagatactaaaaagtgtgtgaacaccaagctggagcagccccaatccattcttatcgaacataaaggcacgataatcggtaagcagaatagcacatgcaccgccagagctagctgttggttggagtccgtaaaatcatttttctatgggctgaagaacatgttaagcggcatttttggaaatgtcttcatgggcatctttctcttcctggcccctttcattcttctgatcttgtttttcatgtttgggtggaggatactcttctgctttaaatgttgccgccggactagaggactgttcaagtacaggcacctaaaggacgacgaagagacaggctatcgccgaattatcgagcggctgaacaacaaaaagggtaaaaataagctcctggatggggaacgtcttgcagacagaaggatcgccgagttgtttagtaccaaaactcatattgga

SEQ ID NO: 10599 - RNA, 2916 nt, synthetic construct
  misc_feature 1..2916: note = derived and/or modified CDS sequence (opt3) from CCHFV(NIVA 118595, Artificial)__JN572083.1__Gn-4aa-Gc
  source 1..2916: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgaaatccttcaagttgtgtgaaaatagcgctactggtaaatcttgcgagattgattcgatccctgtaaagtgtcgacaggggtactgcttaaaaattacccaggagggacgtggccatgtgaagctgtcaagaggcagcgaagtcgtgctagacgcatgtgatagttcctgcgaggttatgatcccaaaggggacaggagacatactcgtggattgttctggtggccagcaacactttctgaaagacaaccttatcgatctggggtgcccgaagattcccttgctcggaaaaatggccatctatatttgtaggatgagcaatcatcctaagaccactatggcgttcctgttttggttctcctttggctacgtcatcacatgcatactgtgcaaagtgattttctatctcttaatcatttttggtaccctggggaagcggttcaagcagtaccgcgaacttaaaccacagacgtgtactatctgcgagaccacacccgtaaacgctatcgacgccgagatgcacgatttgaattgttcatataacatttgcccttactgtgcaagtagactgactagcgacggactagccaggcatgttacccagtgcccaaagcggaaagaaaaggtggaggaaacagagctctacctgaatcttgaacgcataccctgggtcgtgcgaaaactgttgcaagtgtctgagtccaccggcatcgctctcaagagatcaagctggctgattgtcttactggttctctttacggtgagtatcactcctgtacagtctgcaccaataggcaggcggccgcttttcctggactccattgtgaaagggatgaagaacttgctaaatagcacatcgctggagacctctctctccatcgaagccccctggggagctatcaacgtccagtcaacttataagcctacagtgagtgccgcgaatattgcactgagctggtcctctgttgagcaccgtggtaacaaaatccttgtgagcggccgctcagaaagtattatgaagctggaggaaagaaccgggatatcctgggatttgggagtcgaggacgccagcgagtctaaactcctgacggtgtcagtaatggatttaagtcagatgtacagcccagtttttgaatatctgtccggcgacaggcaagtggaggaatggcccaaggctacctgtacaggtgattgccctgagcggtgtgggtgcacttcttcgacctgtctacacaaagaatggccacatagccgaaattggcgctgcaaccccacatggtgctggggcgtcggaactggctgtacctgctgtgggctcgacgtgaaggatctgttcacagactacatgtttgtcaagtggaaagtggagtatatcaagaccgaggccattgtttgcgtggaacttacttcccaggagagacagtgttcattgatcgaagcaggaacgaggttcaacctgggtagtgtaacaatcaccctctctgagccgcggaatattcaacagaaactgcctcccgagataatcactcttcacccacgcattgaagagggcttctttgatctgatgcatgtccagaaggtgttgagcgcttccaccgtttgcaaactccagtcatgtacacacggggtgcctggagacctgcaagtctaccacatcggcaacttactgaagggtgatagagtgaatgggcatctaattcacaagatcgaacagcatctcaacaccagctggatgtcttgggacggctgcgacctggattattactgtaatatgggagactggccctcctgcacttacacaggcgtaacgcagcacaaccatgccagtttcgtgaatcttttgaacatagagaccgattatactaaaacatttcacttccacagcaagagggttaccgcgcatggggacacaccacagctggatctcaaagcccgtcccacttacggagctggtgaaatcaccgtcctggtggaggtggctgacatggagttacacacgaagaaaattgaaatctctggcctgaagtttgcctccctttcatgtaccgggtgctatgcttgcagtagcggaatttcgtgtaaggtccggatccatgttgatgagcctgacgaattgacagtgcacgtgaaatccgatgacccagatgtagtcgccgcatctagctcactcatggcccgaaagctggagagtggcactgactccaccttcaaagcattttctgcgatgccgaagacaagcctatgcttctacatagtggaaagagagtattgtaaaggttgctccaaggaggatactcaaaaatgtgttaataccaagctggaacagccccagtcaattctcatcgagcacaaggggacgattatcggcaaacagaacaatacatgcaccgcaaaggccagctgttggctggaaagtgtgaaatctttcttttacggacttaagaacatgttgtccggcatatttgggaatgtcttcctgggaatctttagcttcttagctcctttcgtgctcctgattctgtttttcatgtttggctggaggatccttttctgctttaaatgttgccgccggactagaggtttgttcaagtataggcatctcaaggacgacgaggaaacagggtaccgcaaaattatcgagcgactgaacaataagaaaggaaagaacaaactactggatggcgagcggctcgccgaccgtaagatagcagaactgttttcgaccaagactcacattggt

SEQ ID NO: 10600 - RNA, 2916 nt, synthetic construct
  misc_feature 1..2916: note = derived and/or modified CDS sequence (opt3) from CCHFV(NIV 112143, Artificial)__JN572085.1__Gn-4aa-Gc
  source 1..2916: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgaaatccttcaagttgtgtgaaaatagcgctactggtaaatcttgcgagattgattcgatccctgtaaagtgtcgacaggggtactgcttaaaaattacccaggagggacgtggccatgtgaagctgtcaagaggcagcgaagtcgtgctagacgcatgtgatagttcctgcgaggttatgatcccaaaggggacaggagacatactcgtggattgttctggtggccagcaacactttctgaaagacaaccttatcgatctggggtgcccgaagattcccttgctcggaaaaatggccatctatatttgtaggatgagcaatcatcctaagaccactatggcgttcctgttttggttctcctttggctacgtcatcacatgcatactgtgcaaagtgattttctatctcttaatcatttttggtaccctggggaagcggttcaagcagtaccgcgaacttaaaccacagacgtgtactatctgcgagaccacacccgtaaacgctatcgacgccgagatgcacgatttgaattgttcatataacatttgcccttactgtgcaagtagactgactagcgacggactagccaggcatgttacccagtgcccaaagcggaaagaaaaggtggaggaaacagagctctacctgaatcttgaacgcataccctgggtcgtgcgaaaactgttgcaagtgtctgagtccaccggcatcgctctcaagagatcaagctggctgattgtcttactggttctctttacggtgagtatcactcctgtacagtctgcaccaataggcaggcggccgcttttcctggactccattgtgaaagggatgaagaacttgctaaatagcacatcgctggagacctctctctccatcgaagccccctggggagctatcaacgtccagtcaacttataagcctacagtgagtgccgcgaatattgcactgagctggtcctctgttgagcaccgtggtaacaaaatccttgtgagcggccgctcagaaagtattatgaagctggaggaaagaaccgggatatcctgggatttgggagtcgaggacgccagcgagtctaaactcctgacggtgtcagtaatggatttaagtcagatgtacagcccagtttttgaatatctgtccggcgacaggcaagtggaggaatggcccaaggctacctgtacaggtgattgccctgagcggtgtgggtgcacttcttcgacctgtctacacaaagaatggccacatagccgaaattggcgctgcaaccccacatggtgctggggcgtcggaactggctgtacctgctgtgggctcgacgtgaaggatctgttcacagactacatgtttgtcaagtggaaagtggagtatatcaagaccgaggccattgtttgcgtggaacttacttcccaggagagacagtgttcattgatcgaagcaggaacgaggttcaacctgggtagtgtaacaatcaccctctctgagccgcggaatattcaacagaaactgcctcccgagataatcactcttcacccacgcattgaagagggcttctttgatctgatgcatgtccagaaggtgttgagcgcttccaccgtttgcaaactccagtcatgtacacacggggtgcctggagacctgcaagtctaccacatcggcaacttactgaagggtgatagagtgaatgggcatctaattcacaagatcgaacagcatctcaacaccagctggatgtcttgggacggctgcgacctggattattactgtaatatgggagactggccctcctgcacttacacaggcgtaacgcagcacaaccatgccagtttcgtgaatcttttgaacatagagaccgattatactaaaacatttcacttccacagcaagagggttaccgcgcatggggacacaccacagctggatctcaaagcccgtcccacttacggagctggtgaaatcaccgtcctggtggaggtggctgacatggagttacacacgaagaaaattgaaatctctggcctgaagtttgcctccctttcatgtaccgggtgctatgcttgcagtagcggaatttcgtgtaaggtccggatccatgttgatgagcctgacgaattgacagtgcacgtgaaatccgatgacccagatgtagtcgccgcatctagctcactcatggcccgaaagctggagttcggcactgacagtacctttaaagcattctccgcgatgccgaagacatctctatgcttttacatagtggaaagagagtattgtaaaggttgcagcaaggaggatactcaaaaatgtgttaataccaagctggaacagccccagtccattctcatcgagcacaaggggacgattatcggcaaacagaacaatacatgcaccgcaaaggcctcatgttggctggaaagcgtgaaaagtttcttttacggacttaagaacatgttgtctggcatattcgggaatgtctttctgggaatcttctccttcttagctccttttgtgctcctgattcttttctttatgttcggctggaggatcctgttttgcttcaaatgttgccgccggactagaggtttgtttaagtataggcatctcaaggacgacgaggaaacagggtaccgcaaaattatcgagcgactgaacaataagaaaggaaagaacaaactactggatggcgagcggctcgccgaccgtaagatagcagaactgttcagcaccaagactcacattggt

SEQ ID NO: 10601 - RNA, 2916 nt, synthetic construct
  misc_feature 1..2916: note = derived and/or modified CDS sequence (opt3) from CCHFV(SCT ex Afghanistan, Artificial)__KC344856.1__Gn-4aa-Gc
  source 1..2916: mol_type = other RNA
agcgaggaatccggcgacgattgcatctctagaacccagctgctcaggacagagactgccgaagtgcacaacgacaattacgggggacccggtgataagattacgatatgtaacggctcaaccatcgtcgaccaacggcttgggagtgagctgggatgctatacaattaatcgcgttaagagcttcaagttgtgtgaaaactccgctactggcaaatcttgcaagatcgattcgacccctgtgaaatgtcgacagggtttttgcttaaagattacacaggaggggcgtggacatgtaaagctgtcaagaggcagcgaggtggtcctagacgcatgtgatagttcctgcgaaatcatgataccaaaaggcaccggggacatcctcgtggattgttctggaggtcagcaacacttcctgaaggacaatcttattgatctgggctgcccgaacatccccttgctcgggaaaatggccatttacatctgtaggatgagcaatcatcctaagactacaatggcgtttctgttctggttttccttcggatatgttataacctgcatcttttgcaaagtgattttctacctgctcattgtcgtgggcacgttaggtaagaagtttaaacagtatcgggagctgaagccacagacttgtaccatctgcgaaacaactcccaccaacgctatcgacgccgagatgcacgatcttaattgttcatacaacatttgcccttattgtgcaagtcgcttgacaagcgacgggctggccagacatgtaacccagtgcccaaaaaggaaggagaaagttgaagagacggaactatacctcaatctggagcggataccctggatcgtgcgcaaacttctgcaagtctctgaatccactggagtggctttgaaacgatcaagctggctcattgtgctgttagtcctgctcacagttagtctttctcctgtgcagtccgcaccaatcggcagaaagccgctgttcttgaacagcatagtaaagggcatgaaaaatctactgaactcgaccaatctcgagacttctctgtccattgaggccccctggggtgctatcaacgtgcagtcaacatttaagcctaccgtcagtacggccaacatcgcgcttagctggtcctctgtggaacacaggggaaataaaattctggttagcggtcggtcagagagtatcatgaagttggaggaacgtaccggcatttcctgggacctcggggtggaagatgcaagcgagtctaaatcactgacagtcagtgtgatggacttaagccagatgtactccccagtattcgagtatctgtctggagatcgccaagttgaagagtggcccaaggccacttgtaccggcgactgccctgaaagatgtggttgcacatcgagcacttgtctacacaaggagtggccacattccaggaactggcggtgcaatcccacctggtgctggggcgtggggacaggatgtacctgctgtggcctcgatgtcaaagacctgtttactgattacatgttcgtgaagtggaaagtcgaatatataaagacggaggctatcgtgtgcgttgagcttacatcacaggaacgacagtgtagtttgattgaggccgggacccgcttcaacctgggaccggtgactatcaccctctctgaacctagaaatatccaacagaaactgcccccagagattataacacttcaccctaggatcgaggaagggtttttcgacctgatgcatgtacagaaggtcttgagcgcatccaccgtgtgcaagctccagtcatgtactcacggcgttcccggggatctgcaagtgtaccacattggaaacttactgaaaggcgacaagctaaatggtcatatgatccacaaaattgagccacattttaacacaagctggatgtcttgggatgggtgcgacctcgactattactgtaatatgggcgattggccctcctgcacgtataccggagtcactcagcacaaccatgctgccttcgtgaatctgcttaacatcgaaacagactacaccaagaattttcacttccacagtaaacgggtaacagcgcatggcgatactcctcagttggacctgaaggcccgcccaacctacggggcaggagagataacggtgctcgttgaagtcgctgatatggagctgcacaccaagaaaatcgacattagcggtttaaagtttgcctctctgacatgtgctggctgctatgcctgctcctcagggatcagttgtaaagtgaggattcatgtggatgagccggacgaacttactgtccacgttaagagcgaggatcccgacatcgtggcagcctcgacctccttgatagctagaaaactcgaactgggaacagattctactttcaaggcgtttagcgcaatgcctaaaacctcactatgcttctacattgtggagcgtgaatattgtaagagttgctccaaggaggacacgcagaaatgtgtaaacacaaagctggagcacccacaaggcatcctcattgaacataaaggtaccatcatagggaagcagaatgatacttgcacagccaaagctggctgttggctggagtctgtcaagagctttttctacggacttaagaacatgttgtccggcatctttgggaacgtgttcattggaatcttcctgtttttagcccccttcgttctcctgattctgtttttcatgtttggctggcggcttttgttctgctttaaatgttgccgaagaaccaggggtctcttcaagtatcgccacctgaaagaagacgaggaatcagggtaccggagaatcatagagaggctaaataacaagaaaggaaagaataagctgctcgacggcgagcgcctggcagatcgacggattgccgaactttttagcactaaaacccatatcggt

SEQ ID NO: 10602 - RNA, 2916 nt, synthetic construct
  misc_feature 1..2916: note = derived and/or modified CDS sequence (opt3) from CCHFV(Zahedan 2007, Artificial)__KC867273.1__Gn-4aa-Gc
  source 1..2916: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgcgtagcttcaaattgtgtgaaaattccgctactggtaagtcttgcgagattgattcgatccctgtaaaatgtaagcaggggttttgcttaaaaattacccaggagggacgaggccatgtgaagctgtcaagaggcagcgaagtcgtgctagacgtttgtgatagttcctgcgaggtgatgatcccaaaggggacaggagacatactcgtcgattgttctggtggccagcaacacttcctgaaagacaaccttgtggatctggggtgcccgaagatccccttgctcggaaaaatggcaatttacatctgtaggatgagcaatcatcctaagaccactatggcctttctgttctggttttccttcggctatgtaattacatgcatcctgtgcaaagcgatatttttcctcttaattatctttggtaccctggggaagcggttcaagcagtaccgcgaacttaaaccacagacgtgtactatttgcgagaccacacccgttaacgctatcgacgccgagatgcacgatttgaattgttcatataacatctgcccttactgtgcaagtagactgactagcgacggactagccaggcatgtgacccagtgcccacggcgcaaggaaaaagtcgaggaaacagagctctatctgaatcttgaacgaataccctgggtggtgagaaagctgttgcaagtctctgagtccaccggcacggttctcaaaaggtcaagctggctgattgtgttactggtactctttactgtgagtctttctcctgtccagtccgctccaatcggccggcgtccgctgttcttggacagcattgtgaaggatatgaaaaacctacttaattcgacatctctcgagacctccctgtcaatcgaagcaccctggggagccataaacgttcagagtacttacaagcctacagtgagcaccgctaatattgccctttcctggtctagcgtcgagcaccgcgggaacaaggtgctggtatcaggtagaagtgaatccatcatgaaattggaggaaaggacgggcatcagctgggacctcggggttgaggatgcgtctgagtcaaagctgttaaccgtgagtgtcatggacctgagccagatgtactccccagtgtttgaatatctatctggagatcggcaagtcgaggaatggcccaaagcaacatgtactggcgactgccctgagcgatgtggttgcacctcgagcacatgtctccacaaggaatggccacattcccgcaattggagatgcaaccccacttggtgctggggcgtggggaccggatgtacatgctgtggcctggatgttaaagaccttttcaccgattacatgttcgtgaagtggaaggtagagtatattaaaactgaggccatcgtctgcgtggaattgacgtcacaggagaggcagtgtagtctgattgaagctgggacacggtttaacctcggatctgttaccataactctgagcgagccgcgcaatatccaacagaagctgcctcccgagattatcaccctgcacccaaaaatcgaagagggtttctttgacttgatgcatgtgcagaaggtcctctccgcctcaacagtgtgcaaactgcagagctgtacccacggcgtacctggggatttacaagtgtaccacattggaaacctgctaaagggcgacagagttaatggtcatctcatacacaagatcgaacagcatttcaacacttcttggatgtcctgggacgggtgcgatctggactattactgtaatatgggcgattggcccagttgcacatatacgggagtcacccagcacaaccatgctagctttgtgaatcttttgaacattgagactgactacacaaaaaccttccactttcactctaagagggtgacagcacatggcgatactccacagctggacctcaaagcccgtcccacctacggggcgggagaaatcacggtcctggttgaggtggccgatatggagttacacaccaagaaaattgaaatctccggtctgaagttcgcaggccttacatgtactgggtgctatgcttgctcaagtggaataagctgtaaggtgcggatccatgtagacgagcctgatgaattgaccgtccacgtgaaatcggacgatccagacgttgtggccgcttcctctagcctcatggcccgaaagctggagtttggcacagattcaactttcaaagcatttagtgccatgccgaagacctccctatgcttctacattgtcgaaagagagtattgtaaatcttgcagcaaggaggacacgcaaaaatgtgtgaatacaaagctggaacagccccagtccatcctcattgagcacaagggtaccatcatagggaaacagaacaatacttgcacagctaaggcgtcatgttggctggaaagcgttaaaagtttcttttacggccttaagaacatgttgggaggcattttcgggaatgtgtttatcggaattttcacctttctgactcctttcatcttactcatatttttctttatgttcggctggaggatcctgttttgcttcaaatgttgccgccggaccagaggtctttttaagtataggcatctgaaggacgatgaggaaacagggtaccgcaaaattatcgagcgattgaacaataagaaaggaaagaaccggctcctggacggcgagcgtctagcagatagaaaaattgccgaactgttctctacgaagacccacatcggt

SEQ ID NO: 10603 - RNA, 2916 nt, synthetic construct
  misc_feature 1..2916: note = derived and/or modified CDS sequence (opt3) from CCHFV(SPU 44/08, Artificial)__KJ682805.1__Gn-4aa-Gc
  source 1..2916: mol_type = other RNA
agcgaggaatccaacgacgattgcctgtctagaacccagctccttaggacagagaatgccgaaatccactcagacaactacggcgggcccggagataagattactatatgtaatggtagtacgatcgtggaccaacggctgggcagcgagttggggtgctataccattaaccgcgtcaaatccttcaagttatgtgaaaattctgctacaggaaaatcgtgcgagatcgattcaactcctgttcgatgtcgtcagggcttttgcctgaagattacccaggagggtagagggcatgtgaaactaagcaggggaagtgaagtagtgctcgacgcatgtgattcctcttgcgagatcatgataccaaagggcacaggcgacatcctggtcgattgtagcgggggacagcaacacttccttaaggacaacctggtggatttgggttgcccgaatattcccctcctgggcaaaatggccatctacatttgtcggatgtccaaccatcctaagaccactatggcgtttctgttctggttttcattcgggtatgttatcacatgcatactctgcaaagctatcttttacttactgattgtggtcggaacccttggcaagaaattcaagcagtatcgcgaattgaagccacagacgtgtactatttgcgagaccaatcccgtgaacgccatcgacgcagagatgcacgatctgaattgtagttacaacatctgcccttattgtgccagcagactaacatctgacggtctcgctaggcatgtaatgcagtgcccaaaacggaaggagaaaattgaagaaactgagctgtaccttaatctggaacgcataccctgggttgtgcgaaagttgctccaagtctccgagtcaaccggggtggcactgaaaagaagcagttggttagtgatcctgctcgtccttctgacagtttctttgtcccctgtgcagagcgccccaatttcgaggaagccgctatttctggactctatcgtaaaaggaatgaagaacctccttaattccacctcacttgagacgagtctgagcatagaagctccctggggcgccattaacgtgcagtccactttcaagcctacagtctctgcggcaaacatcgccttgagctggtcaagtgtggagcaccggggcaataaaatcctcgtttccgggcgtagcgaatctattatgaagctggaggaacgcaccggaatctcatgggatttaggtgtggaggacgctagtgagagcaaactgctaactgtctccgtgatggatctctctcagatgtactcgccagtatttgaatatctgagcggcgacagacaagttgaggaatggcccaaggccacatgtaccggggattgccctgagaggtgtggatgcacgtcctcaacctgtcttcacaaagaatggccacatagtcggaactggcgatgcaatcccacatggtgctggggcgtgggtactgggtgtacctgctgtggcttggacgtcaaggatctgttcacagactacatgtttgtgaagtggaaagtcgattatattaagactgaggcaatagtgtgcgttgagctcacctctcaggaacgccagtgtagcctgatcgaggctggaacaagattcaaccttggcccggtgaccattactctgtccgaacctaggaatatccaacagaaattgcccccagagatcgtaacgctccaccctcggattgaggaagggttctttgacctgatgcatatacagaaggtcttatcagccagcacagtgtgcaaactgcagtcttgtacccacggagttcccggtgatctacaaatctaccacattggcaacctcctgaagggggacaaggtgaatggacatcttatccacaaaattgagccacatttcaacacttcctggatgagttgggacggctgcgatttggactattactgtaatatgggtgattggcccagctgctcttataccggggtcacacagcacaaccatgcggcctttgtgaatatgctgaacatcgaaaccgactacactaagaatttccactttcactccaaacgcgtaacagcacatggcgatacgcctcagctcgacctgaaggctagaccaacctacggagccggcgagataactgtgttagttgaagtcgctgatatggagctgcacaccaaaaagatcgagatttcagggcttaagttcgccagtttgacatgtacaggatgctatgcatgcagctcgggtatctcctgtaaagtgaggattcatgtggacgaaccggatgagctcactgtccacgttaagtctgaagaccccgatatcgtggccgctagctcaagtctgatggcgcgtaaactagagtttggcaccgactccacgttcaaggcattttctgccatgcctaaaaccagcctgtgcttctacatagtggaacgggagtattgtaagtcctgctcaaaagaggatacacagaagtgtgtaaacactaagctcgaacaaccacagagcattctgatcgagcacaaagggaccattatcggaaagcagaatgacacatgcactgctaaagccagttgttggcttgaatctataaagtcctttttctacggcttgaaaaacatgctgagcggtatctttgggaacgtcttcattggcatcttcttatttctcgcacccttcattatgctgatcctgtttttcatgtttggatggcgaatactgttctgctttaagtgttgcagaaggacccgcggcttgttcaagtatcggcatctcaaagacgatgaggaaattgggtacagaaagatcatcgagaggctgaataacaaaaagggcaaaaataagctactggacggagagcgcctcgccgatcgaaagattgctgaactgttttcgacgaaaacacacatcggt

SEQ ID NO: 10604 - RNA, 2916 nt, synthetic construct
  misc_feature 1..2916: note = derived and/or modified CDS sequence (opt3) from CCHFV(SPU 383/87, Artificial)__KJ682806.1__Gn-4aa-Gc
  source 1..2916: mol_type = other RNA
agcgaggaatccaacgacgattgcctgtctagaacccagctccttaggacagagaatgccgaaatccactcagacaactacggcgggcccggagataagattactatatgtaatggtagtacgatcgtggaccaacggctgggcagcgagttggggtgctataccattaaccgcgtcaaatccttcaagttatgtgaaaattctgctacaggaaaatcgtgcgagatcgattcaactcctgttcgatgtcgtcagggcttttgcctgaagattacccaggagggtagagggcatgtgaaactaagcaggggaagtgaagtagtgctcgacgcatgtgattcctcttgcgagatcatgataccaaagggcacaggcgacatcctggtcgattgtagcgggggacagcaacacttccttaaggacaacctggtggatttgggttgcccgaatattcccctcctgggcaaaatggccatctacatttgtcggatgtccaaccatcctaagaccactatggcgtttctgttctggttttcattcgggtatgttatcacatgcatactctgcaaagtgatcttttacttactggtcgtggtaggaacccttggcaagaaattcaagcagtatcgcgaattgaagccacagacgtgtactatttgcgagaccaatcccgttaacgctattgacgccgagatgcacgatctgaattgtagttacaacatctgcccttattgtgcaagcagactaacatctgacggtctcgccaggcatgtgatccagtgcccaaaacggaaggagaaaattgaagaaactgagctgtaccttaatctggaacgcataccctgggtcgtgcgaaagttgctccaagtgtccgagtcaaccggggtcgctctgaaaagaagcagttggttagttatcctgctcgtgcttctgacagtatctttgtcccctgtgcagagcgcaccaatttcgaggaagccgctatttctggactctatcgtcaaaggaatgaagaacctccttaattccacctcactggagacgagtctgagcatagaagccccctggggcgctattaacgtgcagtccactttcaagcctacagtttctgccgcgaacatcgcattgagctggtcaagtgtggagcaccggggcaataaaatcctcgtctccgggcgtagcgaatctattatgaagctggaggaacgcaccggaatctcatgggatttaggtgtggaggacgccagtgagagcaaactgctaactgtatccgttatggatctctctcagatgtactcgccagtgtttgaatatctgagcggcgacagacaagtcgaggaatggcccaaggctacatgtaccggggattgccctgagaggtgtggatgcacgtcctcaacctgtcttcacaaagaatggccacatagtcggaactggcgatgcaatcccacatggtgctggggcgtgggtactgggtgtacctgctgtggcttggacgtcaaggatctgttcacagactacatgtttgtgaagtggaaagttgattatattaagactgaggccatagtgtgcgtagagctcacctctcaggaacgccagtgtagcctgatcgaggcaggaacaagattcaaccttggcccggtcaccattactctgtccgaacctaggaatatccaacagaaattgcccccagagatcgtgacgctccaccctcggattgaggaagggttctttgacctgatgcatatacagaaggttttatcagctagcacagtgtgcaaactgcagtcttgtacccacggagtccccggtgatctacaaatctaccacattggcaacctcctgaagggggacaaggtgaatggacatcttatccacaaaattgagccacatttcaacacttcctggatgagttgggacggctgcgatttggactattactgtaatatgggtgattggcccagctgctcttataccggggtaacacagcacaaccatgccgcgtttgtgaatatgctgaacatcgaaaccgactacactaagaatttccactttcactccaaacgcgttacagcccatggcgatacgcctcagctcgacctgaaggcaagaccaacctacggagctggcgagataactgtcttagtggaagtggccgatatggagctgcacaccaaaaagatcgagatttcagggcttaagttcgctagtttgacatgtacaggatgctatgcctgcagctcgggtatctcctgtaaagtcaggattcatgttgacgaaccggatgagctcactgtgcacgtgaagtctgaagaccccgatatcgtagcagccagctcaagtctgatggctcgtaaactagagtttggcaccgactccacgttcaaggcgttttctgcaatgcctaaaaccagcctgtgcttctacatagtcgaacgggagtattgtaagtcctgctcaaaagaggatacacagaagtgtgtgaacactaagctcgaacaaccacagagcattctgatcgagcacaaagggaccatttttggaaagcagaatgacacatgcactgccaaagctagttgttggcttgaatctgttaagtccttcttttacggcttgaaaaacatgctgagcggtatcttcgggaacgtgttcataggcgtctttttattcctcgccccctttatcatgctgattcttttctttatgttcggatggcgaatcctgttttgcttcaagtgttgcagaaggacccgcggcttgtttaagtatcggcatctcaaagacgatgaggaaattgggtacagaaagatcatagagaggctgaataacaaaaagggcaaaaataagctactggacggagagcgcctcgcagatcgaaagattgccgaactgttctcgacgaaaacacacatcggt

SEQ ID NO: 10605 - RNA, 2916 nt, synthetic construct
  misc_feature 1..2916: note = derived and/or modified CDS sequence (opt3) from CCHFV(SPU 130/89, Artificial)__KJ682807.1__Gn-4aa-Gc
  source 1..2916: mol_type = other RNA
agcgaggaacccaactacgactgcctgtccagaacccagctccttaggacagagaatgccgaaatccactctgataactatggcgggcctggagacaagattactatatgtaatggttcaacgatcgtggatcaacggctgggcagtgagttggggtgctacaccattaaccgcgtcaagagcttcaaattatgtgaaaattccgctacaggaaaatcttgcgagatcgactcgactccagttcgatgtcgtcagggcttttgcctgaagattacccaggagggtagagggcatgtgaaactatcaaggggaagcgaagtagtgctcgatgcatgtgacagttcctgcgagatcatgataccgaagggcacaggcgatatcctggtcgactgttctgggggacagcaacacttccttaaggataacctggtggacttgggttgccccaatattcctctcctgggcaaaatggccatctatatttgtcggatgagcaaccatccaaagaccactatggcgtttctgttctggttttccttcgggtacgttatcacatgcatactctgcaaagtgatcttttatttactgattgtcgtgggaacccttggcaagaaattcaagcagtaccgcgaattgaagccccagacgtgtactatttgcgagaccaatcctgtaaacgctatcgatgccgagatgcacgacctgaattgttcatataacatctgcccatactgtgcaagtagactaacaagcgatggtctcgccaggcatgttatgcagtgccccaaacggaaggagaaaattgaagaaactgagctgtaccttaatctggaacgcataccttgggtggtccgaaagttgctccaagtgtctgagtccaccggggtggctctgaaaagatcaagctggttagtcgttctgctcgtgcttctgacagtaagtttgtctccagtgcagtccgcaccgatcagcaggaagcccctatcgctggactctattgtcaaaggaatgaagaacctccttaattccacctcacttgagacgagtctgagcatcgaagccccttggggcgctataaacgtgcagtccacttttaagccaacagtttctgccgcgaacattgcattgagctggtcaagtgtggagcaccggggcaataaaatcctcgtctccgggcgtagcgaatctatcatgaagctggaggaacgcaccggaatttcatgggacttaggtgtggaggatgccagtgagagcaaactgctaactgtatccgttatggacctctctcagatgtattcgcccgtgttcgaatacctgagcggcgatagacaagtcgaggaatggcctaaggctacatgtaccggggactgcccagagaggtgtggatgcacgtcctcaacctgtcttcacaaagaatggccccatagtcggaactggcgatgcaatccgacatggtgctggggcgtgggtactgggtgtacctgctgtggcttggatgtcaaggacctgtttacagattatatgttcgtgaagtggaaagttgactacatcaagactgaggccattgtgtgcgtagagctcacctctcaggaacgccagtgtagcctgatagaggcaggaacaagatttaaccttggccctgtcaccatcactctgtccgaacccaggaatattcaacagaaattgccacctgagatcgtgacgctccacccccggatcgaggaagggttcttcgatctgatgcatattcagaaggttttatcagctagcacagtgtgcaaactgcagtcttgtacccacggagtcccaggtgacctacaaatatatcacatcggcaacctcctgaagggggataaggtgaatggacatcttattcacaaaatcgagccccattttaacacttcctggatgagttgggacggctgcgacttggattactattgtaatatgggtgactggcctagctgctcttacaccggggtaacacagcacaaccatgccgcgttcgtgaatatgctgaacattgaaaccgattacactaagaattttcacttccactccaaacgcgttacagcccatggcgacacgccacagctcgatctgaaggcaagaccgacctatggagctggcgagatcactgtcttagtggaagtggccgacatggagctgcacaccaaaaaggtcgagatatcagggcttaagtttgctagtttgacatgtacaggatgctacgcctgcagctcgggtatctcctgtaaagttaggattcatgtggatgaacccgacgagctcactgtgcacgtaaagtctgaagatcctgacatcgtcgcagccagctcaagtctgatggctcgtaaactagagttcggcaccgattccacgtttaaggcgttctctgcaatgccaaaaaccagcctgtgcttttatattgtggaacgggagcactgtaagtcctgctcaaaagaggacacacagcgatgtgttaacactaagctcgaacaaccccagagcatcctgatagagcataaggggaccattatcggaaaacagaatgatacatgcactgccaaggctagttgttggcttgaatctattaaatccttcttttacggcttgaagaacatgctgagcggtatcttcgggaacgtgtttataggcgtcttcttattcctcgccccttttatcattctgatccttttctttatgttcggatggaggattctgttttgcttcaaatgttgcagacgcacccggggcttgctcaagtatagacacctgaaggacgacgaggaaatcgggtacaggaaaataattgagcgcctaaataacaagaaaggaaagaataaactgctcgatggcgagcgactggcagaccggaagatcgccgaactgttttcgacgaagacacatatcggt

SEQ ID NO: 10606 - RNA, 2916 nt, synthetic construct
  misc_feature 1..2916: note = derived and/or modified CDS sequence (opt3) from CCHFV(SPU 497/88, Artificial)__KJ682808.1__Gn-4aa-Gc
  source 1..2916: mol_type = other RNA
agcgaggaatccaacgacgattgcctgtctagaacccagctccttaggacagagaatgccgaaatccactcagacaactacggcgggcccggagataagattactatatgtaatggtagtacgatcgtggaccaacggctgggcagcgagttggggtgctataccattaaccgcgtcaaatccttcaagttatgtgaaaattctgctacaggaaaatcgtgcgagatcgattcaactcctgttcgatgtcgtcagggcttttgcctgaagattacccaggagggtaaagggcatgtgaagctaagcagaggaagtgaagtagtgctcgacgcatgtgattcctcttgcgagatcatgataccaaagggcacaggcgacatcctggtcgattgtagcgggggacagcaacacttccttaaagacaacctggtggatttgggttgcccgaatattcccctcctgggcaagatggccatctacatttgtaggatgtccaaccatcctaaaaccactatggtttttctgttctggttttcattcgggtatgtgatcacatgcatactctgcaaggtcatcttttacttactgattgtggtaggaacccttggcaaaaagttcaagcagtatcgggaattgaaaccacagacgtgtactatttgcgagaccaatcccgttaacgcgatcgacgctgagatgcacgatctgaattgtagttacaacatctgcccttattgtgccagccgcctaacatctgacggtctcgcaagacatgtgatgcagtgcccaaagaggaaagaaaagattgaggaaactgagctgtaccttaatctggaacggataccctgggtcgtgcgcaaattgctccaagtgtccgagtcaaccggggtcgccctgaagcgaagcagttggttagttatcctgctcgtgcttctgacagtatctttgtcccctgtgcagagcgctccaatttcgagaaaaccgctatttctggactctatcgtcaagggaatgaggaacctccttaattccacctcacttgagacgagtctgagcatagaagcaccctggggcgccattaacgtgcagtccactttcaagcctacagtttctgctgccaacatcgcgttgagctggtcaagtgtggagcaccggggcaataaaatcctcgtctccgggcgtagcgaatctattatgaagctggaggaacgcaccggaatctcatgggatttaggtgtggaggacgcaagtgagagcaaactgctaactgtatccgttatggatctctctcagatgtactcgccagtgtttgaatatctgagcggcgacagacaagtcgaggaatggcccaaggccacatgtaccggggattgccctgagaggtgtggatgcacgtcctcaacctgtcttcacaaagaatggccacatagtcggaactggcgatgcaatcccacatggtgctggggcgtgggtactgggtgtacctgctgtggcttggacgtcaaggatctgttcacagactacatgtttgtgaagtggaaagttgattatattaagactgaggctatagtgtgcgtagagctcacctctcaggaacgccagtgtagcctgatcgaggccggaacaagattcaaccttggcccggtcaccattactctgtccgaacctaggaatatccaacagaaattgcccccagagatcgtgacgctccaccctcggattgaggaagggttctttgacctgatgcatatacagaaggttttatcagcaagcacagtgtgcaaactgcagtcttgtacccacggagtccccggtgatctacaaatctaccacattggcaacctcctgaagggggacaaggtgaatggacatcttatccacaaaattgagccacatttcaacacttcctggatgagttgggacggctgcgatttggactattactgtaatatgggtgattggcccagctgctcttataccggggtaacacagcacaaccatgctgcctttgtgaatatgctgaacatcgaaaccgactacactaagaatttccactttcactccaaacgcgttacagcgcatggcgatacgcctcagctcgacctgaaggccagaccaacctacggagcaggcgagataactgtcttagtggaagtggctgatatggagctgcacaccaaaaagatcgagatttcagggcttaagttcgccagtttgacatgtacaggatgctatgcttgcagctcgggtatctcctgtaaagtcaggattcatgttgacgaaccggatgagctcactgtgcacgtgaagtctgaagaccccgatatcgtagccgcaagctcaagtctgatggcccgtaaactagagtttggcaccgactccacgttcaaggctttttctgcgatgcctaaaaccagcctgtgcttctacatagtcgaacgggagtattgtaagtcctgctcaaaagaggatacacagaagtgtgtgaacactaagctcgaacaaccacagagcattctgatcgagcacaaagggaccattatcggaaagcagaatgacacatgcactgcacgagccagttgttggcttgaatctataaaatcctttttctacggcttgaagaacatgctgagcggtatctttgggaacgttttcattggcatcttcttatttttcgctccctttattatgctcatcctgttctttatgttcggatggagaatactgttttgcttcaaatgttgcaggcgcacccggggcctgtttaagtatagacatttgaaggacgatgaggaagtggggtacaggaaaattatcgagcgcctcaataacaagaaaggaaagaataaactgctagacggcgagcgactggccgatcggaagatcgcagaactcttctcgacgaagacacacattggt

SEQ ID NO: 10607 - RNA, 2916 nt, synthetic construct
  misc_feature 1..2916: note = derived and/or modified CDS sequence (opt3) from CCHFV(SPU 18/88, Artificial)__KJ682810.1__Gn-4aa-Gc
  source 1..2916: mol_type = other RNA
agcgaggaatccaacgacgattgcctgtctagaacccagctccttaggacagagaatgccgaaatccactcagacaactacggcgggcccggagataagattactatatgtaatggtagtacgatcgtggaccaacggctgggcagcgagttggggtgctataccattaaccgcgtcaaatccttcaagttatgtgaaaattctgctacaggaaaatcgtgcgagatcgattcaactcctgttcgatgtcgtcagggcttttgcctgaagattacccaggagggtagagggcatgtgaaactaagcaggggaagtgaagtagtgctcgacgcatgtgattcctcttgcgagatcatgataccaaagggcacaggcgacatcctggtcgattgtagcgggggacagcaacacttccttaaggacaacctggtggatttgggttgcccgaatattcccctcctgggcaaaatggccatctacatttgtcggatgtccaaccatcctaagaccactatggggtttctgttctggttttcattcggatatgttatcacatgcatactctgcaaagtgatcttttacttactgattgtcgtgggcacccttggtaagaaattcaagcagtatcgcgaattgaagccacagacgtgtactatttgcgagaccaatcccgtaaacgcgatcgacgctgagatgcacgatctgaattgtagttacaacatctgcccttattgtgccagcagactaacatctgacgggctcgcaaggcatgttatgcagtgcccaaaacggaaggagaaaattgaagaaactgagctgtaccttaatctggaacgcataccctgggtggtccgaaagttgctccaagtgtccgagtcaaccggagtggccctgaaaagaagcagttggttagtcatcctgctcgttcttctgacagtgtctttgtcccctgtacagagcgctccaatttcgaggaagccgctatttctggactctatcgtgaaaggcaagaagaacctccttaattccacctcacttgagacgagtctgagcatagaagcaccctggggcgccattaacgtccagtccactttcaaacctacagtgtctgctgccaacatcgcgttgagctggtcaagtgttgagcaccgggggaataagatcctcgtgtccggacgtagcgaatctattatgaaactggaggaacgcaccggtatctcatgggatttaggcgtcgaggacgcaagtgagagcaagctgctaactgtgtccgtaatggatctctctcagatgtactcgccagtttttgaatatctgagcggggacagacaagtggaggaatggcccaaagccacatgtaccggagattgccctgagaggtgtggctgcacgtcctcaacctgtcttcacaaggaatggccacatagtcggaactggcgatgcaatcccacatggtgctggggtgtcgggactggctgtacctgctgtggattggacgtgaaggatctgttcacagactacatgtttgtcaaatggaaggtggattatattaaaactgaggctatagtttgcgtggagctcacctctcaggaacgccagtgtagcctgatcgaggccggcacaagattcaaccttgggccggtaaccattactctgtccgaacctaggaatatccaacagaagttgcccccagagatcgtcacgctccaccctcggattgaggaaggattctttgacctgatgcatatacagaaagtgttatcagcaagcacagtttgcaagctgcagtcttgtacccacggtgtgcccggcgatctacaaatctaccacattgggaacctcctgaagggagacaaagtcaatggccatcttatccacaagattgagccacatttcaacacttcctggatgagttgggacggttgcgatttggactattactgtaatatgggggattggcccagctgctcttataccggcgtgacacagcacaaccatgctgcctttgtaaatatgctgaacatcgaaaccgactacactaaaaatttccactttcactccaagcgcgtgacagcgcatggagatacgcctcagctcgacctgaaagccagaccaacctacggcgcaggggagataactgttttagtcgaagtggctgatatggagctgcacacaaagaagatcgagatttcaggacttaaattcgccagtttgacctgtacaggttgctatgcttgcagctcgggcatctcctgtaaggtgaggattcatgtcgacgaaccggatgagctcactgttcacgtgaaatctgaagaccccgatatcgtggccgcaagctcaagtctgatggcccgtaagctagagtttgggaccgactccacgttcaaggctttttctgcgatgcctaaaaccagcctgtgcttctacatagtagaacgggagtattgtaaatcctgctcaaaggaggatacacagaagtgtgtcaacactaaactcgaacaaccacagagcattctgatcgagcacaagggaaccattatcggcaaacagaatgacacatgcactggtaaggcagggtgttggcttgaaagtataaaatcctttttctacggcttgaagaacatgctgtctggaatctttggcaacgtgttcattgggatcttcttatttctcgcccccttcattatgctgatcctgtttttcatgtttggatggcgaatactgttctgctttaagtgttgcagaaggacccgcggcttgttcaaatatcggcatctcaaggacgatgaggaaattggttacagaaaaatcatcgagaggctgaagaataaaaaggggaagaacaaactactggacggagagcgcctcgctgatcgaaagattgccgaactgtttagcacgaaaacacacatcggc

SEQ ID NO: 10608 - RNA, 2916 nt, synthetic construct
  misc_feature 1..2916: note = derived and/or modified CDS sequence (opt3) from CCHFV(SPU 431/85, Artificial)__KJ682812.1__Gn-4aa-Gc
  source 1..2916: mol_type = other RNA
agcgaggaatccgacggcgattgcatctctagaacccagctgctcaggacagagactacggaaattcactcagacaactacgggggacccggtgataagataaccatctgtaatggcagtacaattgtggaccaacggcttgggagcgagctgggatgctatactatcaaccgcgtcaaatccttcaagttgtgtgaaaattctgccaccggcaaatcgtgcgagattgattcaacacctgttaagtgtcgacagggtttttgcttaaaaatcacccaggaggggcgtggacatgtgaagctgagcagaggcagtgaaatagtactagacgcttgtgattccaactgcgagatcatgattccaaagggcactggggacatcctcgtggattgttctggaggtcagcaacacttcctgaaagacaatcttattgatctgggctgcccgaacatccccttgctcgggaagatggcaatatacatttgtaggatgagcaatcatcctaaaacaaccatggcctttctgttctggttttccttcggatatgtcatcacgtgcattctgtgcaaggtgatcttttacctcttaatcgttgcgggcactgtgggtaaaaagttcaagcagtatcgggaactgcgcccacagacctgtacaatttgcgagactatacccgtcaacgctatcgacgccgagatgcacgatcttaattgttcatacaacatttgcccttattgtgcaagtagattgaccagcgacgggctggccaggcatgtgatgcagtgcccaaaacggaaggaaaaagtagaggaaacagagctatacctcaatctggaacgcatcccctgggttgtgcgaaagctgctgcaagtctctgagtccaccggagtggctttgaaaagatcaagctggctcacggtgctgttagtcctgctcatagttagtctttctcctgtgcagtccgcaccaattggcaggaagccgctgtttttggacagcatcgtaaaaggccggaagaacctacttaattcgacttctctcgagacatccctgtcaatcgaagccccctggggagctattaacgtgcagagtaccttcaagcctactgtcagcgccgcgaatatcgcactttcctggtctagcgtggagcaccgtgggaacaaaattctggtttcaggtcgcagtgaatccataatgaagttggaggaaagaacaggcatcagctgggatctcggggtggaggacgcctctgagtcaaaactgttaaccgtcagtgtgatggatctgagccagatgtactccccagtatttgaatatctatctggagacaggcaagttgaggaatggcccaaggctacgtgtaccggcgattgccctgagcggtgtggttgcacatcgagcacttgtctccacaaagaatggccacattcccgaaactggcgctgcaatcccacctggtgctggggcgtggggacaggatgtacttgctgtggcctggacgtcaaggatcttttcaccgactacatgtttgtgaagtggaaagtcgagtatattaagacagaggccatcgtgtgcgttgaattgacctcacaggagagacagtgtagtctgatcgaagcagggactaggttcaacctcggaccggtgacgattacactgtctgagcctcggaatatacaacagaaacttcccccagagatcattaccctgcaccctcgcatcgaagagggtttctttgatttgatgcatgtacagagagtcctcagcgcttccactgtgtgcaagctgcagtcatgtacccacggcgttcccggggacttacaagtgtaccacattggaaacctgctaaaaggcgataaggtcaatggtcatctcatccacaagatagaaccacatttcaacacaagctggatgtcttgggacgggtgcgacctggattattactgtaatatgggcgactggccctcctgcacctatactggagtgacacagcacaaccatgccgcgtttgtaaatcttttgaacatcgagacggattacaccaaaaatttccactttcacagtaagagggtgactgcccatggcgacacacctcagctggatctcaaagcacgtccaacctacggggctggagaagttacagtcctggtggaggtggccgacatggagttacacactaagaaaattgaaatcagcggtctgaagttcgcttctcttacctgtacgggctgctatgcctgctcctcagggattagttgtaaggtcaaaatccatgttgatgagccggacgaattgaccgtgcacgtaaagagcgaggatcccgacatagtggcagccggatcgtccctcatggctcggaaactggaatttggcgcggattctacattcaaggcatttagcgccatgcctaaaacttcactatgcttctacattgtcgagcgagagtattgtaagagttgctccagagaagacaccaggaaatgtgtgaacacaaagctggatcgcccacagtctatcctcattgagcacaagggtactatcatagggaaacaaaataatacctgcacggctaaggccagctgttggctggaatccgttaaatcatttttctacggccttaagaacatgttgagcggaatctttggcaacgtgttcattgggatcttcctgtttattgcacccttcgtcttactcatcctgtttttcatgtttggatggcggatacttttctgctttaaatgttgcagaaggacacgcggcctgttcaagtatcgacatttgaaggacgacgaggaaaccggttaccggaaaattatcgagcgtctcaacaataagaaagggaagaacaaactgctagatggagagagactggccgacaggaagatcgctgaactctttagtactaagtctcacattggc

SEQ ID NO: 10609 - RNA, 2916 nt, synthetic construct
  misc_feature 1..2916: note = derived and/or modified CDS sequence (opt3) from CCHFV(SPU 48/90, Artificial)__KJ682813.1__Gn-4aa-Gc
  source 1..2916: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaaatccttcaagttgtgtgaaaattccgctactggcaaatcttgcgttattgattcggtgccagtaaagtgtcgacagggttactgcttacgtatcacccaggaggggagaggacatgtgaaactgtcaaggggcagcgaggtcgtgctagacgcatgtgatacaagttgcgaaataatgatcccgaagggcaccggggacattctcgttgattgttccggaggtcagcaacactttctgaaggacaaccttatcgatctgggctgccccaaaattcctttgctcgggaagatggccatctatatatgtcggatgtctaatcatccaactacaaccatggcgttcctgttttggttcagctttggatacgtgattacgtgcatcctgtgcaaagctattttctatctcttaatcatcattggcactctgggtaagcgctttagacagtacagggagcttaaaccccagacctgtacaatatgcgaaactacccctgtcaacgccatcgacgcagagatgcacgatttgaattgttcctataacatttgcccatactgtgcctcacggctgacaagtgacgggctagctcgccatgtgacccagtgccccaagcgaaaggagaaagtagaagagacggaactctacctgaatcttgagagaatcccttgggttgtgaggaagctgttgcaagtcagcgaatctactggagtggcactcaaacggtcctcatggctgatagtgttactggtcctcttcacagttagccttagtccagtgcagtctgccccgattggccgtaagcccctgtttcgcgactccatcgtaaaaggcatgaagaacttgctaaatagcacctcgctggagacttctctctccatcgaggctccttggggagccattaacgtgcagtcaacatataaaccaaccgtcagtacggcgaatatcgcactgagctggtcctctgtggaacacagagggaacaagattcttgttagcggtaggtcagagagtataatgaagctggaagaacggaccggcatctcctgggatttgggggtggaagacgccagcgagtctaaactcctgacagtctcagtgatggatttaagtcagatgtacagccccgtattcgagtatctgtccggagaccgacaagttgaagagtggcctaaggctacttgtaccggcgattgcccagaacgctgtggttgcacatcttcgacttgtctacacaaagagtggccccatagcagaaattggaggtgcaacccgacctggtgctggggcgtggggacaggatgtacctgctgtggcctcgacgtcaaggatctgtttactgactacatgttcgtgaaatggaaggtcgaatatattaagacggaggccatcgtgtgcgttgagcttacatcccaggaacggcagtgttcattgatcgaggcagggacccgctttaacctgggacctgtgactattaccctcagtgaacccagaaatatacaacagaaactgccacctgagatcattacacttcaccccaggatcgaggaaggtttcttcgatctgatgcatgtacagaaggtcttgtctgctagcaccgtgtgcaaactccagtcctgtactcacggcgttccaggggacctgcaagtgtaccacattggaaacttactgaagggcgataaagtcaatggtcatctaatccacaagatagagccccattttaacacatcatggatgagctgggacgggtgcgacctcgattattactgtaatatgggcgactggccttcttgcacgtacaccggagtgactcagcacaaccgtgcctccttcgtaaatctgcttaacatcgaaacagattataccaagaattttcatttccacagtaaacgggtgacagcgcacggcgacactccacagttggatctgaaggcccgaccgacctacggggcaggagagattacggttctcgtcgaagtggctgacatggagctgcataccaaaaagatcgagattagcggtttaaaatttgcctctctgacatgtactggctgctatgcttgctcctcagggatcagttgtaaggtgagaatacacgtcgatgaacccgacgagcttaccgttcatgtaaagagcgatgaccctgatgtggtggccgcatcgtcctctttgatggccaggaaactcgagttcggaacagacagcacttttaaggctttctcagcgatgccaaaaaccagtctgtgcttttacattgtcgagaaggaatattgtaaatcctgctctgaggaggatacgaagaaatgtgtgaacacaaagctagaacagccccaaagcatcctgattgagcacaagggcaccatcataggtaaacagaatagcacttgcacagcaaaggtttcatgttggctcgaaagcgccaaaagtttcttttacgggctgaaggacatgctttctggcatcttcggaaacgtgtttattggcatcttcttgttcctggctccttttattttactcatcctgttctttatgttcgggtggcgcatacttctgtgctttaaatgttgccggagaaccaggggattgttcaagtatcgccacctcaaggacgatgaggaaactggctaccgacggattatcgagcgtctgaataacaaaaagggtaaaaataagctactggacggggagagactcgccgataggcgcatcgcagaactgttttccaccaaaacacatattgga

SEQ ID NO: 10610 - RNA, 2916 nt, synthetic construct
  misc_feature 1..2916: note = derived and/or modified CDS sequence (opt3) from CCHFV(SPU 187/90, Artificial)__KJ682814.1__Gn-4aa-Gc
  source 1..2916: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaaatccttcaagttgtgtgaaaattccgctactggcaaatcttgcgagattgattcggttccagtgaagtgtcgacagggttactgcttacgtatcacccaggaggggagaggacatgtaaaactgtcaaggggcagcgaagtggtcctagacgcatgtgatacaagttgcgagataatgatcccgaagggcaccggggacattctcgtggattgttccggaggtcagcaacactttctgaaggacaaccttatcgatctgggctgccccaaaattcctttgctcgggaagatggccatctatatatgtcggatgtctaatcatccaaaaactacaatggcgttcctgttttggttcagctttggatacgttattacctgcatcctgtgcaaggctattttctatctcttaatcatcattggcacgctgggtaaacgctttaagcagtacagagaacttaagccccagacttgtaccatatgcgagacaactcctgtgaacgccatcgacgcagagatgcacgatttgaattgttcctataacatttgcccatactgtgcctcaaggctgaccagtgacgggctagctcggcatgtcacacagtgccccaaacgcaaggaaaaagtggaggaaaccgagctctacctgaatcttgaacgaatcccttgggtagttagaaagctgttgcaagtgagcgagtctacgggagtcgcactcaaaaggtcctcatggctgatagtgttactggtcctcttcactgtgagccttagtccagttcagtctgccccgattggccggcgtcccctgtttttggactccatcgtgaagggcatgaaaaacctactgaatagcacatcgctcgagacctctctgtccatcgaagctccttggggagccattaacgtacagtcaacttataagccaacagtgagtaccgcgaatatcgcacttagctggtcctctgtcgagcaccgcgggaacaagattctggtgagcggtagatcagaaagtataatgaaattggaggaaaggacgggcatctcctgggatctcggggttgaggacgccagcgagtctaagctgttaaccgtgtcagtcatggatctgagtcagatgtacagccccgtgttcgaatatctatccggagaccggcaagtagaggaatggcctaaagctacatgtactggcgattgcccagagcgatgtggttgcacctcttcgacatgtctccacaaggaatggccccatagccgcaattggagatgcaacccgacttggtgctggggcgttgggaccggatgtacatgctgtggcctggacgtgaaagatctttttaccgactacatgttcgtcaagtggaaggtggagtatattaaaactgaggccatcgtctgcgtggaattgacgtcccaggagaggcagtgttcactgatcgaagcagggacacggtttaacctcggacctgttaccattactctgagtgagccccgcaatatacaacagaaacttccacctgagatcattaccctgcaccccagaatcgaagagggtttcttcgatttgatgcatgtgcagaaagtactctctgctagcacagtctgcaagctgcagtcctgtacccacggcgtgccaggggacttacaagtttaccacattggaaacctgctaaaaggcgataaggtgaatggtcatctcatccacaagatagaaccccattttaacacttcatggatgagctgggacgggtgcgacctggattattactgtaatatgggcgactggccttcttgcacatacacgggagtcacccagcacaaccatgcctccttcgtgaatcttttgaacatcgagactgattataccaaaaattttcacttccacagtaagagggtaacagcgcatggcgacacaccacagctggatctcaaagcccgtccgacttacggggcaggagaaattaccgtgctggttgaggtcgctgacatggagttacacacgaagaaaatcgaaattagcggtctgaagtttgcctctcttacctgtacaggctgctatgcttgctcctcagggatcagttgtaaggtgcggatacatgtggatgagcccgacgaattgactgtccacgttaaaagcgatgaccctgatgtggtggccgcatcgtcctctctcatggcccgaaagctggagttcggaaccgacagcatttttaaggctttctcagcgatgccaaagacaagtctatgcttttacatcgtagaaagagagcactgtaaatcctgctctgaggaagatactaagaaatgtgtcaacaccaagctggagcagccccaaagcattctcatcgaacataagggcacgataatcggtaaacagaatagcacatgcaccgcaaagacttcatgttggctggagagcgtgaaaagtttcttttatgggcttaagaacatgttgtctggcattttcggaaatgtttttatcggcattttcctgttcttagccccttttatcctcctgatacttttctttatgttcgggtggaggattctgttttgcttcaaatgttgccgccggacaagaggattgtttaagtacaggcacctcaaggacgacgaagagaccggctatcgccgaatcatcgagcggctgaacaataaaaagggtaaaaacaagctactggatggggaacgtctcgctgacagaaggattgccgagctgttctccactaaaacccatatcgga

SEQ ID NO: 10611 - RNA, 2916 nt, synthetic construct
  misc_feature 1..2916: note = derived and/or modified CDS sequence (opt3) from CCHFV(Haskovo-V46/13, Artificial)__KR092379.1__Gn-4aa-Gc
  source 1..2916: mol_type = other RNA
agcgaggaactgggcgacgattgcatctccagaacccagctccttaggacagagactgccgaaattcacgacgataactacgggggacccggtgacaagataacgatctgtaatggctctaccattgtggatcaacggctggggtcagagttgggatgctatacaatcaaccgcggcaaaagtttcaagttatgtgaaaatagcgctactggtaaaacctgcgagattgactccacacctgtcaagtgtcgacaggggttttgcctgaaaatcacccaggagggacgtggccatgttaagctatctagaggctcggaagtggtactcgatgcatgtgactcaagctgcgaggtgatgataccaaaggggactggagatatcctggtcgactgtagtggtggccagcaacacttccttaaagataacctgattgacttggggtgcccgcatatccccctcctgggaaagatggccatttacatctgtaggatgtccaatcaccctcggacaaccatggcgtttctgttctggttttctttcggctatgtgataacgtgcatcttttgcaaagctctcttctacagcttaattattatcggtactctggggaagaaaatcaagcagtatcgcgaacttaagccacagacctgtacaatttgcgagactacccccgttaacgccatagatgcagagatgcatgacttgaattgttcctacaacatctgcccttattgtgcctcaagactgacaagtgacggactagctaggcacgtgacccagtgcccaaaacggaaggaaaaagtcgaggaaacggagctctacctgaatcttgaacgcattccctggatcgtgcgaaagctgttgcaagtaagcgagtctactggcgttgcactcaaaagatcctcatggctgatagtgttactggtcctccttcctgtgagcctgagtccagtgcagtctgccccggtcggcaggaagcccttgtttctagattccattgttaaagggatgaagaacctgctcaatagcacatcgctggagacctctctttccatcgaagctccttggggagccatcaacgtgcagtcaactttcaagccaacagtaagtaccgcgaatattgcactgagctggtcctctgtggagcaccggggtaacaaaatcttggtcacgggccgtagcgaatcaattatgaagctcgaggaacgcaccggggtgagttgggacctgggagttgaggatgcctccgagagcaaattactgacagtgtctataatggacctatcacagatgtacagtcccgtctttgaatatctcagcggcgatagacaagtggaggaatggcctaaggctacttgtaccggtgactgcccagagaggtgtgggtgcacatcctctacttgtctgcataaagaatggccccactcgcggaattggcgatgcaacccgacctggtgctggggcgtaggaacaggctgtacctgctgtggggttgatgtgaaggaccttttcactgatcatatgtttgtcaagtggaaagtggagtacatcaagacggaggccattgtctgcgtggaattgacaagccaggagcgccagtgttccctgatcgaagcaggaaccagattcaacctcggtcctgttactatcaccctgtcagagcccaggaatattcaacagaaacttccacctgagataatcacactgcaccccaagattgaagagggcttctttgacttgatgcacgtgcagaaagtactcagtgcttctaccgtctgcaagctgcagagctgtactcatgggatcccaggagatttacaagtgtatcacattggcaacctgctaaagggtgaccgggttaatgggcatctcatccacaaaatagaaccccatttcaacacatcctggatgtcatgggacggctgcgatctggactactattgtaatatgggagattggcctagctgcacgtacaccggcgtgactcagcacaaccacgccgcgtttgtcaatcttttgaacatcgagacagactataccaagacattccattttcactctaaacgcgtgactgcccatggggataccccacagctggacctcaaggcaagaccgacgtacggagctggtgaaattaccgtactggtggaggttgccgatatggagttacacactaaaaaggtcgaaatctccggcctgaagttcgctagtcttacatgtaccgggtgctacgcctgcagctctggaatttcctgtaaagtgaggatccacgtggacgagcccgatgaattgacagtccatgttaagtcaagtgaccctgatgtggtggcagccggcactagcctcatggctcgtaaactggagtttggtaccgactcgacgttcaaggcgttttccgcaatgccaaaaacatctctatgcttctatatagtagaacgggagtactgtaagagctgctcagaggatgacacccagaaatgtgtcgacactaagctggaacaaccccagagtattctcatcgagcacaaggggacaattatcggcaaacagaatgatacctgcactgcccgagcttcctgttggctggaatctgtgaagtcatttttctatggacttaaaaacatgttgggctccgtttttgggaatttcctgataggaatcttactcttcctggccccttttgtgcttctggtcttgttctttatgttcggctggaagattctcttttgcttcaaatgttgcagaaggacccgcggtctgtttaagtaccggcatctaaaggacgatgaggaaacagggtatagaaggatcattgagcgcctgaacagcaaaaagggcaaaaatcgactcctggacggagagcggcttgcagatcgtaagatcgccgaattgttcagcacgaaaacccacataggt

SEQ ID NO: 10612 - RNA, 2916 nt, synthetic construct
  misc_feature 1..2916: note = derived and/or modified CDS sequence (opt3) from CCHFV(24-R-2012, Artificial)__KR814856.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgacacttcatgcgaggtcatgataccgaagggcacaggggatatcctcgtggactgtagcggaggtcagcaacacttcctgaaagataaccttattgacctgggctgcccccatatccctttgctcgggaagatggccatttacatctgtaggatgagtaatcacccacggaccacgatggcgtttctgttctggttttccttcggatatgttataacttgcatcttttgcaaagctctgttctactctctcattattatcggcaccttaggtaagaaaatcaagcagtatcgcgaactgaagccccagacatgtactatttgcgagaccgcccctgtgaacgcaatagatgccgagatgcatgaccttaattgtagctacaacatctgcccatattgtgcttccagattgacatcagacgggctggcaaggcacgtcccccagtgccctaaacggaaggaaaaagtggaggaaaccgagctatacctcaatctggaacgcattccatggatcgtacgaaaacttctgcaagttagtgagagcacgggagtggccttgaaaagatcttcctggctcatagtcctgttagtgctgctcactgtgtcacttagcccggtccagagtgctcccgttggcaggaagcctctgtttttggattctattgtgaaaggcatgaagaacctacttaattccacaagcctcgagacctcgctgtctatcgaagccccatggggagcgatcaacgtacagtccactttcaagcccacagtgtcaaccgcaaatattgcccttagttggagctccgtcgagcaccgggggaacaaaatcctggtgacgggtcgttctgaaagcattatgaagttggaggaacgcaccggcgtttcatgggacctcggggtggaggatgctagtgagtccaaactgttaacagtcagcataatggacctgtctcagatgtactcacctgtgtttgaatatctaagtggagatagacaagtagaggaatggccaaaggccacttgtaccggcgactgccccgagaggtgtggttgcacaagctccacttgtctccataaagaatggccgcactctcggaattggcgatgcaaccctacctggtgctggggcgttgggacaggatgtacctgctgtggcgtggatgtcaaggacctgttcactgatcatatgtttgtgaagtggaaagtcgagtacatcaagacggaggcaattgtgtgcgttgaacttacatcgcaggagcgccagtgtagcttgatcgaagctgggaccagattcaacctgggacccgtgactatcaccctctccgagccaaggaatattcaacagaaactgcctcccgagataatcacacttcacccaaaggtagaagagggtttctttgacctgatgcacgtccagaaagtgttgtcagccagtaccgtttgcaagctccagtcttgtactcatggcattcccggggatctgcaagtgtatcacatcggaaacttactgaagggcgaccgggtcaatggtcatctaattcacaaaatcgaacctcatttcaacacaagctggatgtcctgggacgggtgcgatctcgactactattgtaatatgggcgattggccatcatgcacgtacaccggagtgactcagcacaaccacgcggcctttgtaaatctgcttaacatagagacagactataccaagacattccattttcacagcaaacgcgtgactgcacatggcgataccccgcagttggacctgaaggctagacccacgtacggggccggagaaatcaccgttctcgtcgaggtggctgatatggagctgcacacaaagaaggtggaaatttctggtttaaagttcgcctccctggcatgtactggctgctacgcctgcagtagcgggatctcttgtaaagtcaggattcacgttgacgagcctgatgaacttaccgtgcatgtgaagtccaatgacccagatgtagtcgctgcgtcaacaagtttgatggcacgtaaactcgagtttggaactgacagcaccttcaaggccttttcggctatgcccaaaacgtccctgtgcttctatatcgtggaacgggagtactgtaagtcttgcagcgaggaagatacacagaaatgtgttgacaccaagctagagcaacctcagtcaatactgattgaacacaagggcactatcattggtaaacagaacgacacatgcaccgccaaggcaagttgttggctcgagtccgtgaaatctttcttttatgggctgaagaatatgcttggcagcgtctttggaaacttcttcatcggcatattgctgtttttagccccattcgtgctcctggttctgtttttcatgtttgggtggaaaatcctgttctgctttaagtgttgccgaagaactaggggattgctcaagtaccgcctgctaaaagatgacgaagagaccggctatcggagaattatcgagaggctgaataacaagaaaggtaagaatcgcctcctggatggggaacgacttgctgaccggaaaattgccgagttgttctccacaaagacgcatatcgga

SEQ ID NO: 10613 - RNA, 2916 nt, synthetic construct
  misc_feature 1..2916: note = derived and/or modified CDS sequence (opt3) from CCHFV(36-ST-2014, Artificial)__KR814857.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacagcctcattatcatcggcactttaggtaaaaagattaagcagtatcgggaactgaaaccccagacctgtacaatatgcgagactgcccctgttaacgcaatcgatgccgagatgcatgaccttaattgttcctacaacatttgcccatattgtgcttcacgcttgaccagtgacgggctggcaagacacgtgacacagtgccccaagaggaaagaaaaggtcgaggaaaccgagctatacctcaatctggaacggatcccttggatagtgcgcaaacttctgcaagtaagcgagtctacgggagttgccttgaagcgatcctcatggctcattgtgctgttagtcctgctcactgtgagccttagtccagtgcagtctgctccggtcggcagaaaacccctgtttttggattccatcgttaagggcatgaagaacctactgaatagcacatcgctcgagacctctctgtccatcgaagccccttggggagcgattaacgtgcagtcaactttcaaaccaacagtaagtaccgcaaatatcgcccttagctggtcctctgtggagcacagggggaacaagattctggtcacgggtcggagcgaatcaataatgaaattggaggaacgtaccggcgtgagttgggacctcggggttgaggatgcttccgagagcaagctgttaacagtgtctatcatggacctgtcacagatgtacagtcccgtctttgaatatctaagcggagatcgccaagtggaggaatggcctaaagccacttgtaccggcgactgcccagagagatgtggttgcacatcctctacttgtctccataaggaatggccccactcgaggaattggcggtgcaacccgacctggtgctggggcgtagggacaggatgtacctgctgtggcgttgatgtgaaggacctgttcactgatcatatgtttattaaatggaaggtcgagtacatcaaaacggaggcaatcgtgtgcgtcgaacttacaagccaggagcgacagtgttccttgattgaagctgggacccgcttcaacctgggacctgtgactataaccctctcagagcccagaaatatccaacagaagctgccacctgagattatcacacttcaccccaaaattgaagagggtttctttgacctgatgcacgttcagaaggtgttgagtgcctctaccgtatgcaagctccagagctgtactcatggcatcccaggggatctgcaaatatatcacatcggaaacttactgaaaggcgacaggctaaatggtcatctcattcacaagatcgaaccccatttcaacacatcctggatgtcatgggacgggtgcgatctggactactattgtaatatgggcgattggcctagctgcacgtacaccggagtcactcagcacaaccacgcggcctttgtgaatcttttgaacattgagacagactataccaaaacattccattttcactctaagcgggttactgcacatggcgataccccacagctggacctcaaagctcgcccgacgtacggggccggagaaatcaccgtgctggtcgaggtggctgatatggagttacacacaaagaaggtagaaatatccggtctgaaattcgccagtcttgcatgtactggctgctacgcctgcagctctgggatttcctgtaaggtgagaatccacgttgacgagcccgatgaattgaccgtccatgtgaaatcaagtgaccctgatgtggtcgctgcgagcacatcgctcatggcaaggaagctggagtttggaactgactccaccttcaaagccttttctgctatgccaaagacgagcctatgcttctatattgttgaacgtgagtactgtaaatcatgcagtgaggatgacacaaagaagtgtgtggacaccaaactggatcagccccaatccatcctcatagaacacaagggcactatcattggtaaacagaatgacacatgcaccgccaaggcatcttgttggctggagagcgtgaaatcctttttctatgggcttaagaacatgttgggctcagtatttggaaatttcttcgtcggcatcctgttatttctcgcccctttcgtgctgcttgttctgtttttcatgtgcgggtggaagtttttgttctgttttaaatgctgtcggcgaactagaggactcttcaagtacaggcatctgaaagatgacgaagagaccggctatcgccggattatcgaaagactaaacagcaagaaaggtaagaataggctgctcgatggggagcgcctggctgaccgaaagatagccgagctttttagtacaaaatctcacattgga

SEQ ID NO: 10614 - RNA, 2916 nt, synthetic construct
  misc_feature 1..2916: note = derived and/or modified CDS sequence (opt3) from CCHFV(37-R-2013, Artificial)__KR814858.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgacacttcatgcgaggtcatgataccgaagggcacaggggatatcctcgtggactgtagcggaggtcagcaacacttcctgaaagataaccttattgacctgggctgcccccatatccctttgctcgggaagatggccatttacatctgtaggatgagtaatcacccacggaccacgatggcgtttctgttctggttttccttcggatatgttataacttgcatcttttgcaaagctctgttctactctctcattattatcggcaccttaggtaagaaaatcaagcagtatcgcgaactgaagccccagacatgtactatttgcgagaccgcccctgtgaacgcaatagatgccgagatgcatgaccttaattgtagctacaacatctgcccatattgtgcttccagattgacatcagacgggctggcaaggcacgtcccccagtgccctaaacggaaggaaaaagtggaggaaaccgagctatacctcaatctggaacgcattccatggatcgtacgaaaacttctgcaagttagtgagagcacgggagtggccttgaaaagatcttcctggctcatagtcctgttagtgctgctcactgtgtcacttagcccggtccagagtgctcccgttggcaggaagcctctgtttttggattctattgtgaaaggcatgaagaacctacttaattccacaagcctcgagacctcgctgtctatcgaagccccatggggagcgatcaacgtacagtccactttcaagcccacagtgtcaaccgcaaatattgcccttagttggagctccgtcgagcaccgggggaacaaaatcctggtgacgggtcgttctgaaagcattatgaagttggaggaacgcaccggcgtttcatgggacctcggggtggatgacgctagtgagtccaaactgttaacagtcagcataatggatctgtctcagatgtactcacctgtgtttgagtatctaagtggagacagacaagtagaagagtggccaaaggccacttgtaccggcgattgccccgaaaggtgtggttgcacaagctccacttgtctccataaagagtggccgcactctcggaattggcgatgcaaccctacctggtgctggggcgttgggacaggatgtacctgctgtggcgtggacgtcaaggatctgttcactgaccatatgtttgtgaagtggaaagtcgaatacatcaagacggaggcaattgtgtgcgttgagcttacatcgcaggaacgccagtgtagcttgatcgaggctgggaccagattcaacctgggacccgtgactatcaccctctccgaaccaaggaatattcaacagaaactgcctcccgagataatcacacttcacccaaaggtagaggaaggtttctttgatctgatgcacgtccagaaagtgttgtcagccagtaccgtttgcaagctccagtcttgtactcatggcattcccggggacctgcaagtgtatcacatcggaaacttactgaagggcgaccgggtcaatggtcatctaattcacaaaatcgagcctcatttcaacacaagctggatgtcctgggatgggtgcgacctcgattactattgtaatatgggcgactggccatcatgcacgtacaccggagtgactcagcacaaccacgcggcctttgtaaatctgcttaacatagaaacagattataccaagacattccattttcacagcaaacgcgtgactgcacatggcgacaccccgcagttggatctgaaggctagacccacgtacggggccggagagatcaccgttctcgtcgaagtggctgacatggagctgcacacaaagaaggtggagatttctggtttaaagttcgcctccctggcatgtactggctgctacgcctgcagtagcgggatctcttgtaaagtcaggattcacgttgatgaacctgacgagcttaccgtgcatgtgaagtccaatgatccagacgtagtcgctgcgtcaacaagtttgatggcacgtaaactcgaatttggaactgatagcaccttcaaggccttttcggctatgcccaaaacgtccctgtgcttctatatcgtggagcgggaatactgtaagtcttgcagcgaggaggacacacagaaatgtgttgacaccaagctagaacaacctcagtcaatactgattgagcacaagggcactatcattggtaaacagaacgtgacatgcaccgccaaggcaagttgttggctcgaatccgtcaaatctttcttttatgggctgaagaatatgcttggcagcgtgtttggaaacttcttcatcggcatattgctgtttttagccccattcgttctcctggtgctgtttttcatgtttgggtggaaaatcctgttctgctttaagtgttgccgaagaactaggggattgctcaagtaccgcctgctaaaagatgacgaggaaaccggctatcggagaattatcgagaggctgaataacaagaaaggtaagaatcgcctcctggatggggagcgacttgctgaccggaaaattgccgaattgttctccacaaagacgcatatcgga

SEQ ID NO: 10615 - RNA, 2916 nt, synthetic construct
  misc_feature 1..2916: note = derived and/or modified CDS sequence (opt3) from CCHFV(44-ST-2010, Artificial)__KR814859.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgctgtggttctcttttggatatgtgattacgtgcatcttctgcaaggctctcttttacagcttaattatcatcggcactctgggtaaaaagattaagcagtatcgggaacttaaaccccagacctgtacaatatgcgagactgcccctgttaacgcaatcgatgccgagatgcatgacttgaattgttcctacaacatttgcccatattgtgcttcacgcctgaccagtgacgggctagcaagacacgtgacacagtgccccaagaggaaagaaaaggtcgaggaaaccgagctctacctgaatcttgaacggatcccttggatagtgcgcaaactgttgcaagtaagcgagtctacgggagttgccctcaagcgatcctcatggctgattgtgttactggtcctccttactgtgagcctgagtccagtgcagtctgctccggtcggcagaaaacccttgttcctagattccatcgttaagggcatgaagaacctgctcaatagcacatcgctggagacctctctttccatcgaagccccttggggagcgattaacgtgcagtcaacttttaaaccaacagtaagtaccgcaaatatcgccctgagctggtcctctgtggagcacagggggaacaagattttggtcacgggtcggagcgaatcaataatgaaactcgaggaacgtaccggcgtgagttgggacctgggggttgaggatgcttccgagagcaagttactgacagtgtctatcatggacctatcacagatgtacagtcccgtcttcgaatatctcagcggagatcgccaagtggaggaatggcctaaagccacttgtaccggcgactgcccagagagatgtggttgcacatcctctacttgtctgcataaggaatggccccactcgaggaattggcggtgcaacccgacctggtgctggggcgtagggacaggatgtacctgctgtggcgttgatgtgaaggacctttttactgatcatatgttcattaaatggaaggtcgagtacatcaaaacggaggcaatcgtgtgcgtcgaattgacaagccaggagcgacagtgttccctgattgaagctgggacccgctttaacctcggacctgtgactataaccctgtcagagcccagaaatatccaacagaaacttccacctgagattatcacactgcaccccaagattgaagagggtttcttcgacttgatgcacgttcagaaggtgctcagtgcctctaccgtatgcaagctgcagagctgtactcatggcatcccaggggatttacaaatatatcacatcggaaacctgctaaaaggcgacaggctcaatggtcatctgattcacaagatcgaaccccattttaacacatcctggatgtcatgggacgggtgcgatcttgactactattgtaatatgggcgattggcctagctgcacgtacaccggagtcactcagcacaaccacgcggccttcgtgaatttgctgaacattgagacagactataccaaaacatttcatttccactctaagcgggttactgcacatggcgataccccacagctcgacctgaaagctcgcccgacgtacggggccggagaaatcaccgtgttagtcgaggtggctgatatggagctgcacacaaagaaggtagaaatatccggtcttaaatttgccagtttggcatgtactggctgctacgcctgcagctctgggatttcctgtaaggtgagaatccacgttgacgagcccgatgaactcaccgtccatgtgaaatcaagtgaccctgatgtggtcgctgcgagcacatcgctgatggcaaggaagctagagttcggaactgactccacctttaaagccttctctgctatgccaaagacgagcctgtgcttttatattgttgaacgtgagtactgtaaatcatgcagtgaggatgacacaaagaagtgtgtggacaccaaactcgatcagccccaatccatcctgatagaacacaagggcactatcattggtaaacagaatgacacatgcaccgccaaggcatcttgttggcttgagagcgtgaaatccttcttttatgggttgaagaacatgctgggctcagtattcggaaactttttcgtcggcatcttactcttcctggccccttttgtgcttctggttttgttctttatgtgcgggtggaagattctcttctgttttaaatgctgtcggcgaactagaggactgttcaagtacaggcatctaaaagatgacgaagagaccggctatcgccggatcatagaaagactgaatagcaagaaaggtaagaataggctcctggatggggagcgccttgctgaccgaaagattgccgagttgtttagtacaaaatctcacatcgga

SEQ ID NO: 10616 - RNA, 2916 nt, synthetic construct
  misc_feature 1..2916: note = derived and/or modified CDS sequence (opt3) from CCHFV(46-ST-2012, Artificial)__KR814860.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaagagatcctcatggctcatagtcctgttagtgctgctcacggtgagccttagtccggtccagtctgctcccgttggcaggaagcctctgtttttggattccattgtgaaaggcatgaagaacctactgaatagcacttcgctcgagacatctctgtccatcgaagccccatggggagcgatcaacgtacagtcaaccttcaagcccactgtgagtacagcaaatattgcccttagctggtcctctgtcgagcaccgggggaacaaaatcctggtgaccggtcgtagcgaatcaattatgaagttggaggaacgcacgggcgttagttgggacctcggggtggaggatgcttccgagagcaaactgttaaccgtctctataatggacctgtcacagatgtacagtcctgtgtttgaatatctaagcggagatagacaagtagaggaatggccaaaggccacatgtactggcgactgccccgagaggtgtggttgcacctcctctacatgtctccataaagaatggccgcactcgcggaattggcgatgcaaccctacttggtgctggggcgttgggaccggatgtacatgctgtggcgtggatgtcaaggacctgttcaccgatcatatgtttgtgaagtggaaagtcgagtacatcaagactgaggcaattgtgtgcgttgaacttacgagccaggagcgccagtgttccttgatcgaagctgggacaagattcaacctgggacccgtgaccatcactctctcagagccaaggaatattcaacagaaactgcctcccgagataatcacccttcacccaaaggtagaagagggtttctttgacctgatgcacgtccagaaagtgttgagtgcctctacagtttgcaagctccagagctgtacccatggcattcccggggatctgcaagtgtatcacatcggaaacttactgaagggcgaccggattaatggtcatctaatccacaaaatagaacctcatttcaacacttcctggatgtcatgggacgggtgcgatctcgactactattgtaatatgggcgattggccaagctgcacatacacgggagtcacccagcacaaccacgcggcctttgtgaatctgcttaacatcgagactgactatacaaagaccttccattttcactctaaacgcgtaacagcacatggcgatactccgcagttggacctgaaggctagacccacctacggggccggagaaattacggtgctcgttgaggtcgctgatatggagctgcacaccaaaaaggtggaaatctccggtttaaagttcgccagtctggcatgtacaggctgctacgcctgcagctctgggatttcctgtaaagtgaggatccacgtcgacgagcctgatgaacttactgttcatgtgaagtcaagtgacccagatgtggtagctgcgagcacctcgttgatggcacgtaaactcgagtttggaacagactccactttcaaggccttttctgctatgcccaaaaccagcctgtgcttctatatagtcgaacgggagtactgtaagtcatgcagtgaggaagatacgcagaaatgtgtggacacacgactagagcaacctcagtccattctgatcgaacacaagggcaccattatcggtaagcagaatgacacttgcacagccaaagcatcttgttggctcgagagcgttaagtcctttttctatgggctgaaaaacatgcttggctcagtgtttggaaatttcttcataggcatcttgctgtttttagccccattcgtcctcctggtgctgtttttcatgtttgggtggaagattcttttctgctttaaatgttgcagaaggacccgcggattgctcaagtaccggcatctgaaggatgacgaagagactggctatagaaggatcattgagcgcctaaacaataaaaagggtaaaaaccgactgctcgatggggaacggctggctgaccgtaagatcgccgagcttttcagcaccaaaacacacatagga

SEQ ID NO: 10617 - RNA, 2916 nt, synthetic construct
  misc_feature 1..2916: note = derived and/or modified CDS sequence (opt3) from CCHFV(47-ST-2013, Artificial)__KR814861.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtaagaatagcgctactggcaaaacctgcgaaattgactccacaccagttaagtgtcgccagggtttttgcttaaagatcacccaggaggggcgaggacatgtgaaactgtctcgtggctcggaggtagtgctagatgcatgtgactcaagctgcgaaataatgatcccgaagggcactggggatattctcgtcgactgtagtggaggtcagcaacacttcctgaaagataaccttatcgacctgggctgcccccatattcctttgctcgggaagatggccatctacatatgtagaatgtccaatcacccaaggacaaccatggcgtttctgttctggttttctttcggatatgtgattacgtgcatcttttgcaaagctctgttctacagcctcattatcatcggcactttaggtaagaagattaaacagtatcgggagctgaagccccagacctgtacaatatgcgaaactgcccctgttaacgcaatcgatgccgagatgcatgaccttaattgttcctacaacatttgcccatattgtgcttcacgcttgaccagtgacgggctggcaagacacgtgacacagtgccccaaaaggaaggagaaagtcgaagagaccgaactatacctcaatctggagcggatcccttggatagtgcgcaaacttctgcaagtaagcgaatctacgggagttgccttgaagcgatcctcatggctcattgtgctgttagtcctgctcactgtgagccttagtccagtgcagtctgctccggtcggcagaaagcccctgtttttggattccatcgttaagggcatgaaaaacctactgaatagcacatcgctcgagacctctctgtccatcgaggccccttggggagcgattaacgtgcagtcaactttcaagccaacagtaagtaccgcaaatatcgcccttagctggtcctctgtggaacacagggggaacaaaattctggtcacgggtcggagcgagtcaataatgaagttggaagagagaaccggcgtgagttgggacctcggggttgaagatgcttccgagagcaaactgttaacagtgtctatcatggacctgtcacagatgtacagtcccgtctttgagtatctaagcggagatcgccaagtggaagagtggcctaaggccacttgtaccggcgaatgcccagagagatgtggttgcacatcctctacttgtctccataaggaatggccccactcgaggaattggcggtgcaacccgacctggtgctggggcgtagggacaggatgtacctgctgtggcgttgacgtgaaagatctgttcactgaccatatgtttattaagtggaaagtcgagtacatcaagacggaggcaatcgtgtgcgtcgaacttacaagccaggagcgacagtgttccttgattgaagctgggacccgcttcaacctgggacctgtgactataaccctctcagagcccagaaatatccaacagaaactgccacctgagattatcacacttcaccccaagattgaagagggtttctttgatctgatgcacgttcagaaggtgttgagtgcctctaccgtatgcaaactccagagctgtactcatggcatcccaggggacctgcaaatatatcacatcggaaacttactgaagggcgatagggtcaatggtcatctaattcacaaaatcgaaccccatttcaacacatcctggatgtcatgggacgggtgcgacctcgattactattgtaatatgggcgactggcctagctgcacgtacaccggagtgactcagcacaaccacgcggcctttgttaatctgcttaacattgagacagattataccaagacattccattttcactctaaacgggtgactgcacatggcgacaccccacagttggatctgaaggctcgcccgacgtacggggccggagaaatcaccgtcctcgtggaggtagctgacatggagctgcacacaaagaaagtggaagtttccggtttaaagttcgccagtctggcatgtactggctgctacgcctgcagctctgggatatcctgtaaagtccgtattcacgtggatgagcccgacgaacttaccgtgcatgtcaagtcaagtgatcctgacgttgtggctgcgagcacatcgttgatggcaaggaaactcgagtttggaactgattccaccttcaaggccttttctgctatgccaaaaacgagcctgtgcttctatatcgtggaacgtgagtactgtaagtcatgcagtgaggacgatacaaagaaatgtgtagacaccaagctagaacagccccaatccattctgatcgagcacaaaggcactataatcggtaagcagaatgacacatgcaccgccaaagcatcttgttggctcgaaagcgtcaagtcctttttctatgggctgaagaacatgcttggctcagtgtttggaaatttcttcgttggcattttgctgtttttagcccctttcgtgctcctggtcctgtttttcatgtttgggtggaaaatccttttctgctttaagtgttgccggcgaactagaggattgttcaaatacaggcatctcaaggatgacgaggaaaccggctatcgccggattatcgagagactgaacagcaaaaagggtaagaataggctactggatggggagcgcctcgctgaccgaaaaatagccgaactgtttagtacaaagacgcacattgga

SEQ ID NO: 10618 - RNA, 2916 nt, synthetic construct
  misc_feature 1..2916: note = derived and/or modified CDS sequence (opt3) from CCHFV(52-R-2014, Artificial)__KR814862.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgacacttcatgcgaggtcatgataccgaagggcacaggggatatcctcgtggactgtagcggaggtcagcaacacttcctgaaagataaccttattgacctgggctgcccccatgttcctttgctcgggaagatggccatctacatttgtaggatgagtaatcacccacggaccacgatggcgtttctgttctggttttccttcggatatgtgatcacttgcatattttgcaaagctctgttctactctctcattatcattggcaccttaggtaagaaaatcaagcagtatcgcgaactgaagccccagacatgtactatctgcgagaccgcccctgtcaacgcaattgatgccgagatgcatgaccttaattgtagctacaacatatgcccatattgtgcttccagattgacatcagacgggctggcaaggcacgtgccccagtgccctaaacggaaggaaaaagtagaggaaaccgagctatacctcaatctggaacgcatcccatggattgttcgaaaacttctgcaagtgagtgagagcacgggagtcgccttgaaaagatcttcctggctcatcgtgctgttagtgctgctcactgtctcacttagcccggttcagagtgctcccgtgggcaggaagcctctgtttttggattctatagtaaaaggcatgaagaacctacttaattccacaagcctcgagacctcgctgtctattgaagccccatggggagcgatcaacgtgcagtccactttcaagcccacagtctcaaccgcaaatatcgcccttagttggagctccgtggagcaccgggggaacaaaattctggttacgggtcgttctgaaagcatcatgaagttggaggaacgcaccggcgtgtcatgggacctcggggtcgatgacgctagtgagtccaaactgttaacagtgagcattatggatctgtctcagatgtactcacctgtatttgagtatctaagtggagacagacaagttgaagagtggccaaaggccacttgtaccggcgattgccccgaaaggtgtggttgcacaagctccacttgtctccataaagagtggccgcactctcggaattggcgatgcaaccctacctggtgctggggcgtggggacaggatgtacctgctgtggcgtcgacgtgaaggatctgttcactgaccatatgtttgtcaagtggaaagtggaatacataaagacggaggcaatcgtttgcgtggagcttacatcgcaggaacgccagtgtagcttgattgaggctgggaccagattcaacctgggacccgtaactatcaccctctccgaaccaaggaatatccaacagaaactgcctcccgagattataacacttcacccaaaggtcgaggaaggtttctttgatctgatgcacgtgcagaaagttttgtcagccagtaccgtgtgcaagctccagtcttgtactcatggcatccccggggacctgcaagtctatcacattggaaacttactgaagggcgaccgggtgaatggtcatctaatccacaaaattgagcctcatttcaacacaagctggatgtcctgggatgggtgcgacctcgattactattgtaatatgggcgactggccatcatgcacgtacaccggagtaactcagcacaaccacgcggcctttgtgaatctgcttaacatcgaaacagattataccaagacattccattttcacagcaaacgcgttactgcacatggcgacaccccgcagttggatctgaaggctagacccacgtacggggccggagagataaccgtcctcgtggaagtggctgacatggagctgcacacaaagaaggtcgagatctctggtttaaagttcgcctccctggcatgtactggctgctacgcctgcagtagcgggatttcttgtaaagttaggatccacgtggatgaacctgacgagcttaccgtgcatgtaaagtccaatgatccagacgtcgtggctgcgtcaacaagtttgatggcacgtaaactcgaatttggaactgatagcaccttcaaggccttttcggctatgcccaaaacgtccctgtgcttctatattgttgagcgggaatactgtaagtcttgcagcgaggaggacacacagaaatgtgtggacaccaagctagaacaacctcagtcaatcctgatagagcacaagggcactattatcggtaaacagaacgatacatgcaccgccaaggcagggtgttggctcgaaagtgtcaaatcctttttctatggcctgaagaatatgcttggatctgtgtttggcaacttcttcattgggatcttgctgtttttagccccattcgttctcctggtgctgtttttcatgtttggatggaaaatactgttctgctttaagtgttgccgaagaactaggggcttgctcaagtaccgcctgctaaaagacgatgaggaaaccggttatcggagaatcattgagaggctgaataacaagaaagggaagaatcgcctcctggacggagagcgacttgctgatcggaaaatcgccgaattgttcagcacaaagacgcatattggc

SEQ ID NO: 10619 - RNA, 2916 nt, synthetic construct
  misc_feature 1..2916: note = derived and/or modified CDS sequence (opt3) from CCHFV(75-R-2012, Artificial)__KR814863.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccgcaccagttaagtgtcgacagggtttttgcttaaaaatcacacaggaggggcgtggacatgtgaagctgtctagaggctcggaagtagtgctagatgcctgtgactcaagctgcgaggtcatgataccgaagggcaccggggatatcctcgtggactgtagtggaggtcagcaacacttcctgaaagataaccttattgacctgggctgcccccatatccctttgctcgggaagatggcgatttacatctgtaggatgtccaatcacccacggactacaatggcttttctgttctggttttctttcggatatgttataacctgcatcttttgcaaagccctgttctacagcctcattattatcggcacgttaggtaagaaaatcaagcagtatcgcgaactgaagccccagacttgtaccatttgcgagacagcacctgtgaacgccatagatgctgagatgcatgaccttaattgttcctacaacatctgcccatattgtgcatcaagattgaccagtgacgggctggccaggcacgtcccccagtgccctaaacggaaggaaaaagtggaggaaaccgagctatacctcaatctggaacgcattccatggatcgtacgaaaacttctgcaagttagcgagtctacaggagtggctttgaagagatcctcatggctcatagtcctgttagtgctgctcaccgtgagccttagtccggtccagtctgcccccgttggcaggaagcctctgtttttggattccattgtgaaaggcatgaagaacctactgaatagcacgtcgctcgagacttctctgtccatcgaagcgccatggggagcaatcaacgtacagtcaacattcaagcccaccgtgagtactgccaatattgctcttagctggtcctctgtcgagcaccgggggaacaaaatcctggtgacaggtcgtagcgaatcaattatgaagttggaggaacgcaccggcgttagttgggacctcggggtggaggatgcctccgagagcaaactgttaacggtctctataatggacctgtcacagatgtacagtcctgtgtttgaatatctaagcggagatagacaagtagaggaatggccaaaggcaacctgtacaggcgactgccccgagaggtgtggttgcacttcctctacctgtctccataaagaatggccgcactcgcggaattggcgatgcaaccctacatggtgctggggcgttgggactggatgtacctgctgtggcgtggatgtcaaggacctgttcacagatcatatgtttgtgaagtggaaagtcgagtacatcaagaccgaggctattgtgtgcgttgaacttactagccaggagcgccagtgttccttgatcgaagccgggacgagattcaacctgggacccgtgacaatcaccctctcagagccaaggaatattcaacagaaactgcctcccgagataatcactcttcacccaaaggtagaagagggtttctttgacctgatgcacgtccagaaagtgttgagtgcgtctaccgtttgcaagctccagagctgtacacatggcattcccggggatctgcaagtgtatcacatcggaaacttactgaagggcgaccgggtcaatggtcatctaattcacaaaatcgaacctcatttcaacacctcctggatgtcatgggacgggtgcgatctcgactactattgtaatatgggcgattggccaagctgcacttacacaggagtgacgcagcacaaccacgccgcatttgtaaatctgcttaacatagagaccgactatactaagacattccattttcactctaaacgcgtgaccgctcatggcgatacaccgcagttggacctgaaggccagacccacttacggggctggagaaatcaccgttctcgtcgaggtggccgatatggagctgcacacgaaaaaggtggaaatttccggtttaaagttcgcaagtctggcctgtaccggctgctacgcttgcagctctgggatctcctgtaaagtcaggattcacgttgacgagcctgatgaacttacagtgcatgtgaagtcaagtgacccagatgtagtcgcggcaagcacttcgttgatggcccgtaaactcgagtttggaaccgactccacattcaaggctttttctgccatgcccaaaactagcctgtgcttctatatcgtggaacgggagtactgtaagtcatgcagtgaggaagatacccagaaatgtgttgacacgaagctagagcaacctcagtccatactgattgaacacaagggcacaatcattggtaaacagaatgacacttgcactgcaaaggcctcttgttggctcgagagcgtgaaatcctttctgtatgggcttaagaacatgttgggctcagtcttcggaaactttttcatcggcatactgttattcctcgctccatttgtgctgcttgttctgttctttatgttcgggtggaaaatcttgttttgcttcaagtgttgccgaagaacaaggggactcctgaagtaccgcctactgaaagatgacgaagagaccggctatcggagaattatcgagaggctcaataataagaaaggtaagaaccgcctgcttgatggggaacgattggccgaccggaaaattgcagagctgtttagcactaagacccatatcgga

SEQ ID NO: 10620 - RNA, 2916 nt, synthetic construct
  misc_feature 1..2916: note = derived and/or modified CDS sequence (opt3) from CCHFV(75-ST-2010, Artificial)__KR814864.1__Gn-4aa-Gc
  source 1..2916: mol_type = other RNA
agcgaggaatccggcgacgattgcatctctagaacccagctgctcaggacagagactgccgaaattcacgacgataactacgggggacccggtgacaagataacgatctgtaatggctcaaccattgtggatcaacggcttgggagtgagctgggatgctatacaatcaaccgcgtcaagagcttcaagttgtgtgaaaattccgctactggcaaaacctgcgagattgactctacacctgttaagtgtcgacagggtttttgcttaaaaatcacccaggaggggcgtggacatgtgaagctgtcgagaggctcagaagtagtgctagatgcatgtgacagcagttgcgaggtcatgataccaaagggcactggggatatcctcgtggactgttccggaggtcagcaacacttcctgaaagataaccttattgacctgggctgcccgcatatccccttgctcgggaagatggccatttacatctgtaggatgtctaatcaccctcggacaaccatggcgtttctgttctggtttagcttcggatatgttataacgtgcctgttttgcaaagctctcttctactccttaattatcattggcactctgggtaagaaaatcaagcagtatcgcgaacttagaccacagacctgtacaatctgcgagactgcccccgtgaacgcaattgatgccgagatgcatgacttgaattgttcatacaacatatgcccttattgtgctagtaggctgaccagcgacgggctagcacggcacgtcccacagtgccccaagcgcaaagaaaaggtggaggaaacagagctctacctgaatcttgaacgaatcccttggattgtaagaaaactgttgcaagtttctgagtccaccggagtggccctcaagaggtcaagctggctgatcgtcttactggtgctccttacggtgagtctgtctccagtccagtccgctccggttggccggaaacccttgtttctagatagcatagtgaagggcatgaaaaacctgctcaattcgacttctctggagacatccctttcaattgaagccccttggggagcgatcaacgtacagagtaccttcaagccaactgtgagcacagcaaatatcgccctgtcctggtctagcgtcgagcaccgtgggaacaagattttggtgaccggtcgctcagaaagtatcatgaaactcgaggaaagaacgggcgtttcctgggacctgggggtggaggatgctagcgagtctaagttactgaccgtctcaattatggacctaagtcagatgtacagccccgtgtttgaatatctctccggagataggcaagtagaggaatggcctaaagccacatgtactggcgactgcccagagcggtgtggttgcacctcttcgacatgtctgcataaggaatggccccacagccgaaattggcgctgcaacccgacttggtgctggggcgttgggaccggatgtacatgctgtggcgtggatgtcaaagaccttttcaccgatcatatgtttgtgaagtggaaggtcgagtacataaaaactgaggcaatcgtgtgcgttgaattgacgtcccaggagagacagtgttcactgattgaagctgggacaaggttcaacctcggacctgtgaccatcactctgagtgagccccggaatatccaacagaaacttccacctgagattataaccctgcaccccaaagtagaagagggtttctttgacttgatgcacgtccagaaggtgctctctgccagcacagtttgcaaactgcagtcctgtacccatggcatcccaggggatttacaagtgtatcacattggaaacctgctaaagggcgaccgcgtcaatggtcatctcatccacaagattgaaccccatttcaacacttcatggatgagctgggacgggtgcgatctggactactattgtaatatgggcgattggccttcttgcacatacacgggagtgacccagcacaaccacgcggcctttgtaaatcttttgaacatcgagactgactatacaaaaaccttccattttcactccaagagagtgacagcacatggcgatactccacagctggacctcaaagctaggccgacctacggggccggagaaataacggttctggtcgaggtggctgatatggagttacacaccaagaaagtggaaatcagtggtctgaagttcgccagccttgcatgtacaggctgctacgcctgttcttccgggatttcatgcaaggtccgtatccacgttgacgagcccgatgaattgactgtgcatgtgaaaagtagcgaccctgatgtagtcgctgcgtcgacctccctcatggcacggaagctggagtttggaacagactctactttcaaagcctttagcgctatgccaaagacctcactatgcttctatattgtggaacgagagtactgtaaaagttgctccgaggaagatacgcagaagtgtgttgacacaaaactggagcaaccccagtctatcctcatagaacacaagggcaccattatcggtaagcagaatgacacttgcacagccaaagcaagctgttggctggagtccgtgaagtcatttttctatgggcttaaaaacatgttgggcagcgtctttggaaatttcttcattggcatcctgttatttctcgcccctttcgtgctgcttgttctgtttttcatgtttgggtggaagatattgttctgctttaaatgttgcagaagggctcgcggactcctgaagtaccggcatctaaaggatgacgaagagaccggctatagaaaaatcattgagaggctgaacaataagaaaggtaagaaccgcctcctggatggggaacgacttgccgaccggaaaatcgcagagttgttcagtactaagacccacattgga

SEQ ID NO: 10621 - RNA, 2916 nt, synthetic construct
  misc_feature 1..2916: note = derived and/or modified CDS sequence (opt3) from CCHFV(3756-ST-2007, Artificial)__KR814866.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacagcctcattatcatcggcactttaggtaaaaagattaagcagtatcgggaactgaaaccccagacctgtacaatatgcgagactgcccctgttaacgcaatcgatgccgagatgcatgaccttaattgttcctacaacatttgcccatattgtgcttcacgcttgaccagtgacgggctggcaagacacgtgacacagtgccccaagaggaaagaaaaggtcgaggaaaccgagctatacctcaatctggaacggatcccttggatagtgcgcaaacttctgcaagtaagcgagtctacgggagttgccttgaagcgatcctcatggctcattgtgctgttagtcctgctcactgtgagccttagtccagtgcagtctgctccggtcggcagaaaacccctgtttttggattccatcgttaagggcatgaagaacctactgaatagcacatcgctcgagacctctctgtccatcgaagccccttggggagcgattaacgtgcagtcaactttcaaaccaacagtaagtaccgcaaatatcgcccttagctggtcctctgtggagcacaggggaaacaagattctggtcacgggtcggagcgaatcaataatgaaattggaggaacgtaccggcgtgagttgggacctcggggttgaggatgcttccgagagcaagctgttaacagtgtctatcatggacctgtcacagatgtacagtcccgtctttgaatatctaagcggagatcgccaagtggaggaatggcctaaagccacttgtaccggcgactgcccagagagatgtggttgcacatcctctacttgtctccataaggaatggccccactcgaggaattggcggtgcaacccgacctggtgctggggcgtagggacaggatgtacctgctgtggcgttgatgtgaaggacctgttcactgatcatatgtttattaaatggaaggtcgagtacatcaaaacggaggcaatcgtgtgcgtcgaacttacaagccaggagcgacagtgttccttgattgaagctgggacccgcttcaacctgggacctgtgactataaccctctcagagcccagaaatatccaacagaagctgccacctgagattatcacacttcaccccaaaattgaagagggtttctttgacctgatgcacgttcagaaggtgttgagtgcctctaccgtatgcaagctccagagctgtactcatggcatcccaggggatctgcaaatatatcacatcggaaacttactgaaaggcgacagggtcaatggtcatctaattcacaagatcgaaccccatttcaacacatcctggatgtcatgggacgggtgcgatctcgactactattgtaatatgggcgattggcctagctgcacgtacaccggagtgactcagcacaaccacgcggcctttgttaatctgcttaacattgagacagactataccaaaacattccattttcactctaagcgggtgactgcacatggcgataccccacagttggacctgaaagctcgcccgacgtacggggccggagaaatcaccgtcctcgtggaggtagctgatatggagctgcacacaaagaaggtggaaatatccggtttaaaattcgccagtctgacttgtaccggctgctacgcatgcagctctgggatttcctgtaaggttagaatccacgtcgacgagcccgatgaacttacagtgcatgtgaaatcaagtgaccctgatgtcgttgccgctagcacttcgttgatggcgaggaagctcgagtttggaaccgactccacgttcaaagcattttctgccatgccaaagacaagcctgtgcttctatattgtggaacgtgagtactgtaaatcatgcagtgaggatgacaccaagaagtgtgtggacactaaactagaacagccccaatccatcctgatagagcacaagggcacaatcattggtaaacagaatgatacctgcactgctaaggcctcttgttggctcgaaagcgtaaaatcctttttctatgggctgaagaacatgcttggctcagtctttgggagcttcttcgtgggcatcttgctgtttttaacccctttcgttctcctggtgctgtttttcatgtttgggtggaagattcttttctgctttaaatgttgccggcgaacaagaggattgttcaagtacaggcatctcaaagacgatgaggaaacgggctatcgccggatcatagagagactgaatagtaagaaaggtaagaacaggctactggacggggagcgcctcgcagatcgaaagattgccgaactgttttctaccaaaactcacatcgga

SEQ ID NO: 10622 - RNA, 2916 nt, synthetic construct
  misc_feature 1..2916: note = derived and/or modified CDS sequence (opt3) from CCHFV(3809-ST-2007, Artificial)__KR814867.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaagagatcctcatggctcatagtcctgttagtgctgctcacggtgagccttagtccggtccagtctgctcccgttggcaggaagcctctgtttttggattccattgtgaaaggcatgaagaacctactgaatagcacttcgctcgagacatctctgtccatcgaagccccatggggagcgatcaacgtacagtcaaccttcaagcccactgtgagtacagcaaatattgcccttagctggtcctctgtcgagcaccgggggaacaaaatcctggtgaccggtcgtagcgaatcaattatgaagttggaggaacgcacgggcgttagttgggacctcggggtggaggatgcttccgagagcaaactgttaaccgtctctataatggacctgtcacagatgtacagtcctgtgtttgaatatctaagcggagatagacaagtagaggaatggccaaaggccacatgtactggcgactgccccgagaggtgtggttgcacctcctctacatgtctccataaagaatggccgcactcgcggaattggcgatgcaaccctacttggtgctggggcgttgggaccggatgtacatgctgtggcgtggatgtcaaggacctgttcaccgatcatatgtttgtgaagtggaaagtcgagtacatcaagactgaggcaattgtgtgcgttgaacttacgagccaggagcgccagtgttccttgatcgaagctgggacaagattcaacctgggacccgtgaccatcactctctcagagccaaggaatattcaacagaaactgcctcccgagataatcacccttcacccaaaggtagaagagggtttctttgacctgatgcacgtccagaaagtgttgagtgcctctacagtttgcaagctccagagctgtacccatggcattcccggggatctgcaagtgtatcacatcggaaacttactgaagggcgaccgggtcaatggtcatctaattcacaaaatcgaacctcatttcaacacttcctggatgtcatgggacgggtgcgatctcgactactattgtaatatgggcgattggccaagctgcacatacacgggagtgacccagcacaaccacgcggcctttgtaaatctgcttaacatagagactgactatacaaagaccttccattttcactctaaacgcgtgacagcacatggcgatactccgcagttggacctgaaggctagacccacctacggggccggagaaatcacggttctcgtcgaggtggctgatatggagctgcacaccaaaaaggtggaaatttccggtttaaagttcgccagtctggcatgtacaggctgctacgcctgcagctctgggatctcctgtaaagtcaggattcacgttgacgagcctgatgaacttactgtgcatgtgaagtcaagtgacccagatgtagtcgctgcgagcacctcgttgatggcacgtaaactcgagtttggaacagactccactttcaaggccttttctgctatgcccaaaaccagcctgtgcttctatatcgtggaaaaggagtactgtcggtcatgcagtgaggaagatacgcagaaatgtgttgacacaaagctagagcaacctcagtccatactgattgaacacaagggcaccatcattggtaaacagaatgacacttgcacagccaaggcatcttgttggctcgagagcgtgaaatcctttttctatgggctgaagaacatgcttggctcagtctttggaaatttcttcatcggcatattgctgtttttaaccccattcgtgctcctggttctgtttttcatgtttgggtggaaaatccttttctgctttaagtgttgccgaagaactaggggattgctcaagtaccgccatctgaaagatgacgaagagaccggctatcggagaattatcgagaggctaaacaataagaaaggtaagaaccgcctgctcgatggggaacgactggccgaccggaaaattgctgagcttttcagcacaaagacgcacatcgga

SEQ ID NO: 10623 - RNA, 2916 nt, synthetic construct
  misc_feature 1..2916: note = derived and/or modified CDS sequence (opt3) from CCHFV(3820-ST-2007, Artificial)__KR814868.1__Gn-4aa-Gc
  source 1..2916: mol_type = other RNA
agcgaggaacccggcgacgattgcatctccagaacccagctgctcaagacagagactgccgaaattcacgacgataactacgggtctcctggagacaaaataacgatctgtaatggttcaaccattgtggatcaaaggcttggcagtgagctggggtgctatacaatcaaccgggtcaagagcttcaaattgtgtgaaaattccgctactggaaagacctgcgagattgactctacaccagttaaatgtcgccagggcttttgcttaaagatcacccaggagggtcgagggcatgtgaagctgtcgcgtggatcagaagtagtgctagatgcatgtgacagcagttgcgagataatgatcccgaaaggcactggcgatattctcgtcgactgttccgggggacagcaacacttcctgaaggataaccttatcgacctgggttgcccccatattcctttgctcggcaaaatggccatctacatatgtagaatgtctaatcacccaaggacaaccatggcgtttctgttctggtttagcttcgggtatgtgattacgtgcatcttttgcaaggctctgttctactccctcattatcatcggaactttaggcaaaaagattaagcagtatcgggaactgaaaccccagacctgtacaatatgcgagactgcccctgttaacgcaatcgatgccgagatgcatgaccttaattgttcatacaacatttgcccatattgtgctagtcgcttgaccagcgacggtctggcaagacacgtgacacagtgccccaagaggaaagaaaaggtcgaggaaaccgagctatacctcaatctggaacggatcccttggatagtgcgcaaacttctgcaagtatctgagtccacgggggttgccttgaagcgatcaagctggctcattgtgctgttagtcctgctcgctgtgagtctttctccagtgcagtccgccccggtcggaagaaaacccctgtttttggatagcatcgttaagggcatgaagaacctacttaattcgacttctctcgagacatccctgtcaatcgaagcgccttggggcgcaattaacgtgcagagtaccttcaaaccaactgtaagcacagccaatatcgctctttcctggtctagcgtggagcacagggggaacaagattctggtcaccggacggtcagaaagtataatgaaattggaggaacgtacgggtgtgtcctgggacctcggcgttgaggatgccagcgagtctaagctgttaaccgtgtcaatcatggacctgagtcagatgtacagccccgtctttgaatatctatccggggatcgccaagtggaggaatggcctaaagcaacatgtactggagactgcccagagagatgtggctgcacctcttcgacatgtctccataaggaatggccccacagcaggaattggcggtgcaacccgacttggtgctggggtgtagggaccggctgtacatgctgtggagttgatgtgaaggacctgttcaccgatcatatgtttattaaatggaaggtcgagtacatcaaaactgaggctatcgtgtgcgtcgaacttacgtcccaggagcgacagtgttcattgattgaagccggcacacgcttcaacctggggcctgtgaccataactctcagtgagcccagaaatatccaacagaagctgccacctgagattatcacccttcaccccaaaattgaagagggattctttgacctgatgcacgttcagaaggtgttgtctgcgagcacagtatgcaagctccagtcctgtacccatggtatcccaggcgatctgcaaatatatcacatcgggaacttactgaaaggagacagggtcaatggccatctaattcacaagatcgaaccccatttcaacacttcatggatgagctgggacggttgcgatctcgactactattgtaatatgggggattggccttcttgcacatacacgggcgtgacccagcacaaccacgccgcatttgttaatctgcttaacattgagactgactatacaaaaaccttccattttcactccaagcgggtgacagctcatggagatactccacagttggacctgaaagcccgcccgacctacggcgctggggaaatcacggtcctcgtggaggtagccgatatggagctgcacaccaagaaggtggaaataagtggattaaaattcgcaagcctgacatgtactggttgctacgcctgttcttccggcatttcatgcaaggttagaatccacgtcgacgagcccgatgaacttaccgtgcatgtgaaaagtagcgaccctgatgtcgttgctgcgtcgacatccttgatggcaaggaagctcgagtttgggactgactctaccttcaaagcctttagcgctatgccaaagacgtcactgtgcttctatattgtggaacgtgagtactgtaaaagttgctccgaggatgacacaaagaagtgtgtggacaccaaactagaacagccccaatctatcctgatagagcacaagggaactatcattggcaaacagaatgatacatgcaccgccaaggcaagctgttggctcgaatccgtaaaatcatttttctatggtctgaagaacatgcttgggagcgtctttggcagtttcttcgtgggaatcttgctgtttttagcccctttcgttctcctggtgctgtttttcatgtttggctggaagattctgttctgctttaaatgttgccggcgaactagagggttgttcaagtacaggcatctcaaagacgatgaggaaaccggatatcgccggatcatagagagactaaattctaagaaaggcaagaacaggctgctggacggtgagcgcctcgctgatcgaaagattgccgaactgttttccacaaaaacgcacatcggg

SEQ ID NO: 10624 - RNA, 2916 nt, synthetic construct
  misc_feature 1..2916: note = derived and/or modified CDS sequence (opt3) from CCHFV(4495-ST-2008, Artificial)__KR814869.1__Gn-4aa-Gc
  source 1..2916: mol_type = other RNA
agcgaggaatccggcgacgattgcatctctagaacccagctgctcaggacagagactgccgaaattcacgacgataactacgggggacccggtgacaagataacgatctgtaatggctcaaccattgtggatcaacggcttgggagtgagctgggatgctatacaatcaaccgcgtcaagagcttcaagttgtgtgaaaattccgctactggcaaaacctgcgagattgactctacacctgttaagtgtcgacagggtttttgcttaaaaatcacccaggaggggcgtggacatgtgaagctgtcgagaggctcagaagtagtgctagatgcatgtgacagcagttgcgaggtcatgataccaaagggcactggggatatcctcgtggactgttccggaggtcagcaacacttcctgaaagataaccttattgacctgggctgcccgcatatccccttgctcgggaagatggccatttacatctgtaggatgtctaatcaccctcggacaaccatggcgtttctgttctggtttagcttcggatatgttataacgtgcctgttttgcaaagctctcttctactccttaattatcattggcactctgggtaagaaaatcaagcagtatcgcgaacttagaccacagacctgtacaatctgcgagactgcccccgtgaacgcaattgatgccgagatgcatgacttgaattgttcatacaacatatgcccttattgtgctagtaggctgaccagcgacgggctagcacggcacgtcccacagtgccccaagcgcaaagaaaaggtggaggaaacagagctctacctgaatcttgaacgaatcccttggattgtaagaaaactgttgcaagtttctgagtccaccggagtggccctcaagaggtcaagctggctgatcgtcttactggtgctccttacggtgagtctgtctccagtccagtccgctccggttggccggaaacccttgtttctagatagcatagtgaagggcatgaaaaacctgctcaattcgacttctctggagacatccctttcaattgaagccccttggggagcgatcaacgtacagagtaccttcaagccaactgtgagcacagcaaatatcgccctgtcctggtctagcgtcgagcaccgtgggaacaagattttggtgaccggtcgctcagaaagtatcatgaaactcgaggaaagaacgggcatttcctgggacctgggggttgaggatgctagcgagtctaagttactgaccgtgtcaataatggacctaagtcagatgtacagccccgtctttgaatatctctccggagataggcaagtggaggaatggcctaaagccacatgtactggcgactgcccagagcggtgtggttgcacctcttcgacatgtctgcataaggaatggccccacagccgaaattggcgctgcaacccgacttggtgctggggcgtagggaccggatgtacatgctgtggcgttgatgtgaaagaccttttcaccgatcatatgtttgtcaagtggaaggtggagtacatcaaaactgaggcaattgtctgcgtggaattgacgtcccaggagagacagtgttcactgatcgaagctgggacaaggttcaacctcggacctgttaccatcactctgagtgagccccggaatattcaacagaaacttccacctgagataatcaccctgcaccccaaagtggaagagggtttctttgacttgatgcacgtacagaaggtcctctctgccagcacagtgtgcaaactgcagtcctgtacccatggcattccaggggatttacaagtttatcacatcggaaacctgctaaagggcgaccgcgtgaatggtcatctcattcacaagatcgaaccccatttcaacacttcatggatgagctgggacgggtgcgatctggactactattgtaatatgggcgattggccttcttgcacatacacgggagtcacccagcacaaccacgcggcctttgtgaatcttttgaacatagagactgactatacaaaaaccttccattttcactccaagagagtaacagcacatggcgatactccacagctggacctcaaagctaggccgacctacggggccggagaaatcacggtgctggttgaggtcgctgatatggagttacacaccaagaaagtggaaattagtggtctgaagttcgccagccttgcatgtacaggctgctacgcctgttcttccgggatctcatgcaaggtgcgtattcacgtcgacgagcccgatgaattgactgttcatgtgaaaagtagcgaccctgatgtggtagctgcgtcgacctccctcatggcacggaagctggagtttggaacagactctactttcaaagcctttagcgctatgccaaagacctcactatgcttctatatcgtcgaacgagagtactgtaaaagttgctccgaggaagatacgcagagatgtgtggacacaaagctggagcaaccccagtctatactcattgaacacaaaggcaccatcattggtaagcagaatgacacttgcacagccaaggcaagctgttggctggagtccgttaaatcatttttctatgggcttaagaacatgttgggcagcgtgtttggaaatttcttcatcggcatactgttatttctcgcccctttcgtcctgcttgtgctgtttttcatgtttgggtggaaaatcttgttctgctttaagtgttgcaggcgcgctcggggactcctgaaatacagacatctaaaggatgacgaagagaccggctataggaagattatcgagcgcctgaacaataaaaagggtaaaaaccgactcctggatggggaacggcttgccgaccgtaagattgcagagttgttcagtactaaaacccacatcgga

SEQ ID NO: 10625 - RNA, 2916 nt, synthetic construct
  misc_feature 1..2916: note = derived and/or modified CDS sequence (opt3) from CCHFV(4691-ST-2009, Artificial)__KR814871.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacagcctcattatcatcggcactttaggtaaaaagattaagcagtatcgggaactgaaaccccagacctgtacaatatgcgagactgcccctgttaacgcaatcgatgccgagatgcatgaccttaattgttcctacaacatttgcccatattgtgcttcacgcttgaccagtgacgggctggcaagacacgtgacacagtgccccaagaggaaagaaaaggtcgaggaaaccgagctatacctcaatctggaacggatcccttggatagtgcgcaaacttctgcaagtaagcgagtctacgggagttgccttgaagcgatcctcatggctcattgtgctgttagtcctgctcactgtgagccttagtccagtgcagtctgctccggtcggcagaaaacccctgtttttggattccatcgttaagggcatgaagaacctactgaatagcacatcgctcgagacctctctgtccatcgaagccccttggggagcgattaacgtgcagtcaactttcaaaccagcagtaagtacagccaatatcgctcttagctggtcctctgtggagcacagggggaacaagattctggtcaccggtcggagcgaatcaataatgaaattggaggaacgtacgggcgtgagttgggacctcggggttgaggatgcctccgagagcaagctgttaaccgtgtctatcatggacctgtcacagatgtacagtcccgtctttgaatatctaagcggagatcgccaagtggaggaatggcctaaagcaacatgtactggcgactgcccagagagatgtggttgcacctcctctacatgtctccataaggaatggccccactcgaggaattggcggtgcaacccgacttggtgctggggcgtagggaccggatgtacatgctgtggcgttgatgtgaaggacctgttcaccgatcatatgtttattaaatggaaggtcgagtacatcaaaactgaggctatcgtgtgcgtcgaacttacgagccaggagcgacagtgttccttgattgaagccgggacacgcttcaacctgggacctgtgaccataactctctcagagcccagaaatatccaacagaagctgccacctgagattatcacccttcaccccaaaattgaagagggtttctttgacctgatgcacgttcagaaggtgttgagtgcgtctacagtatgcaagctccagagctgtacccatggcatcccaggggatctgcaaatatatcacatcggaaacttactgaaaggcgacagggtcaatggtcatctaattcacaagatcgaaccccatttcaacacttcctggatgtcatgggacgggtgcgatctcgactactattgtaatatgggcgattggcctagctgcacatacacgggagtgacccagcacaaccacgccgcatttgttaatctgcttaacattgagactgactatacaaaaaccttccattttcactctaagcgggtgacagctcatggcgatactccacagttggacctgaaagcccgcccgacctacggggctggagaaatcacggtcctcgtggaggtagccgatatggagctgcacaccaagaaggtggaaatatccggtttaaaattcgcaagtctggcctgtacaggctgctacgcttgcagctctgggatttcctgtaaggttagaatccacgtcgacgagcccgatgaacttactgtgcatgtgaaatcaagtgaccctgatgtcgttgcggcaagcacctcgttgatggccaggaagctcgagtttggaacagactccactttcaaggctttttctgccatgccaaaaaccagcctgtgcttctatattgtggaacgtgagtactgtaaatcatgcagtgaggatgacacgaagaagtgtgtggacacaaaactagaacagccccaatccatcctgatagagcacaagggcaccatcattggtaaacagaatgatacttgcacagcaaaggcctcttgttggctcgaaagcgtaaaatcctttttctatgggctgaagaacatgcttggctcagtctttggaaatttcttcgtgggcatcttgctgtttttagctcctttcgttctcctggtgctgtttttcatgtttgggtggaagattcttttctgctttaaatgttgccggcgaaccagaggattgttcaagtacaggcatctcaaagacgatgaggaaactggctatcgccggatcatagagagactgaacagcaagaaaggtaagaataggctactggacggggagcgcctcgccgatcgaaagattgcagaactgtttagtaccaaaacacacatcgga

SEQ ID NO: 10626 - RNA, 2916 nt, synthetic construct
  misc_feature 1..2916: note = derived and/or modified CDS sequence (opt3) from CCHFV(4701-ST-2009, Artificial)__KR814872.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccgtggtcgatcaaaggcttgggtcagagctgggatgctatacaattaaccgggttaagagtttcaaattgtgtgaaaatagcgctactggcaagacctgcgagatcgactccacaccagtgaaatgtcgccagggtttttgcttaaagattacccaggaggggcgaggacatgtaaagctgtctcgtggctcggaagtggtcctagatgcatgtgactcaagctgcgagatcatgataccgaaaggcactggggatatcctcgtggactgtagtggaggtcagcaacacttcctgaaggataaccttattgacctgggctgcccccatatccctttgctcgggaaaatggccatttacatctgtagaatgtccaatcacccaaggacaaccatggcgtttctgttctggttttctttcggatatgttataacgtgcatcttttgcaaggctctgttctacagcctcattattatcggcactttaggtaaaaagatcaagcagtatcgggaactgaaaccccagacctgtacaatttgcgagactgcccctgtgaacgcaatagatgccgagatgcatgaccttaattgttcctacaacatctgcccatattgtgcttcacgcttgaccagtgacgggctggcaagacacgtcacacagtgccccaagaggaaagaaaaggtggaggaaaccgagctatacctcaatctggaacggattccttggatcgtacgcaaacttctgcaagttagcgagtctacgggagtggccttgaagcgatcctcatggctcatagtcctgttagtgctgctcactgtgagccttagtccagtccagtctgctccggttggcagaaaacccctgtttttggattccattgtgaagggcatgaagaacctactgaatagcacatcgctcgagacctctctgtccatcgaagccccttggggagcgatcaacgtacagtcaactttcaaaccaacagtgagtaccgcaaatattgcccttagctggtcctctgtcgagcacagggggaacaagatcctggtgacgggtcggagcgaatcaattatgaaattggaggaacgtaccggcgttagttgggacctcggggtggaggatgcttccgagagcaagctgttaacagtctctataatggacctgtcacagatgtacagtcccgtgtttgaatatctaagcggagatcgccaagtagaggaatggcctaaagccacttgtaccggcgactgcccagagagatgtggttgcacatcctctacttgtctccataaggaatggccccactcgaggaattggcggtgcaacccgacctggtgctggggcgttgggacaggatgtacctgctgtggcgtggatgtcaaggacctgttcactgatcatatgtttatcaaatggaaggtggagtacattaaaacggaggcaatcgtctgcgtggaacttacaagccaggagcgacagtgttccttgatcgaagctgggacccgcttcaacctgggacctgttactattaccctctcagagcccagaaatatacaacagaagctgccacctgagatcattacacttcaccccaaaatcgaagagggtttctttgacctgatgcacgtgcagaaggtattgagtgcctctaccgtctgcaagctccagagctgtactcatggcattccaggggatctgcaaatctatcacataggaaacttactgaaaggcgacagggtgaatggtcatctaatccacaagattgaaccccatttcaacacatcctggatgtcatgggacgggtgcgatctcgactactattgtaatatgggcgattggcctagctgcacgtacaccggagttactcagcacaaccacgcggcctttgtgaatctgcttaacatcgagacagactataccaaaacattccattttcactctaagcgggtcactgcacatggcgataccccacagttggacctgaaagctcgcccgacgtacggggccggagaaattaccgtgctcgtagaggtggctgatatggagctgcacacaaagaaggttgaaatctccggtttaaaattcgccagtctgacttgtaccggctgctacgcatgcagctctgggatatcctgtaaggtcaggattcacgtggacgagcccgatgaacttacagtgcatgtcaaatcaagtgaccctgatgttgtggccgctagcacttcgttgatggcgagaaagctcgagtttggaaccgactccacgttcaaagcattttctgccatgccaaagacaagcctgtgcttctatatcgtggaacgtgagtactgtaaatcatgcagtgaggatgacaccaagaagtgtgtagacactaaactagaacagccccaatccattctgatcgagcacaagggcacaataatcggtaaacagaatgatacctgcactgctaaggcctcttgttggctcgaaagcgtcaaatcctttttctatgggctgaagaacatgcttggctcagtgtttggaggcttcttcgttgggattttgctgtttttagcacctttcgtgctcctggtcctgtttttcatgtttggatggaagatccttttctgctttaaatgttgccggcgaaccagaggcttgttcaagtacaggcatctcaaagacgatgaggaaacaggttatcgccggattatcgagagactgaatagcaagaaagggaagaacaggctactggacggagagcgcctcgccgatcgaaagatagctgaactgtttagtacgaaaacccacattggc

SEQ ID NO: 10627 - RNA, 2916 nt, synthetic construct
  misc_feature 1..2916: note = derived and/or modified CDS sequence (opt3) from CCHFV(5170-R-2011, Artificial)__KR814873.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgtctgtgactcaagctgcgagataatgatcccgaaaggcactggggatattctcgtggactgtagtggaggtcagcaacacttcctgaaggataaccttatcgacctgggctgcccccatattcctttgctcgggaaaatggcaatctacatatgtagaatgtccaatcacccaaggacaaccatggcctttctgttctggttttctttcggatatgttattacgtgcatcttttgcaaggcgctgttctacagcctcattatcatcggcactttaggtaaaaagattaagcagtatcgggaactgaaaccccagacctgtacaatatgcgagactgctcctgtgaacgccatcgatgcagagatgcatgaccttaattgttcctacaacatttgcccatattgtgcctcacgcttgaccagtgaagggctggctagacacgtcacacagtgccccaagaggaaagagaaggtggaagagaccgaactatacctcaatctggagcggatcccttggatagtacgcaaacttctgcaagttagcgagtctacgggagtggcattgaagcgatcctcatggctcattgtcctgttagtgctgctcactgtgagccttagtccagtccagtctgccccggttggcagaaaacccctgtttttggactccatcgtgaagggcatgaagaacctactgaatagcacatcgctcgaaacctctctgtccatcgaggctccttggggagccattaacgtacagtcaactttcaaaccaacagtgagtaccgcgaatatcgcacttagctggtcctctgtcgaacacaggggaaacaagattctggtgacgggtcggagcgagtcaataatgaaattggaggaacgtaccggcgttagttgggatctcggggtggaggacgcctccgaaagcaagctgttaacagtctctatcatggatctgtcacagatgtacagtcccgtgtttgagtatctaagcggagaccgccaagtagaagagtggcctaaagctacttgtaccggcgattgcccagaaagatgtggttgcacatcctctacttgtctccataaggagtggccccactcgaggaattggcggtgcaacccgacctggtgctggggcgttgggacaggatgtacctgctgtggcgtggacgtcaaggatctgttcactgaccatatgtttattaaatggaaggtggagtacatcaaaacggaagccatcgtctgcgtggagcttacaagccaggaacgacagtgttccttgattgaggcagggacccgcttcaacctgggacctgttactataaccctctcagagcccagaaatatccaacagaagctgccacctgaaattatcacacttcaccccaaaattgaggaaggtttctttgatctgatgcacgtgcagaaggtattgagtgcttctaccgtctgcaagctccagagctgtactcatggcatcccaggggacctgcaaatatatcacatcggaaacttactgaaaggcgatagggtgaatggtcatctaattcacaagatcgagccccatttcaacacatcctggatgtcatgggacgggtgcgacctcgattactattgtaatatgggcgactggcctagctgcacgtacaccggagttactcagcacaaccacgccgcgtttgtgaatctgcttaacattgaaacagattataccaaaacattccattttcactctaagcgggtcactgcccatggcgacaccccacagttggatctgaaagcacgcccgacgtacggggctggagagatcaccgtgctcgtagaggtggccgacatggaactgcacacaaagaaggttgagatatccggtttaaaattcgctagtctgacttgtaccggctgctacgcctgcagctctgggatttcctgtaaggtcagaatccacgtggatgaacccgacgagcttacagtgcatgtcaaatcaagtgatcctgacgttgtggcagccagcacttcgttgatggctaggaagctcgaatttggaaccgattccacgttcaaagcgttttctgcaatgccaaagacaagcctgtgcttctatattgtggagcgtgagtactgtaaatcatgcagtgaagacgataccaagaagtgtgtagacactaaactagagcagccccaatccatcctgatagaacacaagggcacaatcattggtaaacagaatgatacctgcactgccaaggcttcttgttggctcgagagcgtcaaatcctttttctatgggctgaagaacatgcttggctcagtgtttgggagcttcttcgttggcatcttgctgtttttagcccctttcgtgctcctggtcctgtttttcatgtttgggtggaagattcttttctgctttaaatgttgccggcgaaccagaggattgttcaagtacaggcatctcaaagacgacgaagagacaggctatcgccggatcatagagagactgaatagtaagaaaggtaagaacaggctactggatggggaacgcctcgcagaccgaaagattgccgagctgttttctacgaaaacccacatcgga

SEQ ID NO: 10628 - RNA, 2916 nt, synthetic construct
  misc_feature 1..2916: note = derived and/or modified CDS sequence (opt3) from CCHFV(Oman-199809166, Artificial)__KR864901.1__Gn-4aa-Gc
  source 1..2916: mol_type = other RNA
agcgaggaatccggcgaggactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaaatctttcaagttgtgtgaaaattccgctactggtaaatcttgcgagattgacaacacccctgttaagtgtaaacaggggttttgcttaaagatcacacaggaaggacgaggccatgtgaagctgtcgcgtgattcagaggtagtgctagacgcatgtgatagcagttgcgaaataatgatcccaaaaggcaccggggacattctcgtcgattgttccggaggtcagcaacacttcctgaaggacaatcttatcgatctgggctgcccgaacattcccttgctcgggaaaatggccatctacatatgtagaatgtctaatcatcctaagactacaatggcgtttctgttctggtttagcttcggatatgtgattacctgcatcctgtgcaaagttatcttttacctcttaattgtggtcggcacgctgggtaagaagttcaaacagtatagggagcttaagccacagacttgtaccatctgcgagacaactcccgtgaacgctattgacgccgaaatgcacgatttgaattgttcctacaacatatgcccttattgtgcatcacggctgaccagtgacgggctagcccgccatgtaatgcagtgcccaaaaagaaaggagaaaatcgaagagacagaactctacctgaatcttgagaggattccctgggttgtgcggaagctgttgcaagtcagcgagtctaccggagtggctctcaaacgctcctcatggctgatcgtgttactggtcctccttacggttagcctgagtcctgtgcagtctgcaccaataggccgaaagccgttgtttctagactccattgccaagggcatgaaaaacctgctcaatagcacttcgctggaaacatctctttccatcgaggctccctggggagccatcaacgtacagtcaaccttcaagcctactgtgagtacagcgaatattgcactgagctggtcctctgtcgaacacagagggaacaaaatcttggtgagcggtaggtcagagagtattatgaagctcgaggagcggaccggcatatcctgggatctgggggttgaggacgccagcgaatctaaattactgacggtgtcagtcatggatctaagtcagatgtacagcccagtgtttgagtatctctccggagaccgtcaagtagaagagtggcccaaggctacctgtacaggcgattgccctgaacgctgtggttgcacttcttcgacctgtctgcacaaggagtggccacatagcagaaactggaggtgcaatcccacatggtgctggggcgttgggactggatgtacctgctgtggccttgacgtgaaagatttgttcacagactacatgtttgtcaagtggaaagtggagtatatcaagaccgaagccattgtctgcgtggagctgacttcccaggaacggcagtgttcactcatcgaggcagggacgcgattcaacctgggaccggttacaatcacccttagtgagcctcgcaatattcaacagaaactgcccccagaaatagtgactttgcaccctagaatcgaggaaggtttctttgatctcatgcatgtacagaaggtcctgtctgctagcaccgtgtgcaagttacagtcctgtacacacggcgttcccggggacctgcaagtgtaccacattggaaacctactcaaaggcgataaggtcaatggtcatctgatccacaaagtggagccacatttcaacacctcatggatgagctgggacgggtgcgaccttgattattactgtaatatgggcgactggccctcttgcacttatacaggagtaacgcagcacaaccatgccgcgtttgtgaatttgctgaacattgaaaccgattacactaagaatttccactttcactccaaaagggttacagcccatggcgacacccctcagctcgatctgaaggcacggccaaactacggggctggagagatcacagtcttagtggaggtggccgacatggaactgcacactaagaaaatagagatcagtggtcttaagttcgctagcttgacctgtacgggctgctatgcctgcagctccgggatttcatgtaaagtccgcatccatgttgatgaaccggacgagctcaccgtgcacgtgaagagtgaagatcccgacattgtagcagccagctcgtccctgatggctagaaaactagagtttggaacagattctactttcaaggcgtttagcgcaatgcctaaaacctcactgtgcttctacatcgtcgagagggaatattgtaagagttgctccaaggaggacacacagaaatgtgtgaatgccaagctcgaacgtccacaatctatactgattgagcacaaaggcactatcattggtaagcagaacgatacctgcacggctaaagccagctgttggcttgaatccgttaagtcatttttctacgggttgaagaatatgctgagcggcatctttggaaacgtgttcataggcatcttcttatttctcgcacccttcattctgcttatcctgtttttcatgtttgggtggcggattttgttctgctttaaatgttgccgaagaacaaggggactcttcaagtatcgccatctgaaagacgacgaggagaccggctaccggaagatcatagaaagactaaacaataaaaagggtaagaacaaactgctcgatggggagaggctggccgaccgcaagattgctgaactttttagtactaaaacacacatcgga

SEQ ID NO: 10629 - RNA, 2916 nt, synthetic construct
  misc_feature 1..2916: note = derived and/or modified CDS sequence (opt3) from CCHFV(200406546-Turkey, Artificial)__KR864902.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgtctgtgactcaagctgcgaggtgatgataccgaagggcactggggatatcctcgttgactgtagtggaggtcagcaacacttcctgaaagataaccttattgacctgggctgcccccatgtgcctttgctcgggaggatggcaatctacatttgtcggatgtccaatcacccacgcacaaccatggcctttctgttctggttttctttcggatatgtcatcacgtgcatattttgcaaggcgctgttctacagcctcattatcattggcactttaggtaaaaagtttaaacagtatagagaactgaagccccagacctgtacaatctgcgagactgctcctgtgaacgccatcgatgcagagatgcatgaccttaattgttcctacaacatttgcccatattgtgcctcaaggttgaccagtgacgggctggctcggcacgtaccccagtgccctaagcgcaaagaaaaggttgaggaaacagagctatacctcaatctggaacgaataccatggatcgtgagaaaacttctgcaagtcagcgagtctaccggagtggcattgaagaggtcctcatggctcattgtgctgttagtcctgctcacggttagccttagtccggtgcagtctgcccccgtaggccggaaacctctgttcttggattccatcgtgaagggcatgaaaaacctactgaatagcacttcgctcgagacatctctgtccatagaagctccatggggtgccattaacgtccagtcaacctttaagcccactgtgagtacagcgaatatcgcacttagctggtcctctatcgagcaccgtggaaacaagattctggttaccggtcgcagcgaatcaatcatgaaattggaggaaagaacgggcgtgagttgggacctcggggtcgaggatgcctccgagagcaagctgttaaccgtgtctattatggacctgtcacagatgtacagtcctgtattcgaatatctaagcggagataggcaagttgaggaatggccaaaagctacatgtactggcgactgccccgagcggtgtggttgcacctcctctacatgtctccataaggaatggccgcactcgcgaaattggcgctgcaaccctacttggtgctggggcgtggggaccggatgtacatgctgtggcgtcgatgtgaaagacctgtttaccgatcatatgttcgtcaagtggaaggtggagtacataaaaactgaggccatcgtttgcgtggaacttacgagccaggagagacagtgttccttgattgaagcagggacaaggttcaacctgggacccgtaaccatcactctctcagagccacggaatatccaacagaagctgcctcccgagattataacccttcacccaaaagtcgaagaggggtttttcgacctgatgcacgtgcagaaggttttgagtgcttctacagtgtgcaaactccagagctgtacccatggcatccccggggatctgcaagtctatcacattggaaacttactgaagggcgaccgcgtgaatggtcatctaatccacaagattgaacctcattttaacacttcctggatgtcatgggacgggtgcgatctcgactactattgtaatatgggcgattggccaagctgcacatacacgggagtaacccagcacaaccacgccgcgttcgtgaatctgcttaacatcgagactgactatacaaaaacctttcatttccactctaagagagttacagcccatggcgatactccgcagttggacctgaaagcaaggcccacctacggggctggagaaataacggtcctcgtggaggtggccgatatggagctgcacaccaagaaagtcgaaatctccggtttaaagtttgctagtctggcctgtacaggctgctacgcatgcagctctgggatttcctgtaaggttcgtatccacgtggacgagcctgatgaacttactgtgcatgtaaaatcaagtgacccagatgtcgtggccgctagcacctcgttgacagcgcggaagctcgagttcggaactgactccacctttaaagcattctctgccatgcccaagacgagcctgtgcttttatattgttgaaaaagagtactgtaagtcatgcaatgaggatgacacacagaaatgtgtggacaccaagctagaacaacctcagagtatcctgatagagcacaagggcactattatcggtaaacagaacgatacatgcaccgctaaggcctcctgttggctcgaatctgtcaagagcttcttttatgggctgaaaaatatgcttggctccgtgttcggaaacttctttattggcatcttgctgttcttagcaccatttgttctcctggtgcttttctttatgttcgggtggaaaatactgttttgcttcaagtgttgccgaagaactaggggattgtttaagtaccgccatctcaaagacgatgaggaaaccggctataagcggatcattgagagactgaataacaaaaagggtaaaaataggctactggacggggagcgcctcgccgatcgaaagatcgctgaactgttctcaacaaagacgcacattgga

SEQ ID NO: 10630 - RNA, 2916 nt, synthetic construct
  misc_feature 1..2916: note = derived and/or modified CDS sequence (opt3) from CCHFV(1-CR/HU-2015, Artificial)__KU161584.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcacacagtgccccaaacggaaggaaaaagtggaggaaaccgagctatacctcaatctggaacgcattccttggatcgtacgaaaacttctgcaagttagcgagtctacgggagtggccttgaaaagatcctcatggctcatagtcctgttagtgctgctcactgtgagccttagtccagtccagtctgctccggttggcaggaagcccctgtttttggattccattgtgaaaggcatgaagaacctactgaatagcacatcgctcgagacctctctgtccatcgaagccccttggggagcgatcaacgtacagtcaactttcaagccaacagtgagtaccgcaaatattgcccttagctggtcctctgtcgagcaccgggggaacaaaatcctggtgacgggtcgtagcgaatcaattatgaagttggaggaacgcaccggcgttagttgggacctcggggtggaggatgcttccgagagcaaactgttaacagtctctataatggacctgtcacagatgtacagtcccgtgtttgaatatctaagcggagatagacaagtagaggaatggcctaaggccacttgtaccggcgactgcccagagaggtgtggttgcacatcctctacttgtctccataaagaatggccccactcgcggaattggcgatgcaacccgacctggtgctggggcgttgggacaggatgtacctgctgtggcgtggatgtcaaggacctgttcactgatcatatgtttgtgaagtggaaagtcgagtacatcaagacggaggcaattgtgtgcgttgaacttacaagccaggagcgccagtgttccttgatcgaagctgggaccagattcaacctgggacctgtgactatcaccctctcagagcccaggaatattcaacagaaactgccacctgagataatcacacttcaccccaagattgaagagggtttctttgacctgatgcacgtacagaaagtcttgagtgcctctaccgtgtgcaagctccagagctgtactcatggcatcccaggggatctgcaagtttatcacattggaaacttactgaagggcgaccgggtgaatggtcatctaatccacaaaatagaaccccatttcaacacatcctggatgtcatgggacgggtgcgatctcgactactattgtaatatgggcgattggcctagctgcacgtacaccggagtcactcagcacaaccacgcggcctttgtgaatctgcttaacatcgagacagactataccaagacattccattttcactctaaacgcgtaactgcacatggcgataccccacagttggacctgaaggctagaccgacgtacggggccggagaaattaccgtgctcgttgaggtcgctgatatggagctgcacacaaagaaggtggaaatctccggtttaaagttcgccagtctggcatgtactggctgctacgcctgcagctctgggatttcctgtaaagtgaggatccacgtcgacgagcccgatgaacttaccgttcatgtgaagtcaagtgaccctgatgtggtagctgcgagcacatcgttgatggcacgtaaactcgagtttggaactgactccaccttcaaggccttttctgctatgccaaaaacgagcctgtgcttctatatagtcgaacgggagtactgtaagtcatgcagtgaggatgacaccaaaaagtgtgtggacacaaagctagaacagccccaatccattctgatcgagcacaaaggcactattatcggtaagcagaatgatacatgcaccgccaaagcatcttgttggctcgaaagcgttaagtcctttttctatgggctgaaaaacatgcttggctcagtgtttggaaatttcttcataggcatcttgctgtttttagcccctttcgtcctcctggtgctgtttttcatgtttgggtggaagattcttttctgctttaagtgttgccgaagaactaggggattgttcaaataccgccatctcaaggacgatgaggaaaccggctatcggagaatcattgagaggctgaacaataaaaagggtaaaaaccgcctactggacggggagcgactcgctgatcggaagatcgccgaactgtttagcacaaagacgcacatagga

SEQ ID NO: 10631 - RNA, 2916 nt, synthetic construct
  misc_feature 1..2916: note = derived and/or modified CDS sequence (opt3) from CCHFV(Gaib, Artificial)__KX013445.1__Gn-4aa-Gc
  source 1..2916: mol_type = other RNA
agcgaggaatcctctgacgattgcatctcaagaacccagctgctcaggacagagactgccgaaattcacaacgacaattacggcgggcccggagataagataacgatctgtaacggtagtaccattgtggaccaacggcttggcagcgagctggggtgctatacaatcaatcgcgtcaaatccttcaagttgtgtgaaaactctgctactggaaaatcgtgcgagattgattcaatccctgttaagtgtcgacagggcttttgcttaaaaataacccaggagggtcgtgggcatgtgaagctgagcagaggaagtgaagtagtgctagacgcatgtgattcctcttgcgagatcatgattccaaagggcacaggcgacatcctcgtcgattgtagcgggggacagcaacacttcctgaaagacaatcttattgatctgggttgcccgaacatccccttgctcggcaagatggccatatacatttgtaggatgtccaatcatcctaaaaccactatggcgtttctgttctggttttcattcgggtatgtgatcacatgcattttctgcaaggctatcttctacctgctcatcattgttggaaccttaggcaaaaagtttaagcagtatcgggaactgaaaccacagacgtgtactatatgcgagaccacacccgtgaacgccatcgacgcagagatgcacgatcttaattgtagttacaacatttgcccttattgtgccagccgcttgacttctgacggtctggctagacatgtcgtgcactgcccaaagaggaaagaaaagatcgaggaaaccgagctatacctcaatctggaacgggtaccctgggttgtgcgcaaacttctgcaggtctccgagtcaacaggggtggcattgaagcgaagcagttggctcatagtgctgttagtcctgctcaccgtttctctttcccctgtgcaaagcgccccaattggaagaaaaccgctgttctcggactctatcgtaaagggcatgaagaacttgctaaattccacgtcactggagacttcgctcagcatcgaagctccctggggcgccattaacgtgcagtccacatttaaacctaccgtctctactgcgaatatcgcactgagctggtcaagtattgagcacagggggaacaagatacttgtgtccggacggagcgaatctatcatgaaactggaggaacgtacaggtatttcatgggatttgggcgttgaggacgccagtgagagccgcctcctgaccgtgtccgtcatggatttatctcagatgtactcgccagtgttcgaatatctgagcggggacagacaggtagaggaatggcccaaggctacgtgtaccggagattgccctgagaggtgtggctgcacatcctcaacttgtctacataaagaatggccacacagtcggaactggcgatgcaatcccacctggtgctggggtgttgggacaggctgtacttgctgtggactcgacgtgaaggatctgtttaccgactacatgttcgtcaagtggaaagtggagtatatcaagacagaggccatcgtctgcgtggaacttacctctcaagagcgccagtgtagcttgattgaagcaggcactagattcaacctggggccggttacgataacactctccgagcctaggaatatccagcaaaaactgcccccagagattatcacccttcatcctcggattgaagagggatttttcgatctgatgcacgtgcagaaggtattgtcagctagcactgtctgcaaactccagtcttgtacccacggtgtgcccggcgacctgcaggtttaccatatcgggaacttactgaagggagataaggtgaatggccacctaatacataaaatcgaaccacactttaacacatcctggatgagttgggacggttgcgacctcgattattactgtaatatgggggactggcccagctgcacctatactggcgtcacacaacataaccacgccgcgttcgtgaatctgcttaacattgagacggattacaccaagaattttcacttccattctaaacgcgtaactgcccacggagacacacctcagttggatctgaaggcaagaccaacctacggcgctggggaaatcacagtgctcgttgaggtcgccgacatggagctgcatactaaaaagattgaaatctccggattaaagtttgcttcactgacctgtacgggttgctatgcctgcagtagcggcatatcgtgtaaagtgaggattcacgtggatgagccggacgaacttaccgtccacgttaagtccgaggatcccgacatcgtggcagcctctagctcattgatggctcgtaaactcgaatttgggacagatagtacttttaaggcgttctccgcaatgcctaaaacctctctgtgcttttacattgtggagcgggagtattgtaagagctgctcccgagaagacacacagaaatgtgtatcaactaagctagagcagccacaaagcatcctgatagaacataagggaaccatcattggcaaacagaacaatacgtgcacaaccaagactacatgttggctcgagagtgtcaaatctttcttttacggtctgaagaacatgctttccagcatcttcgggaatgtgttcgttggcatttttagtttcttggccccctttatcctgttaatactcttctttatgttcggatggaggattctgttttgcttcaaatgttgcagacgcacccggggcctttttaagtatagacacctgaaggatgacgaagagactgggtacaggcgcatcatcgagcgattgaacaacaaaaagggaaaatcaaagctcctggacggcgaacggctagctgatcgtaaaattgccgagctgttctctaccaagacacatatcggt

SEQ ID NO: 10632 - RNA, 2916 nt, synthetic construct
  misc_feature 1..2916: note = derived and/or modified CDS sequence (opt3) from CCHFV(Hodzha, Artificial)__KX013448.1__Gn-4aa-Gc
  source 1..2916: mol_type = other RNA
agcgaggaatccggcgacgattgcatctctagaacccagctgctcaggacagagactgccgaaattcacggggacgattacggaggtcccggcgacaagataacgatctgtaacgggtcaaccattgtggatcaacggcttggaagtgagctgggctgctatacaatcaatcgcgtcaagagcttcaagttgtgtgaaaactccgctactggtaaatcttgcgagattgactcgacccctgttaagtgtcgacaggggtactgcttaaaaatcacacaggagggacgtggccatgtgaagctgtcaagaggcagcgaagtagtgctagatgcatgtgacagttcctgcgaggtcatgataccaaaggggaccggagatatcctcgtggactgttctggtggccagcaacactttctgaaagataatcttattgacctggggtgcccgaggatccccttgctcggaaagatggccatttatatctgtcggatgagcaaccatcctgaaactacaatggcgttcctgttttggttctcctttggctacgttataacctgcattctgtgcaaagctatcttctatctcttaattatcgtgggtacgctggggaagcgctttaaacagtacagagagcttaagccacagacttgtaccatctgcgagacaactcccgccaatgcaattgatgccgaaatgcacgacttgaactgttcatataatatatgcccttactgtgctagtaggctgaccagcgacggactagcacggcatgtcacacagtgcccaaagcgcaaagagaaggtggaagagaccgaactctacctgaaccttgagcgaatcccctggattgtaagaaaactgttgcaagtttctgagtccacgggcgtggccctcaagaggtcaagctggctgatcgtcttactggtcctcttcgctgtgagtctttctcctgtgcagtccgccccaataggccggcgtccgctgtttttggatagcattgttaaagggaagaaaaatctactgaactcgacttctctcgaaacatccctgtcaatcgaggcgccctggggagcaatcaatgtgcagagtacctataagcctactgtaagcacagccaacattgctctttcctggtctagcgtggaacaccgcggtaataagatcctggtctcaggcagaagtgagtccattatgaaattggaagagaggaccgggataagctgggacctcggagtggaggatgcctctgaatcaaagctgttaacggttagtgtgatggacctgagccagatgtactccccagtcttcgagtatctatctggcgatcggcaagtggaagagtggcccaaagcaacctgtacaggtgactgctcggaacgatgtgggtgcactagctccacctgtctccacaaggagtggcctcattcacgcaactggagatgcaatccaacatggtgctggggcgtaggaactggctgtacctgctgtgggctggatgttaaagacctttttacagattacatgttcgtgaagtggaaggtcgactatatcaaaaccgaggctattgtgtgcgtcgaattgaccagtcaggagaggcagtgttctctggtggaagccggaacgcggtttaacctcggtcccgttacaatcaccctgagcgagccgcgcaacatccaacagaaacttcctcccgagattataactctgcacccaagaatcgaagagggcttcttcgatttgatgcatgtgcagaaagtactctccgcgtcaaccgtctgcaagctgcagagctgtacacacggggtgcctggagacttacaagtttaccacattggcaatctgctaaaaggtgacaaggtgaacgggcatctcatccacaagattgaaccccattttaatacctcttggatgtcctgggatggctgcgacctggattattactgtaacatgggagactggccaagttgcacttacacaggcgtcacgcagcacaatcatgccagcttcgtgaaccttttgaatatcgagaccgattatactaaatcttttcacttccactccaagagggtaacagcacatggggacactccccagctggatctcaaagctcgtcctacatacggagccggtgaaataactgtgctggttgaggtcgctgacatggagttacacaccaagaaaatcgaaattacgggcctgaagtttgcctcacttacctgtacagggtgctatgcatgcagtagcggaatctcgtgtaaggtgcggattcatgtggatgagccagacgaattgactgtccacgttaaatccgatgacccggatgtggtggccgcttctagctcactcatggcgcgaaagctggagttcggcaccgacagtacatttaaagcattctccgccatgcccaagacttctctatgcttttacatcgtagaaagagagtattgtaaaagctgctccaaggaggacacccagaaatgtgtcaacacgaagctggaacaacctcagtcaatactcattgagcagaagggtacaatcattgggaaacagaataatacctgcactgctaaggccagctgttggctggaaagtgtgaaatctttcttttacggccttaagaacatgttgtccggaatcttcggcaacgtttttgtggggatattcctgttcttagcaccatttatcctcctgattcttttctttatgttcggatggaggatcctgttttgcttcaaatgttgccgccggacaagaggcttgtttaagtataagcacctcaaagatgacgaggaaaccggttacaggcgcattatcgagcgactgaataacaagaaagggaagaataaactactggatggagagcggctcgccgaccgtagaatagctgaactgttcagcactaagacccatattggc

SEQ ID NO: 10633 - RNA, 2916 nt, synthetic construct
  misc_feature 1..2916: note = derived and/or modified CDS sequence (opt3) from CCHFV(IbAn7620, Artificial)__KX013451.1__Gn-4aa-Gc
  source 1..2916: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaaatccttcaagttgtgtgaaaattccgctactggcaaaaactgcgagattgattctgttccagtgaagtgtcgacagggttactgcttacgtatcacccaggaggggagaggacatgtaaaactgtcgaggggctcagaaatagtgctagacgcatgtgatacaagctgcgagatcatgattccgaagggcaccggggacatcctcgtcgattgtagtggaggtcagcaacactttctgaaggacaatcttattgatctgggctgccccaaaatccctttgctcgggaagatggccatatatatttgtcggatgtccaaccatccaaaaactacaatggcgttcctgttttggttctcttttggatacgtgattacctgcattctgtgcaaggctatcttctatctcttaatcattataggcacgctgggtaaacgccttaagcagtacagagaattgaagccccagacttgtaccatctgcgagacaactcctgttaatgccattgacgcagagatgcacgatctgaactgtagctataatatctgcccatactgtgcctccaggctaacctcagacgggctcgctcggcatgtgatacagtgccccaaacgcaaggaaaaagtcgaggaaacagagctgtaccttaacctggaacgaatcccttgggtggtaagaaagttgctccaagttagtgagagcaccggagtggcactgaaaaggtcttcctggttaatcgtcctgctcgtgctttttacggtgtcactgagcccagtccagagtgccccgatcggccggaagcccttgttcctagactctattgctaaaggcatgaagaatcctctgaactccactagcctcgagacatcgctgtctatcgaagccccatggggtgcgattgatgttcagtccacctataagcccactgtgtcaacagcaaatatagcccttagttggagctccgtagagcaccgtggaaacaaaatcctggtgtctggtcgcagcgaatcaattatgaagttggaggaaagaaccggcatcagttgggacctcggggtcgaggatgcttccgagagcaaactgttaacggtgtctgttatggacctgtcacagatgtacagtcctgtgtttgaatatctaagcggagataggcaagtcgaggaatggccaaaggccacctgtacaggcgactgccccgagcggtgtggttgcacttcctctacctgtctccacaaagaatggccgcattcgcgaaattggcgctgcaaccctacatggtgctggggcgtggggactggatgtacctgctgtggcctggatgtaaaggaccttttcacagattacatgtttgttaagtggaaagtggagtatatcaagaccgaggcaattgtctgcgtggaattgactagccaggagagacagtgttccctgatagaagctgggacgaggttcaacctcggacccgtcacaatcaccctgtcagagccacggaatattcaacagaaacttcctcccgagatcattactctgcacccacgcatcgaagaggggtttttcgacttgatgcatgtgcagaaggttctcagtgcctctaccgtgtgcaaactgcagagctgtacacacggcgtacccggggatttacaagtctaccacataggaaacctgctaaagggcgacaaggtgaatggtcatctcatccacaaaattgaacctcatttcaacacctcctggatgtcatgggacgggtgcgatctggactattactgtaatatgggcgattggccaagctgcacttacacaggagttacgcagcacaaccatgcgtcttttgtgaatcttttgaacatcgagaccgactatactaagaatttccactttcactccaaaagagtcacagcccatggcgataccccgcagctggacctcaaggcaaggcccacatacggggctggagaaattactgtgctggtagaggtggccaacatggagttacacaccaaaaagatcgaaataagtggtctgaagttcgctagccttacgtgtaccggctgctatgcctgttcttccgggatttcatgcaaagttcgtatccatgtcgatgagcctgacgaattgacagtgcacgtgaagagtgatgacccagatgtcgttgcagccagctcgtccctcatggctcggaaactggagtttggaactgactctaccttcaaggcgtttagcgcaatgcccaaaacatcactatgcttctacattgtggaacgagagcactgtaagagttgctccgaggaagatactaaaaagtgtgtgaataccaagctggagcagcctcaatctatcctcatagaacataaaggcacgatcattggtaagcagaacagcacatgcaccgccaaagctagctgttggctggagtcagtaaagagctttttctatgggcttaaaaatatgttgagtggcatctttggaaacgtcttcatgggcatttttctgttcttagccccattcatcctcctgatactgtttttcatgtttgggtggaggattcttttctgctttaagtgttgcagacgcactcggggattgttcaagtacagacacctcaaagacgacgaagagacaggctataggcgcatcatcgagcgactgaataacaagaaaggtaagaacaaactactggatggggaacggctcgcagaccgtagaattgccgagctgttttctaccaagactcatatcgga

SEQ ID NO: 10634 - RNA, 2916 nt, synthetic construct
  misc_feature 1..2916: note = derived and/or modified CDS sequence (opt3) from CCHFV(K128_76, Artificial)__KX013454.1__Gn-4aa-Gc
  source 1..2916: mol_type = other RNA
agcgacgagtccggcgatgactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaagagcttcaagttgtgtgaaaattccgctactggtaaatcttgcgaaattgactcgatccctgttaagtgtcgacaggggtactgcttaaaaataacccaggagggacgtggccatgtgaagctgtcaagaggcagcgaggtagtgctagatgcatgtgacagttcctgcgaagtcatgatcccaaaggggacaggagatattctcgtggactgttctggtggccagcaacactttctgaaagataaccttatcgacctggggtgcccgaagattcccttgctcggaaaaatggccatctatatatgtaggatgagcaatcatcctaagaccactatggcgttcctgttttggttctcctttggctacgttattacatgcatcgtgtgcaaagctattttctatctgctcatcatcgtcggtaccttagggaagcggtttaagcagtaccgcgagctgaaaccacagacgtgtactatttgcgaaaccacacccactaacgccatagatgcagagatgcacgaccttaattgttcatataacatctgcccttactgtgccagtagattgaccagcgacggactggctaggcatgtgacacactgcccaaagcggaaagagaaggtagaagagaccgaactatacctcaatctggagcgcattccctgggttgtgcgaaaacttctgcaggtctctgaatccacgggcgtggcattgaagagatcaagctggctcatcgtgctgttagtcctgttcgccgttagtctctctcctgtgcaatccgctccaataagcaggcggccgctttttcaggattcgattgtaaaaggcatgaagaacctgctcaattctacttccctagagacatcactgagtatcgaggccccctggggagcgatcaacgtgcagagcacctataagcctgcagtctccgccgctaatattgccctctcttggagctcagtggaacaccgtgggagtaaaatcctggtttccggtcgcagcgagtctattatgaaacttgaagagagaactggcatatcatgggacctgggggtggaagatgcaagtgagagcaaattgctcacagtctccgtgatggacctgtctcagatgtactcgccagtattcgagtatttaagcggagataggcaagttgaagagtggcccaaggctacctgtacgggcgactgccctgaacggtgtggttgcacctcctcaacatgtctgcataaagagtggccacacagtcgaaactggcgctgcaatcccacttggtgctggggcgtggggaccggatgtacatgctgtggcctagatgtcaaggacctctttactgattacatgttcgtgaagtggaaagtcgaatatatcaagaccgaggccattgtgtgcgttgagctgacatctcaggaaagacagtgtagccttatcgaggcggggaccaggtttaacttgggaccggtgactatcacgctgtccgaacctcggaacattcaacagaaattgcccccagagataatcacactgcatcctcgcattgaggaaggtttcttcgaccttatgcacgtacagaaggtcctgtcagccagcaccgtgtgcaaattgcagtcttgtactcacggcgttcccggggatctccaagtgtaccatatcggaaatctgttaaagggcgacagagtcaacggtcacctgattcataagatcgagccacactttaatacctcctggatgagttgggacgggtgcgatctagactattactgtaacatgggcgattggcccagctgcacatacaccggagtgactcagcataatcacgcatctttcgtaaacctcctgaatatagaaacagactatacgaaatcctttcacttccattcaaagagggtgaccgctcacggcgatactcctcagcttgacttgaaagcccgtccaaactacggggctggagagatcacagttctggtcgaagtggccgatatggagctccataccaagaaaattgagatcagtggtctgaagtttgccagcttaacatgtactggctgctatgcatgctcgtccgggatttcttgtaaggtgcggatccacgtcgacgaaccggatgagctgaccgttcacgtgaaaagcgacgatcccgacgtggtagctgcgtcaagttcccttatggcacgaaagttggagttcggaacggattctacctttaaagccttcagcgctatgcctaagacatccctctgcttttacatagtcgagagagaatattgtaaatcatgcagcaaggaggacactcagaaatgtgtgaataccaagctggagcaaccacagagtattctaatcgaacataagggcacaattatcggtaaacagaacaatacttgcaccgccaagacgtcttgttggctggagtccgttaagagcttcttttacgggctcaaaaacatgctgtcgggcatattcggaaatgtgtttgtcggcatcttccttttcttggcaccctttattctgttaatcctcttctttatgttcgggtggaggattctgttttgcttcaaatgttgccgccggacaagaggactttttaggtataagcacctggaaaacgacgaggaaaccggctaccgccgaatcatagagcggttgaataacaagaaaggtaagaacaaactcctggatggggagcgtctagccgacagaaggattgctgaactgttctcaactaagacacatatcgga

SEQ ID NO: 10635 - RNA, 2916 nt, synthetic construct
  misc_feature 1..2916: note = derived and/or modified CDS sequence (opt3) from CCHFV(K168_40, Artificial)__KX013457.1__Gn-4aa-Gc
  source 1..2916: mol_type = other RNA
agcgacgagtccggcgatgactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaagagcttcaaattgtgtgaaaattccgctactggtaaatcttgcgaagttgactcgattcctgtgaagtgtcgacaggggtactgcttaaaaatcacccaggagggacgtggccatgtaaagctgtcaagaggcagcgaggtggtcctagatgcatgtgacagttcctgcgaagtgatgataccaaaggggacaggagatatcctcgttgactgttctggtggccagcaacactttctgaaagataaccttattgacctggggtgcccgaagatccccttgctcggaaaaatggccatttatatctgtaggatgagcaatcatcctaagaccactatggcgttcctgttttggttctcctttggctacgtgataacatgcattgtctgcaaagctatcttctatctgctcattatcgtgggtaccttagggaagcggtttaagcagtaccgcgagctgaaaccacagacgtgtactatctgcgaaaccacacccactaacgccattgatgcagagatgcacgaccttaattgttcatataacatatgcccttactgtgccagtagattgaccagcgacggactggctaggcatgtaacacactgcccaaagcggaaagagaaggttgaagagaccgaactatacctcaatctggagcgcatcccctgggtggtccgaaaacttcttcaggtgtctgaatccacgggcgtggcattgaagagatcaagctggctcattgtcctgttagttctgttcgccgtgagtctctctcctgtacaatccgctccaatcggcaggcggccgctttttctggatgggatagtgaaaggaatgaagaacttgctaaatagcacttcgctggagacatctctctccattgaggccccctggggtgcgatcaacgtccagtcaacctataagcctactgtgagtgcagccaatatcgctctgagctggtcctctgttgaacaccgtggcaacaaaattcttgtgagcgggcgctcagagagtatcatgaagctggaagagagaacaggaatttcctgggacttgggcgtcgaagatgccagcgagtctaaactcctgaccgtgtcagtaatggacttaagtcagatgtacagcccagttttcgagtatctgtccggtgatagacaggtggaagagtggcccaaggcaacgtgtaccggggactgccctgaacggtgtggctgcacatcttcgacttgtctacataaagagtggccacacagccgaaattggcgctgcaaccccacctggtgctggggagtcggcacagggtgtacttgctgtggactcgatgtgaaggacctgtttaccgattacatgttcgtcaagtggaaagtggaatatataaagacagaggctatcgtttgcgtggagcttacctcccaagaaagacagtgttcattgattgaggccggtactaggtttaacctgggcccggtaacgatcacactcagtgaacctcggaatatccagcaaaaactgcccccagagattataacccttcatcctcgcatcgaggaagggttcttcgacctgatgcacgtccagaaggtgttgtctgcgagcactgtttgcaaactccagtcctgtacccacggagtgcccggcgatctgcaggtctaccatattggtaacttactgaagggggacaaggtgaatggccacctaatccataaaattgagccacactttaacacatcatggatgagctgggacggatgcgatctcgactattactgtaatatgggcgattggccctcttgcacctacactggggtaacacaacataaccacgcctccttcatcaatctgcttaacatagaaacggactataccaagagttttcacttccatagcaaaagagtgactgcacacggagatacacctcagttggacctgaaggctaggccaaattacggtgccggcgagatcaccgttctcgtcgaagtggctgatatggagctgcataccaaaaagattgagatctctgggttaaagtttgcctccctgacttgtaccggatgctatgcatgctcaagtggcattagctgtaaagtgcgtatccacgtcgacgaaccggatgagcttacggttcacgtgaagtcggacgatcccgacgtggtagccgcttcctctagcttgatggcgcggaaactcgagttcggtaccgattcaacatttaaggcattcagtgccatgcctaaaacttccctgtgcttttacatagtcgagcgagaatattgtaagtcttgcagcaaagaggacacccagaagtgtgtgaacacaaagctagagcatccacagtccattctgatcgaacacaaagggactattatcggcaagcaaaataacacatgcacggctaaaacatcatgttggctcgagagcgttaagagtttcttttacggactgaaaaatatgctttctggcatattcgggaacgtgtttgtcggaatcttcttgttcctggccccctttattttactcatcctgttctttatgttcggctggaggattctgttttgcttcaagtgttgcaggcgcacccggggtctgtttagatataagcatttggaagacgatgaggaaactgggtacaggcgcatcatagagcgactcaataacaaaaagggcaaaaacaagctgctagacggagagcggctggcagatcgtagaattgccgaactcttctccacaaaaacccacatcggt

SEQ ID NO: 10636 - RNA, 2916 nt, synthetic construct
  misc_feature 1..2916: note = derived and/or modified CDS sequence (opt3) from CCHFV(K168_125, Artificial)__KX013460.1__Gn-4aa-Gc
  source 1..2916: mol_type = other RNA
agcgacgagtccggcgatgactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaagagcttcaaattgtgtgaaaattccgctactggtaaatcttgcgaagttgactcgattcctgtgaagtgtcgacaggggtactgcttaaaaatcacccaggagggacgtggccatgtaaagctgtcaagaggcagcgaggtggtcctagatgcatgtgacagttcctgcgaagtgatgataccaaaggggacaggagatatcctcgttgactgttctggtggccagcaacactttctgaaagataaccttattgacctggggtgcccgaaggtgcccttgctcggaaaaatggccatctatatttgtaggatgagcaatcatcctaagaccactatggcgttcctgttttggttctcctttggctacgtcatcacatgcatagtgtgcaaagctattttctatctgctcatcattgtaggtaccttagggaagcggtttaagcagtaccgcgagctgaaaccacagacgtgtactatctgcgaaaccacacccactaacgccatcgatgcagagatgcacgaccttaattgttcatataacatttgcccttactgtgccagtagattgaccagcgacggactggctaggcatgttacacactgcccaaagcggaaagagaaggtggaagagaccgaactatacctcaatctggagcgcataccctgggtcgtgcgaaaacttcttcaggtgtctgaatccacgggcgtcgcattgaagagatcaagctggctcatcgttctgttagtgctgttcgccgtaagtctctctcctgtgcaatccgctccaattggcaggcggccgctttttctggatagcatcgtcaaagggaagaagaacttgctaaattcgacttctctggagacatccctctcaatagaggccccctggggagcgattaacgtgcagagtacctataaacctactgttagcgcagccaatatcgctctgtcctggtctagcgtggaacaccgtggtaacaagatccttgtctcaggccgcagtgagtccattatgaaactggaagagagaacagggatcagctgggacttgggagtggaagatgcctctgagtcaaagctcctgaccgtaagtgttatggacttaagccagatgtactccccagtgttcgagtatctgtctggcgataggcaggtcgaagagtggcccaaagcaacgtgtaccggtgactgccctgaacggtgtgggtgcacatcgagcacttgtctacataaggagtggccacactcccgaaattggcgctgcaaccccacctggtgctggggcgtgggaacaggctgtacttgctgtgggctcgatgtcaaggacctgtttaccgattacatgttcgtgaaatggaaggttgaatatattaaaacagaggctatagtgtgcgtagagcttacctcacaagaaagacagtgtagtttgatcgaggccggaactaggtttaacctgggtccggtcacgattacactctctgaacctcggaatatccagcaaaagctgcccccagagatcattacccttcatcctcgcatagaggaaggcttcttcgacctgatgcacgtgcagaaagttttgagcgcgtccactgtgtgcaagctccagtcatgtacccacggggtccccggagatttacaggtgtaccatatcggcaacctgctgaagggtgacaaagtaaatgggcacctaattcataagatcgagccacactttaacacaagctggatgtcttgggacggctgcgatctcgactattactgtaatatgggagattggccctcctgcacctacactggcgtgacacaacataaccacgccagtttcattaatctgcttaacatcgaaacggactataccaagagctttcacttccattctaaaagagttactgcacacggggatacacctcagttggacctgaaagctaggccaaattacggagccggtgagataaccgtcctcgtggaagtggctgatatggagctgcatacaaagaagatcgagatttccggcttaaaatttgcctcactgacttgtaccgggtgctatgcatgcagtagcggaatctcgtgtaaggtccgtattcacgttgacgaaccggatgagcttacggtgcacgtgaaatccgacgatcccgacgtagtcgccgcttctagctcattgatggcgcggaagctcgagttcggcaccgatagtacatttaaagcattctccgccatgcctaagacttctctgtgcttttacatcgtggagcgagaatattgtaaaagctgctccaaggaggacacccagaagtgtgttaacacaaaactagagcatccacagtcaatactgattgaacacaagggtactatcattgggaaacaaaataatacctgcacggctaagacaagctgttggctcgagagtgtgaaatctttcttttacggcctgaagaacatgctttccggaatcttcggcaacgtctttgtggggatattcttgttcctggccccctttatcttactcattctgttctttatgttcggatggagaatcctgttttgcttcaagtgttgcaggcgcacccggggcctgtttagatataaacatttggaagacgatgaggaaactggttacaggcgcattatcgagcgactcaataacaagaaagggaagaacaaactgctagacggagagcggctggcagatcgtagaatagccgaactcttcagcacaaagacccacattggc

SEQ ID NO: 10637 - RNA, 2916 nt, synthetic construct
  misc_feature 1..2916: note = derived and/or modified CDS sequence (opt3) from CCHFV(K229_194, Artificial)__KX013463.1__Gn-4aa-Gc
  source 1..2916: mol_type = other RNA
agcgaggaacccggcgacgattgcatctccagaacccagcttctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaagggcaaccttatcgatctggggtgcccccatattcctttgctcggaaaaatggccatctacatatgtagaatgtccaatcacccaaggacaaccatggcgtttctgttctggttttctttcggctatgtgattacgtgcatcttttgcaaggctctgttctacagcctcattatcatcggtactttagggaaaaagattaagcagtatcgggaactgaaaccccagacctgtacaatatgcgagactgcccctgttaacgcaatcgacgccgagatgcatgatcttaattgttcctacaacatttgcccatattgtgcttcacgcttgaccagtgacggactggcaagacacgtgacacagtgccccaagaggaaagaaaaggtcgaggaaaccgagctatacctcaatctggaacggatcccttggatagtgcgcaaacttctgcaagtaagcgagtctacgggcgttgccttgaagcgatcctcatggctcattgtgctgttagtcctgctcactgtgagccttagtccagtgcagtctgctccggtcggcagaaaacccctgtttttggactccatcgttaaggggaagaaaaacctactgaatagcacatcgctcgagacctctctgtccatcgaagccccttggggagcgattaacgtgcagtcaactttcaagccaacagtaagtaccgcaaatatcgcccttagctggtcctctgtggagcacaggggtaacaaaattctggtcacgggccggagcgaatcaataatgaagttggaggaacgtaccggggtgagttgggatctcggagttgaggacgcttccgagagcaaactgttaacagtgtctatcatggatctgtcacagatgtacagtcccgtctttgaatatctaagcggcgaccgccaagtggaggaatggcctaaggccacttgtaccggtgattgcccagagagatgtgggtgcacatcctctacttgtctccataaggaatggccccactcgaggaattggcggtgcaacccgacctggtgctggggcgtaggaacaggctgtacctgctgtggggttgacgtgaaagatctgttcactgaccatatgtttattaagtggaaagtcgagtacatcaagacggaggcaatcgtgtgcgtcgaacttacaagccaggagcgacagtgttccttgattgaagctggaacccgcttcaacctgggtcctgtgactataaccctctcagagcccagaaatatccaacagaaactgccacctgagattatcacacttcaccccaagattgaagagggcttctttgatctgatgcacgttcagaaggtgttgagtgcctctaccgtatgcaaactccagagctgtactcatgggatcccaggagacctgcaaatatatcacatcggcaacttactgaagggtgataggctaaatgggcatctcattcacaaaatcgaaccccatttcaacacatcctggatgtcatgggacggctgcgacctggattactattgtaatatgggagactggcctagctgcacgtacaccggcgtcactcagcacaaccacgcggcctttgtgaatcttttgaacattgagacagattataccaagacattccattttcactctaaacgggttactgcacatggggacaccccacagctggatctcaaggctcgcccgacgtacggagccggtgaaatcaccgtgctggtcgaggtggctgacatggagttacacacaaagaaagtagaaatatccggcctgaagttcgccagtcttgcatgtactgggtgctacagctgttcttccggaatttcatgcaaagtgagaatccacgttgatgagcccgacgaattgaccgtccatgtgaagagtagcgatcctgacgtggtcgccgcttcgacatccctcatggcgaggaaactggagtttggcactgattctaccttcaaggcatttagcgccatgccaaaaacgtcactatgcttctatattgttgaacgtgagtactgtaagagttgctccgaggacgatacaaagaaatgtgtggacaccaagctggaacagccccaatctatcctcatagagcacaaaggtactatcattgggaagcagaatgacacatgcaccgctaaagccagctgttggctggaatccgtgaagtcatttttctatggccttaagaacatgttgggaagcgtatttggcaatttcttcgtcgggatcctgttatttctcgcacctttcgtgctgcttgttctgtttttcatgtttggatggaaaattttgttctgctttaagtgttgccggcgaactagaggcctcttcaaatacaggcatctgaaggatgacgaggaaaccggttatcgcaaaatcatagagcggctaaacagtaagaaggggaaaaatagactgctcgatggagagaggctggccgaccgcaagattgctgaactgttttctacaaaaacgcacatcggc

SEQ ID NO: 10638 - RNA, 2916 nt, synthetic construct
  misc_feature 1..2916: note = derived and/or modified CDS sequence (opt3) from CCHFV(K229_243, Artificial)__KX013466.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaagagatcctcatggctcatagtcctgttagtgctgctcacggtgagccttagtccggtccagtctgctcccgttggcaggaagcctctgtttttggattccattgtgaaaggcatgaagaacctactgaatagcacttcgctcgagacatctctgtccatcgaagccccatggggagcgatcaacgtacagtcaaccttcaagcccactgtgagtacagcaaatattgcccttagctggtcctctgtcgagcaccgggggaacaaaatcctggtgaccggtcgtagcgaatcaattatgaagttggaggaacgcacgggcgttagttgggacctcggggtggaggatgcttccgagagcaaactgttaaccgtctctataatggacctgtcacagatgtacagtcctgtgtttgaatatctaagcggagatagacaagtagaggaatggccaaaggccacatgtactggcgactgccccgagaggtgtggttgcacctcctctacatgtctccataaagaatggccgcactcgcggaattggcgatgcaaccctacttggtgctggggcgttgggaccggatgtacatgctgtggcgtggatgtcaaggacctgttcaccgatcatatgtttgtgaagtggaaagtcgagtacatcaagactgaggcaattgtgtgcgttgaacttacgagccaggagcgccagtgttccttgatcgaagctgggacaagattcaacctgggacccgtgaccatcactctctcagagccaaggaatattcaacagaaactgcctcccgagataatcacccttcacccaaaggtagaagagggtttctttgacctgatgcacgtccagaaagtgttgagtgcctctacagtttgcaagctccagagctgtacccatggcattcccggggatctgcaagtgtatcacatcggaaacttactgaagggcgaccgggtcaatggtcatctaattcacaaaatcgaacctcatttcaacacttcctggatgtcatgggacgggtgcgatctcgactactattgtaatatgggcgattggccaagctgcacatacacgggagtgacccagcacaaccacgcggcctttgtaaatctgcttaacatagagactgactatacaaagaccttccattttcactctaaacgcgtgacagcacatggcgatactccgcagttggacctgaaggctagacccacctacggggccggagaaatcacggttctcgtcgaggtggctgatatggagctgcacaccaaaaaggtggaaatttccggtttaaagttcgccagtctggcatgtacaggctgctacgcctgcagctctgggatctcctgtaaagtcaggattcacgttgacgagcctgatgaacttactgtgcatgtgaagtcaagtgacccagatgtagtcgctgcgagcacctcgttgatggcacgtaaactcgagtttggaacagactccactttcaaggccttttctgctatgcccaaaaccagcctgtgcttctatatcgtggaaaaggagtactgtaaatcatgcagtgaggaagatacgcagaagtgtgttgacacaaagctagagcaacctcagtccatactgattgaacacaaaggcaccatcattggtaagcagaatgacacttgcacagccaaagcatcttgttggctcgagagcgtgaagtcctttttctatgggctgaaaaacatgcttggctcagtctttggaaatttcttcatcggcatattgctgtttttaaccccattcgtgctcctggttctgtttttcatgtttgggtggaagatccttttctgctttaagtgttgccggcgaactagaggattgctcaaatacaggcatctgaaggatgacgaagagaccggctatcgccggattatcgagagactaaacaataaaaagggtaaaaacaggctgctcgatggggaacgcctggccgaccgaaagattgctgagcttttcagcacaaagacgcacatcgga

SEQ ID NO: 10639 - RNA, 2916 nt, synthetic construct
  misc_feature 1..2916: note = derived and/or modified CDS sequence (opt3) from CCHFV(K315_14, Artificial)__KX013469.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccgtggtcgatcaaaggcttgggtcagagctgggatgctatacaattaaccgggttaagagtttcaaattgtgtaagaatagcgctactggcaaaacctgcgaaatcgactccacaccagtgaagtgtcgccagggtttttgcttaaagattacccaggaggggcgaggacatgtaaaactgtctcgtggctcggaggtggtcctagatgtgtgtgactcaagctgcgaaatcatgataccgaagggcactggggatatcctcgttgactgtagtggaggtcagcaacacttcctgaaagataaccttattgacctgggctgcccccatatccctttgctcgggaagatggcaatttacatctgtagaatgtccaatcacccaaggacaaccatggcctttctgttctggttttctttcggatatgtgataacgtgcatcttttgcaaagcgctgttctacagcctcattattatcggcactttaggtaagaagatcaaacagtatcgggagctgaagccccagacctgtacaatttgcgaaactgctcctgtcaacgccatagatgcagagatgcatgaccttaattgttcctacaacatctgcccatattgtgcctcacgcttgaccagtgaggggctggctagacacgtgacacagtgccccaaaaggaaggaaaaagtagaggaaaccgagctatacctcaatctggaacggattccttggatcgttcgcaaacttctgcaagtgagcgagtctacgggagtcgcattgaaacgatcctcatggctcatagtgctgttagtgctgctcactgtcagccttagtccagttcagtctgccccggtgggcagaaagcccctgtttttggactccattgtaaagggcatgaaaaagctactgaacagcacatcgctcgagacctctctgtccatcgaagctccttggggagccatcaatgtgcagtcaactttcaaaccaacagtcagtaccgcgaacattgcacttagctggtcctctgtggagcacaggggaaataagatcctggttacgggtcggagcgaatcaattatgaaattggaggaacgtaccggcgtgagttgggatctcggggtcgaggacgcctccgagagcaagctgttaacagtgtctataatggatctgtcacagatgtacagtcccgtatttgaatatctaagcggagaccgccaagttgaggaatggcctaaggctacttgtaccggcgattgcccagagagatgtggttgcacatcctctacttgtctccataaagaatggccccactcgaggaactggcggtgcaatccgacctggtgctggggcgtggggacaggatgtacctgctgtggcgtcgacgtgaaggatctgttcactgaccatatgtttatcaaatggaaggtcgagtacattaaaacggaggccatcgtgtgcgttgaacttacaagccaggagcgacagtgttccttgatcgaagcagggacccgcttcaacctgggacctgtgactattaccctctcagagcccagaaacatacaacagaagctgccacctgagatcattacacttcaccccaagatcgaagagggtttctttgatctgatgcacgtacagaaagtcttgagtgcttctaccgtgtgcaagctccagagctgtactcatggcattccaggggacctgcaaatctatcacataggaaatttactgaaaggcgatagggttaacggtcatctaatccacaagattgaaccccatttcaatacatcctggatgtcatgggacgggtgcgacctcgattactattgtaacatgggcgactggcctagctgcacgtacaccggagtgactcagcacaatcacgccgcgtttgtcaacctgcttaatatcgagacagattataccaaaacattccattttcactctaagcgggtgactgcccatggcgacaccccacagttggatctgaaggcacgcccgacgtacggggctggagaaattaccgtactcgtggaggttgccgacatggagctgcacacaaagaaggtcgaaatctccggtttaaaattcgctagtctgacttgtaccggctgctacgcctgcagctctgggatatcctgtaaggtgaggattcacgtggatgagcccgacgaacttacagtccatgttaaatcaagtgatcctgacgtggtggcagccagcacttcgttgatggctagaaagctcgagtttggaaccgattccacgttcaaagcgttttctgcaatgccaaagacaagcctgtgcttctatatcgtagaacgtgagtactgtaagtcatgcagtgaggacgataccaaaaagtgtgtcgacactaaactagaacagccccaatccattctgatcgagcacaagggcacaataatcggtaaacagaacgatacctgcactgccaaggcttcttgttggctcgaaagcgtgaagtcctttttctatgggctgaaaaatatgcttggctcagtttttgggagcttcttcgtgggcattttgctgtttttagcccctttcgtcctcctggtgctgtttttcatgtttgggtggaagatccttttctgctttaaatgttgccggcgaaccagaggattgttcaagtacaggcatctcaaagacgacgaggaaacaggctatcgccggattatcgagagactgaacagtaagaagggtaaaaataggctactggatggggagcgcctcgcagaccgaaagatagccgaactgttttctacgaaaacccacattgga

SEQ ID NO: 10640 - RNA, 2916 nt, synthetic construct
  misc_feature 1..2916: note = derived and/or modified CDS sequence (opt3) from CCHFV(K323_27, Artificial)__KX013472.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacctcttaattatcatcggcactctgggtaaaaagattaagcagtatcgggaacttaaaccccagacctgtacaatatgcgagactgcccctgttaacgcaatcgatgccgagatgcatgacttgaattgtagctacaacatttgcccatattgtgcttcccgcctgacctcagacgggctagcaagacacgtgacacagtgccccaagaggaaagaaaaggtcgaggaaaccgagctctacctgaatcttgaacggatcccttggatagtgcgcaaactgttgcaagtaagtgagagcacgggagttgccctcaagcgatcttcctggctgactgtgttactggtcctccttacagtgtcactgagcccagtgcagagtgctccggtcggcagaaaacccttgtttctagattctattgccaagggcatgaagaacctgctcaattccaccagcctggagacttcgctttctatcgaagcgccttggggagcaatcaacgttcagtccacattcaaaccaaccgtgtcaacggccaatattgctctgagttggagctccgtagagcacagggggaacaagatcttggtgaccggtcggtctgaaagcattatgaaactcgaggaacgtacaggcgtctcatgggacctgggggtggaggatgccagtgagtccaagttactgactgttagcataatggacctatctcagatgtactcacccgtgtttgaatatctcagtggagatcgccaagtcgaggaatggcctaaagcaacctgtacaggcgactgcccagagagatgtggttgcactagctccacctgtctgcataaggaatggccccactctaggaattggcggtgcaacccgacatggtgctggggcgtggggaccggatgtacttgctgtggcgtagatgttaaggaccttttcacggatcatatgtttatcaaatggaaggtggagtacattaaaacagaggctatcgtctgcgtggaattgaccgggcaggagcgacagtgttcgctgatcgaagccggaactcgcttcaacctcggtcctgtcaccattacactgagcgagcccagaaatatacaacagaaacttccacctgagatcattaccctgcaccccaagatcgaagagggcttctttgacttgatgcacgtgcagaaggttctctccgcgtcaactgtgtgcaagctgcagagttgtacacatgggattccaggagatttacaaatctatcacataggcaacctgctaaaaggtgacagggtaaatgggcatctcatccacaagattgaaccccatttcaacacgtcttggatgagctgggacggctgcgatctggactactattgtaatatgggagattggccttcctgcacctacactggcgtcacacagcacaaccacgccgcatttgtgaatcttttgaacatcgagaccgactatacaaaaactttccattttcactcaaagcgggttaccgctcatggggatacgccacagctggacctcaaagcccgcccgacctacggagctggtgaaattacagtgctggtcgaggtggccgatatggagttacacactaagaaggtagaaatcagcggcctgaaattcgcatctcttacctgtacagggtgctacgcctgctccagtggaataagctgtaaggtgaggattcacgttgacgagcccgatgaattgactgtccatgtgaaatcttccgaccctgatgtggtcgctgcgtcaaccagtctcatggcaagaaagctggagtttggcacggacagcacattcaaagccttttcggctatgccaaagacctccctatgcttctatatcgttgaacgtgagtactgtaaatcttgcagcgaggatgacactaagaagtgtgtggacacaaaactggaacagccccaatcaattctcatcgagcacaagggtaccataatcgggaaacagaatgatacttgcaccgccaaggcaagttgttggctggaatccgtgaaatcatttttctatggccttaagaacatgttgggaagcgtatttggctccttcttcgtcgggattctgttatttctcgcccctttcgtgctgcttgttctgtttttcatgtttggatggaagatcttgttctgctttaaatgttgccggcgaacaagaggcctcttcaagtacaggcatctgaatgacgatgaggaaacgggttatcgccggattatcgagagactaaactctaaaaaggggaaaaataggctgctcgacggagagcgcctggctgatcgaaagatagccgaactttttagcaccaagactcacattggc

SEQ ID NO: 10641 - RNA, 2916 nt, synthetic construct
  misc_feature 1..2916: note = derived and/or modified CDS sequence (opt3) from CCHFV(K340_6, Artificial)__KX013475.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcactaccggcaagacatgcgagattgactccaccccagttaaatgtcgccagggtttttgcttaaagatcactcaggaggggcgaggacatgtgaagctgtctcgtggctcggaagtagtgctagatgcttgtgactcaagctgcgagataatgatcccgaaaggcacaggggatattctcgtcgactgtagtggaggtcagcaacacttcctgaaggataaccttatcgacctgggctgcccccatattcctccattggggaaaatggcaatctacatatgtagaatgtccaatcaccccaggaccacgatggcctttctcttctggttttctttcggatatgtgattacttgcatcttttgcaaggcgctgttctacagcctgattatcatcggcaccctcggtaaaaagattaagcagtatcgggaattaaaacctcagacatgtactatatgcgagaccgctccagttaacgccatcgatgcagagatgcatgacctgaattgttcctacaacatttgcccctattgtgcctcacgccttacaagtgacgggttggctagacacgtgacccagtgccctaagaggaaagaaaaggtcgaggaaacggagctgtacctaaatctcgaacggatcccatggatagtgcgcaaactgcttcaagtaagcgagtctactggagttgcactgaagcgatcctcatggttgattgtgctcctggtcttactgacagtgagcctcagtccggtgcagtctgcccccgtcggcagaaaacctctttccctggatagcatcgttaagggcatgaagaacttgctaaattcgacctctctggagacttccctctcaatcgaagctccatggggagccattaacgtgcagagtacatttaaacccaccgtaagcacggcgaatatcgcactgtcctggtctagcgtggagcacagggggaacaagattcttgtcaccggtcggtcagaaagtataatgaaactggaggaacgtacaggcgtgtcctgggacttgggggttgaggatgccagcgagtctaagctcctgactgtgtcaatcatggacttaagtcagatgtacagccctgtcttcgaatatctgtccggagatcgccaagtggaggaatggccaaaagctacctgtacaggcgactgccccgagagatgtggttgcacttcttcgacctgtctacataaggaatggccgcacagcaggaattggcggtgcaaccctacatggtgctggggcgtagggaccggatgtacttgctgtggcgttgatgtgaaggacctctttacggatcatatgttcattaaatggaaggtcgagtacatcaaaacagaggccatcgtgtgcgtcgaactgacctcccaggagcgacagtgttcacttattgaagcagggactcgctttaacttgggacccgtgaccataacactgagtgagccaagaaatatccaacagaagctccctcccgagattatcaccctgcacccaaaaattgaagagggtttcttcgaccttatgcacgttcagaaggtgctgtctgctagcactgtatgcaagttgcagtcctgtacacatggcatccccggggatctccaaatatatcacatcggaaacctgttaaaaggcgacagggtcaatggtcatctgattcacaagatcgaacctcattttaacacgtcatggatgagctgggacgggtgcgatctagactactattgtaatatgggcgattggccatcttgcacctacactggagtgacacagcacaaccacgccgcgttcgttaatctcctgaacattgagaccgactatacaaaaacttttcatttccactccaagcgggtgaccgcccatggcgatacgccgcagcttgacttgaaagcacgccccacctacggggctggagaaatcacagtcctggtggaggtaactgatatggagctccacaccaagaaggtggaaataagtggtctgaaatttgccagcttaacatgtactggctgctacgcttgctctagtgggatttcatgtaaggttagaatccacgtcgacgagcctgatgaactgaccgtgcatgtgaaaagtagcgacccagatgtcgttgccgcatcgacgtcccttatggccaggaagttggagttcggaacagactctacctttaaggctttcagcgcgatgcccaaaacttcactctgcttttatattgtggaacgtgagtactgtaaaagttgctccgaggatgacacaaagaagtgtgtggacaccaaactggaacagcctcaatctatcctaatagagcacaagggcactatcattggtaaacagaatgatacctgcacagcaaaggccagctgttggctggaatccgtaaaatcattcttttatgggctcaagaacatgctgggcagcgtcttcggatcctttttcgtgggcatccttttgttcctggctccatttgttttactcgtgctgttctttatgttcgggtggaagattttgttttgcttcaaatgttgccggcgaacgagaggactgtttaagtacaggcatttcaaagacgatgaggaaaccggctatcgccggatcatagagagacttaattctaagaaaggtaagaacaggctcctggacggggagcgcctagccgatcgaaagattgcagaactgttttccactaaaacacacatcgga

SEQ ID NO: 10642 - RNA, 2916 nt, synthetic construct
  misc_feature 1..2916: note = derived and/or modified CDS sequence (opt3) from CCHFV(Mamon, Artificial)__KX013478.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgtcagatgcatgtgacagcagttgcgaggtcatgataccgaagggcactggggatatcctagtggactgttccggaggtcagcaacacttcctcaaagataacctgattgaccttggctgcccccatatccctctgttggggaagatggccatttacatctgtaggatgtctaatcacccacggacaaccgttgcgtttctcttctggtttagcttcggatatgtgataacgtgcatcttttgcaaagctctgttctactccctgattattatcggcactctcggtaagaaaatcaagcagtatcgcgaattaaagccccagacctgtacaatttgcgagactgcccctgtcaacgcaatagatgccgagatgcatgacctgaattgttcatacaacatctgcccatattgtgctagtagacttaccagcgacgggttggcaaggcacgtgccccagtgccctaaacggaaggaaaaagtagaggaaacagagctgtacctaaatctcgaacgcattccatggatcgttcgaaagctgcttcaagtgtctgagtccaccggagtcgccctgaaaagatcaagctggttgatagtgctcctggtgttactgacggtcagtctctctccggttcagtccgctcccgtgggcaggaagcctctttttctggatagcattgtaaaaggcatgaagaacttgctaaattcgacttctctggagacatccctctcaatcgaagccccatggggagcgatcaacgtgcagagtaccttcaagcccactgtcagcacagcaaatattgccctgtcctggtctagcgtggagcaccgggggaacaaaatccttgttaccggtcgttcagaaagtattatgaagctggaggaacgcacgggcgtgtcctgggacttgggggtcgaggatgctagcgagtctaaactcctgaccgtgtcaataatggacttaagtcagatgtacagccctgtatttgaatatctgtccggagatagacaagttgaggaatggccaaaggccacatgtactggcgactgccccgagaggtgtggttgcacctcttcgacatgtctacataaagaatggccgcacagccggaattggcgatgcaaccctacttggtgctggggcgtggggaccggatgtacatgctgtggcgtcgatgtgaaggacctcttcaccgatcatatgtttgtcaagtggaaagtggagtacatcaagactgaggcaattgtttgcgtggaactgacgtcccaggagcgccagtgttcacttatcgaagctgggacaagattcaacttgggacccgtaaccatcactctgagtgagccaaggaatattcaacagaaactccctcccgagataatcaccctgcacccaaaggtcgaagagggtttctttgaccttatgcacgtgcagaaagttctgtctgccagcacagtgtgcaagttgcagtcctgtacccatggcattcccggggatctccaagtctatcacatcggaaacctgttaaagggcgaccgggtgaatggtcatctgattcacaaaatcgaacctcatttcaacacttcatggatgagctgggacgggtgcgatctagactactattgtaatatgggcgattggccatcttgcacatacacgggagtaacccagcacaaccacgcggcctttgtgaatctcctgaacatagagactgactatacaaagaccttccattttcactccaaacgcgttacagcacatggcgatactccgcagcttgacttgaaggctagacccacctacggggccggagaaatcacggtcctggtggaggtggctgatatggagctccacaccaaaaaggtcgaaattagtggtctgaagttcgccagcttagcatgtacaggctgctacgcctgttcttccgggatctcatgcaaagttaggattcacgtggacgagcctgatgaactgactgtgcatgtaaagagtagcgacccagatgtcgtggctgcgtcgacctcccttatggcacgtaaattggagtttggaacagactctactttcaaggcctttagcgctatgcccaaaacctcactctgcttctatatcgttgaacgggagtactgtaagagttgctccgaggaagatacgcagaaatgtgtggacacaaagctggagcaacctcagtctatactaattgaacacaagggcaccatcattggtaaacagaatgacacttgcacagccaagaccagctgttggctggagtccgtcaaatcatttttctatgggctcaagaacatgctgggcagcgtgtttggaaatttcttcatcggcatacttttgtttctggcaccattcgttttactcgtgctgtttttcatgtttgggtggaaaatccttttctgctttaagtgttgccgaagaactaggggactgttgaagtaccgccatctcaaagatgacgaagagaccggctatcggagaattatcgagaggctgaacaataagaaaggtaagaaccgcctactggatggggaacgactcgccgaccggaaaattgctgagctgttcagtacaaagacgcacatcgga

SEQ ID NO: 10643 - RNA, 2916 nt, synthetic construct
  misc_feature 1..2916: note = derived and/or modified CDS sequence (opt3) from CCHFV(Min, Artificial)__KX013481.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaaaagatcctcatggctcatagtcctgttagtgctgctcacggtgagccttagtccggtccagtctgctcccgttggcaggaagcctctgtttttggattccattgtgaaaggcactaagaacctactgaatagcacatcgctcgagacctctctgtccatcgaagccccatggggagcgatcaacgtacagtcaactttcaagcccacagtgagtaccgcaaatattgcccttagctggtcctctgtcgagcaccgggggaacaaaatcctggtgacgggtcgtagcgaatcaattatgaagttggaggaacgcaccggcgttagttgggacctcggggtggaggatgcttccgagagcaaactgttaacagtctctataatggacctgtcacagatgtacagtcctgtgtttgaatatctaagcggagatagacaagtagaggaatggccaaaggccacttgtaccggcgactgccccgagaggtgtggttgcacatcctctacttgtctccataaagaatggccgcactcgcggaattggcgatgcaaccctacctggtgctggggcgttgggacaggatgtacctgctgtggcgtggatgtcaaggacctgttcactgatcatatgtttgtgaagtggaaagtcgagtacatcaagacggaggcaattgtgtgcgttgaacttacaagccaggagcgccagtgttccttgatcgaagctgggaccagattcaacctgggacccgtgactatcaccctctcagagccaaggaatattcaacagaaactgcctcccgagataatcacacttcacccaaaggtagaagagggtttctttgacctgatgcacgtccagaaagtgttgagtgcctctaccgtttgcaagctccagagctgtactcatggcattcccggggatctgcaagtgtatcacatcggaaacttactgaagggcgaccggattaatggtcatctaatccacaaaatagaacctcatttcaacacatcctggatgtcatgggacgggtgcgatctcgactactattgtaatatgggcgattggccaagctgcacgtacaccggagtcactcagcacaaccacgcggcctttgtgaatctgcttaacatcgagacagactataccaagacattccattttcactctaaacgcgtaactgcacatggcgataccccgcagttggacctgaaggctagacccacgtacggggccggagaaattaccgtgctcgttgaggtcgctgatatggagctgcacacaaagaaggtggaaatctccggtttaaagttcgccagtctggcatgtactggctgctacgcctgcagctctgggatttcctgtaaagtgaggatccacgtcgacgagcctgatgaacttaccgttcatgtgaagtcaagtgacccagatgtggtagctgcgagcacatcgttgatggcacgtaaactcgagtttggaactgactccaccttcaaggccttttctgctatgcccaaaacgagcctgtgcttctatatagtcgaacgggagtactgtaagtcatgcagtgaggaagatacacagaaatgtgtggacaccaagctagagcaacctcagtccattctgatcgaacacaagggcactattatcggtaaacagaatgacacatgcaccgccaaggcatcttgttggctcgagagcgttaaatcctttttctatgggctgaagaacatgcttggctcagtgtttggaaatttcttcataggcatcttgctgtttttagccccattcgtcctcctggtgctgtttttcatgtttgggtggaaaattcttttctgctttaagtgttgccgaagaactaggggattgctcaagtaccgccatctgaaagatgacgaagagaccggctatcggagaatcattgagaggctaaacaataagaaaggtaagaaccgcctgctcgatggggaacgactggctgaccggaaaatcgccgagcttttcagcacaaagacgcacatagga

SEQ ID NO: 10644 - RNA, 2916 nt, synthetic construct
  misc_feature 1..2916: note = derived and/or modified CDS sequence (opt3) from CCHFV(Nakiwogo, Artificial)__KX013484.1__Gn-4aa-Gc
  source 1..2916: mol_type = other RNA
gccgagggcgtgagcaacgactgcgtctccagaacccagctgatcaagacagaagttgctgagattcacgaagattcttacgggggacccggtgagaaaataactatctgtaatggctcaacgattgtggaccaaaggctcgggagtgaacttggatgctataccatcaaccgggtaaagacatacaaactgtgtgagaatagcgcaactgagaagggctgcgaaattgattccgtgcctgtcaaatgtaagcagggtttctgcttgaaggtgacccaggaggggcgcggacatgttaaattatctcgaggcacagaaatcgtgctggacgtctgtgatacctcgtgcgagctaatgataccaaagggcactggggacatcctcgtggattgttcaggaggtcagcaacactttctgcaggacaaccttattgatctgggctgcccgaatgtacccttgctcgggaaaatggccatctatatttgtcgtatgagcaaccatcctaagacaaccatggcgttcctgttttggttcagttttggatacgttatcacgtgcgtggtctgcaaagtgctgttctatctcttaatagtgattggcactctgggtaagaaacttaagcagtacagagagttgaagccacagacctgtatcgtctgcgaatccattcccgttaatgtgatcgacgctgagatgcacgaactgaactgtaattataacatctgcccttactgtgcctctaggctaacaagcgatgggctcgtacggcatgtgactcaatgcccaaaacgcaaggagaaagtcgaagagaccgagctgtaccttaatctggaaaggattccctggttggtgagacggctcctgcaggtttccgagtcaacaggaatggcattaaagcgcagttgttggatgaccacgctgctcatacttctggtggtcagcttgtctcctgtgcagtccgccccagtaggccgaaaaccgctatatctggactcaatcgctaagggcatgaaaagcctcctgaacagtactaatcttgaaacatctctgtccattgaggcaccctggggtgccatcaacgttcagagcacctttaagcctactgtgtcggctgccaatatagcgttgtcttggtcctcagtcgaacacagaggaaacaagattctcgtgagtggtaggagcgagtccatcatgaaactggaggaacggacaggcatctcttggagcttaggggtcgaggatgcatcagaaagtaagaccctgacggtgtccgttatggacctaagccaaatgtactctccagtgttcgagtatctctcaggagaccgtcaggtagaagagtggcccaaagctacctgcacaggcgattgtcctgagcgctgcggttgtactagcagtacctgcctgcacaaggaatggccacattccagaaactggaggtgcaatcccacatggtgttggggcgtcgggactggatgcacctgttgcggccttgacgtgcgggatttgtttacagactacatgatggttaagtggaaagtggagtatgtcaagaccgaagccattatgtgtgtggagctgacttctcaggagcgacaatgctcgctcatcgaagccgggacgcgcttcaacctgggaccggtaacaattacccttagcgagcctagaaatgtgcagcagaggctgccctccgaaatagttactttgcacccaaaaatcgaggaagggtttttcgatctcatgcatgtccagaaggtgctgttttgtaaacactcattacaagcaaccagttgcacacacggcgtgcctggggacctgcaggtctaccatgttggaaacctactcaagggcgataaggtgaatggtcactctattcataaaatcgagagccacttcaacacctcctggatgtcatgggacgggtgtgatctggactatttctgcaatatgggcgattggcccagctgtacttacacaggagtgacgcagcataaccgggctgcctttgtaaatatgcttaacatcgagaccgactacactaagacattccactttcactctaaacgcgtcaccgcgcatggcgacacaccacagttggatctgaaggccagacccacttatggggcaggagaagtgaccgttctcgtggaggtcgctgacctggaattacacacgaaaaagattgaggtgtccggtctgaagttcgccagtcttacctgcagcggctgctacgcttgttcttccgggatatcatgcaaagttaggatccatgtgaatgaacctgatgagtttacagtacacgtcaagagtaacgacccagatgtggtggccgcaggaagctcgttgatggcccgtaaaattgagctcggcgctgactccactttcaaggcgttttctagcatgccgaaaaattcactgtgtttctatatcgtcgaacgggattactgcagttcctgtaccgacgatgacacacaaaagtgcgttaacactaaactagagcacccccagtctattctgatcgaacataagggtaccataatcgggaagcagaatgatacgtgtcctacaaaaaccagctgctggctcgagtccgtgaagtcatttttctatggcctgaaaaacatgcttggaggcatttttgggaacgtattcttgggaatctttctgttcttagcaccattcgccctcctgattctgtttttctttttcggctggcgacttttgttttgtctcaagtgctgtagaaggactcgcggtctgctaaaatacaagcagctgaaggacgaagaggaggctgggtataaaaagatcatagaacggctcaatgataaaaagggaaaaagcagactgttcgacggcgagaggcttgccgaccgcaagattgcagaattgtttagtacaaagacccacatcggt

SEQ ID NO: 10645 - RNA, 2916 nt, synthetic construct
  misc_feature 1..2916: note = derived and/or modified CDS sequence (opt3) from CCHFV(Saf, Artificial)__KX013487.1__Gn-4aa-Gc
  source 1..2916: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacactacctgaaagataaccttattgacctgggctgcccccatatccctttgctcgggaagatggccatttatatctgtaggatgtccaatcacccacggacaaccatggcgttcctgttttggttctcttttggatacgttataacgtgcattttctgcaaagctctgttttatagcctcatcattatcggcactttaggtaagaaaatcaagcagtaccgcgaactgaagccccagacctgtacaatttgcgagactgcccctgtgaacgcaatagatgccgagatgcatgaccttaattgttcctataacatctgcccatactgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaagagatcctcatggctcatagtcctgttagtgctgctcacggtgagccttagtccggtccagtctgctcccgttggcaggaagcctctgttctccgatagcattgtgaaaggcatgaagaacttgctaaattcgacttctctggagacatccctctcaatcgaagccccatggggagcgatcaacgtacagagtacctttaagcccactgtgagcacagcaaatattgccctgtcctggtctagcgtcgagcaccgggggaacaaaatccttgtgaccggtcgttcagaaagtattatgaagctggaggaacgcacgggcgtttcctgggacttgggggtggaggatgctagcgagtctaaactcctgaccgtctcaataatggacttaagtcagatgtatagccctgtgttcgaatacctgtccggagatagacaagtagaggaatggccaaaggccacatgtactggcgactgccccgagaggtgtggttgcacctcttcgacatgtctacataaagaatggccgcacagccggaattggcgatgcaaccctacttggtgctggggcgttgggaccggatgtacatgctgtggcgtggatgtcaaggacctctttaccgatcatatgttcgtgaagtggaaagtcgagtatatcaagactgaggcaattgtgtgcgttgaactgacgtcccaggagcgccagtgttcacttatcgaagctgggacaagatttaacttgggacccgtgaccatcactctgagtgagccaaggaatattcaacagaaactccctcccgagataatcaccctgcacccaaaggtagaagagggtttcttcgaccttatgcacgtccagaaagtgctgtctgccagcacagtttgcaagttgcagtcctgtacccatggcattcccggggatctccaagtgtaccacatcggaaacctgttaaagggcgaccgggtcaatggtcatctgattcacaaaatcgaacctcattttaacacttcatggatgagctgggacgggtgcgatctagactattactgtaatatgggcgattggccatcttgcacatatacgggagtgacccagcacaaccacgcggccttcgtaaatctcctgaacatagagactgactacatgaagacatttcatttccactccaaacgcgtgaccgcacatggcgatacaccgcagcttgacttgaaggctagacccacttacggggccggagaaatcaccgttctggtcgaggtggctgatatggagctccacacgaaaaaggtggaaattagtggtctgaagtttgtcagcttagcctgtaccggctgctatgcatgttcttccgggatctcatgcaaagttaggattcacgtggacgagcctgatgaactgacagtgcatgtaaagagtagcgacccagatgtcgtggccgcttcgacttcccttatggcgcgtaaattggagttcggaaccgactctacatttaaggcattcagcgccatgcccaaaacttcactctgcttttacatcgttgaacgggagtattgtaagagttgctccgaggaagatacccagaaatgtgtggacacgaagctggagcaacctcagtctatactaattgaacacaagggcacaatcattggtaaacagaatgatacctgcactgctaaggccagctgttggctggagtccgtcaaatcattcttttacgggctcaagaacatgctgggcagcgtgttcggaaactttttcatcggcatacttttgttcctggcaccatttgttttactcgtgctgttctttatgttcgggtggaaaatcctgttttgcttcaagtgttgccgaagaacaaggggacttttgaagtatcgccatctcaaagacgacgaagagaccggctaccggagaattatcgagaggctgaataataagaaaggtaagaaccgcctactggatggggaacgactcgccgaccggaaaattgctgagctgtttagtactaagacccacatcgga

SEQ ID NO: 10646 - RNA, 2916 nt, synthetic construct
  misc_feature 1..2916: note = derived and/or modified CDS sequence (opt3) from CCHFV(Ast199, Artificial)__KX056051.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacagcctcattatcatcggcactttaggtaaaaagattaagcagtatcgggaactgaaaccccagacctgtacaatatgcgagactgcccctgttaacgcaatcgatgccgagatgcatgaccttaattgttcctacaacatttgcccatattgtgcttcacgcttgaccagtgacgggctggcaagacacgtgacacagtgccccaagaggaaagaaaaggtcgaggaaaccgagctatacctcaatctggaacggatcccttggatagtgcgcaaacttctgcaagtaagcgagtctacgggagttgccttgaagcgatgttcctggctcattgtgctgttagtcctgctcactgtgtcacttagcccagtgcagagtgctccggtcggcagaaaacccctgtttttggattctatcgttaagggcatgaagaacctactcaattccacaagcctggagacctcgctgtctatcgaagccccttggggagcgattaacgtgcagtccactttcaaaccaacagtatcaaccgcaaatatcgcccttagttggagctccgtggagcacagggggaacaagattctggtcacgggtcggtctgaaagcataatgaaattggaggaacgtaccggcgtgtcatgggacctcggggttgaggatgctagtgagtccaagctgttaacagtgagcatcatggacctgtctcagatgtactcacccgtctttgaatatctaagtggagatcgccaagtggaggaatggcctaaagccacttgcaccggcgactgtccagagagatgcggttgtacaagctccacttgcctccataaggaatggccccactctaggaattggcggtgcaacccgacctggtgttggggcgtagggacaggatgcacctgttgcggcgttgatgtgaaggacctgttcactgatcatatgtttattaaatggaaggtcgagtacatcaaaacggaggcaatcgtgtgtgtcgaacttacatcgcaggagcgacagtgcagcttgattgaagctgggacccgcttcaacctgggacctgtgactataaccctctccgagcccagaaatatccaacagaagctgccacctgagattatcacacttcaccccaaaattgaagagggtttctttgacctgatgcacgttcagaaggtgttgtcagccagtaccgtatgtaagctccagtcttgcactcatggcatcccaggggatctgcaaatatatcacatcggaaacttactgaaaggcgacaggctaaatggtcatctcattcacaagatcgaaccccatttcaacacaagctggatgtcctgggacgggtgtgatctggactactattgcaatatgggcgattggccttcatgtacgtacaccggagtcactcagcacaaccacgcggcctttgtgaatcttttgaacattgagacagactataccaaaacattccattttcacagcaagcgggttactgcacatggcgataccccacagctggacctcaaagctcgcccgacgtacggggccggagaaatcaccgtgctggtcgaggtggctgatatggagttacacacaaagaaggtagaagtgtctggtctgaaattcgcctcccttgcatgcactggctgctacgcctgtagtagcgggatatcttgcaaggttaggattcacgtcgacgagcccgatgaattgaccgtgcatgtgaaatcctcagaccctgatgtcgttgctgcgagtacaagcctcatggcaagaaagctggagtttggaactgactcgaccttcaaagccttttccgctatgccaaagacgtctctatgtttctatatcgtggaacgtgagtactgcaaaagctgttcagaggatgacacaaagaagtgcgtggacaccaaactggaacagccccaaagtattctcatcgagcacaagggcactataatcggtaaacagaatgatacatgtaccgccaaggcatcctgctggctggaatctgtaaaatcatttttctatgggcttaagaacatgttgggctccgtctttggaaatttcttcgtgggcattctgttatttctcgcccctttcgttctgcttgtgctgtttttcatctttgggtggaagattttgttctgttttaaatgctgtcggcgaactagaggactcttcaagtacaggcatctgaaagacgatgaggaaaccggctatcgcaagatcatagagcggctaaacagcaaaaagggtaagaatagactgctcgacggggagaggctggctgatcgcaaaattgccgaactttttagcacaaagacgcacatcgga

SEQ ID NO: 10647 - RNA, 2916 nt, synthetic construct
  misc_feature 1..2916: note = derived and/or modified CDS sequence (opt3) from CCHFV(Ast149, Artificial)__KX056054.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacagcctcattatcatcggcactttaggtaaaaagattaagcagtatcgggaactgaaaccccagacctgtacaatatgcgagactgcccctgttaacgcaatcgatgccgagatgcatgaccttaattgttcctacaacatttgcccatattgtgcttcacgcttgaccagtgacgggctggcaagacacgtgacacagtgccccaagaggaaagaaaaggtcgaggaaaccgagctatacctcaatctggaacggatcccttggatagtgcgcaaacttctgcaagtaagcgagtctacgggagttgccttgaagcgatcctcatggctcattgtgctgttagtcctgctcactgtgagccttagtccagtgcagtctgctccggtcggcagaaaacccctgtttttggattccatcgttaagggcatgaagaacctactgaatagcacatcgctcgagacctctctgtccatcgaagccccttggggagcgattaacgtgcagtcaactttcaaaccaacagtaagtaccgcaaatatcgcccttagctggtcctctgtggagcacagggggaacaagattctggtcacgggtcggagcgaatcaataatgaaattggaggaacgtaccggcgtgagttgggacctcggggttgaggatgcttccgagagcaagctgttaacagtgtctatcatggacctgtcacagatgtacagtcccgtctttgaatatctaagcggagatcgccaagtggaggaatggcctaaagccacttgtaccggcgactgcccagagagatgtggttgcacatcctctacttgtctccataaggaatggccccactcgaggaattggcggtgcaacccgacctggtgctggggcgtagggacaggatgtacctgctgtggcgttgatgtgaaggacctgttcactgatcatatgtttattaaatggaaggtcgagtacatcaaaacggaggcaatcgtgtgcgtcgaacttacaagccaggagcgacagtgttccttgattgaagctgggacccgcttcaacctgggacctgtgactataaccctctcagagcccagaaatatccaacagaagctgccacctgagattatcacacttcaccccaaaattgaagagggtttctttgacctgatgcacgttcagaaggtgttgagtgcctctaccgtatgcaagctccagagctgtactcatggcatcccaggggatctgcaaatatatcacatcggaaacttactgaaaggcgacaggctaaatggtcatctcattcacaagatcgaaccccatttcaacacatcctggatgtcatgggacgggtgcgatctggactactattgtaatatgggcgattggcctagctgcacgtacaccggagtcactcagcacaaccacgcggcctttgtgaatcttttgaacattgagacagactataccaaaacattccattttcactctaagcgggttactgcacatggcgataccccacagctggacctcaaagctcgcccgacgtacggggccggagaaatcaccgtgctggtcgaggtggctgatatggagttacacacaaagaaggtagaagtgtccggtctgaaattcgccagtcttgcatgtactggctgctacgcctgcagctctgggatatcctgtaaggttaggattcacgtcgacgagcccgatgaattgaccgtgcatgtgaaatcaagtgaccctgatgtcgttgctgcgagcacatcgctcatggcaagaaagctggagtttggaactgactccaccttcaaagccttttctgctatgccaaagacgagcctatgcttctatatcgtggaacgtgagtactgtaaatcatgcagtgaggatgacacaaagaagtgtgtggacaccaaactggaacagccccaatccattctcatcgagcacaagggcactataatcggtaaacagaatgatacatgcaccgccaaggcatcttgttggctggaaagcgtaaaatcctttttctatgggcttaagaacatgttgggctcagtctttggaaatttcttcgtgggcattctgttatttctcgcccctttcgttctgcttgctctgtttttcatctttgggtggaagattttgttctgctttaaatgttgccggcgaactagaggactcttcaagtacaggcatctgaaagacgatgaggaaaccggctatcgcaagatcatagagcggctaaacagcaaaaagggtaagaatagactgctcgacggggagaggctggccgatcgcaaaattgcagaactttttagtacaaagacgcacatcgga

SEQ ID NO: 10648 - RNA, 2916 nt, synthetic construct
  misc_feature 1..2916: note = derived and/or modified CDS sequence (opt3) from CCHFV(Ast137, Artificial)__KX056057.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatccacatatgtagaatgtccaatcatccaaggacaaccatggcgtttctgttctggttttctttcggatacgtgattacgtgcatcttttgcaaggctctgttctatagcctcattatcatcggcactttaggtaaaaagattaagcagtaccgggaactgaaaccccagacctgtacaatatgcgagactgcccctgttaacgcaatcgatgccgagatgcacgaccttaattgttcctataacatttgcccatactgtgcttcacgcttgaccagtgacgggctggcaagacacgtgacacagtgccccaagaggaaagaaaaggtcgaggaaaccgagctatatctcaatctggaacggatcccttggatagtgcgcaaacttctgcaagtaagcgagtctacgggagttgccttgaagcgatcctcatggctcattgtgctgttagtcctgctcactgtgagccttagtccagtgcagtctgctccggtcggcagaaaacccctgtttttggattccatcgttaagggcacaaagaacctactgaatagcacctcgctcgagacttctctgtccatcgaagccccttggggagcgattaacgtgcagtcaacattcaaaccaaccgtaagtacggcaaatatcgcccttagctggtcctctgtggagcatagggggaacaagattctggtcaccggtcggagcgaatcaataatgaaattggaggaacgtacaggcgtgagttgggacctcggggttgaggatgcttccgagagcaagctgttaactgtgtctatcatggacctgtcacagatgtacagtcccgtctttgaatacctaagcggagatcgccaagtggaggaatggcctaaagccacctgtacaggcgactgcccagagagatgtggttgcacttcctctacctgtctccacaaggaatggccccattcgaggaattggcggtgcaacccgacatggtgctggggcgtagggaccggatgtacttgctgtggcgttgatgtgaaggacctgttcacggatcacatgtttattaaatggaaggtcgagtatatcaaaacagaggcaatcgtgtgcgtcgaacttaccagccaggagcgacagtgttccttgattgaagctgggactcgcttcaacctgggacctgtgaccataacactctcagagcccagaaatatccaacagaagctgccacctgagattatcacccttcaccccaaaattgaagagggtttctttgacctgatgcatgttcagaaggtgttgagtgcctctactgtatgcaagctccagagctgtacacacggcatcccaggggatctgcaaatataccatatcggaaacttactgaaaggcgacaggctaaatggtcacctcattcataagatcgaaccccacttcaacacgtcctggatgtcatgggacgggtgcgatctggactattactgtaatatgggcgattggcctagctgcacctatactggagtcacacagcacaaccatgcggcctttgtgaatcttttgaacattgagaccgactacacaaaaactttccactttcattctaagcgggttaccgcacacggcgatacgccacagctggacctcaaagctcgcccgacctatggggccggagaaatcacagtgctggtcgaggtggctgatatggagttacacactaagaaggtagaagtgtccggtctgaaattcgccagtcttgcatgtaccggctgctacgcctgcagctctgggatatcctgtaaggttaggattcatgtcgacgagcccgatgaattgacagtgcacgtgaaatcaagtgaccctgatgtcgttgctgcgagcacttcgctcatggcaagaaagctggagtttggaaccgactccacgttcaaagccttttctgctatgccaaagacaagcctatgcttctacatcgtggaacgtgagtattgtaaatcatgcagtgaggatgacaccaagaagtgtgtggacactaaactggaacagccccaatccattctcatcgagcataagggcacaataatcggtaaacagaatgatacctgcactgccaaggcatcttgttggctggaaagcgtaaaatcctttttctacgggcttaagaacatgttgggctcagtctttggaaatttcttcgtgggcattctgttatttctcgcccctttcgttctgcttgtgctgtttttcatctttgggtggaagattttgttctgctttaaatgttgccggcgaaccagaggactcttcaagtataggcacctgaaagacgatgaggaaacaggctaccgcaagatcatagagcggctaaacagcaaaaagggtaagaatagactgctcgacggggagaggctggctgatcgcaaaattgccgaactttttagtacgaagacccatatcgga

SEQ ID NO: 10649 - RNA, 2916 nt, synthetic construct
  misc_feature 1..2916: note = derived and/or modified CDS sequence (opt3) from CCHFV(Ast133, Artificial)__KX056060.1__Gn-4aa-Gc
  source 1..2916: mol_type = other RNA
agcgaggaacccgacgatgactgcatctccagaacccagctgctcaagacagagactgccgaaattcacgatgacaactacggcgggcctggagataaaataacgatctgtaatggttctaccattgtggaccaaaggcttggctcagagctggggtgctatacaatcaaccgggtcaagagtttcaaattgtgtgaaaatagcgctactggaaagacctgcgagattgattccacaccagttaaatgtcgccagggcttttgcttaaagatcacccaggagggtcgagggcatgtgaagctgtctcgtggatcggaagtagtgctagacgcatgtgattcaagctgcgagataatgatcccgaaaggcactggcgacattctcgtcgattgtagtgggggacagcaacacttcctgaaggacaaccttatcgatctgggttgcccccatattcctttgctcggcaaaatggccatctacatatgtagaatgtccaatcacccaaggacaaccatggcgtttctgttctggttttctttcgggtatgtgattacgtgcatcttttgcaaggctctgttctacctcttaattatcatcggaactctgggcaaaaagattaagcagtatcgggaacttaaaccccagacctgtacaatatgcgagactgcccctgttaacgcaatcgacgccgagatgcatgacttgaattgtagctacaacatttgcccatattgtgcttcccgcctgacctcagatggtctagcaagacacgtgacacagtgccccaagaggaaagaaaaggtcgaggaaaccgagctctacctgaatcttgaacggatcccttggatagtgcgcaaactgttgcaagtaagtgagagcacgggggttgccctcaagcgatcttcctggctgattgtgttactggtcctccttactgtgtcactgagcccagtgcagagtgctccggtcggaagaaaacccttgttttctgactccatcgttaagggcatgaagaacctactgaatagcacatcgctcgagacctctctgtccatcgaagccccttggggcgcgattaacgtgcagtcaactttcaaaccaacagtaagtaccgcaaatatcgcccttagctggtcctctgtggagcacagggggaacaagattctggtcacgggacggagcgaatcaataatgaaattggaggaacgtaccggtgtgagttgggatctcggcgttgaggacgcttccgagagcaagctgttaacagtgtctatcatggatctgtcacagatgtacagtcccgtctttgaatatctaagcggggaccgccaagtggaggaatggcctaaagccacttgtaccggagattgcccagagagatgtggctgcacatcctctacttgtctccataaggaatggccccactcgaggaattggcggtgcaacccgacctggtgctggggtgtagggacaggctgtacctgctgtggagttgacgtgaaggatctgttcactgaccatatgtttattaaatggaaggtcgagtacatcaaaacggaggcaatcgtgtgcgtcgaacttacaagccaggagcgacagtgttccttgattgaagctggcacccgcttcaacctggggcctgtgactataaccctctcagagcccagaaatatccaacagaagctgccacctgagattatcacacttcaccccaaaattgaagagggattctttgatctgatgcacgttcagaaggtgttgagtgcctctaccgtatgcaagctccagagctgtactcatggtatcccaggcgacctgcaaatatatcacatcgggaacttactgaaaggagacagggtcaatggccatctaattcacaagatcgaaccccatttcaacacatcctggatgtcatgggatggttgcgacctcgattactattgtaatatgggggactggcctagctgcacgtacaccggcgtgactcagcacaaccacgcggcctttgttaatctgcttaacattgagacagattataccaaaacattccattttcactctaagcgggtgactgcacatggagacaccccacagttggatctgaaagctcgcccgacgtacggcgccggggaaatcaccgtcctcgtggaggtagctgacatggagctgcacacaaagaaggtggaaatatccggattaaaattcgccagtctgacttgtaccggttgctacgcatgcagctctggcatttcctgtaaggttagaatccacgtcgatgagcccgacgaacttacagtgcatgtgaaatcaagtgatcctgacgtcgttgccgctagcacttcgttgatggcgaggaagctcgagtttgggaccgattccacgttcaaagcattttctgccatgccaaagacaagcctgtgcttctatattgtggaacgtgagtactgtaaatcatgcagtgaggacgacaccaagaagtgtgtggatactaaactagaacagccccaatccatcctgatagagcacaagggaacaatcattggcaaacagaatgatacctgcactgctaaggcctcttgttggctcgaaagcgtaaaatcctttttctatggtctgaagaacatgcttgggtcagtctttggcagcttcttcgtgggaatcttgctgtttttagcacctttcgttctcctggtgctgtttttcatgtttggctggaagattcttttctgctttaaatgttgccggcgaaccagagggttgttcaagtacaggcatctcaaagacgacgaggaaacaggatatcgccggatcatagagagactgaatagtaagaaaggcaagaacaggctactggatggtgagcgcctcgccgaccgaaagattgctgaactgttttcttccaaaacgcacatcggg

SEQ ID NO: 10650 - RNA, 2916 nt, synthetic construct
  misc_feature 1..2916: note = derived and/or modified CDS sequence (opt3) from CCHFV(SK/2015/human, Artificial)__KX458183.1__Gn-4aa-Gc
  source 1..2916: mol_type = other RNA
agcgaggaatccggcgacgattgcatctctagaaccaggctgctccggacagagactgccgaaattcacggggactcatacggaggtcccggcgataagataacgatctgtaacgggagtaccattgtggaccagcgccttggaagcgagatgggctgctatacaatcaatcgagtcaaatccttcaagctgtgtgaaaactctgctactggtaaatcgtgcgagattgattcaatccctgttcgttgtagacaagggtactgcttgaagataacccaggagggaaggggccatgtgaaattaagccggggcagtgaagtagtgctggacgcatgtgattcctcttgcgaggtcatgatcccaaaggggacaggagacattctagtggattgtagcggtggccagcagcactttctcaaggacaatctgatcgatcttgggtgcccgaacattcccctgttgggaaaaatggccatctatatatgtcgcatgtccaatcatcctaagaccactatggcgttcctcttttggttctcatttggctacgttattacatgcatcctgtgcaaagctattttctatctgctcatcatcgtgggtaccttagggaagagatttaaacaatacagggaactgaagccacagacgtgtactatttgcgagaccacacccgccaacgcaatagacgccgagatgcacgatcttaattgtagttatactatctgcccttactgtgctagccggttgacctctgacggactggcacgccatgtcacacagtgcccaaagcgaaaagaaaaggtggaggaaaccgagctatacctcaacctggaaaggattccctgggtagttagaaaacttctgcaagtgtccgagtcaacgggcgtcgccttgaagcggagcagttggctcatcgtgctgttagtgctgttcactgtctctctctcccctgttcagagcgctccaataggccgtcgcccgctttttctggactcgattgtgagagggatgaaaaatttgctaaactctacatccctggagacctcactcagtatcgaagccccctggggagcgatcaatgtacagagcacttataagcctacagtgtccaccgcaaacattgccctgtcttggagctcagtcgagcacaggggtaataaaatccttgtgagtggccggtccgaaagcattatgaagctggaggaacgaacgggggtttcttgggatttgggagtggaggacgcttcagagagtaagctcctgaccgtcagcgtgatggatttatcccagatgtactctccagtattcgaatatctgtcgggcgaccgccaggttgaggaatggcccaaagccacatgtactggtgattgccctgagagatgtgggtgcaccacaagcacttgtctacacaaggaatggccacattccaggaactggcggtgcaatcccacctggtgctggggcgtgggaacaggctgtacctgctgtgggctcgacgtcaaagatctgtttactgactacatgttcgtgaagtggaaagtcgagtatataaagacggaggcaatcgtgtgcgttgaacttacatcacaaggacgccagtgtagtttgattgaggctggtaccagatttaacctgggctctgtgactatcaccctcagcgaaccgaggaacatccagcacaagctgcctcccgagattataacacttcatccacgtatcgaggaagggttcttcgatctgatgcacgtacaaaaagtcttgtccgcctcaaccgtgtgcaagctccagagctgtactcacggagttcctggcgacttacaggtgtaccatattggtaatctgctgaaaggggataaggtcaacggccacctaatccataaaattgagccccactttaatacatcttggatgtcctgggacggatgcgacctcgattattactgtaacatgggcgactggccaagttgcacgtacaccggggtgactcagcataatcacgcgagcttcgtaaacctgcttaatatcgaaacagattataccaagaactttcacttccattctaagcgggtgacagcccacggagacactccccaattggatctgaaagcacgacctacctacggtgctggcgagataacggttctcgtcgaagtggccgacatggagctgcataccaagaaaatcgagatttccgggttaaagtttgcttcactgacatgtactggatgctatgcctgcagtagcggcatctcgtgtaaagtgaggattcacgtcgatgaaccagacgagcttaccgttcacgtgaagtccgatgacccggatgtggtagcagcctctagctcattgatggctagaaagctcgagttcggtacagacagtacttttaaagcgttctccgcaatgcccaagacctctctgtgcttttacatcgtcgaacgcgaatattgtaaaagctgctccaaggaggatacgcagaaatgtgtgaatacaaagctagagcagcctcagtcaatactgattgaacatcgggggaccatcattggcaaacaaaacaatacttgcatcgccaaggctagctgttggctcgagagtgttaagtctttcttttacggactgaaaaacatgctttccggcatattcgggaatttgtttctgggaatcttcttattcctcgccccatttattctgcttatcctgttctttatgttcggctggagaattttgttttgcttcaagtgttgcaggcgcacacgaggtctctttaaatatcggcacctgaaggacgacgaagagaccgggtaccgtagaatcatagaaaggctaaacaataaaaagggaaagaacaaactgctcgatggcgagcgcctggcagaccggagaattgccgagcttttcagcactaagacccatatcggt

SEQ ID NO: 10651 - RNA, 2916 nt, synthetic construct
  misc_feature 1..2916: note = derived and/or modified CDS sequence (opt3) from CCHFV(YL16070, Artificial)__KY354081.1__Gn-4aa-Gc
  source 1..2916: mol_type = other RNA
gccgagggcgggagctccgactgcatctctagaacccagctggtgaagacagaagtcgctgagattcacgaagattcatacggaggtcccggcgagaaaataactatctgtaacgggagtacgattgttgaccaaaggctcggaagcgaacttggctgctataccatcaatcgggtgaagtcctacaaactgtgtgagaactctgcatcgggtaagtcatgcgagattgatagcatccctgtaaaatgtaagcaggggttctgcttgaagataacacaggaaggacgcggccatgtgaaattaagtcgaggcactgagatcgtcctggacgtgtgtgattcctcttgcgaactaatgattccaaaggggaccggagacatcctcgttgattgtagcggtggccagcaacactttctgcagaataaccttattgacctggggtgcccgaatgtgcccttgctcggaaaaatggccatctatgtctgtcgtatgtccaaccatcctaagacaaccatggcgttcctgttttggttctcatttggctacgtgataacttgcattgtatgcagagttctgttctatctcttaatcgctattggtacagtggggaaaaagctgaagcagtacagggagcttaaaccacagacctgtatcgtctgcgagagtgtgcccgtgaatgccatcgatgcagaaatgcacgagttgaactgtagctataatatttgcccttactgtgcctctcggctgtccacggacggactaatacgccatgtcactcaatgcccaaagagaagggaaaaagttgaggaaaccgagctctttctgaaccttgagcggatcccctggctggtgcgcaagttgctccaggtatcagaaagcacaggcatggctctgaaacgaagttgttggatgattactttactgatcctccttctggtgtctatgtcccctgtccagagcgcaccagtgggcagaaagccgttgttcctagattcgatagccaaagggatgaagtctctgctcaattccacctcactggagacaagtcttagcattgaagctccctggggagccatcaacgttcagtccacctttaagcctacggtgtctgcggcaaatatcgccctgagctggtcaagtgtcgagcacaggggtaacaaaattttggtgtccggccggagcgaatctatcatgaagctcgaggagcgtactggggtatcatggaatctgggagttgaagacgctagtgagagcaaaacattaaccgtgtccgtcatggatctgtctcaaatgtactcgccagtgttcgaatatctaagcggcgaccgccaggtcgaggaatggcccaaggccacttgcacaggtgactgtcctgagagatgcgggtgtacctcctcaacgtgcctccacaaagagtggccacatagtaggaactggcggtgcaaccccacctggtgttggggcgtgggaacaggctgcacttgttgcgggctggatgttaaggactttttcaccgattacatgcttgtgaagtggaaagtagaatatattaagacagaggcaatagtctgtgtggaattgacttctcaggagcgacaatgcagcctgatcgaggctggaacccgctttaatctcggtccggttacaattaccctgtccgaacctagaaacgtgcagcagaggcttcccccagagatcgtcactctgcaccctaaaatcgaagagggcttcttcgacttgatgcatgtgcagaagattctctcagccagcacggtatgtaaactgcaatcttgcacacacggggtgcccggagattttcaggtttaccacgtcggcaatttactgcggggtgacaaggtgaacgggcattccatacacaagatcgaaccacatttcaataccagttggatgagctgggatggctgtgacctagattatttttgcaacatgggagactggccctcttgtacttacaccggcgtgacacagcacaatcgcgcggccttcattaacatgctcaatatcgagaccgattatactaaaacatttcatttccactccaagagagtcacggcacacggggacacccctcagctggaccttaaagctaggccagcctacggagctggtgaggttactgtgttggtggaagtagccgatctggagctccatacaaagaaactggaagtctcaggcttaaagattgcaagtctgacctgcagcgggtgctacgcctgttcgtccggaatctcttgcaaggtgcgtatacacgttaacgagccggacgaatttacagtgcatgtccggagctcagatcccgacgtggttgctgcgggcagttcccttatggcacgaaaaatcgagttcggtgccgattctacttttaaggctttcagctccatgcctaaagactcattgtgtttttatattgtggagaaggattactgcagcagttgtaccgacgatgacacgcaaaaatgcgtaaataccaagctcgatcacccacagtctatcctgattgaacacaaagggacaatcataggcaagcagaacgacacttgttccaccaagacaagctgctggctaaaatcgttcaagggatttttctatggcctgaaaaatatgctctcagggattttcggaaacgtctttctgggcatccttttgttcctggccccctttgtgttactcattttctttttctttttcggttggagactgctgttttgtcttaagtgctgtaaaaagactaaggggttgctcaaatacaagcatctgaaagataaggaggaagcaggatataaaaagatcatagagaggctaaatggcaagaaaggtaagtctcagctgttcgacggcgaacgcctcgccaaccggaaaatcgctgagctgtttagtaccaagattcacatcggg

SEQ ID NO: 10652 - RNA, 2916 nt, synthetic construct
  misc_feature 1..2916: note = derived and/or modified CDS sequence (opt3) from CCHFV(Oman_812956, Artificial)__KY362518.1__Gn-4aa-Gc
  source 1..2916: mol_type = other RNA
agcgaggaatccggcgaggactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaaatctttcaagttgtgtgaaaattccgctactggtaaatcttgcgagattgacaacacccctgttaagtgtaaacaggggttttgcttaaagatcacacaggaaggacgaggccatgtgaagctgtcgcgtgattcagaggtagtgctagacgcatgtgatagcagttgcgaaataatgatcccaaaaggcaccggggacattctcgtcgattgttccggaggtcagcaacacttcctgaaggacaatcttatcgatctgggctgcccgaacattcccttgctcgggaaaatggccatctacatatgtagaatgtctaatcatcctaagactacaatggcgtttctgttctggtttagcttcggatatgtgattacctgcatcctgtgcaaagttatcttttacctcttaattgtggtcggcacgctgggtaagaagttcaaacagtatagggagcttaagccacagacttgtaccatctgcgagacaactcccgtgaacgctattgacgccgaaatgcacgatttgaattgttcctacaacatatgcccttattgtgcatcacggctgaccagtgacgggctagcccgccatgtaatgcagtgcccaaaaagaaaggagaaaatcgaagagacagaactctacctgaatcttgagaggattccctgggttgtgcggaagctgttgcaagtcagcgagtctaccggagtggctctcaaacgctcctcatggctgatcgtgttactggtcctccttacggttagcctgagtcctgtgcagtctgcaccaataggccgaaagccgttgtttttcgactccattgccaagggcatgaaaaacctactgaatagcacttcgctcgaaacatctctgtccatcgaggctccctggggtgccatcaacgtacagtcaacctttaagcctactgtgagtacagcgaatattgcacttagctggtcctctgtcgaacacagaggaaacaaaatcctggtgagcggtaggtcagagagtattatgaagttggaggagcggaccggcatatcctgggatctcggggttgaggacgccagcgaatctaaactgttaacggtgtcagtcatggatctgagtcagatgtacagcccagtgttcgagtatctatccggagaccgtcaagtagaagagtggcccaaggctacctgtacaggcgattgccctgaacgctgtggttgcacttcttcgacctgtctccacaaggagtggccacatagcagaaactggaggtgcaatcccacatggtgctggggcgttgggactggatgtacctgctgtggcctggacgtgaaagatctttttacagactacatgttcgtcaagtggaaagtggagtatatcaagaccgaagccattgtctgcgtggagttgacttcccaggaacggcagtgttcactgatcgaggcagggacgcgattcaacctcggaccggttacaatcaccctgagtgagcctcgcaatattcaacagaaacttcccccagaaatagtgactctgcaccctagaatcgaggaagggtttttcgatttgatgcatgtacagaaggtcctctctgctagcaccgtgtgcaagctgcagtcctgtacacacggcgttcccggggacttacaagtgtaccacattggaaacctgctaaaaggcgataaggtcaatggtcatctcatccacaaagtggagccacattttaacacctcatggatgagctgggacgggtgcgacctggattattactgtaatatgggcgactggccctcttgcacttatacaggagtaacgcagcacaaccatgccgcgttcgtgaatcttttgaacattgaaaccgattacactaagaattttcacttccactccaaaagggttacagcccatggcgacacccctcagctggatctcaaggcacggccaaactacggggctggagagatcacagtcctggtggaggtggccgacatggaattacacactaagaaaatagagatcagtggtctgaagtttgctagccttacctgtacgggctgctatgcctgcagctccgggatttcatgtaaagtccgcatccatgttgatgaaccggacgagttgaccgtgcacgtgaagagtgaagatcccgacattgtagcagccagctcgtccctcatggctagaaaactggagttcggaacagattctacttttaaggcgttcagcgcaatgcctaaaacctcactatgcttttacatcgtcgagagggaatattgtaagagttgctccaaggaggacacacagaaatgtgtgaatgccaagctggaacgtccacaatctatactcattgagcacaaaggcactatcattggtaagcagaacgatacctgcacggctaaagccagctgttggctggaatccgttaagtcattcttttacgggcttaagaatatgttgagcggcatcttcggaaacgtgttcataggcatctttctgttcttagcaccctttattctcctgatccttttctttatgttcgggtggcggattctgttttgcttcaaatgttgccgaagaacaaggggattgtttaagtatcgccatctcaaagacgacgaggagaccggctaccggaagatcatagaaagactgaacaataaaaagggtaagaacaaactactggatggggagaggctcgccgaccgcaagattgctgaactgttcagtactaaaacacacatcgga

SEQ ID NO: 10653 - RNA, 2916 nt, synthetic construct
  misc_feature 1..2916: note = derived and/or modified CDS sequence (opt3) from CCHFV(UCCR4405, Artificial)__KY484029.1__Gn-4aa-Gc
  source 1..2916: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgaggtcatgataccgaaaggcactggggatatcctcgtggactgtagtggaggtcagcaacacttcctgaaggataaccttattgacctgggctgcccccatatccctttgctcgggaaaatggccatttacatctgtagaatgtccaatcacccaaggacaaccatggcgtttctgttctggttttctttcggatatgttataacgtgcatcttttgcaaggctctgttctacagcctcattattatcggcactttaggtaaaaagatcaagcagtatcgggaactgaaaccccagacctgtacaatttgcgagactgcccctgtgaacgcaatagatgccgagatgcatgaccttaagtgttcctacaatatctgcccatattgtgcttcacgcttgaccagtgacgggctggcaagacacgtcacacagtgccccaaaaggaaggaaaaagtggaggaaaccgagctatacctcaacctggaacggattccttggatcgtacgcaaacttctgcaagttagcgagtctacgggagtggccttgaagcgatcctcatggctcatagtcctgttagtgctgctcactgtgagccttagtccagtccagtctgctccggttggcagaaagcccctgtttttggattccacagtgaagggcatgaaaaatctactgaacagcacctcgctcgagacttctctgtccattgaagccccttggggagcgatcaatgtacagtcaacattcaagccaaccgtgagtacggcaaacatcgcccttagctggtcctctgtcgagcacagggggaataaaattctggtgaccggtcggagcgaatcaatcatgaagttggaggaacgtacaggcgttagttgggacctcggggtggaggatgcttccgagagcaaactgttaactgtctctattatggacctgtcacagatgtacagtcccgtgtttgaatatctaagcggagatcgccaagtagaggaatggcctaaggccacctgtacaggcgactgcccagagagatgtggttgcacttcctctacctgtctccataaggaatggccccactcgaggaactggcggtgcaatccgacatggtgctggggcgttgggaccggatgtacttgctgtggcgtggatgtcaaagacctgttcacggatcatatgtttgtgaagtggaaagtcgagtacataaagacagaggcaatcgtgtgcgttgaacttaccagccaggagcgacagtgttccttgattgaagctgggactcgcttcaacctgggacctgtgaccatcacactctcagagcccagaaacatccaacagaaactgccacctgagattataacccttcaccccaagatcgaagagggtttctttgacctgatgcacgtacagaaggtcttgagtgcctctactgtgtgcaaactccagagctgtacacatggcattccaggggatctgcaaatctatcacattggaaatttactgaagggcgacagggttaacggtcatctaatccacaaaatagaaccccatttcaatacgtcctggatgtcatgggacgggtgcgatctcgactactattgtaacatgggcaattggcctagctgcacctacactggagtgacacagcacaaccacgcggcctttgtcaatctgcttaacatcgagaccgattatacaaagactttccattttcactctaaacgggtgaccgcacatggcgacacgccacagttggatctgaaggctcgcccgacctacggggccggagaaattacagtactcgtggaggttgctgacatggagctgcacactaagaaagtcgaaatctccggtttaaagttcgccagtctggtgtgtaccggctgctacgcatgcagctctgggatttcctgtaaagtgagaatccacgtcgatgagcccgacgaacttacagttcatgtgaagtcaagtgatcctgacgtggtagccgctagcacttcgttgatggcgaggaaactcgagtttggaaccgattccatattcaaggcattttctgccatgccaaaaacgagcctgtgcttctatattgtcgaacgtgagtactgtaagtcatgcagtgaggacgatacaaagaaatgtgtggacaccaagctagaacagccccaatccatcctgattgagcacaaaggcactatcataggtaagcagaatgacacatgcaccgctaaagcctcttgttggctcgaaagcgttaagtcctttttctatgggctgaagaacatgcttggctcagtgtttggaaatttcttcgtcggcatcttgctgtttttagcacctttcgtgctcctggttctgtttttcatgtttgggtggaaaattcttttctgctttaagtgttgccggcgaactagaggattgttcaaatacaggcatctcaaggatgacgaggaaaccggctatcgccggatcattgagagactgaacagcaaaaagggtaagaataggctactggatggggagcgcctcgccgaccgaaaaatcgctgaactgtttagtacaaagacgcacatagga

SEQ ID NO: 10654 - RNA, 2916 nt, synthetic construct
  misc_feature 1..2916: note = derived and/or modified CDS sequence (opt3) from CCHFV(UCCR4401, Artificial)__KY484035.1__Gn-4aa-Gc
  source 1..2916: mol_type = other RNA
agcgaggaaccctccgacgattgcatctctagaacccagcttctcaggacagagactgccgaaattcacggcgacaactacgggggacctggtgataagataacgatctgtaatggctcaaccattgtggaccaacggcttgggagtgagctgggatgctatacaatcaaccgcgtccgtagcttcaaattgtgtgaaaattccgctactggcaagaactgcgagattgattctgttccagtgaaatgtcgacagggttactgcttaagaatcacccaggaggggaggggacatgtaaagctgtcgcggggctcagaagtggtcctagacgcatgtgatacaagctgcgagataatgatcccgaaaggcaccggggacattctcgtggattgtagtggaggtcagcaacactttctgaaggacaatcttatcgatctgggctgccccaagattcctttgctcgggaaaatggccatctatatatgtcgcatgtccaaccatccaaagactacaatggcgttcctgttttggttctcttttggatacgttattacctgcatcctgtgcaaagctattttctatctcttaatcatcgtgggcacgctgggtaagagacttaaacagtacagggaattgaagccccagacttgtaccatttgcgagacaactcctgtcaatgccatagacgcagagatgcacgatctgaactgtagctataatatctgcccatactgtgcctcccggctaacctcagacgggctcgctcgccatgtgattcagtgccccaagcgaaaagaaaaggtagaggaaacagagctgtaccttaacctggaaagaatcccttgggttgtgaggaaattgctccaagtcagtgagagcaccggagtggcactgaagcggtcttcctggttaatagtgctgctcgtcctttttacggtttcactgagcccagtgcagagtgccccgattggccgtaaacccttgttcctagactctactgctaagggcatgaaaaatctgctcaactccacaagcctggagacctcgctttctatcgaagccccttggggtgcgatcaatgtacagtccacttataagccaacagtgtcaaccgcaaacattgccctgagttggagctccgtcgagcaccgcggaaataagatcttggtgtctggtagaagcgaatcaattatgaaactcgaggaaaggacgggcataagttgggatctgggggttgaggacgcttccgagagcaagttactgaccgtgtctgtcatggatctatcacagatgtacagtcccgtgtttgaatatctcagcggagaccggcaagtagaggaatggcctaaagccacatgtactggcgattgcccagagcgatgtggttgcacctcctctacatgtctgcacaaggaatggccccattcgcgcaactggagatgcaacccgacttggtgctggggcgttgggaccggatgtacatgctgtggccttgacgtgaaagatttgttcaccgactacatgtttgtcaagtggaaggtggagtatatcaaaactgaggcaattgtctgcgtggaactgacgagccaggagaggcagtgttccctcatcgaagctgggacacggttcaatctgggacctgttaccatcactctttcagagccccgcaacattcaacagaagctgccacctgagataatcaccttgcaccccagaattgaagaggggtttttcgatctcatgcatgtgcagaaagtactgagtgcctctacagtctgcaagttacagagctgtacccacggcgtgccaggggacctgcaagtttaccacatcggaaatctactcaaaggcgataaggtgaacggtcatctgattcacaagatcgaaccccatttcaatacttcctggatgtcatgggacgggtgcgaccttgattattactgtaacatgggcgactggcctagctgcacatacacgggagtcacccagcacaatcatgcgtcttttgtgaacttgctgaatatagagactgattataccaaaaacttccactttcactccaagagggtaacagcccatggcgacacaccacagctcgatctgaaagcacgtccgacttacggggctggagaaatcaccgtgttagttgaggtcgccgacatggagctgcacacgaagaaaattgaaatcagtggtcttaagttcgctagcttggcctgtaccggctgctatgcatgctctagcgggatttcatgtaaggtgcggatccatgtggatgagcccgacgaactcacagtccacgttaaaagtgatgaccctgatgtggtggccgctagctcgtccctgatggcgcgaaagctagagtttggaactgactctaccttcaaagcatttagcgccatgccaaagacatcactgtgcttctacatagtagaaagagagcactgtaaaagttgctccgaggaagatactaagaaatgtgtcaataccaagctcgagcagccccaatctattctgatcgaacataagggcacgattatcggtaaacagaacagcacatgcaccgctaaggcctcctgttggcttgagtcagtgaaatcctttttctatgggttgaagaatatgctgagtggcatatttggaaacgttttcatgggcatctttttattcctcgcacctttcattctgcttatcctgtttttcatgtttgggtggaggattttgttctgctttaaatgttgccgccggactagaggactcttcaagtacaggcacctgaaggacgacgaagagacaggctatcgccgaatcatagagaaactaaataacaagaaaggtaagaacaaactgctcgatggggaacggctggccgaccgtagaattgctgagctgttttctaccaagactcatatcgga

SEQ ID NO: 10655 - RNA, 2916 nt, synthetic construct
  misc_feature 1..2916: note = derived and/or modified CDS sequence (opt3) from CCHFV(UCCR4448, Artificial)__KY484042.1__Gn-4aa-Gc
  source 1..2916: mol_type = other RNA
agcgaggaaacctccgacgattgcatctctagaacacagctgctcaggactgagacggccgaaattcacggcgacaactacgggggacccggtgataagataaccatctgtaatggctcaacaattgtggaccaacggcttgggagtgagctgggatgctatactatcaaccgcgtcaaatcattcaagttgtgtgaaaattccgctaccggcaaatcttgcgagattgattcggttcctgtgaagtgtcgacagggttactgcttacgtatcacacaggaggggagaggacatgtaaaactgtcaaggggcagcgaagtggtcctagacgcatgtgataccagttgcgagataatgatcccaaagggcactggggacattctcgtggattgttccggaggtcagcaacactttctgaaggacaaccttatcgatctgggctgcccgaaaattcccttgctcgggaagatggccatctatatatgtcggatgtctaatcatcctaaaacaaccatggcgttcctgttttggttcagctttggatacgttattacgtgcatcctgtgcaaggctattttctatctcttaatcatcattggcactctgggtaaacgctttaagcagtacagagaacttaagccacagacctgtacaatatgcgagactacccccgtgaacgccatcgacgcagagatgcacgatttgaattgttcctataacatttgcccttactgtgcctcaaggctgacaagtgacgggctagctcggcatgtcacccagtgcccaaaacgcaaggaaaaagtggaggaaacggagctctacctgaatcttgaacgaatcccctgggtagttagaaagctgttgcaagtgagcgagtctactggagtcgcactcaaaaggtcctcatggctgatagtgttactggtgctgttcacaattagccttagtcctgtccagtctgccccaatctcccggaagccgctgtttttggacagcatcgttaaaggcatgaagaacctactcaattcgacctctctcgagacttccctgtcaattgaagctccctggggcgccatcaacgtgcagagtacatataagcctaccgtaagcacggcgaatattgcactttcctggtctagcgtggagcaccgtgggaacaaaatactggtctcaggacgcagtgaatccatcatgaagttggaggagaaaaccggtattagctgggatctcggcgtggaagacgcctctgagtcaaagctgttaacagttagtgtgatggatctgagccagatgtactccccagtcttcgaatatctatctggggacagacaagtggaggaatggcccaaagctacttgtaccggagattgccctgagaggtgtggctgcacatcgagcacttgtctccacaaggaatggccacattcccggaattggcgatgcaaccccacctggtgctggggtgtagggacaggctgtacctgctgtggactggacgttaaggatctttttactgactacatgttcgtgaaatggaaggtcgagtatatcaaaacggaggccatcgtgtgcgtcgaattgacatcacaggagcgccagtgtagtctgattgaagcaggcaccagatttaacctcgggccggtgactataaccctgtctgagcctaggaatatccaacagaaacttcccccagagattatcacactgcaccctcggattgaagagggattcttcgatttgatgcatgttcagaaagtgctcagcgcttccaccgtatgcaagctgcagtcatgtactcacggtgtccccggcgacttacaagtgtaccacatcgggaacctgctaaagggagataaagttaatggccatctcatacacaagatcgaaccacattttaacacaagctggatgtcttgggacggttgcgacctggattattactgtaatatgggggactggccctcctgcacgtacaccggcgtgactcagcacaaccatgccagtttcgtcaatcttttgaacattgagacagattataccaaaaattttcacttccacagcaagcgcgtgacagcgcatggagacactcctcagctggatctcaaagccagaccaacctacggcgcaggggaaatcacggtactggtggaggttgctgacatggagttacacaccaagaagattgaaatctctggactgaaatttgcctcccttacatgtactggttgctatgcttgctcaagtggcataagctgtaaggtcaggattcatgtggatgagccggacgaattgaccgtgcacgtcaaatcggatgaccccgatgttgtggccgcatcctctagcctcatggcccgtaagctggagttcgggacagactcaacttttaaggctttcagtgcgatgcctaagacctccctatgcttttacatcgtggaacgggagcactgtaaatcttgcagcgaggaagatacgaagaagtgtgtaaacacaaaactggagcagccacaatccattctcatcgaacataagggaaccataatcggcaaacagaatagcacttgcacagcaaaggccagctgttggctggagagtgtcaaatctttcttttatggtcttaagaacatgttgtccgggattttcggcaatgtgtttatcggaattttcctgttcttagctccctttatcctcctgatacttttctttatgttcggctggaagattctgttttgcttcaaatgttgccgaagaaccagggggttgtttaagtaccgccacctcaaagacgacgaagagactggatatcggagaatcatcgagaggctgaacaataagaaaggcaagaacaagctactggatggtgaaattctcgccgaccgccgaatcgcagagctgttcagcaccaaaacacatattggg

SEQ ID NO: 10656 - RNA, 2916 nt, synthetic construct
  misc_feature 1..2916: note = derived and/or modified CDS sequence (opt3) from CCHFV(SPU 45/88, Artificial)__KJ682809.1__Gn-4aa-Gc
  source 1..2916: mol_type = other RNA
agcgaggaatcctctgacgattgcctgtcaagaacccagctccttaggacagagaacactgaaatccacagtgacaattacggcgggcccggagataagattacgatatgtaacggtagcaccatcgtggaccaacggctgggctccgagttggggtgctatacaattaatcgcgtcaaatctttcaagttatgtgaaaactcggccactggaaaatcatgcgagatcgatagcacccctgttcgatgtcgtcagggcttttgcctgaagattacacaggagggtagagggcatgtgaaactaagtaggggatccgaagtagtgctcgacgcttgtgattctagctgcgagatcatgataccaaagggcaccggcgacatcctggtcgattgttccgggggacagcaacacttccttaaggacaatctggtggatttgggttgcccgaacattcccctcctgggcaaaatggcaatctacatttgtcggatgtcaaatcatcctaagactacaatggggtttctgttctggtttagtttcggatatgttattacctgcatactctgcaaagtgatcttttacttactgatcgtcgtgggcacgcttggtaagaaattcaagcagtatcgcgaattgaagccacagacttgtaccatttgcgagacaactcccgtaaacgccatcgacgcggagatgcacgatctgaattgtagctacaacatctgcccttattgtgcttctagactaacctccgacgggctcgccaggcatgttatgcagtgcccaaaacggaaggagaaaattgaagaaacagagctgtaccttaatctggaacgcataccctggatcgtgcgaaagttgctccaagtctcagagagcaccggagtggcactgaaaagaagttcttggttagtggtcctgctcgttcttctgacggtgtccttgagccctgtacagtcggccccaattggcaggaagccgctatttctggactctatcgtgaaaggcaagaagaacctccttaattccacttcactggagacaagtctgagcatagaagctccctggggagcaattaacgtccagtccaccttcaaacctactgtgtctgccgctaatatcgccttgagctggtcaagtgttgagcaccgggggaacaagatcctcgtgtccggtcgtagcgaatctattatgaaactggaggaacgcacaggcatctcatgggatttaggggtcgaggacgcgagtgagagcaagctgctaaccgtgtccgtaatggatctctctcagatgtactcgccagtttttgaatatctgagcggagacagacaagtggaggaatggcccaaagcaacgtgtaccggcgattgccctgagaggtgtggttgcacatcctcaacttgtcttcacaaggaatggccacatagtcggaactggcgatgcaatcccacctggtgctggggcgtcgggacaggatgtacttgctgtggcttggacgtgaaggatctgttcaccgactacatgtttgtcaaatggaaggtggattatattaaaacagaggccatagtttgcgtggagctcacctctcaggaacgccagtgtagcctgatcgaggctgggactagattcaaccttggaccggtaacgattacactgtccgaacctaggaatatccaacagaagttgcccccagagatcgtcaccctccaccctcggattgaggaaggtttctttgacctgatgcatgtgcagaacgttttatcagccagcactgtgtgcaaactgcagtcttgtacccacggcgtccccggggatctacaaatataccacatcggaaatctcctgaagggcgacaaggtgaacggtcatcttattcacaaaatcgagccacatttcaatacatcctggatgagttgggacgggtgcgatttggactattactgtaacatgggcgattggcccagctgctcttataccggagtaactcagcacaatcatgcagcttttgtgaacatgctgaatattgaaacagactacacgaagaacttccactttcactccaaacgcgttaccgcccatggcgatactcctcagctcgacctgaaggcgagaccaacatacggggccggagagatcaccgtcttagtggaagtggcagatatggagctgcacaccaaaaagatagagatctcaggtcttaagttcgctagtttgacttgtaccggctgctatgcctgcagctcggggatttcctgtaaagtcaggatccatgttgacgaaccggatgagctcacggtgcacgtgaagtctgaagaccccgatattgtagctgccagctcaagtctgatggcacgtaaactagagtttggaaccgactccacattcaaggccttttctgctatgcctaaaactagcctgtgcttctacatcgtcgaacgggagtattgtaagtcctgctcaaaagaggatacccagaagtgtgtgaatacaaagctcgaacaaccacagagcatactgattgagcacaaaggcactatcattggtaagcagaacgacacatgcacggcgaaagcaagttgttggcttgaatctgttaagtcctttttctacgggttgaaaaatatgctgagcggcatctttggaaacgtgttcataggcatcttactcttcctggccccctttattatgcttatcctgttctttatgttcgggtggcgaattttgttttgcttcaagtgttgcagaaggacacgcggactctttaagtatcggcatctgaaagacgatgaggaaatcggctacagaaagataattgagaggctaaacaataaaaagggtaaaaacaagctgctcgacggggagcgcctggctgatcgaaagatcgccgaacttttctcgaccaaaactcacatcgga

SEQ ID NO: 10657 - RNA, 2916 nt, synthetic construct
  misc_feature 1..2916: note = derived and/or modified CDS sequence (opt3) from CCHFV(3010, Artificial)__DQ019222.1__Gn-4aa-Gc
  source 1..2916: mol_type = other RNA
gccgagggcgtgagcaacgactgcgtctccagaacccagctgatcaagacagaagttgctgagattcacgaagattcttacgggggacccggtgagaaaataactatctgtaatggctcaacgattgtggaccaaaggctcgggagtgaacttggatgctataccatcaaccgggtaaagacatacaaactgtgtgagaatagcgcaactgagaagggctgcgaaattgattccgtgcctgtcaaatgtaagcagggtttctgcttgaaggtgacccaggaggggcgcggacatgttaaattatctcgaggcacagaaatcgtgctggacgtctgtgatacctcgtgcgagctaatgataccaaagggcactggggacatcctcgtggattgttcaggaggtcagcaacactttctgcaggacaaccttattgatctgggctgcccgaatgtacccttgctcgggaaaatggccatctatatttgtcgtatgagcaaccatcctaagacaaccatggcgttcctgttttggttcagttttggatacgttatcacgtgcatagtgtgcaaagtcctgttctatctcttaattgtgatcggcactctgtccaagaagctcaaacagtacagagagttgaagccacagacctgtattgtgtgcgaatctacacccgtcaatgctatcgacgccgagatgcacgaactgaactgtaattataacatctgcccttactgtgcaagcaggctaacttccgatggtctcgttcggcatgtgaatcaatgcccaaaacgcaaggagaaagtagaagagaccgagctgtaccttaacctggaaaggattccctggttggtgagacggctcctgcaggtctcagagagtacagggatggccttaaagcgcagctgttggatgaccacgctgctcatacttctggtggtttctttgtcccctgtgcagtcagctccagtcggacgaagaccgctatttctggacagcatcgtgaaaggcatgaagaatctcctgaacagtacttctcttgaaacatccctgagcattgaggcaccctggggcgccatcaatgtacagtcgacctataagcctactgtttctacagctaacatagccttgtcctggtcaagtgtggaacacagggggaacaaagtcctcgtgagcggacggtccgagtctattatgaagctggaggaacgtaccggtatcagctgggatttaggcgtcgaggacgcgtcagaaagtaaactgctaacggtgtccgttatggacctcagccaaatgtactctccagtgttcgagtatctgtcaggggatcgccaggtagaagagtggcccaaggcaacctgcacaggagactgtcctgagagatgcggctgtactagcagtacctgccttcacaaagaatggccacattccaggaattggcggtgcaaccccacatggtgttggggtgtcgggactggctgcacctgttgcggattggatgtgaaggacctgtttacagattacatgttcgttaagtggaaagtggagtatatcaagaccgaagccattgtctgtgtggagctcacttctcaggagcgacaatgctcgctgatcgaagctggcacgcgctttaatcttgggagcgtaacaattaccctgtccgagccgagaaacatacagcagaaattgcctcccgaaatcattactctccacccaaagatcgaggaaggattctttgacctgatgcatgtgcagaaagttttatcagccagtaccgtctgtaagctgcaatcttgcacacacggtgtgcctggcgatctacaggtgtaccacatcgggaatctcctgaagggagacagggtcaacggccatcttattcacaaaatagagcagcatttcaataccagctggatgtcctgggatggttgtgacttggattattactgcaacatgggggactggccctcatgtacttacacaggcgttacgcagcacaatcatgctagcttcgtgaacctgctcaatatcgagaccgactatactaagacatttcacttccactctaaacgggtgaccgcacatggagatacaccacaactggacttaaaggcccgccccacttacggcgcgggggaagtaaccgtcctggtggaggttgccgatatggaacttcacacgaaaaagattgagatctccggattgaagtttgcaggtcttacctgcacaggctgctatgcttgtagtagcgggatttcttgcaaagtgagaatccatgtcgacgaacctgatgagctgactgtgcacgttaagtccgacgatccagacgtggtagccgcttcaagtagcctaatggccaggaaactggagttcggaaccgattcgacatttaaggcattctccgccatgccgaaaacttctctctgtttttacatagtcgaacgtgagtattgcaagagctgttcaaaagaagacacccagaagtgcgtgaacacgaagctggagcagccccagagtatccttattgaacacaaaggcacaatcattggtaagcaaaataacacctgtactgctaaagcgtcctgctggttggagtctgtcaagagcttcttttacgggctgaaaaatatgttaggcggaatcttcggcaacgtgtttatagggattttcacatttctcacccctttcatcctgcttattctgttctttatgttcggatggcggatcttgttttgtttcaagtgctgtcgaagaactaggggcctctttaagtatcgccatctgaaagatgacgaggaaaccggttaccggaagataatcgagagactaaacaataaaaaggggaaaaacaggctgctcgatggagaacgcctggcagaccgaaagattgccgagcttttctccacaaagacgcacatcggc

SEQ ID NO: 10658 - RNA, 972 nt, synthetic construct
  misc_feature 1..972: note = derived and/or modified CDS sequence (opt3) from CCHFV(10200)__U39455.2__Gn
  source 1..972: mol_type = other RNA
agcgaggaaccctccgacgattgcgtgtctagaacccagctgctcaggacagagactgccgaaatccacggcgacaactacgggggacctggtgataagattacgatatgtaatggctcaaccatcgtcgaccaacggcttgggagtgagctgggatgctatacaattaaccgcgttcgtagcttcaaattgtgtgaaaattccgctactggcaagaactgcgagatcgattctgtgccagtaaaatgtcgacagggttactgcttaagaattacccaggaggggaggggacatgtgaagctgtcgcggggctcagaagtcgtgctagacgcatgtgatacaagctgcgagatcatgataccgaaaggcaccggggacatcctcgttgattgtagtggaggtcagcaacactttctgaaggacaatcttattgatctgggctgccccaagatccctttgctcgggaaaatggccatttatatctgtcgcatgtccaaccatccaaagactacaatggcgttcctgttttggttctcttttggatacgtgataacctgcattctgtgcaaagctatcttctatctcttaattatcgtcggcacgctgggtagaaggcttaagcagtaccgggaattgaaaccccagacttgtaccatctgcgagacaactcctgtgaatgccattgacgcagagatgcacgatctgaactgtagctataatatatgcccatactgtgcctcccgcctaacctcagacgggctcgctcgacatgtaatccagtgccccaagagaaaggaaaaagttgaggaaacagagctgtaccttaacctggaaaggattccttgggtggtccggaagttgctccaagtgagtgagagcaccggagtggcactgaaacgttcttcctggttaatcgtcctgctcgttctttttacggtgtcactgagcccagtacagagtgccccgataggc

SEQ ID NO: 10659 - RNA, 972 nt, synthetic construct
  misc_feature 1..972: note = derived and/or modified CDS sequence (opt3) from CCHFV(IbAr10200)__AF467768.2__Gn
  source 1..972: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtccgtagcttcaaattgtgtgaaaattccgctactggcaagaactgcgagattgattctgttccagtgaaatgtcgacagggttactgcttaagaatcacccaggaggggaggggacatgtaaagctgtcgcggggctcagaagtggtcctagacgcatgtgatacaagctgcgagataatgatcccgaaaggcaccggggacattctcgtggattgtagtggaggtcagcaacactttctgaaggacaatcttatcgatctgggctgccccaagattcctttgctcgggaaaatggccatctatatatgtcgcatgtccaaccatccaaagactacaatggcgttcctgttttggttctcttttggatacgttattacctgcatcctgtgcaaagctattttctatctcttaatcatcgtgggcacgctgggtaagagacttaaacagtacagggaattgaagccccagacttgtaccatttgcgagacaactcctgtcaatgccatagacgcagagatgcacgatctgaactgtagctataatatctgcccatactgtgcctcccggctaacctcagacgggctcgctcgccatgtgattcagtgccccaagcgaaaagaaaaggtagaggaaacagagctgtaccttaacctggaaagaatcccttgggttgtgaggaaattgctccaagtcagtgagagcaccggagtggcactgaagcggtcttcctggttaatagtgctgctcgtcctttttacggtttcactgagcccagtgcagagtgccccgattggc

SEQ ID NO: 10660 - RNA, 972 nt, synthetic construct
  misc_feature 1..972: note = derived and/or modified CDS sequence (opt3) from CCHFV(Turkey-Kelkit06)__GQ337054.1__Gn
  source 1..972: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtaaaaatagcgctactggcaagacctgcgaagttgactccacaccagtgaaatgtcgacagggtttttgcttaaagattacccaggaggggcgtggacatgtaaagctgtctagaggctcggaggtggtcctagatgcatgtgactcaagctgcgaagtgatgatcccgaaaggcactggggatatactcgttgactgtagtggaggtcagcaacacttcctgaaggataaccttatcgacctgggctgcccccatattcctttgctcgggaggatggccatctacatttgtcggatgtccaatcacccacgcacaaccatggcgtttctgttctggttttctttcggatatgtgatcacgtgcatattttgcaaagctctgttctacagcctcattatcattggcactttaggtaagaaaatcaagcagtatagagagctgaagccccagacctgtacaatctgcgaaactgcccctgtcaacgcaattgatgccgagatgcatgaccttaattgttcctacaacatatgcccatattgtgcttcaaggttgaccagtgacgggctggcacggcacgtgacacagtgccccaaacgcaaggagaaagtagaagagaccgaactatacctcaatctggagcgaatcccttggattgttagaaaacttctgcaagtgagcgaatctacgggagtcgccttgaagaggtcctcatggctcatcgtgctgttagtgctgctcactgtcagccttagtccagttcagtctgctccggtgggc

SEQ ID NO: 10661 - RNA, 972 nt, synthetic construct
  misc_feature 1..972: note = derived and/or modified CDS sequence (opt3) from CCHFV(SR3)__AJ538199.1__Gn
  source 1..972: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgcgtagcttcaaattgtgtgaaaattccgctactggtaagtcttgcgagattgattcgatccctgtaaaatgtaagcaggggtactgcttaaaaattacccaggagggacgaggccatgtgaagctgtcaagaggcagcgaagtcgtgctagacgtttgtgatagttcctgcgaggtgatgatcccaaaggggacaggagacatactcgtcgattgttctggtggccagcaacactttctgaaagacaaccttgtggatctggggtgcccgaagatccccttgctcggaaaaatggcaatttatatctgtaggatgagcaatcatcctaagaccactatggccttcctgttttggttctcctttggctacgtaattacatgcatcctgtgcaaagcgatattctttctcttaattatcttcggtaccctggggaagcggtttaagcagtatcgcgaacttaaaccacagacgtgtactatttgcgagaccacacccgttaacgctatcgacgccgagatgcacgatttgaattgttcatacaacatctgcccttattgtgcaagtagactgactagcgacggactagccaggcatgtgacccagtgcccacggcgcaaggaaaaagtcgaggaaacagagctctacctgaatcttgaacgaataccctgggtggtgagaaagctgttgcaagtctctgagtccaccggcacggttctcaaaaggtcaagctggctgattgtgttactggtactcttcactgtgagtctttctcctgtccagtccgctccaatcggc

SEQ ID NO: 10662 - RNA, 972 nt, synthetic construct
  misc_feature 1..972: note = derived and/or modified CDS sequence (opt3) from CCHFV(UCCR4413)__KY484038.1__Gn
  source 1..972: mol_type = other RNA
agcgagtcctctgcctcaggctgcatcagtagaacccagatgattaagagcgaaacagctgagatacacgacgatatctacgggggacccggtgaaaaactgactatttgtaacggcacgaccgtggtcgaccaaaggctcgggtccgagcttggatgctatacaatcaatcggattaagacttacaaactgtgtgaaaactctgttaaggagaaaacctgcgagatcgattcggtgcctgtaaagtgtcgccagggcttgtgcttaaagataacacaggaaggtcgagggcatgtgaaactgtcacgtggaagcgagatcgtcctagacatttgtgatagttcctgcgaactcatgatcccaaagggcaccggcgacattctggtggattgttctgggggacagcaacacttccttcaggacaatctggttgatttgggttgcccgaacatccccctcctgggcaaagtggcaatatatatttgtagaatgagcaatcatcctaagactacaatggcctttctgttctggttttccttcgggtacgtcattacctgcatcctctgcaaaatcttattttatctgcttatcattacgggaactttgggcaagaagctgaaacagtacagggagctaaagccacagacctgtacaatatgcgagtcaactcccgtgaacgcgatcgacgctgaaatgcacgatctcaattgtagttataacatttgcccttactgtgccagccggctgacctctgacggtcttatccgccatgtaaatctgtgcccaaaaagaaaggagaaagttgaagagacagaattgtacctcaacctggagaggataccctggttcgtgcggaagttactgcaagtctccgagtcaaccggggtggcactcaaacgcagcagttggcttctgattttggtgatcctactgacggtctctatgtcccctgttcagagcgccccaatcaat

SEQ ID NO: 10663 - RNA, 972 nt, synthetic construct
  misc_feature 1..972: note = derived and/or modified CDS sequence (opt3) from CCHFV(66019)__AB069669.1__Gn
  source 1..972: mol_type = other RNA
agcgaggaatccggcgacgattgcatctctagaacccagctgctcaggacagagactgccgaagtgcacggggacaactacggaggtcccggcgataagattacgatatgtaatgggtcaaccatcgtcgaccaacggcttggaagtgagctgggctgctatacaattaaccgcgttaagagcttcaaattgtgtgaaaattccggtactgggaaatcttgcaagatcgataacacccctgtgaaatgtcgacagggattttgcttaaagattacacaggagggccgtggccatgtaaagctgtcgagagggtcagaggtggtcctagacgcttgtgatagcagttgcgaaatcatgataccaaaaggaaccggtgacatcctcgtggattgttccggcgggcagcaacacttcctgaaggacaatcttgttgatctgggatgcccgaacattcccttgctcggcaaaatggcaatctacatttgtaggatgtctaatcatcctaagactacaatggcctttctgttctggtttagcttcggttatgtgataacctgcatcttttgcaaaattatcttctacctgctcattgtcgtggggacgttaggaaagaagtttaaacagtatcgggagctgaagccacagacttgtaccatctgcgaaacaactcccaccaacgcgatcgacgctgagatgcacgatcttaaatgttcctacaatatttgcccttattgtgcctcacgcttgacaagtgacggcctggcaagacatgtaacccagtgcccaaagaggaaagagaaggttgaagagacggaactatacctcaacctggagcggataccctggatcgtgcgcaaacttctgcaagtcagcgaatctactggcgtggccttgaagcgatcctcatggctcattgtgctgttagtcctgctcacagttagccttagtcctgtgcagtctgctccaatcggg

SEQ ID NO: 10664 - RNA, 972 nt, synthetic construct
  misc_feature 1..972: note = derived and/or modified CDS sequence (opt3) from CCHFV(7001)__AB069670.1__Gn
  source 1..972: mol_type = other RNA
gccgagggcgggagctccgactgcatctctagaacccagctggtgaagacagaagtcgctgagattcacgaagattcatacggaggtcccggcgagaaaataactatctgtaacgggagtacgattgttgaccaaaggctcggaagcgaacttggctgctataccatcaatcgggtgcgctcctacaagctgtgtgagaactctgcatcgggtaaatcatgcgagattgatagcatccctgtaaagtgtaaacaggggttctgcttgaagataacacaggaaggacgaggccatgtgaagttaagtcgtggcactgagatcgtcctggacgtgtgtgattcctcttgcgaactaatgattccaaaagggaccggagacatcctcgttgattgtagcggtggccagcaacactttctgcagaataaccttattgacctggggtgcccgaatgtgcccttgctcggaaagatggccatctatgtctgtagaatgtccaaccatcctaaaacaaccatggcgttcctgttttggttctcatttggctacgtgataacttgcattgcttgcagggtactgttctatctcttaatcgccattggtacagttgggaagaaactgaagcagtaccgggagcttaagccacagacctgtatcgtgtgcgagagtgtccccgtgaatgcaatcgatgccgaaatgcacgagttgaactgtagctataatatttgcccttactgtgcttctcgcctgtccacggacggactaataagacatgtgactcaatgcccaaaaaggcgggaaaaggtcgaggaaaccgagctctttctgaaccttgagcgcatcccctggctggttcgaaaattgctccaggtgtcagaaagcacaggcatggcactgaagagaagttgttggatgattactttactgatcctccttctggtatctatatcccctgtgcagagcgccccagtcggc

SEQ ID NO: 10665 - RNA, 972 nt, synthetic construct
  misc_feature 1..972: note = derived and/or modified CDS sequence (opt3) from CCHFV(75024)__AB069671.1__Gn
  source 1..972: mol_type = other RNA
agcgaggaatccggcgacgattgcatctctagaacccagctgctcaggacagagactgccgaaattcacggggacaactacggaggtcccggcgataagataacgatctgtaatgggtcaaccattgtggaccaacggcttggaagtgagatgggctgctatacaatcaaccgcgtcaagagcttcaagctgtgtgaaaattccgctactggtaaatcttgcgagattgattcgatccctgttaagtgtcgacaggggtactgcttgaaaataacccaggagggacgtggccatgtgaagttatcaagaggcagcgaagtagtgctggacgcatgtgatagttcctgcgaggtcatgatcccaaaggggacaggagacattctagtggattgttctggtggccagcaacactttctcaaagacaacctgatcgatcttgggtgcccgagcattcccctgttgggaaagatggccatctatatatgtaggatgtccaatcatcctaaaaccactatggcgttcctcttttggttctcatttggctacgttattacatgcatcctgtgcaaggctattttctatctgctcatcatcgtgggtaccttagggaaacggtttaagcagtaccgcgaactgaagccacagacgtgtactatttgcgagaccacacccgccaacgcaatagacgccgagatgcacgatcttaattgtagttataacatctgcccttactgtgctagcagattgacttctgacggactggcaaggcatgtcacccagtgcccaaaacggaaggaaaaagtggaggaaacagagctatacctcaatctggaacgcattccctgggtagttcgaaaacttctgcaagtgtccgagtcaaccggcgtcgccttgaaaagaagcagttggctcatcgtgctgttagtgctgttcgctatatctctctcccctgtccagagcgccccaattggc

SEQ ID NO: 10666 - RNA, 972 nt, synthetic construct
  misc_feature 1..972: note = derived and/or modified CDS sequence (opt3) from CCHFV(7803)__AB069672.1__Gn
  source 1..972: mol_type = other RNA
agcgaggaatccggcgacgattgcatctctagaacccagctgctcaggacagagactgccgaaattcacggggacaactacggaggtcccggcgataagataacgatctgtaatgggtcaaccattgtggaccaacggcttggaagtgagatgggctgctatacaatcaaccgcgtcaagagcttcaagctgtgtgaaaattccgctactggtaaatcttgcgagattgattcgatccctgttaagtgtcgacaggggtactgcttgaaaataacccaggagggacgtggccatgtgaagttatcaagaggcagcgaagtaatcctggacgcatgtgatagttcctgcgaggtgatgattccaaaggggacaggagacatcctagtcgattgttctggtggccagcaacactttctcaaagacaacctgattgatcttgggtgcccgagcatccccctgttgggaaagatggccatatatatttgtaggatgtccaatcatcctaaaaccactatggcgttcctcttttggttctcatttggctacgtgatcacatgcattctgtgcaaggctatcttctatctgctcatcattgttggtaccttagggaaacggtttaagcagtaccgcgaactgaagccacagacgtgtactatatgcgagaccacacccgccaacgcaatcgacgccgagatgcacgatcttaattgtagttataacatttgcccttactgtgctagcagattgacttctgacggactggcaaggcatgtgacccagtgcccaaaacggaaggaaaaagtcgaggaaacagagctatacctcaatctggaacgcatcccctgggtggtacgaaaacttctgcaagtttccgagtcaaccggcgtggccttgaaaagaagcagttggctcatagtcctgttagtgctgttcgctatttctctctcccctgtgcagagcgccccaatctcg

SEQ ID NO: 10667 - RNA, 972 nt, synthetic construct
  misc_feature 1..972: note = derived and/or modified CDS sequence (opt3) from CCHFV(79121)__AB069673.1__Gn
  source 1..972: mol_type = other RNA
gccgagggcgggagctccgactgcatctctagaacccagctggtgaagacagaagtcgctgagattcacgaagattcatacggaggtcccggcgagaaaataactatctgtaacgggagtacgattgttgaccaaggactcggcagcgaacttggttgctataccatcaatagggtgcggtcctacaagctgtgtgagaactctgcatcggggaaatcatgcgagattgatagcatccctgtaaagtgtaaacagggattctgcttgaagataacacaggaaggccgcggccatgtgaagttaagtcgagggactgagatcgtcctggacgtgtgtgattcctcttgcgaactaatgattccaaaaggaaccggtgacatcctcgttgattgtagcggcgggcagcaacactttctgcagaataaccttattgacctgggatgcccgaatgtgcccttgctcggcaagatggccatctatgtctgtcgtatgtccaaccatcctaaaacaaccatggcgttcctgttttggttctcatttggttacgtgataacttgcattgcttgcagagtactgttctatctcttaatcgccattgggacagttggaaagaaactgaagcagtacagggagcttaagccacagacctgtatcgtgtgcgagagtgtccccgtgaatgcaatcgatgccgaaatgcacgagttgaactgtagctataatatttgcccttactgtgcttctcggctgtccacggacggcctaatacgccatgtgactcaatgcccaaaaagaagggaaaaggtcgaggaaaccgagctctttctgaaccttgagcggatcccctggctggttcgcaaattgctccaggtgtcagaaagcacaggcatggcactgaagcgaagttgttggatgattactttactgatcctccttctggtatctatatcccctgtgcagagcgccccagtcggg

SEQ ID NO: 10668 - RNA, 972 nt, synthetic construct
  misc_feature 1..972: note = derived and/or modified CDS sequence (opt3) from CCHFV(8402)__AB069674.1__Gn
  source 1..972: mol_type = other RNA
agcgaggaatccggcgacgattgcatctctagaacccagctgctcaggacagagactgccgaaattcacaacgacaattacgggggacccggtgataagataacgatctgtaacggctcaaccgtggtcgaccaacggcttgggagtgagctgggatgctatacaattaatcgcgttaagagcttcaaattgtgtgaaaactccgctactggcaaatcttgcgagatcgattcgacccctgtgaagtgtcgacagggtttttgcttaaaaattacacaggaggggcgtggacatgtaaagctgtcaagaggcagcgaagtggtcctagacgcatgtgatagttcctgcgagatcatgataccaaagggcaccggggacatcctcgtggattgttctggaggtcagcaacacttcctgaaagacaatcttattgatctgggctgcccgaacatccccttgctcgggaagatggccatttacatctgtaggatgagcaatcatcctaaaactacaatggcgtttctgttctggttttccttcggatatgttgtgacctgcatactgtgcaaggtcatcttttacctcttaattgtggtaggcacgctgggtaaaaagttcaagcagtatcgggaacttaaaccacagacttgtaccatttgcgagacaactcccgttaacgctatcgacgccgagatgcacgatttgaattgttcatacaacatctgcccttattgtgcaagtcgcctgaccagcgacgggctagccagacatgtgatgcagtgcccaaagaggaaagaaaagattgaggaaacagagctctacctgaatcttgaacggataccctgggtcgtgcgcaaactgttgcaagtgtctgagtccaccggagtcgctctcaagcgatcaagctggctggttgtgttactggtactccttacggtgagtctgtctcctgtccagtccgcaccaatcggc

SEQ ID NO: 10669 - RNA, 972 nt, synthetic construct
  misc_feature 1..972: note = derived and/or modified CDS sequence (opt3) from CCHFV(88166)__AB069675.1__Gn
  source 1..972: mol_type = other RNA
agcgaggaatccggcgacgattgcatctctagaacccagctgctcaggacagagactgccgaaattcactcagacaactacgggggacccggtgataagataacgatctgtaatggcagtaccgtggtcgaccaacggcttgggagcgagctgggatgctatacaattaaccgcgttaaatccttcaagttgtgtgaaaattctgctactggcaaatcgtgcgagatcgattcaacccctgtgaagtgtcgacagggtttttgcttaaaaattacacaggaggggcgtggacatgtaaagctgagcagaggcagtgaagtggtcctagacgcatgtgattcctcttgcgagatcatgataccaaagggcaccggggacatcctcgtggattgtagcggaggtcagcaacacttcctgaaagacaaccttattgatctgggctgcccgaatatccccttgctcgggaagatggccatttacatctgtaggatgtccaaccatcctaaaactacaatgggatttctgttctggttttcattcggctatgttgtgacctgcatactgtgcaaggtcatcttttacctcttaattgtggtaggtacgctggggaaaaagttcaagcagtatcgggaacttaaaccacagacttgtaccatttgcgagacaactcccgttaatgcgatcgacgctgagatgcacgatttgaactgtagttacaatatctgcccttattgtgccagccgcctgacctctgacggactagcaagacatgtgatgcagtgcccaaagaggaaagaaaagattgaggaaacagagctctacctgaaccttgaacggataccctgggtcgtgcgcaaactgttgcaagtgtccgagtcaaccggcgtcgccctcaagcgaagcagttggctggttgtgttactggtactccttacggtgtctctgtcccctgtccagagcgctccaatcggc

SEQ ID NO: 10670 - RNA, 972 nt, synthetic construct
  misc_feature 1..972: note = derived and/or modified CDS sequence (opt3) from CCHFV(BA88166)__AF338470.1__Gn
  source 1..972: mol_type = other RNA
agcgaggaatccggcgacgattgcatctctagaacccagctgctcaggacagagactgccgaaattcactcagacaactacgggggacccggtgataagataacgatctgtaatggcagtaccgtggtcgaccaacggcttgggagcgagctgggatgctatacaattaaccgcgttaaatccttcaagttgtgtgaaaattctgctactggcaaatcgtgcgagatcgattcaacccctgtgaagtgtcgacagggtttttgcttaaaaattacacaggaggggcgtggacatgtaaagctgagcagaggcagtgaagtggtcctagacgcatgtgattcctcttgcgagatcatgataccaaagggcaccggggacatcctcgtggattgtagcggaggtcagcaacacttcctgaaagacaaccttattgatctgggctgcccgaatatccccttgctcgggaagatggccatttacatctgtaggatgtccaaccatcctaaaactacaatgggatttctgttctggttttcattcggctatgttgtgacctgcatactgtgcaagggtatcttttacctcttaattgtcgtggggacgctgggcaaaaagttcaagcagtatcgggaacttaaaccacagacttgtaccatttgcgagacaactcccgtaaatgcgatcgacgctgagatgcacgatttgaactgtagttacaatatctgcccttattgtgccagccgcctgacctctgacggactagcaagacatgttatgcagtgcccaaagaggaaagaaaagattgaggaaacagagctctacctgaaccttgaacggataccctgggtggtccgcaaactgttgcaagtgtccgagtcaaccggcgtggccctcaagcgaagcagttggctggtcgttttactggtgctccttacggtatctctgtcccctgtgcagagcgctccaatcggg

SEQ ID NO: 10671 - RNA, 972 nt, synthetic construct
  misc_feature 1..972: note = derived and/or modified CDS sequence (opt3) from CCHFV(BA66019)__AF350448.1__Gn
  source 1..972: mol_type = other RNA
agcgaggaatccggcgacgattgcatctctagaacccagctgctcaggacagagactgccgaagtgcacggggacaactacggaggtcccggcgataagattacgatatgtaatgggtcaaccatcgtcgaccaacggcttggaagtgagctgggctgctatacaattaaccgcgttaagagcttcaagttgtgtgaaaattccggtactgggaaatcttgcaagatcgataaacatcctgtgaagtgtcgacagggattttgcttaaagattacccaggagggccgtggccacgtaaaactgtcgagagggtcagaggtggtcctagacgcttgtgatagcagttgcgaaatcatgataccaaagggaacaggtgacatcctcgtggattgttccggcgggcagcaacatttcctgaaagacaaccttgttgatctgggatgcccgaatattcccttgctcggcaagatggcaatctacatttgtaggatgtctaaccaccctaaaaccactatggcctttctgttctggtttagcttcggttatgtgatcacatgcatattttgcaagattatcttctacctgctcattgtcgtggggaccttaggaaagaaatttaagcagtatcgggagctgaaaccacagacgtgtactatctgcgaaaccacacccactaatgcgatcgacgctgagatgcatgatcttaagtgttcctacaacatttgcccttattgtgcctcacgcttgaccagtgacggcctggcaagacacgtaacacagtgcccaaaaaggaaggagaaagttgaagagaccgaactatacctcaatctggagcggataccctggatcgtgcgcaaacttctgcaagtcagcgaatctacgggcgtggccttgaagcgatcctcatggctcattgtgctgttagtcctgctcactgttagccttagtcctgtgcagtctgctccaatcggg

SEQ ID NO: 10672 - RNA, 972 nt, synthetic construct
  misc_feature 1..972: note = derived and/or modified CDS sequence (opt3) from CCHFV(BA8402)__AF350449.1__Gn
  source 1..972: mol_type = other RNA
agcgaggaatccggcgacgattgcatctctagaacccagctgctcaggacagagactgccgaaattcacaacgacaattacgggggacccggtgataagataacgatctgtaacggctcaaccgtggtcgaccaacggcttgggagtgagctgggatgctatacaattaatcgcgttaacagcttcaatttgtgtgaaaacactgctaccggcaaatcctgcgagatcgattctacacctgtgaagtgtcgacagggtttttgcttaaaaattacccaggaggggcgtggacatgtaaagctgtcgagaggctcagaagtggtcctagacgcatgtgagagcagttgcgaaatcatgataccaaaaggcactggggatatcctcgtggactgttccggaggtcagcaacacttcctgaaggataatcttattgacctgggctgcccgaacatccccttgctcgggaagatggccatttacatctgtaggatgtctaatcatcctaaaacaaccatggcgtttctgttctggtttagcttcggatatgttgtgacgtgcatactgtgcaaggtcatcttttacctcttaattgtggtaggcactctgggtaaaaagttcaaacagtatcgggagcttaagccacagacctgtacaatttgcgagactacccccgttaacgctatcgatgccgaaatgcacgacttgaattgttcctacaacatctgcccttattgtgcatcacgcccaacaagtgatgggctggccagacatgtgatgcagtgccccaagaggaaagagaagattgaagagaccgctctatacctcaatctggaacggataccttgggtcgtgcgcaaacttctgcaagtgagcgagtctacgggagtcgcattgaagcgatcctcatggctcgttgtgctgttagtactgctcactgtgagccttagtccagtccagtctgccccgatcggc

SEQ ID NO: 10673 - RNA, 972 nt, synthetic construct
  misc_feature 1..972: note = derived and/or modified CDS sequence (opt3) from CCHFV(Matin)__AF467769.2__Gn
  source 1..972: mol_type = other RNA
agcgaggaatccggcgacgattgcatctctagaacccagctgctcaggacagagactgccgaaattcactcagacagttacgggggacccggtgataagataacgatctgtaacggcagcaccgtggtcgaccaacggcttgggtccgagctgggatgctatacaattaatcgcgttaaatctttcaagttgtgtgaaaactcggctactggcaaatcatgcgagatcgatagcacccctgtgaagtgtcgacagggtttttgcttaaaaattacacaggaggggcgtggacatgtaaagctgagtagaggctccgaagtggtcctagacgcatgtgattctagctgcgagatcatgataccaaagggcaccggggacatcctcgtggattgttccggaggtcagcaacacttcctgaaagacaatcttattgatctgggctgcccgaacatccccttgctcgggaagatggccatttacatctgtaggatgtcaaatcatcctaaaactacaatggtttttctgttctggtttagtttcggatatgtgataacctgcattctgtgcaaggtcatcttttacctcttaattgtggtaggcacgctgggtaaaaagttcaagcagtatcgggaacttaaaccacagacttgtaccatctgcgagacaactcccgttaacgcgatcgacgctgagatgcacgatttgaattgtagctacaacatttgcccttattgtgcctctcgcctgacctccgacgggctagcaagacatgtgatgcagtgcccaaagaggaaagaaaagatagaggaaacagagctctacctgaatcttgaacggatcccctgggtcgtgcgcaaactgttgcaagtgtcagagagcaccggagtcgccctcaagcgaagttcttggctggttgtgttactggtactccttacggtgtccctgagccctgtccagtcggctccaattggc

SEQ ID NO: 10674 - RNA, 972 nt, synthetic construct
  misc_feature 1..972: note = derived and/or modified CDS sequence (opt3) from CCHFV(Baghdad 12)__AJ538197.2__Gn
  source 1..972: mol_type = other RNA
agcgaggaatccggcgacgattgcatctctagaaccaggctgctccggacagagactgccgaaattcacggggactcatacggaggtcccggcgataagataacgatctgtaacgggagtaccattgtggaccagcgccttggaagcgagatgggctgctatacaatcaatcgagtcaaatccttcaagctgtgtgaaaactctgctactggtaaatcgtgcaagattgattcaatccctgttaaatgtcgtcaagggtactgcttgaagataacccaggagggaagaggccatgtgaagttaagcaggggcagtgaggtagtgctggacgcatgtgattcctcttgcgaagtcatgatcccaaaagggacaggagacattctagtggattgtagcggtggccagcagcactttctcaaggacaatctgatcgatcttgggtgcccgaacattcccctgttgggaaaaatggccatctatatatgtcggatgtccaatcatcctaagaccactatggcgttcctcttttggttctcatttggctacgttattacatgcatcctgtgcaaagctattttctatctgctcatcatcgtgggtaccttagggaagcgctttaagcaatacagagagctgaaaccacagacgtgtactatttgcgaaaccacacccgtcaacgccatagacgcagagatgcacgatcttaattgtagttataacatctgcccttactgtgccagcaggttgacttctgacggactggctcggcatgtgacccagtgcccaaagcgcaaagagaaggtagaagagacagaactatacctcaatctggagcgaatcccctgggttgtgagaaaacttctgcaggtctccgaatcaaccggcgtggcattgaagaggagcagttggctcattgtgctgttagtcctgctcgccgtttcttccagccctgtgcaatcggctccaataggc

SEQ ID NO: 10675 - RNA, 972 nt, synthetic construct
  misc_feature 1..972: note = derived and/or modified CDS sequence (opt3) from CCHFV(VLG/TI29414)__AY179961.1__Gn
  source 1..972: mol_type = other RNA
agcgaggaacccggcgacgattgcatctccagaacccagctgctcagggccgagcctgctgaaattcacgacgataactacgggggaccaggtgacaagataacaatctgtaatggctctactattgtggatcaacggcttgggtcagagctgggatgctatacgatcaaccgcgtcaaaagtttcaagttgtgtgaaaatagcgcaaccggcaaaacatgcgagattgactccactccggttaagtgtcgacagggtttttgcttaaaaatcacccaggaggggcgtggacatgtgaagctgtctagaggctcggaagtagtgctagatgcctgtgactcaagctgcgaggtcatgatacccaagggcacaggggatatcctcgtggactgtagtggaggtcagcaacacttcctgaaagataaccttattgacctgggctgccctcatatcccattgctcgggaagatggcgatttacatctgtaggatgtccaatcacccccggaccactatggcttttctgttctggttttctttcggatatgttataacatgcatcttttgcaaagccctgttctacagcctcattattatcggcaccttaggtaagaaaatcaagcagtatcgcgaactgaagcctcagacgtgtactatttgcgagaccgcaccagtgaacgccatagatgctgagatgcatgaccttaattgttcctacaacatctgcccctattgtgcatcaagattgacaagtgacgggctggccaggcacgtccctcagtgcccaaaacggaaggaaaaagtggaggaaactgagctatacctcaatctggaacgcattccgtggaacgtacgaaaacttctgcaagttagcgagtctaccggagtggctttgaagagatcctcatggctcatcgtcctgttagtgctgctcacagtgagccttagtcccgtccagtctgcccctgttggc

SEQ ID NO: 10676 - RNA, 972 nt, synthetic construct
  misc_feature 1..972: note = derived and/or modified CDS sequence (opt3) from CCHFV(TADJ/HU8966)__AY179962.1__Gn
  source 1..972: mol_type = other RNA
agcgaggaatccggcgacgattgcatctctagaacccagctgctcaggacagagactgccgaaattcacggggacgattacggaggtcccggcgacaagataacgatctgtaacgggtcaaccattgtggatcaacggcttggaagtgagctgggctgctatacaatcaatcgcgtcaagagcttcaagttgtgtgaaaactccgctactggtaaaaattgcgagattgactctgttcctgtgaagtgtcgacaggggtactgcttaaaaatcacccaggagggacgtggccatgtaaagctgtcgagaggctcagaagtggtcctagatgcatgtgacagcagttgcgaggtgatgataccaaaggggacaggagatatctccgttgactgttctggtggccagcaacactttctcaaagataacctgattgaccttgggtgcccgaagatccccctgttgggaaaaatggccatttatatctgtaggatgagcaatcatcctaagaccactatggcgttcctcttttggttctcctttggctacgtgataacacggattctgtgcaaagctatcttctatctgctcattatcgtcggtaccttagggaagcgctttaagcagtacagagaactgaaaccacagacgtgcactatctgtgagaccacacccgccaacgcaattgatgccgagatgcacgaccttaattgctcatataacatatgtccttactgcgctagtaggttgactagcgacggactggcacggcatgtgacccagtgtccaaagcgcaaagaacgagtagaggaaacagagctatacctcaatctggaaagaatcccctggattgttaggaaacttctgcaagtgtctgagtccaccggcgtcgccttgaaacggtcaagctggctcatcgtgctgttagtgctgttcacggtcagtctctctcctgttcagtccgctccaataggc

SEQ ID NO: 10677 - RNA, 972 nt, synthetic construct
  misc_feature 1..972: note = derived and/or modified CDS sequence (opt3) from CCHFV(Hodzha)__AY223476.1__Gn
  source 1..972: mol_type = other RNA
agcgaggaatccggcgacgattgcatctctagaacccagctgctcaggacagagactgccgaaattcacggggacgattacggaggtcccggcgacaagataacgatctgtaacgggtcaaccattgtggatcaacggcttggaagtgagctgggctgctatacaatcaatcgcgtcaagagcttcaaattgtgtaaaaactccgctactggtaagtcttgcgaaattgactcgacccctgttaaatgtcgacaggggtactgcttaaagatcacacaggagggacgtggccatgtgaagctgtcaagaggcagcgaggtagtgctagatgcatgtgacagttcctgcgaagtcatgataccaaaagggaccggagatatcctcgtggactgttctggtggccagcaacactttctgaaggataatcttattgacctggggtgcccgaggatccccttgctcggaaaaatggccatttatatctgtcggatgagcaaccatcctaagactacaatggcgttcctgttttggttctcctttggctacgttataacctgcattctgtgcaaagctatcttctatctcttaattatcgtgggtacgctggggaagcgctttaagcagtacagagagcttaaaccacagacttgtaccatctgcgaaacaactcccgccaatgcaattgatgccgagatgcacgacttgaactgttcatataatatatgcccttactgtgctagtaggctgaccagcgacggactagcacggcatgtcacacagtgcccaaagcgcaaagagaaggtggaagagaccgaactctacctgaaccttgagcgaatcccctggattgtaagaaaactgttgcaagtttctgaatccacgggcgtggccctcaagaggtcaagctggctgatcgtcttactggtcctcttcgctgtgagtctttctcctgtgcagtccgccccaataggc

SEQ ID NO: 10678 - RNA, 972 nt, synthetic construct
  misc_feature 1..972: note = derived and/or modified CDS sequence (opt3) from CCHFV(Kosovo/9553/2001)__AY675511.1__Gn
  source 1..972: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatcgcgaggatgtccaatcacccaaaaacaaccatggcttttctgttctggttttctctgggatatgttataacgtgtattctctgcaaggccttattctacagcctgatcattatcggcactcttggtaaaaagatcaagcagtatcgggaattgaaaccccagacctgcacaatttgtgagactgcacctgtgaacgccatagatgctgagatgcatgacctgaattgctcctacaacatctgtccatattgcgcatcacgcctaaccagtgacgggctcgccagacacgtcaagcagtgtcccaaaaggaaggaaaaagtggaggaaacagagctgtaccttaatctggaacggattccttgggtagttcgcaagttgctccaagtgagcgagtctaccggagtcgctctgaaacgatcctcatggttaatcgtgctgctcgtgcttctgacggtcagcttgagtccagttcagtctgccccggtgggc

SEQ ID NO: 10679 - RNA, 972 nt, synthetic construct
  misc_feature 1..972: note = derived and/or modified CDS sequence (opt3) from CCHFV(SPU41/84)__AY900142.1__Gn
  source 1..972: mol_type = other RNA
agcgaggaatcctctgacgattgcatctcaagaacccagctgctcaggacagagactgccgaaattcacggcgacaactacgggggacccggtgataagataacgatctgtaatggcagtaccgtggtcgaccaacggcttgggagcgagctgggatgctatacaattaaccgcgttaaaactttcaagttgtgtgaaaattccgctaccggcaaatcttgcgagatcgattcggtgcctgtaaagtgtcgacagggttactgcttaaaaattacacaggaggggcgtggacatgtgaagctgtcaagaggcagcgaagtcgtgctagacgcatgtgataccagttgcgaggttatgatcccaaagggcactggggacatactcgtggattgttccggaggtcagcaacactttctgaaagacaaccttatcgatctgggctgcccgaagattcccttgctcgggaaaatggccatctatatttgtaggatgtctaatcatcctaagacaaccatggcgttcctgttttggttcagctttggatacgtcatcacgtgcataatttgcaaagtgatcttctatctgctcattatcgtaggcactttaggtaagcggtttaagcagtaccgcgaactgaaaccacagacctgtacaatctgcgagactacccccgttaacgctattgacgccgagatgcacgatcttaattgttcctataacatatgcccttactgtgcatcaagattgacaagtgacgggctggccaggcatgtgacccagtgcccaaagcggaaagaaaaggtcgaggaaacggagctatacctcaatctggaacgcatcccctgggtggtgcgaaaacttctgcaagtcagcgagtctactggagttgctttgaagagatcctcatggctcgtggtactgttagtgctgctcacagtcagccttagtcctgtgcagtctgcaccaatttcc

SEQ ID NO: 10680 - RNA, 972 nt, synthetic construct
  misc_feature 1..972: note = derived and/or modified CDS sequence (opt3) from CCHFV(UG3010)__AY900143.1__Gn
  source 1..972: mol_type = other RNA
gccgagggcgtgagcaacgactgcgtctccagaacccagctgatcaagacagaagttgctgagattcacgaagattcttacgggggacccggtgagaaaataactatctgtaatggctcaacgattgtggaccaaaggctcgggagtgaacttggatgctataccatcaaccgggtaaagacatacaaactgtgtgagaatagcgcaactgagaagggctgcgaaattgattccgtgcctgtcaaatgtaagcagggtttctgcttgaaggtgacccaggaggggcgcggacatgttaaattatctcgaggcacagaaatcgtgctggacgtctgtgatacctcgtgcgagctaatgataccaaagggcactggggacatcctcgtggattgttcaggaggtcagcaacactttctgcaggacaaccttattgatctgggctgcccgaatgtacccttgctcgggaaaatggccatctatatttgtcgtatgagcaaccatcctaagacaaccatggcgttcctgttttggttcagttttggatacgttatcacgtgcatagtgtgcaaagtcctgttctatctcttaattgtgatcggcactctgtccaagaaacttaagcagtacagagagttgaagccacagacctgtattgtgtgcgaatctacacccgtcaatgctatcgacgccgagatgcacgaactgaactgtaattataacatctgcccttactgtgcaagcaggctaacttccgatggtctcgttcggcatgtgaatcaatgcccaaaacgcaaggagaaagtagaagagaccgagctgtaccttaacctggaaaggattccctggttggtgagacggctcctgcaggtctcagagagtacagggatggccttaaagcgcagctgttggatgaccacgctgctcatacttctggtggtttctttgtcccctgtgcagtcagctccagtcgga

SEQ ID NO: 10681 - RNA, 972 nt, synthetic construct
  misc_feature 1..972: note = derived and/or modified CDS sequence (opt3) from CCHFV(Hy13)__AY900145.1__Gn
  source 1..972: mol_type = other RNA
agcgaggaatccggcgacgattgcatctctagaacccagctgtcaaggacagagactgccgaaattcacagtgacaactacgggggacccggtgataagataacgatctgtaatggcagcaccattgtggaccaacggctcgggtccgagcttggatgctatacaatcaaccgcgtcaaatctttcaagctgtgtgaaaattcggctactggcaaatcatgcgagattgatagcacccctatcaagtgtcgacagggtttttgcttgaaaataacacaggaggggcgtggacatgttaagttaagtagaggctccgaagtggtactggacgcatgtgattctagctgcgagatcatgattccaaagggcaccggggacatcctagtggattgttccggaggtcagcaacacttcctcaaagacaacctgattgatcttggctgcccgaatatccccctgttggggaagatggccatatacatttgtaggatgtcaaaccatcctaaaactacaatggcgtttctcttctggtttagtttcggatatgtcattacctgcatcctgtgcaaggtgatcttttacctgctcatcgttgtgggcacgttaggtaaaaagttcaagcagtatcgggaactgaaaccacagacttgtaccatttgcgagacaactcccgtcaatgctatagacgccgagatgcacgatcttaactgtagctacaatatctgcccttattgtgcatctcgcttgacctccgacgggctggccagacatgtgatgcagtgcccaaagaggaaagaaaaggtagaggaaacagagctatacctcaacctggaacggattccctgggttgtgcgcaaacttctgcaagtctcagagagcaccggagtggctttgaagcgaagttcttggctcgtggtcctgttagttctgctcacggtgtcccttagccctgtacagtcggcaccaatcggc

SEQ ID NO: 10682 - RNA, 972 nt, synthetic construct
  misc_feature 1..972: note = derived and/or modified CDS sequence (opt3) from CCHFV(Semunya)__DQ094832.1__Gn
  source 1..972: mol_type = other RNA
gccgagggcgtgagcaacgactgcgtctccagaacccagctgatcaagacagaagttgctgagattcacgaagattcttacgggggacccggtgagaaaataactatctgtaatggctcaacgattgtggaccaaaggctcgggagtgaacttggatgctataccatcaaccgggtaaagacatacaaactgtgtgagaatagcgcaactgagaagggctgcgaaattgattccgtgcctgtcaaatgtaagcagggtttctgcttgaaggtgacccaggaggggcgcggacatgttaaattatctcgaggcacagaaatcgtgctggacgtctgtgatacctcgtgcgagctaatgataccaaagggcactggggacatcctcgtggattgttcaggaggtcagcaacactttctgcaggacaaccttattgatctgggctgcccgaatgtacccttgctcgggaaaatggccatctatatttgtcgtatgagcaaccatcctaagacaaccatggcgttcctgttttggttcagttttggatacgttatcacgtgcgtggtctgcaaagtgctgttctatctcttaatagtgattggcactctgggtaagaagctgaaacagtacagagagttgaagccacagacctgtatcgtctgcgaatccattcccgttaatgctatcgacgccgagatgcacgaactgaactgtaattataacatctgcccttactgtgcatctaggctaacaagcgatgggctcgtgcggcatgtaactcaatgcccaaaacgcaaggagaaagtggaagagaccgagctgtaccttaatctggaaaggattccctggttggtcagacggctccttcaggtgtccgagtcaacaggaatggccttaaagcgcagttgttggatgaccacgctgctcatacttctggttgtgagcttgtctcctgtccagtccgctccagtgggc

SEQ ID NO: 10683 - RNA, 972 nt, synthetic construct
  misc_feature 1..972: note = derived and/or modified CDS sequence (opt3) from CCHFV(SPU128/81/7)__DQ157174.1__Gn
  source 1..972: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaagagcttcaaattgtgtgaaaattccgctactggcaaatcttgcgagattgagtcggttccagtgaagtgtcgacagggttactgcttacgtatcacccaggaagggagaggacatgtaaaactgtcaaggggcagcgaggtggtcctagatgcatgtgacacaagttgcgaaataatgatcccgaagggcaccggggatattctcgtggactgttccggaggtcagcaacactttctgaaggataaccttatcgacctgggctgccccaaaattcctttgctcgggaagatggccatctatatatgtcggatgtctaatcatccaaaaactacaatggcgttcctgttttggttcagctttggatacgttattacctgcatcctgtgcaaggctattttctatctcttaatcatcattggcacgctgggtaaacgctttaagcagtacagagagcttaagccccagacttgtaccatatgcgagacaactcctgtgaacgccatcgatgcagaaatgcacgacttgaattgttcctataacatttgcccatactgtgcctcaaggctgaccagtgatgggctagctcggcatgtcacacagtgccccaaacgcaaggagaaagtggaagagaccgaactctacctgaatcttgagcgaatcccttgggtagttagaaagctgttgcaagtgagcgagtctacgggagtcgcactcaaaaggtcctcatggctgatagtgttactggtcctcttcactgtgagccttagtccagttcagtctgccccgattggc

SEQ ID NO: 10684 - RNA, 972 nt, synthetic construct
  misc_feature 1..972: note = derived and/or modified CDS sequence (opt3) from CCHFV(ROS/HUVLV-100)__DQ206448.1__Gn
  source 1..972: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaagagatcctcatggctcatagtcctgttagtgctgctcacggtgagccttagtccggtccagtctgctcccgttggc

SEQ ID NO: 10685 - RNA, 972 nt, synthetic construct
  misc_feature 1..972: note = derived and/or modified CDS sequence (opt3) from CCHFV(AP92)__DQ211625.1__Gn
  source 1..972: mol_type = other RNA
agcgagggcggggacggaggttgcatctccagaacccagctgattaagacagaaactgccgaggtgcacggcgatgactacgggggacccggcgagaaaataacgatctgtaacggttctaccattgtcgatcaaaggctcgggtcagaacttggatgctatacaatcaatcggattaagagtttcaaactgtgtgaaaacagcgctcagggcaagaattgcgagatcgactccgcacctgttcagtgtcgccagggctactgcttgaaaatatctcaagaggggcgaggacatgtgaagttatcgcgtggttcagaaatcgtactggatgtgtgtgacactagctgcgagattatgatcccaaagggcaccggggatattctagtcgactgtagtggaggccagcagcactttctccagtccaacctggtggatcttggttgcccgaatatccccctgttggggaaaatggccatatatatttgtagaatgtctaaccatcctaagacaaccatggcgttcctcttttggttcagctttggatacgttatcacttgcattctgtgcaaaacactgttctatatcctcatcattataggcaccttaggcaagaaactgaagcaatacagggaacttaagccacagacgtgtactatctgcgagtccgtgcccgtcaatgctattgacgccgagatgcacgatttgaactgttcatataatatctgcccttactgtgcaagtcggctgaccagcgaagggctaacacgccatgtgaaccagtgcccaaaaagaaaggagaaagtagaagagactgaactctacctgaatcttgagaggataccctggattgttcggaagctgctccaggtgtctgagtccaccggagtcgccttgaaacgctcaagctggatgatcgtgctgttaatcctgctcattgtgagtatgtctcctgtccaatccgctccaatcagc

SEQ ID NO: 10686 - RNA, 972 nt, synthetic construct
  misc_feature 1..972: note = derived and/or modified CDS sequence (opt3) from CCHFV(ArD8194)__DQ211626.1__Gn
  source 1..972: mol_type = other RNA
gccgagggcgggagcaacgactgcgtgtccagaacccagctggtcaagacagaagttgctgagatccacgaagattcttacggaggtcccggcgagaaaattactatatgtaatgggtcaacgatcgtggaccaaaggctcggaagtgaacttggctgctataccattaaccgggtacgcacatacaagctgtgtgagaatagcgcaactgagaaatcctgcgaaatcgattctgtgcctgtcaagtgtaaacagggtttctgcttgaagattacccaggaggggcgaggacatgtgaagttatcgcgtggcacagaaatcgttctggacgtgtgtgatacctcatgcgagctaatgataccaaaaggcactggggacatcctcgtcgattgtagcggaggtcagcaacactttctgcaggacaaccttattgatctgggctgcccgaatatccccttgctcgggagaacagccatttatgtgtgtaggatgagtaaccatcctaagaccacgatggcgttcctgttttggttctcctttggatacgtaatcacttgcgttgtgtgcaaagtcctgttctatctcttaatagtgattggcaccctgggtaagcggcttaaacagtaccgcgagttgaagccacagacatgtatcgtgtgcgaatctattcccgtcaatgctatcgacgccgagatgcacgatctgaactgtaattataacatctgcccttactgtgcaagcagactaacttccgacgggctcgttaggcatgtgacccaatgcccaaagcggaaagaaaaggtagaggaaacagagctgtaccttaatctggagcgcattccctggttggtgcgaaaactcctgcaggtctcagaaagtaccggagtggccttaaagagaagctgttggatgataacgctgctcatccttctgactgtttctatgtcccctgtgcagtcagctccagtcggc

SEQ ID NO: 10687 - RNA, 972 nt, synthetic construct
  misc_feature 1..972: note = derived and/or modified CDS sequence (opt3) from CCHFV(ArD15786)__DQ211627.1__Gn
  source 1..972: mol_type = other RNA
gccgagggcgggagcaacgactgcgtgtccagaacccagctggtcaagacagaagttactgagatccacgaagattcttacggaggtcccggcgagaaaattacgatatgtaatgggtcaaccatcgtggaccaaaggctcggaagtgaacttggctgctatacaattaaccgggtacgcacttacaagctgtgtgagaatagcgctaccgagaaatcctgcgaaatcgattctgtgcctgtcaagtgtaaacagggtttctgcttgaagattacacaggaggggcgaggacatgtgaagttatcgcgtggcaccgaaatcgttctggacgtgtgtgatacttcatgcgagctaatgataccaaaaggcacaggggacatcctcgtcgattgtagcggaggtcagcaacactttctgcaggacaaccttattgatctgggctgcccgaatatccccttgctcgggcagaccgcaatttatgtgtgtagaatgagtaaccatcctaagacgactatggccttcctgttttggttctcctttggatacgtaataacctgcgttgtgtgcaaagtcctgttctatctcttaatcgtgattggcacactgggtaagaggcttaaacagtaccgggagttgaagccacaaacttgtatcgtgtgcgaatctattcccgtcaatgcgatcgacgctgagatgcacgatctgaactgtaattataacatctgcccttactgtgccagccgcctaacctccgacgggctcgttagacatgtgacacagtgcccaaagaggaaagaaaaggtagaggaaaccgagctgtaccttaatctggagcggattccctggttggtgcgcaaactcctgcaggtctcagaaagtacgggagtggcattaaagcgaagctgttggataatcactctgctcattcttctgacagtttctatgtcccctgtgcagtcagccccagtcggc

SEQ ID NO: 10688 - RNA, 972 nt, synthetic construct
  misc_feature 1..972: note = derived and/or modified CDS sequence (opt3) from CCHFV(ArD39554)__DQ211628.1__Gn
  source 1..972: mol_type = other RNA
agcgagtccaacaataacgactgcgtgtctagaacccagctgatcaagacagaaaatgccgagattcacggcgatgactacgggggacccggtgagaaaataactatctgtaacggctcaacgattgtcgaacaaaggctcgggagtgaacttggatgctataccatcaatcggattaagagcttcaaactgtgtgagaactccgcttctggcaagggttgcgagatcgattcgacacctgttaaatgtaagcaggggttttgcttgaagataactcaggaaggacgcggccatgtgaaattatcacgaggcagcgagatcattctggacgtatgtgatagttcctgcgaaatgatgatcccaaaggggtctggagacattctagtggattgtagcggtggccagcaacacttcctccaggacaatctggtcgatcttgggtgcccgaacgtgcccctgttgggaaaaatggcaatctacatatgtcgtatgtccaatcatcctaagaccacaatggcctttctcttctggttttcattcggctatgttattacctgcatcttttgcaaagtgattttctacgtcctgatcatcattggtactctggggaagagaataaagcagtatagggagctcaaaccacagacatgtaccatctgcgaggcgacgcccgtgaacgctattgacgccgaaatgcacgatttaaattgtagttacaacatctgcccttattgtgcaagccggctgacttctgagggacttgtacgccatgttacccaatgcccaaagagaaaagaaaagatagaggaaacagagttgtacctgaatctagagaggattccctggtttgtgcggaaactcctgcaggtctccgaatcaactggcgtggcccttaagcgcagcagttggctggtgaccttgctcgtcctgttaacagtttctctgtcccctgtgcagagcgctccaatcggc

SEQ ID NO: 10689 - RNA, 972 nt, synthetic construct
  misc_feature 1..972: note = derived and/or modified CDS sequence (opt3) from CCHFV(Drosdov)__DQ211630.1__Gn
  source 1..972: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgaggtcatgataccgaaaggcactggggatatcctcgtggactgtagtggaggtcagcaacacttcctgaaggataaccttattgacctgggctgcccccatatccctttgctcgggaaaatggccatttacatctgtagaatgtccaatcacccaaggacaaccatggcgtttctgttctggttttctttcggatatgttataacgtgcatcttttgcaaggctctgttctacagcctcattattatcggcactttaggtaaaaagatcaagcagtatcgggaactgaaaccccagacctgtacaatttgcgagactgcccctgtgaacgcaatagatgccgagatgcatgaccttaagtgttcctacaatatctgcccatattgtgcttcacgcttgaccagtgacgggctggcaagacacgtcacacagtgccccaaaaggaaggaaaaagtggaggaaaccgagctatacctcaacctggaacggattccttggatcgtacgcaaacttctgcaagttagcgagtctacgggagtggccttgaagcgatcctcatggctcatagtcctgttagtgctgctcactgtgagccttagtccagtccagtctgctccggttggc

SEQ ID NO: 10690 - RNA, 972 nt, synthetic construct
  misc_feature 1..972: note = derived and/or modified CDS sequence (opt3) from CCHFV(Oman)__DQ211632.1__Gn
  source 1..972: mol_type = other RNA
agcgaggaatccggcgaggactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaaatccttcaagttgtgtgagaatagcgctactggtaaatcttgcgagattgacaacacccctgttaagtgtaaacaggggttttgcttaaagatcacacaggaaggacgaggccatgtgaagctgtcgcgtgattcagaggtagtgctagacgcatgtgatagcagttgcgaaataatgatcccaaaaggcaccggggacattctcgtcgattgttccggaggtcagcaacacttcctgaaggacaatcttatcgatctgggctgcccgaacattcccttgctcgggaaaatggccatctacatatgtagaatgtctaatcatcctaagactacaatggcgtttctgttctggtttagcttcggatatgtgattacctgcatcctgtgcaaagttatcttttacctcttaattgtggtcggcacgctgggtaagaagttcaaacagtatagggagcttaagccacagacttgtaccatctgcgagacaactcccgtgaacgctattgacgccgaaatgcacgatttgaattgttcctacaacatatgcccttattgtgcatcacggctgaccagtgacgggctagcccgccatgtaatgcagtgcccaaaaagaaaggagaaaatcgaagagacagaactctacctgaatcttgagaggattccctgggttgtgcggaagctgttgcaagtcagcgagtctaccggagtggctctcaaacgctcctcatggctgatcgtgttactggtcctccttacggttagcctgagtcctgtgcagtctgcaccaataggc

SEQ ID NO: 10691 - RNA, 972 nt, synthetic construct
  misc_feature 1..972: note = derived and/or modified CDS sequence (opt3) from CCHFV(SPU97/85)__DQ211633.1__Gn
  source 1..972: mol_type = other RNA
agcgaggaatccgacggcgattgcatctctagaacccagctgctcaggacagagactgccgaaattcactcagacaactacgggggacccggtgataagataacgatctgtaatggcagtaccattgtggaccaacggcttgggagcgagctgggatgctatacaatcaaccgcgtcaaatccttcaagttgtgtgaaaattctgctactggcaaatcgtgcgagattgattcaacccctgttaagtgtcgacagggtttttgcttaaaaatcacacaggaggggcgtggacatgtgaagctgagcagaggcagtgaaatagtactagacgcatgtgattcctcttgcgagatcatgattccaaagggcaccggggacatcctcgtggattgtagcggaggtcagcaacacttcctgaaagacaaccttattgatctgggctgcccgaatatccccttgctcgggaggatggccatatacatttgtcggatgtccaaccatcctaagactacaatggcgtttctgttctggttttcattcggatatgtcattacctgcatcctgtgcaaagtgatcttttacctcttaatcgttgctggcacggtgggtaagaaattcaagcagtatcgcgaactgagaccacagacttgtaccatttgcgagacaactcccgtcaatgccatagacgcagagatgcacgatcttaactgtagttacaatatctgcccttattgtgccagcaggttgacctctgacgggctggctcggcatgtgatgcagtgcccaaagcgcaaagaaaagattgaggaaacagagctatacctcaacctggaacgaatcccctgggtagttagaaaacttctgcaagtgtccgagtcaaccggagtcgcattgaagaggagcagttggctcacggtgctgttagtgctgctcatagtctctctttcccctgttcagagcgccccaattggc

SEQ ID NO: 10692 - RNA, 972 nt, synthetic construct
  misc_feature 1..972: note = derived and/or modified CDS sequence (opt3) from CCHFV(SPU103/87)__DQ211634.1__Gn
  source 1..972: mol_type = other RNA
agcgaggaatcctctgacgattgcatctcaagaacccagctgctcaggacagagactgccgaaattcacggcgacaactacgggggacccggtgataagataacgatctgtaatggcagtaccattgtggaccaacggcttgggagcgagctgggatgctatacaatcaaccgcgtcaaaactttcaagttgtgtgaaaattccgctaccggcaaatcttgcgagattgattcggttcctgtgaagtgtcgacagggttactgcttaaaaatcacacaggaggggcgtggacatgtaaagctgtcaagaggcagcgaagtggtcctagacgcatgtgataccagttgcgaggtgatgataccaaagggcactggggacatcctcgttgattgttccggaggtcagcaacactttctgaaagacaaccttattgatctgggctgcccgaagatccccttgctcgggaaaatggccatttatatctgtaggatgtctaatcatcctaagacaaccatggcgttcctgttttggttcagctttggatacgtgataacgtgcgtcctgtgcaaagctattttctatctcttaatcattgtgggcactctgggtaagcggcttaagcagtaccgcgaattgaaaccacagacctgtacaatctgcgagactacccccgtaaacgccatcgacgcagagatgcacgatctgaattgttcctataacatttgcccttactgtgcctcaagactaacaagtgacgggctcgctaggcatgttacccagtgcccaaagcggaaagaaaaggtggaggaaacggagctgtaccttaatctggaacgcataccctgggtcgtgcgaagattgctccaagtgagcgagtctactggagtcgcactgaaaaggtcctcatggttaatcgttctgctcgtgctttttacagtaagcctgagtcctgtgcagtctgccccaatttcc

SEQ ID NO: 10693 - RNA, 972 nt, synthetic construct
  misc_feature 1..972: note = derived and/or modified CDS sequence (opt3) from CCHFV(SPU415/85)__DQ211635.1__Gn
  source 1..972: mol_type = other RNA
agcgaggaatccgacggcgattgcatctctagaacccagctgctcaggacagagactacggaaattcactcagacaactacgggggacccggtgataagataaccatctgtaatggcagtacaattgtggaccaacggcttgggagcgagctgggatgctatactatcaaccgcgtcaaatccttcaagttgtgtgaaaattctgccaccggcaaatcgtgcgagattgattcaacacctgttaagtgtcgacagggtttttgcttaaaaatcacccaggaggggcgtggacatgtgaagctgagcagaggcagtgaaatagtactagacgcttgtgattccaactgcgagatcatgattccaaagggcactggggacatcctcgtggattgttctggaggtcagcaacacttcctgaaagacaatcttattgatctgggctgcccgaacatccccttgctcgggaagatggcaatatacatttgtaggatgagcaatcatcctaaaacaaccatggcctttctgttctggttttccttcggatatgtcatcacgtgcattctgtgcaaggtgatcttttacctcttaatcgttgcgggcactgtgggtaaaaagttcaagcagtatcgggaactgcgcccacagacctgtacaatttgcgagactatacccgtcaacgctatcgacgccgagatgcacgatcttaattgttcatacaacatttgcccttattgtgcaagtagattgaccagcgacgggctggccaggcatgtgatgcagtgcccaaaacggaaggaaaaagtagaggaaacagagctatacctcaatctggaacgcatcccctgggttgtgcgaaaacttctgcaagtctctgagtccaccggagtggctttgaagagatcaagctggctcacggtgctgttagtcctgctcatagttagtctttctcctgtgcagtccgcaccaattggc

SEQ ID NO: 10694 - RNA, 972 nt, synthetic construct
  misc_feature 1..972: note = derived and/or modified CDS sequence (opt3) from CCHFV(Turkey200310849)__DQ211636.1__Gn
  source 1..972: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgaggttgactccacaccagtgaagtgtcgacagggtttttgcttaaaaattacccaggaggggcgtggacatgtaaagctgtctagaggctcggaagtggtcctagatgcatgtgactcaagctgcgaggtgatgatcccgaagggcactggggatatactcgttgactgtagtggaggtcagcaacacttcctgaaagataaccttatcgacctgggctgcccccatattcctttgctcgggaagatggccatctacatttgtaggatgtccaatcacccacggacaaccatggcgtttctgttctggttttctttcggatatgtgatcacgtgcataagctgcaaagctctgttttactccctcattatcattggcactttaggtaagaaaatcaagcagtatcgcgaactgaagccccagacctgtacaatctgcgagactgcccctgtcaacgcaattgatgccgagatgcatgaccttaattgttcatacaacatatgcccatattgtgctagtagattgaccagcgacgggctggcaaggcacgtgacacagtgccccaaacggaaggaaaaagtagaggaaaccgagctatacctcaatctggaacgcatcccttggattgttcgaaaacttctgcaagtgtctgagtccacgggagtcgccttgaagagatcaagctggctcatcgtgctgttagtgctgctcactgtcagtctttctccagttcagtccgctccggtgggc

SEQ ID NO: 10695 - RNA, 972 nt, synthetic construct
  misc_feature 1..972: note = derived and/or modified CDS sequence (opt3) from CCHFV(Kosova Hoti)__EU037902.1__Gn
  source 1..972: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccagaaggggcgtggacatgtgaagctgtctagaggctcggaggtagtgctagatgcatgtgactcaaactgcgaagtcatgataccgaaaggcactggggatatcctcgtggactgtagcggaggtcagcaacacttcctgaaggataatcttattgacctgggctgcccccatatccctttgctcgggaaaatggccatttacatctgtaggatgagtaaccacccaaagacaaccatggcgtttctgttctggttttccttcggatatgttataacgtgcatcttttgcaaagctctgttctactctctcattattatcggcactttaggtaagaagatcaaacagtatcgggagctgaagccccagacctgtacaatttgcgaaactgcccctgtgaatgcaatagatgccgagatgcatgaccttaactgtagctacaatatctgcccatattgtgcttcccgcttgacctcagacgggctggcaagacacgtcaaacagtgccccaagaggaaagagaaggtggaagagacagaactatacctcaacctggagcggattccttgggtagttcgcaaacttctgcaagtgagtgaaagcaccggagtcgccttgaagcgatcttcctggctcatcgtgctgttagtgctgctcacggtctcacttagcccagttcagagtgctccggtgggc

SEQ ID NO: 10696 - RNA, 972 nt, synthetic construct
  misc_feature 1..972: note = derived and/or modified CDS sequence (opt3) from CCHFV(YL04057)__FJ562094.1__Gn
  source 1..972: mol_type = other RNA
gccgagggcgggagctccgactgcatctctagaacccagctggtgaagacagaagtcgctgagattcacgaagattcatacggaggtcccggcgagaaaataactatctgtaacgggagtacgattgttgaccaaaggctcggacgggaacttggctgctataccatcaatcgcgtgcgaagctacaagctgtgtgagaactccgcatctggtaaatcgtgcgagattgattcaatccctgtaaagtgtaaacaggggttctgcttgaagataacacaggaaggacgtggccatgtgaagttaagcagaggcactgagatcgtcctggacgtgtgtgatagttcctgcgaactaatgattccaaaagggaccggagacatcctcgttgattgttctggtggccagcaacactttctgcagaataaccttattgacctggggtgcccgaatgtgcccttgctcggaaagatggccatctatgtctgtaggatgagcaaccatcctaaaacaaccatggcgttcctgttttggttctcctttggctacgtgataacttgcattgcttgccgggtactgttctatctcttaatcgccattggtacagttgggaagaaactgaagcagtaccgcgagcttaagccacagacctgtatcgtgtgcgagtcagtccccgtgaatgcaatcgatgccgaaatgcacgagttgaactgtagttataatatttgcccttactgtgctagcagactgtctacggacggactaataaggcatgtgactcaatgcccaaaacggcgcgaaaaggtcgaggaaaccgagctctttctgaaccttgagcgaatcccctggctggttagaaaattgctccaggtgtccgaatcaacaggcatggcactgaagaggagctgttggatgattactttactgatcctccttctggtaagtatatctcctgtgcagtccgccccagtcggc

SEQ ID NO: 10697 - RNA, 972 nt, synthetic construct
  misc_feature 1..972: note = derived and/or modified CDS sequence (opt3) from CCHFV(V42/81)__GU477490.1__Gn
  source 1..972: mol_type = other RNA
agcaaggagcccggcgacgattgcatctccagaacccagctgatgaggacagaaactgccgagattcacgacgataactacgggggacctggtgacaaaataacgatctgtaatggctctaccattgtggatcaacggctcgggtcagaacttggatgctatacaatcaaccgcgtcaagagtttcaaactgtgtgagaatagcgctactggcaaggcatgcgaagttgactccaccccagtgaaatgtcgacagggtttttgcttgaagattacacaggaggggcgtggacatgtaaagttatctagaggctcggaggtggtcctggatgcctgtgactcaagctgcgaagtgatgatcccgaaaggcaccggggatatcctagttgactgtagtggaggtcagcaacacttcctcaaggataacctgatcgaccttgagtgcccccatattcctctgttgggcaaactcgcgatctacatttgtaggatgtccaatcacccacggactacaatggcttttctgttctggtttgggttcggatatgtgataacctgcatactgtgcaaggccctcttttactctttaattatcattggcacgctgggtaaaaagatcaagcagtatcgcgaacttaaaccccagacttgtaccatctgcgagacagcacctgtcaacgccattgatgctgagatgcatgacttgaattgtagctacaacatatgcccatattgtgcatccagactgacttcagacgggctagccaggcacgtgacccagtgccccaagcggaaagaaaaggtagaggaaacagagctctacctgaatcttgaacgcatcccttggattgttcgaaaactgttgcaagtgagtgagagcaccggagtcgtgctcaagagatcttcctggctgatcgtgttactggtcctccttacggtttcactgagcccagtgcagagtgctccggtaggc

SEQ ID NO: 10698 - RNA, 972 nt, synthetic construct
  misc_feature 1..972: note = derived and/or modified CDS sequence (opt3) from CCHFV(Afg09-2990)__HM452306.1__Gn
  source 1..972: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgcgtagcttcaaattgtgtgaaaattccgctactggtaagtcttgcgagattgattcgatccctgtaaaatgtaagcaggggtactgcttaaaaattacccaggagggacgaggccatgtgaagctgtcaagaggcagcgaagtcgtgctagacgtttgtgatagttcctgcgaggtgatgatcccaaaggggacaggagacatactcgtcgattgttctggtggccagcaacactatctgaaagacaaccttgtggatctggggtgcccgaagatccccttgctcggaaaaatggcaatttacatctgtaggatgagcaatcatcctaagaccactatggcctttctgttctggttttccttcggctatgtaattacatgcatcctgtgcaaagcgatatttttcctcttaattatctttggtaccctggggaagcggttcaagcagtaccgcgaacttaaaccacagacgtgtactatttgcgagaccacacccgttaacgctatcgacgccgagatgcacgatttgaattgttcatataacatctgcccttactgtgcaagtagactgactagcgacggactagccaggcatgtgacccagtgcccacggcgcaaggaaaaagtcgaggaaacagagctctacctgaatcttgaacgaataccctgggtggtgagaaagctgttgcaagtctctgagtccaccggcacggttctcaaaaggtcaagctggctgattgtgttactggtactctttactgtgagtctttctcctgtccagtccgctccaatcggc

SEQ ID NO: 10699 - RNA, 972 nt, synthetic construct
  misc_feature 1..972: note = derived and/or modified CDS sequence (opt3) from CCHFV(Sudan Al-Fulah 3-2008)__HQ378184.1__Gn
  source 1..972: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaagagcttcaaattgtgtgaaaattccgctactggcaaatcttgcgttattgattcggtgccagtaaagtgtcgacagggttactgcttacgtatcacccaggaggggagaggacatgtgaaactgtcaaggggcagcgaggtcgtgctagacgcatgtgatacaagttgcgaaataatgatcccgaagggcaccggggacattctcgttgattgttccggaggtcagcaacactttctgaaggacaaccttgtggatctgggctgccccaaaatccctttgctcgggaagatggccatttatatctgtcggatgtctaatcatccaaaaactacaatggcgttcctgttttggttcagctttggatacgtcataacctgcattctgtgcaaggctatcttctatctcttaattatcatcggcacgctgggtaaacgctttagacagtacagggagcttaagccccagacttgtaccatttgcgaaacaactcctgtgaacgccatagacgcagagatgcacgatttgaattgttcctataacatctgcccatactgtgcctcacggctgaccagtgacgggctagctcgccatgtaacacagtgccccaagcgaaaagagaaggttgaagagaccgaactctacctgaatcttgagaggattccttgggtggtcagaaaactgttgcaagtgagcgaatctacgggagtggcactcaagcggtcctcatggctgatcgtcttactggttctcttcactgtgagccttagtccagtacagtctgccccgataggc

SEQ ID NO: 10700 - RNA, 972 nt, synthetic construct
  misc_feature 1..972: note = derived and/or modified CDS sequence (opt3) from CCHFV(Sudan AB1-2009)__HQ378187.1__Gn
  source 1..972: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaagagcttcaaattgtgtgaaaattccgctactggcaaaaactgcgagattgattctgttccagtgaagtgtcgacagggttactgcttacgtatcacccaggaggggagaggacatgtaaaactgtcgaggggctcagaagtggtcctagacgcatgtgatacaagctgcgagataatgatcccgaagggcaccggggacattctcgtggattgtagtggaggtcagcaacactttctgaaggacaatcttatcgatctgggctgccccaaaattcctttgctcgggaagatggccatctatatatgtcggatgtccaaccatccaaaaactacaatggcgttcctgttttggttctcttttggatacctgattacctgcatcctctgcaaggctattttctatttactgatcatcattggcacgcttggtaaacgcttgaagcagtacagagaactgaagccccagacttgtaccatatgcgagacaactcctgttaatgccatcgacgcagagatgcacgatctaaactgtagctataatatttgcccatactgtgcctccaggctcacctcagacgggctggctcggcatgtgatccagtgccccaaacgcaaggaaaaagtcgaggaaacagagctttacctgaacttggaacgaataccttgggtggtaagaaagctcctgcaagttagtgagagcaccggagtggcattaaaaaggtcttcctggctgattgtcctccttgtgctgtttacggtgtcattgagcccagtccagagtgccccgatcggc

SEQ ID NO: 10701 - RNA, 972 nt, synthetic construct
  misc_feature 1..972: note = derived and/or modified CDS sequence (opt3) from CCHFV(NIVA 118595)__JN572083.1__Gn
  source 1..972: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgaaatccttcaagttgtgtgaaaatagcgctactggtaaatcttgcgagattgattcgatccctgtaaagtgtcgacaggggtactgcttaaaaattacccaggagggacgtggccatgtgaagctgtcaagaggcagcgaagtcgtgctagacgcatgtgatagttcctgcgaggttatgatcccaaaggggacaggagacatactcgtggattgttctggtggccagcaacactttctgaaagacaaccttatcgatctggggtgcccgaagattcccttgctcggaaaaatggccatctatatttgtaggatgagcaatcatcctaagaccactatggcgttcctgttttggttctcctttggctacgtcatcacatgcatactgtgcaaagtgattttctatctcttaatcatttttggtaccctggggaagcggttcaagcagtaccgcgaacttaaaccacagacgtgtactatctgcgagaccacacccgtaaacgctatcgacgccgagatgcacgatttgaattgttcatataacatttgcccttactgtgcaagtagactgactagcgacggactagccaggcatgttacccagtgcccaaagcggaaagaaaaggtggaggaaacagagctctacctgaatcttgaacgcataccctgggtcgtgcgaaaactgttgcaagtgtctgagtccaccggcatcgctctcaagagatcaagctggctgattgtcttactggttctctttacggtgagtatcactcctgtacagtctgcaccaataggc

SEQ ID NO: 10702 - RNA, 972 nt, synthetic construct
  misc_feature 1..972: note = derived and/or modified CDS sequence (opt3) from CCHFV(SCT ex Afghanistan)__KC344856.1__Gn
  source 1..972: mol_type = other RNA
agcgaggaatccggcgacgattgcatctctagaacccagctgctcaggacagagactgccgaagtgcacaacgacaattacgggggacccggtgataagattacgatatgtaacggctcaaccatcgtcgaccaacggcttgggagtgagctgggatgctatacaattaatcgcgttaagagcttcaagttgtgtgaaaactccgctactggcaaatcttgcaagatcgattcgacccctgtgaaatgtcgacagggtttttgcttaaagattacacaggaggggcgtggacatgtaaagctgtcaagaggcagcgaggtggtcctagacgcatgtgatagttcctgcgaaatcatgataccaaaaggcaccggggacatcctcgtggattgttctggaggtcagcaacacttcctgaaggacaatcttattgatctgggctgcccgaacatccccttgctcgggaaaatggccatttacatctgtaggatgagcaatcatcctaagactacaatggcgtttctgttctggttttccttcggatatgttataacctgcatcttttgcaaagtgattttctacctgctcattgtcgtgggcacgttaggtaagaagtttaaacagtatcgggagctgaagccacagacttgtaccatctgcgaaacaactcccaccaacgctatcgacgccgagatgcacgatcttaattgttcatacaacatttgcccttattgtgcaagtcgcttgacaagcgacgggctggccagacatgtaacccagtgcccaaaaaggaaggagaaagttgaagagacggaactatacctcaatctggagcggataccctggatcgtgcgcaaacttctgcaagtctctgaatccactggagtggctttgaaacgatcaagctggctcattgtgctgttagtcctgctcacagttagtctttctcctgtgcagtccgcaccaatcggc

SEQ ID NO: 10703 - RNA, 972 nt, synthetic construct
  misc_feature 1..972: note = derived and/or modified CDS sequence (opt3) from CCHFV(Zahedan 2007)__KC867273.1__Gn
  source 1..972: mol_type = other RNA
agcgaggaatccggcgacgattgcatctctagaacccagctgctcaggacagagactgccgaagtgcacggggacaactacggaggtcccggcgataagattacgatatgtaatgggtcaaccgtcgttgaccaacggcttggaagtgagctgggctgctatacaatcaaccgcgtgcgtagcttcaaattgtgtgaaaattccgctactggtaagtcttgcgagattgattcgatccctgtaaaatgtaagcaggggttttgcttaaaaattacccaggagggacgaggccatgtgaagctgtcaagaggcagcgaagtcgtgctagacgtttgtgatagttcctgcgaggtgatgatcccaaaggggacaggagacatactcgtcgattgttctggtggccagcaacacttcctgaaagacaaccttgtggatctggggtgcccgaagatccccttgctcggaaaaatggcaatttacatctgtaggatgagcaatcatcctaagaccactatggcctttctgttctggttttccttcggctatgtaattacatgcatcctgtgcaaagcgatatttttcctcttaattatctttggtaccctggggaagcggttcaagcagtaccgcgaacttaaaccacagacgtgtactatttgcgagaccacacccgttaacgctatcgacgccgagatgcacgatttgaattgttcatataacatctgcccttactgtgcaagtagactgactagcgacggactagccaggcatgtgacccagtgcccacggcgcaaggaaaaagtcgaggaaacagagctctatctgaatcttgaacgaataccctgggtggtgagaaagctgttgcaagtctctgagtccaccggcacggttctcaaaaggtcaagctggctgattgtgttactggtactctttactgtgagtctttctcctgtccagtccgctccaatcggc

SEQ ID NO: 10704 - RNA, 972 nt, synthetic construct
  misc_feature 1..972: note = derived and/or modified CDS sequence (opt3) from CCHFV(SPU 44/08)__KJ682805.1__Gn
  source 1..972: mol_type = other RNA
agcgaggaatccaacgacgattgcctgtctagaacccagctccttaggacagagaatgccgaaatccactcagacaactacggcgggcccggagataagattactatatgtaatggtagtacgatcgtggaccaacggctgggcagcgagttggggtgctataccattaaccgcgtcaaatccttcaagttatgtgaaaattctgctacaggaaaatcgtgcgagatcgattcaactcctgttcgatgtcgtcagggcttttgcctgaagattacccaggagggtagagggcatgtgaaactaagcaggggaagtgaagtagtgctcgacgcatgtgattcctcttgcgagatcatgataccaaagggcacaggcgacatcctggtcgattgtagcgggggacagcaacacttccttaaggacaacctggtggatttgggttgcccgaatattcccctcctgggcaaaatggccatctacatttgtcggatgtccaaccatcctaagaccactatggcgtttctgttctggttttcattcgggtatgttatcacatgcatactctgcaaagctatcttttacttactgattgtggtcggaacccttggcaagaaattcaagcagtatcgcgaattgaagccacagacgtgtactatttgcgagaccaatcccgtgaacgccatcgacgcagagatgcacgatctgaattgtagttacaacatctgcccttattgtgccagcagactaacatctgacggtctcgctaggcatgtaatgcagtgcccaaaacggaaggagaaaattgaagaaactgagctgtaccttaatctggaacgcataccctgggttgtgcgaaagttgctccaagtctccgagtcaaccggggtggcactgaaaagaagcagttggttagtgatcctgctcgtccttctgacagtttctttgtcccctgtgcagagcgccccaatttcg

SEQ ID NO: 10705 - RNA, 972 nt, synthetic construct
  misc_feature 1..972: note = derived and/or modified CDS sequence (opt3) from CCHFV(SPU 383/87)__KJ682806.1__Gn
  source 1..972: mol_type = other RNA
agcgaggaatccaacgacgattgcctgtctagaacccagctccttaggacagagaatgccgaaatccactcagacaactacggcgggcccggagataagattactatatgtaatggtagtacgatcgtggaccaacggctgggcagcgagttggggtgctataccattaaccgcgtcaaatccttcaagttatgtgaaaattctgctacaggaaaatcgtgcgagatcgattcaactcctgttcgatgtcgtcagggcttttgcctgaagattacccaggagggtagagggcatgtgaaactaagcaggggaagtgaagtagtgctcgacgcatgtgattcctcttgcgagatcatgataccaaagggcacaggcgacatcctggtcgattgtagcgggggacagcaacacttccttaaggacaacctggtggatttgggttgcccgaatattcccctcctgggcaaaatggccatctacatttgtcggatgtccaaccatcctaagaccactatggcgtttctgttctggttttcattcgggtatgttatcacatgcatactctgcaaagtgatcttttacttactggtcgtggtaggaacccttggcaagaaattcaagcagtatcgcgaattgaagccacagacgtgtactatttgcgagaccaatcccgttaacgctattgacgccgagatgcacgatctgaattgtagttacaacatctgcccttattgtgcaagcagactaacatctgacggtctcgccaggcatgtgatccagtgcccaaaacggaaggagaaaattgaagaaactgagctgtaccttaatctggaacgcataccctgggtcgtgcgaaagttgctccaagtgtccgagtcaaccggggtcgctctgaaaagaagcagttggttagttatcctgctcgtgcttctgacagtatctttgtcccctgtgcagagcgcaccaatttcg

SEQ ID NO: 10706 - RNA, 972 nt, synthetic construct
  misc_feature 1..972: note = derived and/or modified CDS sequence (opt3) from CCHFV(SPU 130/89)__KJ682807.1__Gn
  source 1..972: mol_type = other RNA
agcgaggaacccaactacgactgcctgtccagaacccagctccttaggacagagaatgccgaaatccactctgataactatggcgggcctggagacaagattactatatgtaatggttcaacgatcgtggatcaacggctgggcagtgagttggggtgctacaccattaaccgcgtcaagagcttcaaattatgtgaaaattccgctacaggaaaatcttgcgagatcgactcgactccagttcgatgtcgtcagggcttttgcctgaagattacccaggagggtagagggcatgtgaaactatcaaggggaagcgaagtagtgctcgatgcatgtgacagttcctgcgagatcatgataccgaagggcacaggcgatatcctggtcgactgttctgggggacagcaacacttccttaaggataacctggtggacttgggttgccccaatattcctctcctgggcaaaatggccatctatatttgtcggatgagcaaccatccaaagaccactatggcgtttctgttctggttttccttcgggtacgttatcacatgcatactctgcaaagtgatcttttatttactgattgtcgtgggaacccttggcaagaaattcaagcagtaccgcgaattgaagccccagacgtgtactatttgcgagaccaatcctgtaaacgctatcgatgccgagatgcacgacctgaattgttcatataacatctgcccatactgtgcaagtagactaacaagcgatggtctcgccaggcatgttatgcagtgccccaaacggaaggagaaaattgaagaaactgagctgtaccttaatctggaacgcataccttgggtggtccgaaagttgctccaagtgtctgagtccaccggggtggctctgaaaagatcaagctggttagtcgttctgctcgtgcttctgacagtaagtttgtctccagtgcagtccgcaccgatcagc

SEQ ID NO: 10707 - RNA, 972 nt, synthetic construct
  misc_feature 1..972: note = derived and/or modified CDS sequence (opt3) from CCHFV(SPU 497/88)__KJ682808.1__Gn
  source 1..972: mol_type = other RNA
agcgaggaatccaacgacgattgcctgtctagaacccagctccttaggacagagaatgccgaaatccactcagacaactacggcgggcccggagataagattactatatgtaatggtagtacgatcgtggaccaacggctgggcagcgagttggggtgctataccattaaccgcgtcaaatccttcaagttatgtgaaaattctgctacaggaaaatcgtgcgagatcgattcaactcctgttcgatgtcgtcagggcttttgcctgaagattacccaggagggtaaagggcatgtgaagctaagcagaggaagtgaagtagtgctcgacgcatgtgattcctcttgcgagatcatgataccaaagggcacaggcgacatcctggtcgattgtagcgggggacagcaacacttccttaaagacaacctggtggatttgggttgcccgaatattcccctcctgggcaagatggccatctacatttgtaggatgtccaaccatcctaaaaccactatggtttttctgttctggttttcattcgggtatgtgatcacatgcatactctgcaaggtcatcttttacttactgattgtggtaggaacccttggcaaaaagttcaagcagtatcgggaattgaaaccacagacgtgtactatttgcgagaccaatcccgttaacgcgatcgacgctgagatgcacgatctgaattgtagttacaacatctgcccttattgtgccagccgcctaacatctgacggtctcgcaagacatgtgatgcagtgcccaaagaggaaagaaaagattgaggaaactgagctgtaccttaatctggaacggataccctgggtcgtgcgcaaattgctccaagtgtccgagtcaaccggggtcgccctgaagcgaagcagttggttagttatcctgctcgtgcttctgacagtatctttgtcccctgtgcagagcgctccaatttcg

SEQ ID NO: 10708 - RNA, 972 nt, synthetic construct
  misc_feature 1..972: note = derived and/or modified CDS sequence (opt3) from CCHFV(SPU 18/88)__KJ682810.1__Gn
  source 1..972: mol_type = other RNA
agcgaggaatccaacgacgattgcctgtctagaacccagctccttaggacagagaatgccgaaatccactcagacaactacggcgggcccggagataagattactatatgtaatggtagtacgatcgtggaccaacggctgggcagcgagttggggtgctataccattaaccgcgtcaaatccttcaagttatgtgaaaattctgctacaggaaaatcgtgcgagatcgattcaactcctgttcgatgtcgtcagggcttttgcctgaagattacccaggagggtagagggcatgtgaaactaagcaggggaagtgaagtagtgctcgacgcatgtgattcctcttgcgagatcatgataccaaagggcacaggcgacatcctggtcgattgtagcgggggacagcaacacttccttaaggacaacctggtggatttgggttgcccgaatattcccctcctgggcaaaatggccatctacatttgtcggatgtccaaccatcctaagaccactatggggtttctgttctggttttcattcggatatgttatcacatgcatactctgcaaagtgatcttttacttactgattgtcgtgggcacccttggtaagaaattcaagcagtatcgcgaattgaagccacagacgtgtactatttgcgagaccaatcccgtaaacgcgatcgacgctgagatgcacgatctgaattgtagttacaacatctgcccttattgtgccagcagactaacatctgacgggctcgcaaggcatgttatgcagtgcccaaaacggaaggagaaaattgaagaaactgagctgtaccttaatctggaacgcataccctgggtggtccgaaagttgctccaagtgtccgagtcaaccggagtggccctgaaaagaagcagttggttagtcatcctgctcgttcttctgacagtgtctttgtcccctgtacagagcgctccaatttcg

SEQ ID NO: 10709 - RNA, 972 nt, synthetic construct
  misc_feature 1..972: note = derived and/or modified CDS sequence (opt3) from CCHFV(SPU 48/90)__KJ682813.1__Gn
  source 1..972: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaagagcttcaaattgtgtgaaaattccgctactggcaaatcttgcgttattgattcggtgccagtaaagtgtcgacagggttactgcttacgtatcacccaggaggggagaggacatgtgaaactgtcaaggggcagcgaggtcgtgctagacgcatgtgatacaagttgcgaaataatgatcccgaagggcaccggggacattctcgttgattgttccggaggtcagcaacactttctgaaggacaaccttatcgatctgggctgccccaaaattcctttgctcgggaagatggccatctatatatgtcggatgtctaatcatccaactacaaccatggcgttcctgttttggttcagctttggatacgtgattacgtgcatcctgtgcaaagctattttctatctcttaatcatcattggcactctgggtaagcgctttagacagtacagggagcttaaaccccagacctgtacaatatgcgaaactacccctgtcaacgccatcgacgcagagatgcacgatttgaattgttcctataacatttgcccatactgtgcctcacggctgacaagtgacgggctagctcgccatgtgacccagtgccccaagcgaaaggagaaagtagaagagacggaactctacctgaatcttgagagaatcccttgggttgtgaggaagctgttgcaagtcagcgaatctactggagtggcactcaaacggtcctcatggctgatagtgttactggtcctcttcacagttagccttagtccagtgcagtctgccccgattggc

SEQ ID NO: 10710 - RNA, 972 nt, synthetic construct
  misc_feature 1..972: note = derived and/or modified CDS sequence (opt3) from CCHFV(SPU 187/90)__KJ682814.1__Gn
  source 1..972: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaagagcttcaaattgtgtgaaaattccgctactggcaaatcttgcgagattgattcggttccagtgaagtgtcgacagggttactgcttacgtatcacccaggaggggagaggacatgtaaaactgtcaaggggcagcgaagtggtcctagacgcatgtgatacaagttgcgagataatgatcccgaagggcaccggggacattctcgtggattgttccggaggtcagcaacactttctgaaggacaaccttatcgatctgggctgccccaaaattcctttgctcgggaagatggccatctatatatgtcggatgtctaatcatccaaaaactacaatggcgttcctgttttggttcagctttggatacgttattacctgcatcctgtgcaaggctattttctatctcttaatcatcattggcacgctgggtaaacgctttaagcagtacagagaacttaagccccagacttgtaccatatgcgagacaactcctgtgaacgccatcgacgcagagatgcacgatttgaattgttcctataacatttgcccatactgtgcctcaaggctgaccagtgacgggctagctcggcatgtcacacagtgccccaaacgcaaggaaaaagtggaggaaaccgagctctacctgaatcttgaacgaatcccttgggtagttagaaagctgttgcaagtgagcgagtctacgggagtcgcactcaaaaggtcctcatggctgatagtgttactggtcctcttcactgtgagccttagtccagttcagtctgccccgattggc

SEQ ID NO: 10711 - RNA, 972 nt, synthetic construct
  misc_feature 1..972: note = derived and/or modified CDS sequence (opt3) from CCHFV(Haskovo-V46/13)__KR092379.1__Gn
  source 1..972: mol_type = other RNA
agcgaggaactgggcgacgattgcatctccagaacccagctccttaggacagagactgccgaaattcacgacgataactacgggggacccggtgacaagataacgatctgtaatggctctaccattgtggatcaacggctggggtcagagttgggatgctatacaatcaaccgcggcaaaagtttcaagttatgtgaaaatagcgctactggtaaaacctgcgagattgactccacacctgtcaagtgtcgacaggggttttgcctgaaaatcacccaggagggacgtggccatgttaagctatctagaggctcggaagtggtactcgatgcatgtgactcaagctgcgaggtgatgataccaaaggggactggagatatcctggtcgactgtagtggtggccagcaacacttccttaaagataacctgattgacttggggtgcccgcatatccccctcctgggaaagatggccatttacatctgtaggatgtccaatcaccctcggacaaccatggcgtttctgttctggttttctttcggctatgtgataacgtgcatcttttgcaaagctctcttctacagcttaattattatcggtactctggggaagaaaatcaagcagtatcgcgaacttaagccacagacctgtacaatttgcgagactacccccgttaacgccatagatgcagagatgcatgacttgaattgttcctacaacatctgcccttattgtgcctcaagactgacaagtgacggactagctaggcacgtgacccagtgcccaaaacggaaggaaaaagtcgaggaaacggagctctacctgaatcttgaacgcattccctggatcgtgcgaaagctgttgcaagtaagcgagtctactggcgttgcactcaaaagatcctcatggctgatagtgttactggtcctccttcctgtgagcctgagtccagtgcagtctgccccggtcggc

SEQ ID NO: 10712 - RNA, 972 nt, synthetic construct
  misc_feature 1..972: note = derived and/or modified CDS sequence (opt3) from CCHFV(24-R-2012)__KR814856.1__Gn
  source 1..972: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgacacttcatgcgaggtcatgataccgaagggcacaggggatatcctcgtggactgtagcggaggtcagcaacacttcctgaaagataaccttattgacctgggctgcccccatatccctttgctcgggaagatggccatttacatctgtaggatgagtaatcacccacggaccacgatggcgtttctgttctggttttccttcggatatgttataacttgcatcttttgcaaagctctgttctactctctcattattatcggcaccttaggtaagaaaatcaagcagtatcgcgaactgaagccccagacatgtactatttgcgagaccgcccctgtgaacgcaatagatgccgagatgcatgaccttaattgtagctacaacatctgcccatattgtgcttccagattgacatcagacgggctggcaaggcacgtcccccagtgccctaaacggaaggaaaaagtggaggaaaccgagctatacctcaatctggaacgcattccatggatcgtacgaaaacttctgcaagttagtgagagcacgggagtggccttgaagagatcttcctggctcatagtcctgttagtgctgctcactgtgtcacttagcccggtccagagtgctcccgttggc

SEQ ID NO: 10713 - RNA, 972 nt, synthetic construct
  misc_feature 1..972: note = derived and/or modified CDS sequence (opt3) from CCHFV(36-ST-2014)__KR814857.1__Gn
  source 1..972: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacagcctcattatcatcggcactttaggtaaaaagattaagcagtatcgggaactgaaaccccagacctgtacaatatgcgagactgcccctgttaacgcaatcgatgccgagatgcatgaccttaattgttcctacaacatttgcccatattgtgcttcacgcttgaccagtgacgggctggcaagacacgtgacacagtgccccaagaggaaagaaaaggtcgaggaaaccgagctatacctcaatctggaacggatcccttggatagtgcgcaaacttctgcaagtaagcgagtctacgggagttgccttgaagcgatcctcatggctcattgtgctgttagtcctgctcactgtgagccttagtccagtgcagtctgctccggtcggc

SEQ ID NO: 10714 - RNA, 972 nt, synthetic construct
  misc_feature 1..972: note = derived and/or modified CDS sequence (opt3) from CCHFV(44-ST-2010)__KR814859.1__Gn
  source 1..972: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgctgtggttctcttttggatatgtgattacgtgcatcttctgcaaggctctcttttacagcttaattatcatcggcactctgggtaaaaagattaagcagtatcgggaacttaaaccccagacctgtacaatatgcgagactgcccctgttaacgcaatcgatgccgagatgcatgacttgaattgttcctacaacatttgcccatattgtgcttcacgcctgaccagtgacgggctagcaagacacgtgacacagtgccccaagaggaaagaaaaggtcgaggaaaccgagctctacctgaatcttgaacggatcccttggatagtgcgcaaactgttgcaagtaagcgagtctacgggagttgccctcaagcgatcctcatggctgattgtgttactggtcctccttactgtgagcctgagtccagtgcagtctgctccggtcggc

SEQ ID NO: 10715 - RNA, 972 nt, synthetic construct
  misc_feature 1..972: note = derived and/or modified CDS sequence (opt3) from CCHFV(47-ST-2013)__KR814861.1__Gn
  source 1..972: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtaagaatagcgctactggcaaaacctgcgaaattgactccacaccagttaagtgtcgccagggtttttgcttaaagatcacccaggaggggcgaggacatgtgaaactgtctcgtggctcggaggtagtgctagatgcatgtgactcaagctgcgaaataatgatcccgaagggcactggggatattctcgtcgactgtagtggaggtcagcaacacttcctgaaagataaccttatcgacctgggctgcccccatattcctttgctcgggaagatggccatctacatatgtagaatgtccaatcacccaaggacaaccatggcgtttctgttctggttttctttcggatatgtgattacgtgcatcttttgcaaagctctgttctacagcctcattatcatcggcactttaggtaagaagattaaacagtatcgggagctgaagccccagacctgtacaatatgcgaaactgcccctgttaacgcaatcgatgccgagatgcatgaccttaattgttcctacaacatttgcccatattgtgcttcacgcttgaccagtgacgggctggcaagacacgtgacacagtgccccaaaaggaaggagaaagtcgaagagaccgaactatacctcaatctggagcggatcccttggatagtgcgcaaacttctgcaagtaagcgaatctacgggagttgccttgaagcgatcctcatggctcattgtgctgttagtcctgctcactgtgagccttagtccagtgcagtctgctccggtcggc

SEQ ID NO: 10716 - RNA, 972 nt, synthetic construct
  misc_feature 1..972: note = derived and/or modified CDS sequence (opt3) from CCHFV(52-R-2014)__KR814862.1__Gn
  source 1..972: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgacacttcatgcgaggtcatgataccgaagggcacaggggatatcctcgtggactgtagcggaggtcagcaacacttcctgaaagataaccttattgacctgggctgcccccatgttcctttgctcgggaagatggccatctacatttgtaggatgagtaatcacccacggaccacgatggcgtttctgttctggttttccttcggatatgtgatcacttgcatattttgcaaagctctgttctactctctcattatcattggcaccttaggtaagaaaatcaagcagtatcgcgaactgaagccccagacatgtactatctgcgagaccgcccctgtcaacgcaattgatgccgagatgcatgaccttaattgtagctacaacatatgcccatattgtgcttccagattgacatcagacgggctggcaaggcacgtgccccagtgccctaaacggaaggaaaaagtagaggaaaccgagctatacctcaatctggaacgcatcccatggattgttcgaaaacttctgcaagtgagtgagagcacgggagtcgccttgaagagatcttcctggctcatcgtgctgttagtgctgctcactgtctcacttagcccggttcagagtgctcccgtgggc

SEQ ID NO: 10717 - RNA, 972 nt, synthetic construct
  misc_feature 1..972: note = derived and/or modified CDS sequence (opt3) from CCHFV(75-R-2012)__KR814863.1__Gn
  source 1..972: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccgcaccagttaagtgtcgacagggtttttgcttaaaaatcacacaggaggggcgtggacatgtgaagctgtctagaggctcggaagtagtgctagatgcctgtgactcaagctgcgaggtcatgataccgaagggcaccggggatatcctcgtggactgtagtggaggtcagcaacacttcctgaaagataaccttattgacctgggctgcccccatatccctttgctcgggaagatggcgatttacatctgtaggatgtccaatcacccacggactacaatggcttttctgttctggttttctttcggatatgttataacctgcatcttttgcaaagccctgttctacagcctcattattatcggcacgttaggtaagaaaatcaagcagtatcgcgaactgaagccccagacttgtaccatttgcgagacagcacctgtgaacgccatagatgctgagatgcatgaccttaattgttcctacaacatctgcccatattgtgcatcaagattgaccagtgacgggctggccaggcacgtcccccagtgccctaaacggaaggaaaaagtggaggaaactgagctatacctcaatctggaacgcattccatggatcgtacgaaaacttctgcaagttagcgagtctacaggagtggctttgaagagatcctcatggctcatagtcctgttagtgctgctcaccgtgagccttagtccggtccagtctgcccccgttggc

SEQ ID NO: 10718 - RNA, 972 nt, synthetic construct
  misc_feature 1..972: note = derived and/or modified CDS sequence (opt3) from CCHFV(75-ST-2010)__KR814864.1__Gn
  source 1..972: mol_type = other RNA
agcgaggaatccggcgacgattgcatctctagaacccagctgctcaggacagagactgccgaaattcacgacgataactacgggggacccggtgacaagataacgatctgtaatggctcaaccattgtggatcaacggcttgggagtgagctgggatgctatacaatcaaccgcgtcaagagcttcaaattgtgtgaaaattccgctactggcaaaacctgcgagattgactctacacctgttaagtgtcgacagggtttttgcttaaaaatcacccaggaggggcgtggacatgtgaagctgtcgagaggctcagaagtagtgctagatgcatgtgacagcagttgcgaggtcatgataccaaagggcactggggatatcctcgtggactgttccggaggtcagcaacacttcctgaaagataaccttattgacctgggctgcccgcatatccccttgctcgggaagatggccatttacatctgtaggatgtctaatcaccctcggacaaccatggcgtttctgttctggtttagcttcggatatgttataacgtgcctgttttgcaaagctctcttctactccttaattatcattggcactctgggtaagaaaatcaagcagtatcgcgaacttagaccacagacctgtacaatctgcgagactgcccccgtgaacgcaattgatgccgagatgcatgacttgaattgttcatacaacatatgcccttattgtgctagtaggctgaccagcgacgggctagcacggcacgtcccacagtgccccaagcgcaaagaaaaggtggaggaaacagagctctacctgaatcttgaacgaatcccttggattgtaagaaaactgttgcaagtttctgagtccaccggagtggccctcaagaggtcaagctggctgatcgtcttactggtgctccttacggtgagtctgtctccagtccagtccgctccggttggc

SEQ ID NO: 10719 - RNA, 972 nt, synthetic construct
  misc_feature 1..972: note = derived and/or modified CDS sequence (opt3) from CCHFV(3820-ST-2007)__KR814868.1__Gn
  source 1..972: mol_type = other RNA
agcgaggaacccggcgacgattgcatctccagaacccagctgctcaagacagagactgccgaaattcacgacgataactacgggtctcctggagacaaaataacgatctgtaatggttcaaccattgtggatcaaaggcttggcagtgagctggggtgctatacaatcaaccgggtcaagagcttcaaattgtgtgaaaattccgctactggaaagacctgcgagattgactctacaccagttaaatgtcgccagggcttttgcttaaagatcacccaggagggtcgagggcatgtgaagctgtcgcgtggatcagaagtagtgctagatgcatgtgacagcagttgcgagataatgatcccgaaaggcactggcgatattctcgtcgactgttccgggggacagcaacacttcctgaaggataaccttatcgacctgggttgcccccatattcctttgctcggcaaaatggccatctacatatgtagaatgtctaatcacccaaggacaaccatggcgtttctgttctggtttagcttcgggtatgtgattacgtgcatcttttgcaaggctctgttctactccctcattatcatcggaactttaggcaaaaagattaagcagtatcgggaactgaaaccccagacctgtacaatatgcgagactgcccctgttaacgcaatcgatgccgagatgcatgaccttaattgttcatacaacatttgcccatattgtgctagtcgcttgaccagcgacggtctggcaagacacgtgacacagtgccccaagaggaaagaaaaggtcgaggaaaccgagctatacctcaatctggaacggatcccttggatagtgcgcaaacttctgcaagtatctgagtccacgggggttgccttgaagcgatcaagctggctcattgtgctgttagtcctgctcgctgtgagtctttctccagtgcagtccgccccggtcgga

SEQ ID NO: 10720 - RNA, 972 nt, synthetic construct
  misc_feature 1..972: note = derived and/or modified CDS sequence (opt3) from CCHFV(4701-ST-2009)__KR814872.1__Gn
  source 1..972: mol_type = other RNA
agcgaggaacccggcgacgattgcatctccagaacccagctgctcaagacagagactgccgaaattcacgacgataactacgggggacctggtgacaaaataacgatctgtaatggctctaccgtggtcgatcaaaggcttgggtcagagctgggatgctatacaattaaccgggttaagagtttcaaattgtgtgaaaatagcgctactggcaagacctgcgagatcgactccacaccagtgaaatgtcgccagggtttttgcttaaagattacccaggaggggcgaggacatgtaaagctgtctcgtggctcggaagtggtcctagatgcatgtgactcaagctgcgagatcatgataccgaaaggcactggggatatcctcgtggactgtagtggaggtcagcaacacttcctgaaggataaccttattgacctgggctgcccccatatccctttgctcgggaaaatggccatttacatctgtagaatgtccaatcacccaaggacaaccatggcgtttctgttctggttttctttcggatatgttataacgtgcatcttttgcaaggctctgttctacagcctcattattatcggcactttaggtaaaaagatcaagcagtatcgggaactgaaaccccagacctgtacaatttgcgagactgcccctgtgaacgcaatagatgccgagatgcatgaccttaattgttcctacaacatctgcccatattgtgcttcacgcttgaccagtgacgggctggcaagacacgtcacacagtgccccaagaggaaagaaaaggtggaggaaaccgagctatacctcaatctggaacggattccttggatcgtacgcaaacttctgcaagttagcgagtctacgggagtggccttgaagcgatcctcatggctcatagtcctgttagtgctgctcactgtgagccttagtccagtccagtctgctccggttggc

SEQ ID NO: 10721 - RNA, 972 nt, synthetic construct
  misc_feature 1..972: note = derived and/or modified CDS sequence (opt3) from CCHFV(5170-R-2011)__KR814873.1__Gn
  source 1..972: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgtctgtgactcaagctgcgagataatgatcccgaaaggcactggggatattctcgtggactgtagtggaggtcagcaacacttcctgaaggataaccttatcgacctgggctgcccccatattcctttgctcgggaaaatggcaatctacatatgtagaatgtccaatcacccaaggacaaccatggcctttctgttctggttttctttcggatatgttattacgtgcatcttttgcaaggcgctgttctacagcctcattatcatcggcactttaggtaaaaagattaagcagtatcgggaactgaaaccccagacctgtacaatatgcgagactgctcctgtgaacgccatcgatgcagagatgcatgaccttaattgttcctacaacatttgcccatattgtgcctcacgcttgaccagtgaagggctggctagacacgtcacacagtgccccaagaggaaagagaaggtggaagagaccgaactatacctcaatctggagcggatcccttggatagtacgcaaacttctgcaagttagcgagtctacgggagtggcattgaagcgatcctcatggctcattgtcctgttagtgctgctcactgtgagccttagtccagtccagtctgccccggttggc

SEQ ID NO: 10722 - RNA, 972 nt, synthetic construct
  misc_feature 1..972: note = derived and/or modified CDS sequence (opt3) from CCHFV(200406546-Turkey)__KR864902.1__Gn
  source 1..972: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgtctgtgactcaagctgcgaggtgatgataccgaagggcactggggatatcctcgttgactgtagtggaggtcagcaacacttcctgaaagataaccttattgacctgggctgcccccatgtgcctttgctcgggaggatggcaatctacatttgtcggatgtccaatcacccacgcacaaccatggcctttctgttctggttttctttcggatatgtcatcacgtgcatattttgcaaggcgctgttctacagcctcattatcattggcactttaggtaaaaagtttaaacagtatagagaactgaagccccagacctgtacaatctgcgagactgctcctgtgaacgccatcgatgcagagatgcatgaccttaattgttcctacaacatttgcccatattgtgcctcaaggttgaccagtgacgggctggctcggcacgtaccccagtgccctaagcgcaaagaaaaggttgaggaaacagagctatacctcaatctggaacgaataccatggatcgtgagaaaacttctgcaagtcagcgagtctaccggagtggcattgaagaggtcctcatggctcattgtgctgttagtcctgctcacggttagccttagtccggtgcagtctgcccccgtaggc

SEQ ID NO: 10723 - RNA, 972 nt, synthetic construct
  misc_feature 1..972: note = derived and/or modified CDS sequence (opt3) from CCHFV(1-CR/HU-2015)__KU161584.1__Gn
  source 1..972: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacacttcctgaaagataaccttattgacctgggctgcccccatatccctttgctcgggaagatggccatttacatctgtaggatgtccaatcacccacggacaaccatggcgtttctgttctggttttctttcggatatgttataacgtgcatcttttgcaaagctctgttctacagcctcattattatcggcactttaggtaagaaaatcaagcagtatcgcgaactgaagccccagacctgtacaatttgcgagactgcccctgtgaacgcaatagatgccgagatgcatgaccttaattgttcctacaacatctgcccatattgtgcttcaagattgaccagtgacgggctggcaaggcacgtcacacagtgccccaaacggaaggaaaaagtggaggaaaccgagctatacctcaatctggaacgcattccttggatcgtacgaaaacttctgcaagttagcgagtctacgggagtggccttgaagagatcctcatggctcatagtcctgttagtgctgctcactgtgagccttagtccagtccagtctgctccggttggc

SEQ ID NO: 10724 - RNA, 972 nt, synthetic construct
  misc_feature 1..972: note = derived and/or modified CDS sequence (opt3) from CCHFV(Gaib)__KX013445.1__Gn
  source 1..972: mol_type = other RNA
agcgaggaatcctctgacgattgcatctcaagaacccagctgctcaggacagagactgccgaaattcacaacgacaattacggcgggcccggagataagataacgatctgtaacggtagtaccattgtggaccaacggcttggcagcgagctggggtgctatacaatcaatcgcgtcaaatccttcaagttgtgtgaaaactctgctactggaaaatcgtgcgagattgattcaatccctgttaagtgtcgacagggcttttgcttaaaaataacccaggagggtcgtgggcatgtgaagctgagcagaggaagtgaagtagtgctagacgcatgtgattcctcttgcgagatcatgattccaaagggcacaggcgacatcctcgtcgattgtagcgggggacagcaacacttcctgaaagacaatcttattgatctgggttgcccgaacatccccttgctcggcaagatggccatatacatttgtaggatgtccaatcatcctaaaaccactatggcgtttctgttctggttttcattcgggtatgtgatcacatgcatcttttgcaaggctattttctacctgctcatcattgttggaaccttaggcaaaaagtttaagcagtatcgggaactgaaaccacagacgtgtactatatgcgagaccacacccgtgaacgccatcgacgcagagatgcacgatcttaattgtagttacaacatttgcccttattgtgccagccgcttgacttctgacggtctggctagacatgtcgtgcactgcccaaagaggaaagaaaagatcgaggaaaccgagctatacctcaatctggaacgggtaccctgggttgtgcgcaaacttctgcaggtctccgagtcaacaggggtggcattgaagcgaagcagttggctcatagtgctgttagtcctgctcaccgtttctctttcccctgtgcaaagcgccccaattgga

SEQ ID NO: 10725 - RNA, 972 nt, synthetic construct
  misc_feature 1..972: note = derived and/or modified CDS sequence (opt3) from CCHFV(Hodzha)__KX013448.1__Gn
  source 1..972: mol_type = other RNA
agcgaggaatccggcgacgattgcatctctagaacccagctgctcaggacagagactgccgaaattcacggggacgattacggaggtcccggcgacaagataacgatctgtaacgggtcaaccattgtggatcaacggcttggaagtgagctgggctgctatacaatcaatcgcgtcaagagcttcaaattgtgtgaaaactccgctactggtaaatcttgcgagattgactcgacccctgttaagtgtcgacaggggtactgcttaaaaatcacacaggagggacgtggccatgtgaagctgtcaagaggcagcgaagtagtgctagatgcatgtgacagttcctgcgaggtcatgataccaaaggggaccggagatatcctcgtggactgttctggtggccagcaacactttctgaaagataatcttattgacctggggtgcccgaggatccccttgctcggaaagatggccatttatatctgtcggatgagcaaccatcctgaaactacaatggcgttcctgttttggttctcctttggctacgttataacctgcattctgtgcaaagctatcttctatctcttaattatcgtgggtacgctggggaagcgctttaaacagtacagagagcttaagccacagacttgtaccatctgcgagacaactcccgccaatgcaattgatgccgaaatgcacgacttgaactgttcatataatatatgcccttactgtgctagtaggctgaccagcgacggactagcacggcatgtcacacagtgcccaaagcgcaaagagaaggtggaagagaccgaactctacctgaaccttgagcgaatcccctggattgtaagaaaactgttgcaagtttctgagtccacgggcgtggccctcaagaggtcaagctggctgatcgtcttactggtcctcttcgctgtgagtctttctcctgtgcagtccgccccaataggc

SEQ ID NO: 10726 - RNA, 972 nt, synthetic construct
  misc_feature 1..972: note = derived and/or modified CDS sequence (opt3) from CCHFV(IbAn7620)__KX013451.1__Gn
  source 1..972: mol_type = other RNA
agcgaggaaccctccgacgattgcatctctagaacccagctgctcaggacagagactgccgaaattcacggcgacaactacgggggacctggtgataagataacgatctgtaatggctcaaccattgtggaccaacggcttgggagtgagctgggatgctatacaatcaaccgcgtcaagagcttcaaattgtgtgaaaattccgctactggcaaaaactgcgagattgattctgttccagtgaagtgtcgacagggttactgcttacgtatcacccaggaggggagaggacatgtaaaactgtcgaggggctcagaaatagtgctagacgcatgtgatacaagctgcgagatcatgattccgaagggcaccggggacatcctcgtcgattgtagtggaggtcagcaacactttctgaaggacaatcttattgatctgggctgccccaaaatccctttgctcgggaagatggccatatatatttgtcggatgtccaaccatccaaaaactacaatggcgttcctgttttggttctcttttggatacgtgattacctgcattctgtgcaaggctatcttctatctcttaatcattataggcacgctgggtaaacgccttaagcagtacagagaattgaagccccagacttgtaccatctgcgagacaactcctgttaatgccattgacgcagagatgcacgatctgaactgtagctataatatctgcccatactgtgcctccaggctaacctcagacgggctcgctcggcatgtgatacagtgccccaaacgcaaggaaaaagtcgaggaaacagagctgtaccttaacctggaacgaatcccttgggtggtaagaaagttgctccaagttagtgagagcaccggagtggcactgaaaaggtcttcctggttaatcgtcctgctcgtgctttttacggtgtcactgagcccagtccagagtgccccgatcggc

SEQ ID NO: 10727 - RNA, 972 nt, synthetic construct
  misc_feature 1..972: note = derived and/or modified CDS sequence (opt3) from CCHFV(K128_76)__KX013454.1__Gn
  source 1..972: mol_type = other RNA
agcgacgagtccggcgatgactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaaatccttcaagttgtgtgagaatagcgctactggtaaatcttgcgaaattgactcgatccctgttaagtgtcgacaggggtactgcttaaaaataacccaggagggacgtggccatgtgaagctgtcaagaggcagcgaggtagtgctagatgcatgtgacagttcctgcgaagtcatgatcccaaaggggacaggagatattctcgtggactgttctggtggccagcaacactttctgaaagataaccttatcgacctggggtgcccgaagattcccttgctcggaaaaatggccatctatatatgtaggatgagcaatcatcctaagaccactatggcgttcctgttttggttctcctttggctacgttattacatgcatcgtgtgcaaagctattttctatctgctcatcatcgtcggtaccttagggaagcggtttaagcagtaccgcgagctgaaaccacagacgtgtactatttgcgaaaccacacccactaacgccatagatgcagagatgcacgaccttaattgttcatataacatctgcccttactgtgccagtagattgaccagcgacggactggctaggcatgtgacacactgcccaaagcggaaagagaaggtagaagagaccgaactatacctcaatctggagcgcattccctgggttgtgcgaaaacttctgcaggtctctgaatccacgggcgtggcattgaagagatcaagctggctcatcgtgctgttagtcctgttcgccgttagtctctctcctgtgcaatccgctccaataagc

SEQ ID NO: 10728 - RNA, 972 nt, synthetic construct
  misc_feature 1..972: note = derived and/or modified CDS sequence (opt3) from CCHFV(K168_40)__KX013457.1__Gn
  source 1..972: mol_type = other RNA
agcgacgagtccggcgatgactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaaatccttcaagttgtgtgagaatagcgctactggtaaatcttgcgaagttgactcgattcctgtgaagtgtcgacaggggtactgcttaaaaatcacccaggagggacgtggccatgtaaagctgtcaagaggcagcgaggtggtcctagatgcatgtgacagttcctgcgaagtgatgataccaaaggggacaggagatatcctcgttgactgttctggtggccagcaacactttctgaaagataaccttattgacctggggtgcccgaagatccccttgctcggaaaaatggccatttatatctgtaggatgagcaatcatcctaagaccactatggcgttcctgttttggttctcctttggctacgtgataacatgcattgtctgcaaagctatcttctatctgctcattatcgtgggtaccttagggaagcggtttaagcagtaccgcgagctgaaaccacagacgtgtactatctgcgaaaccacacccactaacgccattgatgcagagatgcacgaccttaattgttcatataacatatgcccttactgtgccagtagattgaccagcgacggactggctaggcatgtaacacactgcccaaagcggaaagagaaggttgaagagaccgaactatacctcaatctggagcgcatcccctgggtggtccgaaaacttctgcaagtgtctgaatccacgggcgtggcattgaagagatcaagctggctcattgtcctgttagttctgttcgccgtgagtctctctcctgtacagtccgctccaatcggc

SEQ ID NO: 10729 - RNA, 972 nt, synthetic construct
  misc_feature 1..972: note = derived and/or modified CDS sequence (opt3) from CCHFV(K168_125)__KX013460.1__Gn
  source 1..972: mol_type = other RNA
agcgacgagtccggcgatgactgcatctctagaacccagctgctcaggacagaaactgccgagattcacggggataactacggaggtcccggcgacaagataacgatctgtaatgggtcaaccattgtggatcaacggcttggaagtgaactgggctgctatacaatcaaccgcgtcaaatccttcaagttgtgtgagaatagcgctactggtaaatcttgcgaagttgactcgattcctgtgaagtgtcgacaggggtactgcttaaaaatcacccaggagggacgtggccatgtaaagctgtcaagaggcagcgaggtggtcctagatgcatgtgacagttcctgcgaagtgatgataccaaaggggacaggagatatcctcgttgactgttctggtggccagcaacactttctgaaagataaccttattgacctggggtgcccgaaggtgcccttgctcggaaaaatggccatctatatttgtaggatgagcaatcatcctaagaccactatggcgttcctgttttggttctcctttggctacgtcatcacatgcatagtgtgcaaagctattttctatctgctcatcattgtaggtaccttagggaagcggtttaagcagtaccgcgagctgaaaccacagacgtgtactatctgcgaaaccacacccactaacgccatcgatgcagagatgcacgaccttaattgttcatataacatttgcccttactgtgccagtagattgaccagcgacggactggctaggcatgttacacactgcccaaagcggaaagagaaggtggaagagaccgaactatacctcaatctggagcgcataccctgggtcgtgcgaaaacttctgcaagtgtctgaatccacgggcgtcgcattgaagagatcaagctggctcatcgttctgttagtgctgttcgccgtaagtctctctcctgtgcagtccgctccaattggc

SEQ ID NO: 10730 - RNA, 972 nt, synthetic construct
  misc_feature 1..972: note = derived and/or modified CDS sequence (opt3) from CCHFV(K229_194)__KX013463.1__Gn
  source 1..972: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaagggcaaccttatcgatctggggtgcccccatattcctttgctcggaaaaatggccatctacatatgtagaatgtccaatcacccaaggacaaccatggcgtttctgttctggttttctttcggctatgtgattacgtgcatcttttgcaaggctctgttctacagcctcattatcatcggtactttagggaaaaagattaagcagtatcgggaactgaaaccccagacctgtacaatatgcgagactgcccctgttaacgcaatcgacgccgagatgcatgatcttaattgttcctacaacatttgcccatattgtgcttcacgcttgaccagtgacggactggcaagacacgtgacacagtgccccaagaggaaagaaaaggtcgaggaaaccgagctatacctcaatctggaacggatcccttggatagtgcgcaaacttctgcaagtaagcgagtctacgggcgttgccttgaagcgatcctcatggctcattgtgctgttagtcctgctcactgtgagccttagtccagtgcagtctgctccggtcggc

SEQ ID NO: 10731 - RNA, 972 nt, synthetic construct
  misc_feature 1..972: note = derived and/or modified CDS sequence (opt3) from CCHFV(K315_14)__KX013469.1__Gn
  source 1..972: mol_type = other RNA
agcgaggaacccggcgacgattgcatctccagaacccagctgctcaagacagagactgccgaaattcacgacgataactacgggggacctggtgacaaaataacgatctgtaatggctctaccgtggtcgatcaaaggcttgggtcagagctgggatgctatacaattaaccgggttaagagtttcaaattgtgtaagaatagcgctactggcaaaacctgcgaaatcgactccacaccagtgaagtgtcgccagggtttttgcttaaagattacccaggaggggcgaggacatgtaaaactgtctcgtggctcggaggtggtcctagatgtgtgtgactcaagctgcgaaatcatgataccgaagggcactggggatatcctcgttgactgtagtggaggtcagcaacacttcctgaaagataaccttattgacctgggctgcccccatatccctttgctcgggaagatggcaatttacatctgtagaatgtccaatcacccaaggacaaccatggcctttctgttctggttttctttcggatatgtgataacgtgcatcttttgcaaagcgctgttctacagcctcattattatcggcactttaggtaagaagatcaaacagtatcgggagctgaagccccagacctgtacaatttgcgaaactgctcctgtcaacgccatagatgcagagatgcatgaccttaattgttcctacaacatctgcccatattgtgcctcacgcttgaccagtgaggggctggctagacacgtgacacagtgccccaaaaggaaggaaaaagtagaggaaaccgagctatacctcaatctggaacggattccttggatcgttcgcaaacttctgcaagtgagcgagtctacgggagtcgcattgaagcgatcctcatggctcatagtgctgttagtgctgctcactgtcagccttagtccagttcagtctgccccggtgggc

SEQ ID NO: 10732 - RNA, 972 nt, synthetic construct
  misc_feature 1..972: note = derived and/or modified CDS sequence (opt3) from CCHFV(K323_27)__KX013472.1__Gn
  source 1..972: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacctcttaattatcatcggcactctgggtaaaaagattaagcagtatcgggaacttaaaccccagacctgtacaatatgcgagactgcccctgttaacgcaatcgatgccgagatgcatgacttgaattgtagctacaacatttgcccatattgtgcttcccgcctgacctcagacgggctagcaagacacgtgacacagtgccccaagaggaaagaaaaggtcgaggaaaccgagctctacctgaatcttgaacggatcccttggatagtgcgcaaactgttgcaagtaagtgagagcacgggagttgccctcaagcgatcttcctggctgactgtgttactggtcctccttacagtgtcactgagcccagtgcagagtgctccggtcggc

SEQ ID NO: 10733 - RNA, 972 nt, synthetic construct
  misc_feature 1..972: note = derived and/or modified CDS sequence (opt3) from CCHFV(K340_6)__KX013475.1__Gn
  source 1..972: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcactaccggcaagacatgcgagattgactccaccccagttaaatgtcgccagggtttttgcttaaagatcactcaggaggggcgaggacatgtgaagctgtctcgtggctcggaagtagtgctagatgcttgtgactcaagctgcgagataatgatcccgaaaggcacaggggatattctcgtcgactgtagtggaggtcagcaacacttcctgaaggataaccttatcgacctgggctgcccccatattcctccattggggaaaatggcaatctacatatgtagaatgtccaatcaccccaggaccacgatggcctttctcttctggttttctttcggatatgtgattacttgcatcttttgcaaggcgctgttctacagcctgattatcatcggcaccctcggtaaaaagattaagcagtatcgggaattaaaacctcagacatgtactatatgcgagaccgctccagttaacgccatcgatgcagagatgcatgacctgaattgttcctacaacatttgcccctattgtgcctcacgccttacaagtgacgggttggctagacacgtgacccagtgccctaagaggaaagaaaaggtcgaggaaacggagctgtacctaaatctcgaacggatcccatggatagtgcgcaaactgcttcaagtaagcgagtctactggagttgcactgaagcgatcctcatggttgattgtgctcctggtcttactgacagtgagcctcagtccggtgcagtctgcccccgtcggc

SEQ ID NO: 10734 - RNA, 972 nt, synthetic construct
  misc_feature 1..972: note = derived and/or modified CDS sequence (opt3) from CCHFV(Mamon)__KX013478.1__Gn
  source 1..972: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgtcagatgcatgtgacagcagttgcgaggtcatgataccgaagggcactggggatatcctagtggactgttccggaggtcagcaacacttcctcaaagataacctgattgaccttggctgcccccatatccctctgttggggaagatggccatttacatctgtaggatgtctaatcacccacggacaaccgttgcgtttctcttctggtttagcttcggatatgtgataacgtgcatcttttgcaaagctctgttctactccctgattattatcggcactctcggtaagaaaatcaagcagtatcgcgaattaaagccccagacctgtacaatttgcgagactgcccctgtcaacgcaatagatgccgagatgcatgacctgaattgttcatacaacatctgcccatattgtgctagtagacttaccagcgacgggttggcaaggcacgtgccccagtgccctaaacggaaggaaaaagtagaggaaacagagctgtacctaaatctcgaacgcattccatggatcgttcgaaagctgcttcaagtgtctgagtccaccggagtcgccctgaaaagatcaagctggttgatagtgctcctggtgttactgacggtcagtctctctccggttcagtccgctcccgtgggc

SEQ ID NO: 10735 - RNA, 972 nt, synthetic construct
  misc_feature 1..972: note = derived and/or modified CDS sequence (opt3) from CCHFV(Nakiwogo)__KX013484.1__Gn
  source 1..972: mol_type = other RNA
gccgagggcgtgagcaacgactgcgtctccagaacccagctgatcaagacagaagttgctgagattcacgaagattcttacgggggacccggtgagaaaataactatctgtaatggctcaacgattgtggaccaaaggctcgggagtgaacttggatgctataccatcaaccgggtaaagacatacaaactgtgtgagaatagcgcaactgagaagggctgcgaaattgattccgtgcctgtcaaatgtaagcagggtttctgcttgaaggtgacccaggaggggcgcggacatgttaaattatctcgaggcacagaaatcgtgctggacgtctgtgatacctcgtgcgagctaatgataccaaagggcactggggacatcctcgtggattgttcaggaggtcagcaacactttctgcaggacaaccttattgatctgggctgcccgaatgtacccttgctcgggaaaatggccatctatatttgtcgtatgagcaaccatcctaagacaaccatggcgttcctgttttggttcagttttggatacgttatcacgtgcgtggtctgcaaagtgctgttctatctcttaatagtgattggcactctgggtaagaaacttaagcagtacagagagttgaagccacagacctgtatcgtctgcgaatccattcccgttaatgtgatcgacgctgagatgcacgaactgaactgtaattataacatctgcccttactgtgcctctaggctaacaagcgatgggctcgtacggcatgtgactcaatgcccaaaacgcaaggagaaagtcgaagagaccgagctgtaccttaatctggaaaggattccctggttggtgagacggctcctgcaggtttccgagtcaacaggaatggcattaaagcgcagttgttggatgaccacgctgctcatacttctggtggtcagcttgtctcctgtgcagtccgccccagtaggc

SEQ ID NO: 10736 - RNA, 972 nt, synthetic construct
  misc_feature 1..972: note = derived and/or modified CDS sequence (opt3) from CCHFV(Saf)__KX013487.1__Gn
  source 1..972: mol_type = other RNA
agcgaggaacccggcgacgattgcatctccagaacccagctgctcaggacagagactgccgaaattcacgacgataactacgggggacctggtgacaagataacgatctgtaatggctctaccattgtggatcaacggcttgggtcagagctgggatgctatacaatcaaccgcgtcaaaagtttcaagttgtgtgaaaatagcgctactggcaaaacctgcgagattgactccacaccagttaagtgtcgacagggtttttgcttaaaaatcacccaggaggggcgtggacatgtgaagctgtctagaggctcggaagtagtgctagatgcatgtgactcaagctgcgaggtcatgataccgaagggcactggggatatcctcgtggactgtagtggaggtcagcaacactacctgaaagataaccttattgacctgggctgcccccatatccctttgctcgggaagatggccatttatatctgtaggatgtccaatcacccacggacaaccatggcgttcctgttttggttctcttttggatacgttataacgtgcattttctgcaaagctctgttttatagcctcatcattatcggcactttaggtaagaaaatcaagcagtaccgcgaactgaagccccagacctgtacaatttgcgagactgcccctgtgaacgcaatagatgccgagatgcatgaccttaattgttcctataacatctgcccatactgtgcttcaagattgaccagtgacgggctggcaaggcacgtcccccagtgccctaaacggaaggaaaaagtggaggaaacagagctatacctcaatctggaacgcattccatggatcgtacgaaaacttctgcaagttagcgagtctaccggagtggccttgaagagatcctcatggctcatagtcctgttagtgctgctcacggtgagccttagtccggtccagtctgctcccgttggc

SEQ ID NO: 10737 - RNA, 972 nt, synthetic construct
  misc_feature 1..972: note = derived and/or modified CDS sequence (opt3) from CCHFV(Ast199)__KX056051.1__Gn
  source 1..972: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatctacatatgtagaatgtccaatcacccaaggacaaccatggcgtttctgttctggttttctttcggatatgtgattacgtgcatcttttgcaaggctctgttctacagcctcattatcatcggcactttaggtaaaaagattaagcagtatcgggaactgaaaccccagacctgtacaatatgcgagactgcccctgttaacgcaatcgatgccgagatgcatgaccttaattgttcctacaacatttgcccatattgtgcttcacgcttgaccagtgacgggctggcaagacacgtgacacagtgccccaagaggaaagaaaaggtcgaggaaaccgagctatacctcaatctggaacggatcccttggatagtgcgcaaacttctgcaagtaagcgagtctacgggagttgccttgaagcgatgttcctggctcattgtgctgttagtcctgctcactgtgtcacttagcccagtgcagagtgctccggtcggc

SEQ ID NO: 10738 - RNA, 972 nt, synthetic construct
  misc_feature 1..972: note = derived and/or modified CDS sequence (opt3) from CCHFV(Ast137)__KX056057.1__Gn
  source 1..972: mol_type = other RNA
agcgaggaacccggcgacgattgcatctccagaacccagctgctcaagacagagactgccgaaattcacgacgataactacgggggacctggtgacaaaataacgatctgtaatggctctaccattgtggatcaaaggcttgggtcagagctgggatgctatacaatcaaccgggtcaagagtttcaaattgtgtgaaaatagcgctactggcaagacctgcgagattgactccacaccagttaaatgtcgccagggtttttgcttaaagatcacccaggaggggcgaggacatgtgaagctgtctcgtggctcggaagtagtgctagatgcatgtgactcaagctgcgagataatgatcccgaaaggcactggggatattctcgtcgactgtagtggaggtcagcaacacttcctgaaggataaccttatcgacctgggctgcccccatattcctttgctcgggaaaatggccatccacatatgtagaatgtccaatcatccaaggacaaccatggcgtttctgttctggttttctttcggatacgtgattacgtgcatcttttgcaaggctctgttctatagcctcattatcatcggcactttaggtaaaaagattaagcagtaccgggaactgaaaccccagacctgtacaatatgcgagactgcccctgttaacgcaatcgatgccgagatgcacgaccttaattgttcctataacatttgcccatactgtgcttcacgcttgaccagtgacgggctggcaagacacgtgacacagtgccccaagaggaaagaaaaggtcgaggaaaccgagctatatctcaatctggaacggatcccttggatagtgcgcaaacttctgcaagtaagcgagtctacgggagttgccttgaagcgatcctcatggctcattgtgctgttagtcctgctcactgtgagccttagtccagtgcagtctgctccggtcggc

SEQ ID NO: 10739 - RNA, 972 nt, synthetic construct
  misc_feature 1..972: note = derived and/or modified CDS sequence (opt3) from CCHFV(Ast133)__KX056060.1__Gn
  source 1..972: mol_type = other RNA
agcgaggaacccgacgatgactgcatctccagaacccagctgctcaagacagagactgccgaaattcacgatgacaactacggcgggcctggagataaaataacgatctgtaatggttctaccattgtggaccaaaggcttggctcagagctggggtgctatacaatcaaccgggtcaagagtttcaaattgtgtgaaaatagcgctactggaaagacctgcgagattgattccacaccagttaaatgtcgccagggcttttgcttaaagatcacccaggagggtcgagggcatgtgaagctgtctcgtggatcggaagtagtgctagacgcatgtgattcaagctgcgagataatgatcccgaaaggcactggcgacattctcgtcgattgtagtgggggacagcaacacttcctgaaggacaaccttatcgatctgggttgcccccatattcctttgctcggcaaaatggccatctacatatgtagaatgtccaatcacccaaggacaaccatggcgtttctgttctggttttctttcgggtatgtgattacgtgcatcttttgcaaggctctgttctacctcttaattatcatcggaactctgggcaaaaagattaagcagtatcgggaacttaaaccccagacctgtacaatatgcgagactgcccctgttaacgcaatcgacgccgagatgcatgacttgaattgtagctacaacatttgcccatattgtgcttcccgcctgacctcagatggtctagcaagacacgtgacacagtgccccaagaggaaagaaaaggtcgaggaaaccgagctctacctgaatcttgaacggatcccttggatagtgcgcaaactgttgcaagtaagtgagagcacgggggttgccctcaagcgatcttcctggctgattgtgttactggtcctccttactgtgtcactgagcccagtgcagagtgctccggtcgga

SEQ ID NO: 10740 - RNA, 972 nt, synthetic construct
  misc_feature 1..972: note = derived and/or modified CDS sequence (opt3) from CCHFV(SK/2015/human)__KX458183.1__Gn
  source 1..972: mol_type = other RNA
agcgaggaatccggcgacgattgcatctctagaaccaggctgctccggacagagactgccgaaattcacggggactcatacggaggtcccggcgataagataacgatctgtaacgggagtaccattgtggaccagcgccttggaagcgagatgggctgctatacaatcaatcgagtcaaatccttcaagctgtgtgaaaactctgctactggtaaatcgtgcgagattgattcaatccctgttcgttgtagacaagggtactgcttgaagataacccaggagggaaggggccatgtgaaattaagccggggcagtgaagtagtgctggacgcatgtgattcctcttgcgaggtcatgatcccaaaggggacaggagacattctagtggattgtagcggtggccagcagcactttctcaaggacaatctgatcgatcttgggtgcccgaacattcccctgttgggaaaaatggccatctatatatgtcgcatgtccaatcatcctaagaccactatggcgttcctcttttggttctcatttggctacgttattacatgcatcctgtgcaaagctattttctatctgctcatcatcgtgggtaccttagggaagagatttaaacaatacagggaactgaagccacagacgtgtactatttgcgagaccacacccgccaacgcaatagacgccgagatgcacgatcttaattgtagttatactatctgcccttactgtgctagccggttgacctctgacggactggcacgccatgtcacacagtgcccaaagcgaaaagaaaaggtggaggaaaccgagctatacctcaacctggaaaggattccctgggtagttagaaaacttctgcaagtgtccgagtcaacgggcgtcgccttgaagcggagcagttggctcatcgtgctgttagtgctgttcactgtctctctctcccctgttcagagcgctccaataggc

SEQ ID NO: 10741 - RNA, 972 nt, synthetic construct
  misc_feature 1..972: note = derived and/or modified CDS sequence (opt3) from CCHFV(YL16070)__KY354081.1__Gn
  source 1..972: mol_type = other RNA
gccgagggcgggagctccgactgcatctctagaacccagctggtgaagacagaagtcgctgagattcacgaagattcatacggaggtcccggcgagaaaataactatctgtaacgggagtacgattgttgaccaaaggctcggaagcgaacttggctgctataccatcaatcgggtgaagtcctacaaactgtgtgagaactctgcatcgggtaagtcatgcgagattgatagcatccctgtaaaatgtaagcaggggttctgcttgaagataacacaggaaggacgcggccatgtgaaattaagtcgaggcactgagatcgtcctggacgtgtgtgattcctcttgcgaactaatgattccaaaggggaccggagacatcctcgttgattgtagcggtggccagcaacactttctgcagaataaccttattgacctggggtgcccgaatgtgcccttgctcggaaaaatggccatctatgtctgtcgtatgtccaaccatcctaagacaaccatggcgttcctgttttggttctcatttggctacgtgataacttgcattgtatgcagagttctgttctatctcttaatcgctattggtacagtggggaaaaagctgaagcagtacagggagcttaaaccacagacctgtatcgtctgcgagagtgtgcccgtgaatgccatcgatgcagaaatgcacgagttgaactgtagctataatatttgcccttactgtgcctctcggctgtccacggacggactaatacgccatgtcactcaatgcccaaagagaagggaaaaagttgaggaaaccgagctctttctgaaccttgagcggatcccctggctggtgcgcaagttgctccaggtatcagaaagcacaggcatggctctgaaacgaagttgttggatgattactttactgatcctccttctggtgtctatgtcccctgtccagagcgcaccagtgggc

SEQ ID NO: 10742 - RNA, 972 nt, synthetic construct
  misc_feature 1..972: note = derived and/or modified CDS sequence (opt3) from CCHFV(UCCR4448)__KY484042.1__Gn
  source 1..972: mol_type = other RNA
agcgaggaaacctccgacgattgcatctctagaacacagctgctcaggactgagacggccgaaattcacggcgacaactacgggggacccggtgataagataaccatctgtaatggctcaacaattgtggaccaacggcttgggagtgagctgggatgctatactatcaaccgcgtcaagagcttcaaattgtgtgaaaattccgctaccggcaaatcttgcgagattgattcggttcctgtgaagtgtcgacagggttactgcttacgtatcacacaggaggggagaggacatgtaaaactgtcaaggggcagcgaagtggtcctagacgcatgtgataccagttgcgagataatgatcccaaagggcactggggacattctcgtggattgttccggaggtcagcaacactttctgaaggacaaccttatcgatctgggctgcccgaaaattcccttgctcgggaagatggccatctatatatgtcggatgtctaatcatcctaaaacaaccatggcgttcctgttttggttcagctttggatacgttattacgtgcatcctgtgcaaggctattttctatctcttaatcatcattggcactctgggtaaacgctttaagcagtacagagaacttaagccacagacctgtacaatatgcgagactacccccgtgaacgccatcgacgcagagatgcacgatttgaattgttcctataacatttgcccttactgtgcctcaaggctgacaagtgacgggctagctcggcatgtcacccagtgcccaaaacgcaaggaaaaagtggaggaaacggagctctacctgaatcttgaacgaatcccctgggtagttagaaagctgttgcaagtgagcgagtctactggagtcgcactcaaaaggtcctcatggctgatagtgttactggtcctcttcacaattagccttagtcctgtgcagtctgccccaatctcc

SEQ ID NO: 10743 - RNA, 972 nt, synthetic construct
  misc_feature 1..972: note = derived and/or modified CDS sequence (opt3) from CCHFV(SPU 45/88)__KJ682809.1__Gn
  source 1..972: mol_type = other RNA
agcgaggaatcctctgacgattgcctgtcaagaacccagctccttaggacagagaacactgaaatccacagtgacaattacggcgggcccggagataagattacgatatgtaacggtagcaccatcgtggaccaacggctgggctccgagttggggtgctatacaattaatcgcgtcaaatctttcaagttatgtgaaaactcggccactggaaaatcatgcgagatcgatagcacccctgttcgatgtcgtcagggcttttgcctgaagattacacaggagggtagagggcatgtgaaactaagtaggggatccgaagtagtgctcgacgcttgtgattctagctgcgagatcatgataccaaagggcaccggcgacatcctggtcgattgttccgggggacagcaacacttccttaaggacaatctggtggatttgggttgcccgaacattcccctcctgggcaaaatggcaatctacatttgtcggatgtcaaatcatcctaagactacaatggggtttctgttctggtttagtttcggatatgttattacctgcatactctgcaaagtgatcttttacttactgatcgtcgtgggcacgcttggtaagaaattcaagcagtatcgcgaattgaagccacagacttgtaccatttgcgagacaactcccgtaaacgccatcgacgcggagatgcacgatctgaattgtagctacaacatctgcccttattgtgcttctagactaacctccgacgggctcgccaggcatgttatgcagtgcccaaaacggaaggagaaaattgaagaaacagagctgtaccttaatctggaacgcataccctggatcgtgcgaaagttgctccaagtctcagagagcaccggagtggcactgaaaagaagttcttggttagtggtcctgctcgttcttctgacggtgtccttgagccctgtacagtcggccccaattggc

SEQ ID NO: 10744 - RNA, 1932 nt, synthetic construct
  misc_feature 1..1932: note = derived and/or modified CDS sequence (opt3) from CCHFV(10200)__U39455.2__Gc
  source 1..1932: mol_type = other RNA
ttcctggacagcaccgccaagggcatgaaaaacctccttaattccacatctctggagacttcattgagtatcgaagctccctggggtgcaattaacgtgcagagcacgtacaagcctaccgtctccacagccaatatagcgttatcttggtcgtcagttgagcacagaggaaacaaaatcctggtgagcggtaggagtgaatccattatgaagctagaggaacggactggcatctcttgggatctcggggtagaggacgctagcgagtccaaactgcttaccgtgtcagtcatggatctgagtcaaatgtatagcccagtgtttgaatacttgtctggagaccgccaggttgaggaatggccgaaggccacatgcaccggcgattgtcccgagcgatgcggttgtacttcctcaacatgcctccataaggagtggcctcacagccgtaattggagatgtaacccaacctggtgctggggagtggggacgggctgtacttgctgtggcctggacgtcaaagatctgttcaccgactatatgtttgtgaagtggaaagtagaatacattaagacagaggcaatcgtttgcgtggaactcactagccaggagaggcagtgttctttaatagaagccgggacccggttcaatctgggacccgtcacaatcaccctttccgagcctcgcaacattcaacagaaattgccacccgagatcattacgctgcatcctagaatcgaagaggggtttttcgatctaatgcacgtgcagaaggtgctcagcgcttcgactgtctgcaagctgcagtcttgcacacatggcgttccaggggaccttcaagtgtatcacataggaaatctgttgaaaggcgataaggtaaacggtcacctcattcataaaatcgaaccgcactttaatacctcctggatgtcatgggacgggtgtgatctggactactattgcaacatgggagactggcccagttgtacttacacaggcgtgacccagcataatcacgcaagtttcgtcaacttactgaatattgagacggattacaccaagaactttcacttccattccaaaagggtgacagcccacggcgacactcctcagctcgatcttaaggctcggccaacctatggggccggagaaatcacagttctggtggaggtcgcggacatggagttgcatactaaaaagatcgaaatttctggtctaaagtttgcaagcctggcctgcaccggctgttacgcttgctcaagttccataagctgtaaagtgcgcatccacgtagatgagcccgacgaactcacagttcatgtgaagtctgatgaccctgatgtcgtggccgcatcaagtagcctgatggctcgaaaacttgagttcgggaccgactccacttttaaggccttctctgcgatgccaaaaacgtcgctgtgcttctatattgtcgaaagagagcactgtaagagctgctccgaggaagatacaaagaaatgtgtgaacaccaagttggagcagccccaatcaatcctcatagaacacaaaggaactattatcggcaagcagaatagtacctgcacagccaaagcatcttgctggctggagagcgttaagtcctttttctacggtttaaagaacatgctgtcagggatctttggcaatgtgttcatgggaatttttctattcctcgctccgtttatcctgcttattttgttctttatgttcggctggaggatactgttttgtttcaaatgctgtcggcgtacccgcgggctctttaagtatagacatctgaaagacgacgaggaaactggatacaggcggatcattgagaaacttaacaataagaagggtaagaacaaactgttggatggcgaacgactcgccgacgggcgcatcgctgagctgttcagcacaaagacgcacatcgga

SEQ ID NO: 10745 - RNA, 1932 nt, synthetic construct
  misc_feature 1..1932: note = derived and/or modified CDS sequence (opt3) from CCHFV(IbAr10200)__AF467768.2__Gc
  source 1..1932: mol_type = other RNA
ttcctggacagcaccgccaagggcatgaaaaacctccttaattccacatctctggagacttcattgagtatcgaagctccctggggagcaattaacgtgcagagcacgtacaagcctaccgtctccacagccaatatagcgttatcttggtcgtcagttgagcacagagggaacaaaatcctggtgagcggtaggagtgaatccattatgaagctagaggaacggactggcatctcttgggatctcggggtagaggacgctagcgagtccaaactgcttaccgtgtcagtcatggatctgagtcagatgtatagcccagtgtttgaatacttgtctggagaccgccaggttggcgagtggccgaaggccacatgcaccggtgattgtcccgaacgatgcgggtgtacttcctcaacatgcctccataaggagtggcctcacagccgtaattggagatgtaacccaacctggtgctggggagtgggcacgggctgtacttgctgtgggctggacgtcaaagatctgttcaccgactatatgtttgtgaagtggaaagtagagtacattaagacagaagcaatcgtttgcgtggagctcactagccaggaaaggcagtgttctttaatagaggccggaacccggttcaatctgggtcccgtcacaatcaccctttccgaacctcgcaacattcaacagaaattgccacccgagatcattacgctgcatcctagaatcgaggaaggctttttcgatctaatgcacgtgcagaaggtgctcagcgcttcgactgtctgcaagctgcagtcttgcacacatggggttccaggagaccttcaagtgtatcacataggcaatctgttgaaaggtgataaggtaaacgggcacctcattcataaaatcgagccgcactttaatacctcctggatgtcatgggacggatgtgatctggactactattgcaacatgggcgactggcccagttgtacttacacaggcgtgacccagcataatcacgcaagtttcgtcaacttactgaatattgaaacggattacaccaagaactttcacttccattccaaaagggtgacagcccacggggacactcctcagctcgatcttaaggctcggccaacctatggagccggtgagatcacagttctggtggaagtcgcggacatggagttgcatactaaaaagatcgagatttctggcctaaagtttgcaagcctggcctgcaccgggtgttacgcttgctcaagtggaatatcctgtaaagtgcgcatccacgtagatgaacccgacgagctcacagttcatgtcaagagcgatgaccctgatgtggtggccgcatcttcaagtctgatggctcgaaaacttgagttcggcaccgacagcacttttaaggccttctccgcgatgccaaaaacgtctctgtgcttctatattgtcgaaagagaacactgtaagtcgtgcagcgaggaggatacaaagaaatgtgtgaacaccaagttggaacagccccaatccatcctcatagagcacaaaggtactattatcgggaagcaaaattcaacctgcacagccaaagcaagttgctggctggaatctgttaagagctttttctacggcttaaagaacatgctgtccggaatctttggcaatgtgttcatggggatttttctattcctcgctccgtttatcctgcttattttgttctttatgttcggatggaggatactgttttgtttcaaatgctgtcggcgtacccgcggtctctttaagtatagacatctgaaagacgacgaggagactggctacaggcggatcattgaaaaacttaacaataagaaggggaagaacaaactgttggatggagagcgactcgccgaccgcagaatcgctgaactgttctcaacaaagacgcacatcggc

SEQ ID NO: 10746 - RNA, 1932 nt, synthetic construct
  misc_feature 1..1932: note = derived and/or modified CDS sequence (opt3) from CCHFV(Turkey-Kelkit06)__GQ337054.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggtacacagagggaacaaaattctggtgacaggtaggagcgagagtatcatgaagctagaggaacggactggcgtctcctgggatctcggggtggaagacgcgtctgagagcaaactgcttaccgtttccattatggatctgtcacaaatgtacagtccagtgttcgagtatttgagcggagaccgccaggtcgaagagtggccgaaggctacatgcaccggcgattgtcccgaacgatgcggttgtacttcttccacatgcctccataaggagtggtcacacagccgtaattggagatgtaaccctacctggtgctggggagtggggacgggctgtacttgctgtggcgtagacgttaaagatctgtttaccgaccatatgttcgtgaagtggaaagtcgagtacatcaagacagaagccatagtgtgcgtggcactgacttcacaggagaggcagtgttctctcatcgaagccgggacccggtttaatttaggaccagtcacaattaccctgtccgagccccgcaacatccaacagaaacttcctccagaaattatcacgttgcaccccaagatagaggagggtttctttgatctgatgcatgttcagaaggtgctaagcgcttcgactgtatgcaaactccagtcttgcacacacggcattcctggggacctgcaagtgtatcacatcggaaatcttctgaagggcgatagagtcaacggtcatttgattcacaaaatcgaatcccatttcaatacctcatggatgagttgggacgggtgtgatctcgactactattgcaacatgggagactggccaagctgtacttacacaggcgtgacccagcacaatcacgcagcctttgttaacctgttaaatatcgagacggattataccaagacattccattttcactccaaaagggtgactgctcatggcgacaccccgcagctggatctcaaggcccggcccacatacggggcgggaggtattactgtccttgtggaagtagcagacatggagctgcacaccaaaaaggttgaaatatctggcttgaagttcgccagcctagcttgcacagggtgttacgcctgctcaagtggaatctcctgtaaagtgcgcattcatgtcgatgagcctgacgagctgaccgtgcacgtcaagagctctgatccagacgtggttgcagcttcaaccagtctcatggcccgaaaactggaatttggcacggatagcacattcaaggcgttctccgccatgcccaaaacctctctttgcttttatatcgtggagagagaatactgtaagtcgtgcagcgaggacgatactcagaagtgtgtagacaccaggctggaacaacctcagtccatattgattgagcacaaaggtacaatcatcgggaagcagaacgacacttgcactgcaaaagctagttgctggctcgagagtgtcaagtctttcttttatggcctgaaaaacatgttaggaagcgtgttcggcaatctgtttattgggatcctactcttcctggccccatttgttcttttggtgctgttctttatgttcggatggaagattctcttttgtttcaagtgctgtcggcgtacacgcggtctgtttaaatacagacatcttaaggatgacgaagagacgggctataggcggataatcgaacgactgaactccaaaaaggggaaaaatcgcttgctcgatggagacagactggctgataggaagattgccgagttattctcaaccaagactcacatcggc

SEQ ID NO: 10747 - RNA, 1935 nt, synthetic construct
  misc_feature 1..1935: note = derived and/or modified CDS sequence (opt3) from CCHFV(SR3)__AJ538199.1__Gc
  source 1..1935: mol_type = other RNA
ctgttcctcgacagcatcgtgaagggcatgaaaaaccttctcaattccacctctttggagacatcattaagtattgaagccccctggggtgctataaacgtccagagcacttacaagcctacggtttccaccgcaaatatcgccctgtcttggtcgtcagtggagcacagaggaaacaaagtgctagtgagcggtaggagtgaatccattatgaagctcgaggaacggacaggcatctcttgggatctgggggtcgaggacgcgagcgagtccaaacttctgactgtgtcagttatggatttgagtcaaatgtatagcccagtgtttgaatacctctctggagaccgccaggtcgaggaatggccgaaggctacctgcacaggcgattgtcccgagcgatgcggttgtacctcctcaacttgcctgcataaggagtggcctcacagccgtaattggagatgtaacccaacatggtgctggggagtggggaccggctgtacgtgctgtggcctggacgtaaaagatctcttcactgactatatgtttgttaagtggaaagtggaatacattaagaccgaggccatcgtctgcgtggaattaacaagtcaggagaggcagtgttctctgatagaagcagggactcggttcaatcttggatccgtgaccatcacattgagcgagccccgcaacattcaacagaaactgcctccagagatcattaccctacatcccaagatcgaagaggggtttttcgatctcatgcacgtccagaaggttctgtcggcctctacggtgtgcaaacttcagtcctgcactcatggcgtacctggggacctgcaagtgtatcacataggaaatttgctcaagggcgatagagtcaacggtcacctgattcataaaatcgaacagcactttaatacatcatggatgagttgggacgggtgtgatttagactactattgcaacatgggagactggccaagctgtacctacactggcgtgacacagcataatcacgcttccttcgttaacctgctcaatattgagaccgattacacgaagacctttcacttccattctaaaagggtgacagcacacggcgacactccgcagcttgatctgaaggcccggcccacctatggggctggagaaatcacagtcttggtggaggtagccgacatggagctacatactaaaaagatcgaaattagcggtctgaagtttgcgggcctgacctgcacagggtgttacgcatgctcaagtggaatatcctgtaaagttcgcatccacgtggatgagcctgacgaactgaccgtccatgtaaagagcgatgacccagatgtcgtggccgcttcttcaagtcttatggcccgaaaactggagttcggcactgacagcacgtttaaggcattctccgctatgcccaaaacatctttgtgcttctatattgttgaaagagagtactgtaagtcgtgcaacaaggaggatacccaaaaatgtgtgaacactaagctcgaacagcctcagagcatcctgatagagcacaaaggtaccattatcgggaagcaaaataacacatgcaccgccaaagcgtcctgctggttagaatcagtaaagagtttcttttatggcctgaagaatatgctaggaggcatctttgggaacgtcttcattggaatctttactttcctcacaccatttattctgcttatattgttctttatgttcggttggaggatcctgttttgtttcaaatgctgtcggcgtacgcgcggcctctttaagtacagacacctgaaagacgacgaggagaccgggtataggaagattatcgaacggcttaataacaaaaagggaaagaatcgactgttggatggcgagcgcctcgccgacagaaaaatcgcagaactgttctctactaagacacatattggt

SEQ ID NO: 10748 - RNA, 1935 nt, synthetic construct
  misc_feature 1..1935: note = derived and/or modified CDS sequence (opt3) from CCHFV(UCCR4413)__KY484038.1__Gc
  source 1..1935: mol_type = other RNA
ttcctgagctccatcgtgaagggcaaaaagaacctccttaattctgcctcactggagaccagtttgagcattgaagctccctggggagcaataaacgcccagtccacatttaaacctactatctctacggcgaatattgctttatcgtggtcaagcgtcgagcacagagggaacaaggttctggtgagtggtaggtccgaatctatcatgaaactagaggaacggaccggcattagctggaatctcggggtagaggacgcctccgagtcacgcatgctgacagtgagtgtcatggatcttagccaaatgtacctgccagtgttcgaatatttgtctggagaccgacaggttgaggaatggccgaaggcaacttgcaccggcgattgtcccgagcgttgcggttgtacatcctcaacctgcctccataaggagtggcctcacagcagaaactggaggtgtaatccaacttggtgctggggagtggggacaggctgtacctgctgtggcctggacgtcaaagatctgtttacggactacatgttcgtgaagtggaaagtagaatatatcaagactgaggccatagtttgcgtggaactcaccagtcaggagcggcagtgttctttaatcgaagctgggacacgctttaacctgggacccgtcactattaccctttccgagcctagaaatatccaacagaaattgccaagcgagattgtgacactgcatcccaagatcgaagagggtttctttgatctaatgcacgtgcagaaggtcctctcggcatctaccgtttgcaaactgcagtcctgcacgcatggcgtggccggggaccttcaagtataccacgtgggaaacctgttgaagggcgataaaataaatggtcactcaattcataagatcgaacctcacctcaacacaagttggatgagctgggacgggtgtgatctggactattactgcaatatgggagattggccatcctgtacttataccggcgtcactcagcataaccacgctgccttcgtgaatttactgaacattgagacagactacaccaaatcttttcacttccatagcaagagggttacggcgcacggcgacaccccgcagctcgatcttaaagcacggcccatgtacggggccggagaaatcacagtgctggtcgaggtggctgacatggagttgcattcaaagaacatcgaaattagtggtctaaagtttgcctccctgacttgcagcggctgttatgcatgttcttcagggataagttgcaaagtacgcatccacgttgatgagcctgacgaactcgctgtgcatgtcaagagcgatgacctggatgtggtcgccgcgtcctcttcgcttatggcccgaaaaattgagttcggaaccgacagcacatttaaggcattctcctcaatgccaaaagaaagtctgtgcttctacatcgtggagagagatttttgtaagtcttgcgctgccgaggacactcagaagtgtgttaaagctaagttggaacaaccccagagcatactcattgagcacaaaggcaccatcatcggtaagcagaatgatacatgctccaccaaaacttcatgctggctggaatctttcaagagctttttctatgggttaaagaacatgctgtccggcgtgtttggaagtgccattatgggcatcctactcttcctggcaccttttattcttttgatactgttctttttctttgggtggaggatcctcttctgtctgcggtgctgtcgtcgcacgagaggactttttaaatacaagcacattaaagacgacgaggaggccggttataagaaaatcatcgaaaagctgaataacaagaaaggcgggacaagcaagttgctcgatggagagaggctggctgaccggaaaattgcggaattattctctaccaaggcacatataggc

SEQ ID NO: 10749 - RNA, 1932 nt, synthetic construct
  misc_feature 1..1932: note = derived and/or modified CDS sequence (opt3) from CCHFV(66019)__AB069669.1__Gc
  source 1..1932: mol_type = other RNA
ttcagcgactccatcgtgaagggcatgaaaaacctgctcaattctacctcacttgagacaagtctgagcattgaagccccctggggagctataaacgtccagtccacttttaagcctacggtttctaccgcaaatatcgccttgtcgtggtcaagcgtggagcacagagggaacaaaattttagtaagtggtaggtccgaatctatcatgaagctggaggaacggacaggcattagctgggatctaggggtggaggacgcgtccgagtcaaaactcctgactgtcagtgtgatggatcttagccaaatgtactctccagttttcgaatatctgtccggagaccgccaggtggaggaatggccgaaggctacctgcacaggcaattgtcccgatcgatgcggttgtacctcaagcacttgcttgcataaggagtggcctcacagtcgtaactggagatgtaatccaacatggtgctggggagtcgggaccggctgtacgtgctgtggcctcgacgtgaaagatctgtttactgactacatgttcgtaaagtggaaagttgagtatatcaagaccgaagccatagtgtgcgtcgagctgaactctcaggaaaggcagtgttccctcatcgaggcagggacacggtttaatttaggacccgtgactattaccctgagcgaacctcgcaacatccaacagaaacttccatcggagattatcacattgcatcccagaatagaggaaggtttctttgatctgatgcacgtgcagaaggtcctatctgcctccaccgtttgcaagctccagtcatgcacgcatggcgtgcctggggacctgcaaatttaccacatcggaaatcttctgaaaggcgatagggtaaacggtcacttgattcataagatcgagccacacttcaataccagttggatgagctgggacgggtgtgatctcgactattactgcaacatgggagactggccgtcctgtacatataccggcgtgactcagcataatcacgctgcatttgtcaacctgttaaacatcgaaacagattacaccaaaaatttccactttcattctaagcgggtgacggcccacggcgacactccccagctggatctcaaagctcgccctacatacggggccggagagattactgttcttgtggaagtcgcggacatggagctgcataccaagaaaatagcaatcagcggtttgaagttcgcctcactaacatgcactggctgttatgcttgcagttccgggattagctgtaaggtgcgaatccacgtagatgagccagacgaactgaccgttcatgtgaaatctgaggatcccgacatagtcgccgcatcaagtagcctcatggctagaaagctggaatttggaacagattccaccttcaaagccttctctgcgatgcctaagacttcgctttgcttttacattgtggagagggaatattgtgagagctgctccaaagaggacacgcagaagtgtgtcaacacaaagctggaacaaccacagtcaatcttgatcgagcacaaaggcaccattatcggtaagcagaatgatacttgcaccgccaaagcaagttgctggctcgaatctgttaagagcttcttttacgggctgaaaaacatgttatccggcattttcggaaatgtgtttataggcatcttcctgtttctagctcccttcattctcctgatcttgtttttcatgtttgggtggcggatccttttctgttttaagtgctgtcgtcgcacaagaggactgttcaagtataggtacctcaaagacgacgaggagtcaggttatcggcgaattatagaacgcctgaacaataagaaaggcaagaacaaacttctggatggggagagattggccgacaggcggatcgctgaactcttcagcaccaagactcacattgga

SEQ ID NO: 10750 - RNA, 1932 nt, synthetic construct
  misc_feature 1..1932: note = derived and/or modified CDS sequence (opt3) from CCHFV(7001)__AB069670.1__Gc
  source 1..1932: mol_type = other RNA
ttcctggacaacatcgccaagggcatgaaaagcctccttaattccacctctctggagacatcattgagtattgaagctccctggggagcaataaacgtgcagagcacttttaagcctacggtctccgccgcgaatatcgctttatcttggtcgtcagttgagcacagagggaacaaaattctggtgagcggtaggagtgaatccatcatgaagctagaggaacggaccggcgtatcttggaatctcggggtggaggatgccagcgagtccaaaacactgactgtctcagtgatggaccttagtcaaatgtacagcccagttttcgaatatctgtctggagatcgccaggtggaggaatggccgaaggcaacctgcacaggcgactgtcccgagcgatgcggttgtacctcctcaacttgcttgcataaggagtggcctcacagccgtaactggagatgtaatccaacatggtgctggggagtcgggaccggctgtacgtgctgtggcctcgatgtgaaagactttttcactgattacatgctggtaaagtggaaagttgaatatattaagaccgaggccatcgtgtgcgtcgaactgacaagtcaggagaggcagtgttctctcatagaagctgggactcggtttaacttaggacccgtgaccatcacactgtccgagcctcgcaatgtgcaacagagacttccacccgagattgtcaccttgcatcctaaaatcgaagagggtttctttgacctgatgcacgttcagaagattctaagcgcatcgacggtgtgcaagctccagtcttgcactcatggcgtaccaggggatttccaagtgtaccacgtcggaaacctgcttaggggcgacaaagtgaatggtcactccatccataagatagaaccgcactttaacacatcatggatgagttgggatgggtgtgacctggattatttctgcaatatgggagactggcccagctgtacctacactggcgttacacagcataaccgggccgcttttattaatatgttgaacatcgagaccgactatacgaaaaccttccactttcactccaagcgcgtgacagcccatggcgatactcctcagctcgacctgaaagcgcgaccagcatacggggccggagaagtcaccgtgttagtagaggttgctgatctggagctccacacaaagaaacttgaagtgtctggtctgaagattgccagcttgacttgctcaggctgttacgcatgcagttccgggatcagctgtaaggtcagaatccatgtgaacgagcccgacgaatttaccgtccacgtgaggtcttcagatcctgacgttgtggctgccggaagtagcctaatggcgcggaaaattgagttcggcgccgattccacattcaaggcattctcttcgatgccaaaagacagcctgtgcttttatatagtagaaaaggattactgttcctcatgcaccgacgatgacactcagaaatgtgtcaatacgaagctcgaccatccccaaagtatcctgattgagcacaagggtacaatcatagggaaacagaacgatacctgctctactaagaccagctgctggcttgagtccgtgaaaggcttcttttatggactgaagaatatgttgtcaggcattttcgggaacgtttttctcggaatcttcctgtttttagctccgttcgtgctgctaatctttttctttttcttcggttggcgtctcctgttttgtcttaaatgctgtcgcagaacaaggggcttgctgaagtacaagcacctcaaagacgaagaggaagccgggtataagaaaattatcgagcggctgaatggaaagaaaggcaagagccagcttttcgatggtgagcgactggctgaccgcaagattgccgaattgttttctaccaaaatacatatcggg

SEQ ID NO: 10751 - RNA, 1932 nt, synthetic construct
  misc_feature 1..1932: note = derived and/or modified CDS sequence (opt3) from CCHFV(75024)__AB069671.1__Gc
  source 1..1932: mol_type = other RNA
ttcctggacagcatcgtgagaggcatgaagaaccagctcaattccacctctcttgagacatcactgagtattgaagccccctggggagctataaacgtccaaagcacttacaaacctacggtttccaccgcaaatatcgccttgtcttggtcgtcagtggagcacagggggaacaagattttagtaagcggtcggagtgaatccatcatgaaactggaggaacgcacaggcatttcttgggatctaggggtggaggacgcgagcgagtccaagctcctgactgtctcagtgatggatcttagtcagatgtatagcccagtttttgaatacctgtctggagaccgacaggtggaggaatggccgaaagctacctgcacaggcgattgtcccgagcgttgcggttgtaccacttccacatgcttgcataaggagtggcctcactcaagaaattggaggtgtaacccaacctggtgctggggagtcgggacgggctgtacttgctgtggcctcgacgtgaaggatctgttcaccgactatatgatcgtaaaatggaaggttgaatacataaaaacagaggccatcgtgtgcgtcgaactgactagccaggagcggcaatgtagtctcattgaagcagggacccgctttaatttaggatctgtgacaatcaccctgtccgagcccagaaacattcagcagaaacttcctccagagatcataacgttgcatcccaggattgaagagggtttctttgatctgatgcacgtgcagaaagtcctaagcgcctcgactgtttgcaagctccaatcttgcacacatggcgtgcctggggacctgcaggtatatcacgtgggaaatcttctgaagggcgataaagtcaacggtcacttgatccataagattgaaccacacctcaatacctcctggatgtcatgggacgggtgtgatctggactactattgcaacatgggagactggccgagttgtacttacacaggcgtgacccagcataatcacgctagcttcgttaacttactgaatatcgagacggattacaccaaatcctttcacttccattctaagcgggtgacagcacacggcgacactccccagctcgatcttaaagcccgccctacctatggggctggagaaatcacagtcctggtggaggtagccgacatggagtttactccaaagaaaattgaaataagcggtttgaagttcgcgtcactaacctgcacaggctgttacgcatgcagttccgggatcagctgtaaggttcgaatccatgtggatgagcccgacgaactgaccgtccacgtgaaatctgatgaccctgatgtcgtggccgcttcaagtagcctcatggccagaaagctggagtttggaactgactccacgttcaaagcattttctgctatgccaaagacatcgctttgcttctatattgttgaaagggagtactgtaaaagctgctccaaggaggatacccaaaagtgtgtgaacactaaactggaacagccccagtcaatattgattgagcataagggcaccatcatcggtaaacaaaacaatacatgcaccgccaaggcgagttgctggctcgaatctgtaaagagcttcttttatgggctgaagaacatgttatccggcattttcggaaatctgtttatgggcatcttcctatttctcgccccgttcattctgcttatattgtttttcatgtttgggtggcggatcctgttctgttttaagtgctgtcgtcgcactagaggactcttcaaatacaggcacctgaaggacgacgaggagacaggttatcggcgaattatcgaacgccttaacaataaaaagggcaaaaacaagctgttggatggggagagactcgcagacaggcggatcgctgaactgttttcaacgaagacccacattgga

SEQ ID NO: 10752 - RNA, 1932 nt, synthetic construct
  misc_feature 1..1932: note = derived and/or modified CDS sequence (opt3) from CCHFV(7803)__AB069672.1__Gc
  source 1..1932: mol_type = other RNA
ttcctggacagcatcgtgagaggcatgaagaaccccctcaattccacctctcttgagacatcactgagtattgaagccccttggggagctataaacgtccagagcacttacaaaccaacggtttccaccgcaaatatcgccttgtcttggtcgtcagtggagcacagggggaacaagattttagtaagcggtcggagtgaatccatcatgaaactggaggaacgcacaggcatttcttgggatctaggggtggaggacgcgagcgagtccaagctcctgactgtctcagtgatggatcttagtcaaatgtatagcccggtttttgaatacctgtctggagaccgacaggtggaggaatggcccaaagctacctgcacaggcgattgtcctgagcgttgcggttgtaccacttccacatgcttgcataaggagtggccacactcaagaaattggaggtgtaaccccacctggtgctggggagtcgggacgggctgtacttgctgtggcctcgacgtgaaggatctgttcaccgactatatgatcgtaaaatggaaggttgaatacataaaaacacgggggatcgtgtgcgtcgagctgactagccaggaacgccagtgtagtctcattgaggccggaaccagatttaatttaggttctgtgacaatcaccctgtccgaacctaggaacattcaacagaagctcccacccgagatcataacgttgcatcctcggattgaggaaggcttctttgatctgatgcacgtgcagaaagtcctaagcgcatcgactgtttgcaagctccagtcttgcacacatggggtgccaggagacctgcaagtatatcacgtgggcaatcttctgaagggtgataaagtcaacgggcacttgatccataagattgagccgcacctcaatacctcctggatgtcatgggacggatgtgatctggactactattgcaacatgggcgactggcccagttgtacttacacaggcgtgacccagcataatcacgccagcttcgttaacttactgaatatcgaaacggattacaccaaatcctttcacttccattctaagcgcgtgacagctcacggggacactcctcagctcgatcttaaagcacgaccaacctatggagccggtgagatcacagtcctggtggaagtagctgacatggagtttactcccaagaaaattgagataagcggcttgaagttcgcctcactaacctgcacagggtgttacgcgtgcagttccggaatcagctgtaaggttaggattcatgtggatgaacctgacgagctgaccgtccacgtgaaatctgatgacccagatgtcgtggcagcctcaagtagcctcatggctagaaagctggaatttggcactgactccacgttcaaagccttttctgcaatgcccaagacatcgctttgcttctatatcgttgagcgggaatactgtaaaagctgctccaaggaggatacccagaagtgtgtgaacactaaactggagcaaccgcagtcaatattgattgaacataagggtaccatcatcgggaaacagaacaatacatgcaccgctaaggccagttgctggctcgagtctgtaaagagcttcttttatggcctgaagaacatgttatccggaattttcggcaactttttcatggggatctttctgttcctagcgccttttattctcctgatacttttctttatgttcggatggcgtatcttgttttgtttcaagtgctgtcgcagaactaggggtctgtttaaataccggcacctcaaggacgacgaagagacaggctatcgacgcattatcgagagactgaataataaaaaggggaaaaacaaacttctggatggagaaaggttggccgaccggcgcatcgcagagcttttctcaacgaagacccacattggc

SEQ ID NO: 10753 - RNA, 1932 nt, synthetic construct
  misc_feature 1..1932: note = derived and/or modified CDS sequence (opt3) from CCHFV(79121)__AB069673.1__Gc
  source 1..1932: mol_type = other RNA
ttcctggacagcaccgccaagggcatgaaatccctccttaactctacatcactggagacgagtttgagcatcgaagctccctggggagcaattaatgtgcagtccacttttaagcctaccgtctctgccgcgaacatagctttatcgtggtcaagcgttgagcacagaggaaataaaatcctggtgagtggtaggtccgaatctattatgaagctagaggaacggacaggcgtaagctggaacctcggggtggaggatgcctccgagtcaaaaactctgaccgtcagtgtgatggaccttagccaaatgtactctccagttttcgaatatctgtccggagatcgccaggtggaggaatggccgaaggcaacatgcaccggcgactgtcccgagcgatgcggttgtacttcaagcacatgcttgcataaggagtggcctcacagtcgtaattggagatgtaacccaacctggtgctggggagtcgggacgggctgtacttgctgtggcctcgatgtgaaagactttttcaccgattacatgctggtaaagtggaaagttgaatatatcaagacagaggccattgtgtgcgtcgaactgacttctcaggagaggcagtgttccctcatcgaagctgggacccggtttaatttaggacccgtgacaataaccctgagcgagcctcgcaacgtgcaacagagacttccacccgagatcgtcacgttgcatcctaaaattgaagagggtttctttgacctgatgcacgttcagaagatcctatcggcatctactgtgtgcaagctccagtcctgcacacatggcgtaccaggggatttccaaatttaccacgtgggaaatctgcttaggggcgacaaagtcaacggtcactcaatccataagatagaaccgcactttaataccagttggatgagctgggatgggtgtgacctggattatttctgcaacatgggagactggccctcctgtacttacacaggcgtgacccagcataatcgggccgcttttattaacatgttgaatatcgagacggactataccaaaacattccactttcactctaagcgcgttactgcccatggcgatacccctcagctcgacctgaaagcgcgaccagcatacggggccggagaagtgacagtcttagtggaggtagctgatctggagctccacactaagaaccttgaagttagcggtctgaaaattgcctcattgacctgcagtggctgttacgcatgctccagcgggatctcttgtaaggtgagaatccatgtcaacgagcccgacgaatttacagtgcacgtcaggtcaagtgatcctgacgtggttgctgccggaagctccctaatggcgcggaagattgagttcggcgccgattctaccttcaaagcattctcgagcatgccaaaggactccctgtgcttttatatagtggaaaaagattactgttcaagttgcactgacgatgacacgcagaagtgtgtaaatacaaaactcgaccatccccaatctatcctgattgagcacaagggtaccatcatagggaagcagaacgatacttgcagcaccaaaacatcctgctggcttgagtcagtcaagggcttcttttatggactgaaaaatatgttgagcggcattttcgggaacgtgtttctcggaatcttcctgtttttagctccgttcgttctgctaatctttttctttttcttcggttggcgtctcctgttttgtcttaagtgctgtcgcagaaccaggggcttgctgaaatacaagcacctcaaggacgaagaggaagccgggtataaaaagattatcgagcggctgaatgggaaaaagggcaaatctcagcttttcgatggtgagcgactggctgaccgcaagattgccgaattgttttccactaagatacatatcggg

SEQ ID NO: 10754 - RNA, 1932 nt, synthetic construct
  misc_feature 1..1932: note = derived and/or modified CDS sequence (opt3) from CCHFV(8402)__AB069674.1__Gc
  source 1..1932: mol_type = other RNA
ttcagcgactccatcgtgaagggcatgaaaaacctgctcaattctacctcacttgagacaagtctgagcattgaagccccctggggagctataaacgtccagtccacttttaagcctacggtttctgcagccaatatcgcgttgtcgtggtcaagcgtggagcacagagggaacaaaattttagtaagtggtaggtccgaatctatcatgaagctggaggaacggaccggcattagctgggatctaggggtggaggacgcttccgagtcaaaactcctgacagtcagtgtgatggatcttagccaaatgtactctccagttttcgaatatctgtccggagaccgccaggtggaggaatggccgaaggccacttgcaccggcgattgtcccgagcgatgcggttgtacatcatctacctgcttgcataaggagtggcctcacagtcgtaattggagatgtaacccaacttggtgctggggagtcgggacaggctgtacctgctgtggcctcgacgtgaaagatctgtttacggactacatgttcatcaagtggaaagtagaatatataaagactgaggcaatcgtttgcgtggaactgacctctcaggagaggcagtgtacactcattgaagccgggactcggtttaatttaggacccgtcaccatcacactgtccgagcctcgcaacattcaacagaaacttccacccgagatcgtgaccttgcatcctagaatagaagagggtttctttgatctgatgcacgtgcagaaggtcctaagcgcttcgacggtttgcaagctccagtcttgcactcatggcgtgccaggggacctgcaagtataccacattggaaatcttctgaaaggcgataaggtgaacggtcacttgatccataaaattgaaccgcacttcaatacatcctggatgtcatgggacgggtgtgatctcgactattactgcaacatgggagactggcccagttgtacctatactggcgtcacacagcataatcacgcagcctttgtgaacatgctgaatatcgagaccgattacacgaagaacttccactttcatagcaaaagggttaccgctcacggcgacacacctcagttagatctgaaggcccggccaacttacggggcgggagaaatcaccgtgctcgtcgaggtggcagacatggagcttcatacaaagaagattgaaatatccggtctgaagttcgcctctttgacttgcaccggctgttatgcttgcagctcagggatcagttgtaaagtacgcattcacgttgatgagcccgacgaactaacagtgcatgtcaagtccgaggatcctgacatcgtggccgcaagcagctcactgatggctcgaaaactcgaatttggaaccgatagtactttcaaggccttcagcgcgatgccaaaaacgtccctgtgcttttacatagtcgagagagagtattgtaagtcttgctcgaaggaagacacacagaaatgtgtgaacaccaaacttgagcaaccccagagcattctgatcgaacacaaaggcactatcattggtaagcagtccaatacctgcacagccaaagcatcatgctggttggagagtgttaagtctttcttttacgggctcaagaacatgctgagcggcatcttcggaaatgtgtttattggcgtattcttatttttcgctccgtttatactgctaatcctcttctttatgttcgggtggaggattctgttttgtttcaaatgctgtcggcgtacccgcggacttttcaagtatagacacttgaaagatgacgaggaaactggttacaggaagatcatcgagcggctgaacaataaaaagggcaagaacaaactcctggacggggaacgacttgccgatcgcaagattgctgagctgttttccacaaaaacgcatatagga

SEQ ID NO: 10755 - RNA, 1932 nt, synthetic construct
  misc_feature 1..1932: note = derived and/or modified CDS sequence (opt3) from CCHFV(88166)__AB069675.1__Gc
  source 1..1932: mol_type = other RNA
ttcagcgactccatcgtgaagggcatgaaaaacctgctcaattctacctcacttgagacaagtctgagcattgaagccccctggggagctataaacgtccagtccacttttaagcctacgatgtctgcagccaatatcgcgttgtcgtggtcaagcgttgagcacagagggaacaaaattttagtgagtggtaggtccgaatctatcatgaagctggaggaacggaccggcattagctggaatctaggggtagaggatgcttccgagtcaaaactcctgacagtgagtgtcatggaccttagccaaatgtactctccagtgttcgaatatctgtccggagatcgccaggttgaggaatggccgaaggccacttgcaccggcgactgtcccgagcgatgcggttgtacatcatctacctgcttgcataaggagtggcctcacagtcgtaactggagatgtaatccaacttggtgctggggagtggggacaggctgtacctgctgtggcctcgatgtcaaagacctgtttacggattacatgttcatcaagtggaaagtggaatatataaagactgaggcaatcgtatgcgttgaactgacctctcaggagaggcagtgtacactcattgaagccgggactcggtttaacttaggacccgtgaccatcacactgtccgagcctcgcaatattcaacagaaacttccacccgagatcgtcaccttgcatcctagaatagaagagggtttctttgacctgatgcacgtgcagaaggtgctaagcgcttcgacggtctgcaagctccagtcttgcactcatggcgttccaggggatctgcaagtgtaccacattggaaaccttctgaaaggcgacaaggtaaatggtcacttgatccataaaattgaaccgcacttcaacacatcctggatgtcatgggatgggtgtgacctcgattattactgcaatatgggagactggcccagttgtacctatactggcgtgacacagcataaccacgcagcctttgtcaatatgctgaacatcgagaccgactacacgaagaacttccactttcatagcaaaagggtgaccgctcacggcgatacacctcagttagacctgaaggcccggccaacttacggggcgggagaaatcaccgttctcgtggaggtcgcagatatggagcttcatactaaaaagattgaaatatccggtctgaagttcgcctctttgacatgcaccggctgttatgcttgcagctcagggatcagttgtaaagtgcgcattcacgtagacgagcccgatgaactaacagttcatgtgaagtccgaggaccctgatctggtcgccgcaagcagctcactcatggctcgaaaactggaatttggaaccgacagtactttcaaggccttcagcgcgatgccaaaaacgtccctttgcttttacatcgtggagagagagtattgtaagtcttgctcgaaggaagatacacagaaatgtgtcaataccaagctggagcaaccccagagcatattgattgaacacaaaggcactatcatcggtaagcagaacaatacctgcacagccaaagcatcctgctggctcgagtcagtgaagagtttcttttacgggctgaagaacatgttatctggcattttcggaaatgtttttatcggcgtgttcctgtttttcgctccgtttattctactcatactgttctttatgttcgggtggaggatcttgttttgtttcaaatgctgtcggcgtacccgcggacttttcaagtatagacacctgaaagacgatgaggaaactggttacaggaagattatcgagcggctcaacaataaaaagggcaagaacaaactgcttgacggggaacgactggccgaccgcaagatcgctgagttgtttagcacaaaaacgcatattgga

SEQ ID NO: 10756 - RNA, 1932 nt, synthetic construct
  misc_feature 1..1932: note = derived and/or modified CDS sequence (opt3) from CCHFV(BA88166)__AF338470.1__Gc
  source 1..1932: mol_type = other RNA
tacctggacagcatcgtgaagggcatgaaaaacctccttaattccacctctctggagacatcattgagtattgaagccccctggggtgctataaacgtccagagcactttcaagcctacgatgtccgcagccaatatcgcgttatcttggtcgtcagttgagcacagaggaaacaaaattctggtgagcggtaggagtgaatccatcatgaagctagaggaacggaccggcatttcttggaatctcggggtagaggatgctagcgagtccaaactgcttacagtgtcagtcatggacctgagtcaaatgtatagcccagtgtttgaatacttgtctggagatcgccaggttgaggaatggccgaaggccacttgcaccggcgactgtcccgagcgatgcggttgtacatcctcaacctgcctccataaggagtggcctcacagccgtaactggagatgtaatccaacttggtgctggggagtggggacaggctgtacctgctgtggcctggatgtcaaagacctgttcacggattatatgtttatcaagtggaaagtggaatacataaagactgaggcaatcgtatgcgttgaactcaccagtcaggagaggcagtgtacattaattgaagccgggactcggttcaacctgggacccgtgatcattaccctttctgagcctcgcaatatccaacagaaattgccacccgagatagtcacactgcatcctagaattgaagaggggtttttcgacctaatgcacgtgcagaaggtgctctccgctagcaccgtctgcaagctgcagtcgtgcacgcatggcgttccaggggatcttcaagtgtatcacatcggaaacctgttgaaaggcgacaaggtaaatggtcacctcattcataaaatcgaaccgcactttaacacttcttggatgtcctgggatgggtgtgacctggattactattgcaatatgggagactggccctcatgtacatacaccggcgtgactcagcataaccacgcagccttcgtcaatatgttaaacatcgagacagactacaccaagaactttcacttccatagtaaaagggtgacggctcacggcgatacccctcagctggacctcaaggcccggccaacatatggggcgggagaaattactgttcttgtggaggtcgcagatatggagctgcataccaaaaagatagaaatcagcggtttgaagtttgcctccctaacatgcactggctgttacgcttgctctagcgggatttcatgtaaagtgcgcatccacgtagacgagcccgatgaactgaccgttcatgtgaagagtgaggaccctgatatagtcgccgcatccagctctctcatggctcgaaaactggagttcggaacagactcaacctttaaggccttcagtgcgatgccaaaaactagcctttgcttctatattgtggaaagagagtactgtaagtcctgctctaaggaagatacgcagaaatgtgtcaatacaaagctggagcaaccccagtcgatcttgatcgaacacaaaggcaccattatcggtaagcagaacaatacttgcaccgccaaagcaagctgctggctcgagtccgtgaagtcatttttctatgggctgaagaacatgttaagtggcatttttggaaatgttttcataggcgtgtttctgttctttgctccgttcatcctactcattctgtttttcatgtttgggtggaggatccttttctgttttaaatgctgtcggcgtacacgcggattgttcaagtacagacacctgaaagacgatgaggaaaccggttataggaagatcattgagcggctcaacaataaaaagggcaagaacaaactgcttgacggggaacgactggccgaccgcaagatagctgagttgttctctactaaaacacatatcgga

SEQ ID NO: 10757 - RNA, 1932 nt, synthetic construct
  misc_feature 1..1932: note = derived and/or modified CDS sequence (opt3) from CCHFV(BA66019)__AF350448.1__Gc
  source 1..1932: mol_type = other RNA
ttcagcgactccatcgtgaagggcatgaaaaacctgctcaattctacctcacttgagacaagtctgagcattgaagccccctggggagctataaacgtccagtccacttttaagcctacggtttctaccgcaaatatcgccttgtcgtggtcaagcgtggagcacagagggaacaaaattttagtaagtggtaggtccgaatctatcatgaagctggaggaacggacaggcattagctgggatctaggggtggaggacgcgtccgagtcaaaactcctgactgtcagtgtgatggatcttagccaaatgtactctccagttttcgaatatctgtccggagaccgccaggtggaggaatggccgaaggctacctgcacaggcgattgtcccgaccgatgcggttgtacctcaagcacttgcttgcataaggagtggcctcacagtcgtaattggagatgtaacccaacatggtgctggggagtcgggaccggctgtacgtgctgtggcctcgatgtgaaagacctgtttactgattacatgttcgtaaagtggaaagttgagtatatcaagaccgaagccatagtgtgcgtcgagcttaattctcaggaaaggcagtgttccctcatcgaggcagggacacggtttaacttaggacccgtgactattaccctgagcgaacctcgcaatatccaacagaaacttccacccgagattatcacattgcatcctagaatagaggaaggtttctttgacctgatgcacgtgcagaaggtcctatcggcctctaccgtttgcaagctccagtcctgcacgcatggcgtgccaggggatctgcaaatttaccacatcggaaaccttctgaaaggcgacagggtaaatggtcacttgattcataagatcgagccgcacttcaacacttcatggatgagttgggatgggtgtgacctcgactattactgcaatatgggagattggcccagctgtacatataccggcgtgactcagcataaccacgctgcatttgtcaatctgttaaacatcgaaacagactacaccaaaaacttccactttcattccaagcgggtgacggcccacggcgatacccctcagctggacctcaaagctcgcccaacatacggggccggagagattactgttcttgtggaagtcgcggatatggagctgcataccaagaaaatagcaatctctggtttgaagttcgccagcctaacatgcactggctgttatgcttgctcaagtgggatttcctgtaaggtgcgaatccacgtagacgagcccgatgaactgaccgttcatgtgaaaagcgaggaccctgatatagtcgccgcatcttcaagtctcatggctagaaagctggaatttggaacagacagcaccttcaaagccttctccgcgatgccaaagacttctctttgcttttacattgtggagagggaatattgtgagtcgtgcagcaaagaggatacgcagaagtgtgtcaatacaaagctggaacaaccccagtccatcttgatcgagcacaaaggcaccattatcggtaagcagaacgacacttgcaccgccaaagcatcatgctggctcgaaagtgtgaagtctttcttttacgggctgaaaaatatgttaagcggcattttcggaaacgtttttataggcatcttcctgtttctagctccgttcattctcctgatcctgtttttcatgtttgggtggcggatcttgttctgttttaagtgctgtcgtcgcacaagaggactgttcaagtataggtacctcaaagacgatgaggagtccggttatcggcgaattatagaacgcctgaataacaagaaaggcaagaataaacttctggacggggagagattggccgataggcggatcgctgaactcttctcaaccaagactcacattgga

SEQ ID NO: 10758 - RNA, 1932 nt, synthetic construct
  misc_feature 1..1932: note = derived and/or modified CDS sequence (opt3) from CCHFV(BA8402)__AF350449.1__Gc
  source 1..1932: mol_type = other RNA
ttcagcgactccatcgtgaagggcatgaaaaacctgctcaattctacctcacttgagacaagtctgagcattgaagccccctggggagctataaacgtccagtccacttttaagcctacggtttctgcagccaatatcgcgttgtcgtggtcaagcgtggagcacagagggaacaaaattttagtaagtggtaggtccgaatctatcatgaagctggaggaacggaccggcattagctgggatctaggggtggaggacgcttccgagtcaaaactcctgacagtcagtgtgatggatcttagccaaatgtactctccagttttcgaatatctgtccggagaccgccaggtggaggaatggccgaaggccacttgcaccggcgattgtcccgagcgatgcggttgtacatcatctacctgcttgcataaggagtggcctcacagtcgtaattggagatgtaacccaacttggtgctggggagtcgggacaggctgtacctgctgtggcctcgacgtgaaagatctgtttacggactacatgttcatcaagtggaaagtagaatatataaagactgaggcaatcgtttgcgtggaactgacctctcaggagaggcagtgtacactcattgaagccgggactcggtttaatttaggacccgtcaccatcacactgtccgagcctcgcaacattcaacagaaacttccacccgagatcgtgaccttgcatcctagaatagaagagggtttctttgatctgatgcacgtgcagaaggtcctaagcgcttcgacggtttgcaagctccagtcttgcactcatggcgtgccaggggacctgcaagtataccacattggaaatcttctgaaaggcgataaggtgaacggtcacttgatccataaaattgaaccgcacttcaatacatcctggatgtcatgggacgggtgtgatctccattattactgcaacatgggagactggcccagttgtacctatactggcgtcacacagcacaatcacgcagcctttgtgaacatgctgaatatcgagaccgactacacgaagaacttccattttcacagcaaaagggttaccgctcatggcgatacacctcagttagacctgaaggcccggccaacttacggggcgggagaaatcaccgtgctcgtcgaggtggcagatatggagcttcacactaaaaagattgaaatatccggtctgaagttcgcctctttgacatgcaccggctgttatgcttgcagctcagggatcagttgtaaagtacgcattcatgttgacgagcccgatgaactaacagtgcacgtcaagtccgaggaccctgatatcgtggccgcaagcagctcactgatggctcgaaaactcgaatttggaaccgacagtactttcaaggccttcagcgcgatgccaaaaacgtccctgtgcttttacatagtcgagagagagtattgtgaatcttgctcgaaggaggatacacagaagtgtgtgaacaccaaacttgaacaaccccagagcattctgatcgagcacaagggcactatcattggtaaacagtccaatacctgcacagccaaggcatcatgctggttggagagtgttaaatctttcttttacgggctcaagaacatgctgagcggcatcttcggaaatgtgtttattggcgtattcttatttttcgctccgtttatactgctaatcctcttctttatgttcgggtggaggattctgttttgtttcaagtgctgtcggcgtacccgcggacttttcaaatatagacatttgaaggacgatgaagagactggttacaggaaaatcatcgaacggctgaacaataagaaaggcaagaacaagctcctggacggggagcgacttgccgaccgcaaaattgctgaactgttttccacaaagacgcacatagga

SEQ ID NO: 10759 - RNA, 1932 nt, synthetic construct
  misc_feature 1..1932: note = derived and/or modified CDS sequence (opt3) from CCHFV(Matin)__AF467769.2__Gc
  source 1..1932: mol_type = other RNA
ttcctggacagcatcattaagggcatgaaaaacctccttaattccacctctctggagacatcattgagtatagaagccccctggggagctatcaacgtgcagagcacttttaagcctacgatgtccgcagccaatattgcgttatcttggtcgtcagtcgagcacagagggaacaaaatcctggttagcggtaggagtgaatccattatgaagctagaggaacggaccggcatctcttgggatctcggggtggaggacgctagcgagtccaaactgcttacagtatcagtgatggatctgagtcaaatgtacagcccagtcttcgaatatttgtctggagaccgccaggtggaggaatggccgaaggccacttgcaccggcgattgtcccgagcgatgcggttgtacatcctcaacctgcctccataaggagtggcctcacagccgtaattggagatgtaacccaacttggtgctggggagttgggacaggctgtacctgctgtggcctggacgtgaaagatctgtttacggactacatgttcgtcaagtggaaagtggaatatataaagactgaggtaatcgtttgcgtggaactcaccagtcaggagaggcagtgttctttaattgaagcagggacacggtttaatctgggacccgtcactatcaccctttccgagcctcgcaacattcaacagaaattgccacccgagatcgtgacactgcatcctagaatagaagagggtttctttgatctaatgcacgtgcagaaggtcctcagcgcctcgaccgtttgcaagctgcagtcttgcacgcatggcgtgccaggggaccttcaagtataccacattggaaatctgttgaaaggcgataaggtgaacggtcacctcatccataaaattgaaccgcacttcaatacttcctggatgtcatgggacgggtgtgatctggactattactgcaacatgggagactggcccagttgtagctatacaggcgtcacccagcataatcacgctgcatttgtgaacatgttatccatcgagactgattacacaaagaatttccactttcattctaaaagggttaccgcccacggcgacacgcctcagctggatctcaaggctcggccaacctacggggccggagaaatcacagtgcttgtcgaggtggcggacatggagctgcatactaaaaagattgaaataagcggtttgaagttcgcatcactaacctgcacaggctgttatgcctgcagttccgggatcagctgtaaagtacgcattcacgttgatgagcccgacgaactgactgtgcatgtcaagtctgaggatcctgacatcgtggctgcctcaagtagcctcatggcacgaaaactggaatttggaaccgattccacattcaaggctttctctgccatgccaaaaacctcgctttgcttttacatagtcgagagagagtattgtaagagctgctccaaggaagacactcagaaatgtgtgaacacgaagctggagcaaccccagtcaattttgatcgaacacaaaggcacaatcattggtaagcagaacgatacctgcactgcgaaagccagttgctggctcgagtctgttaagagcttcttttacgggctgaagaatatgttatccggcatcttcggaaacgtgtttattggcatattcctgtttctagcaccgttcgctctcctgatcctctttttcatgtttgggtggaggattttgttctgttttaaatgctgtcggcgtacccgcggactgttcaagtatagacacctcaaagacgacgaggaaacaggttacaggaagatcatcgagcggctgaataacaaaaagggcaagaataaacttctggatggggaacgattggccgaccgcaagattgctgagcttttctcaaccaaaactcatgtagga

SEQ ID NO: 10760 - RNA, 1932 nt, synthetic construct
  misc_feature 1..1932: note = derived and/or modified CDS sequence (opt3) from CCHFV(Baghdad 12)__AJ538197.2__Gc
  source 1..1932: mol_type = other RNA
ttcctggacagcatcgtgaagggcaccaaaaacctccttaattccacatctctggagacttcattgagtattgaagccccctggggtgctataaacgtccagagcacgtacaagcctaccgtttccacagcaaatatcgccttatcttggtcgtcagtggagcacagaggaaacaaaattctggtaagcggtaggagtgaatccatcatgaagctagaggaacggactggcatttcttgggatctcggggtggaggacgcgagcgagtccaaactgcttaccgtctcagtgatggatctgagtcaaatgtatagcccagtttttgaatacttgtctggagaccgccaggtggaggaatggccgaaggctacatgcaccggcgattgtcccgagcgatgcggttgtactacatcaacctgcctccataaggagtggcctcactcccgtaattggagatgtaacccaacgtggtgctggggagtcgggactggctgtacctgctgtggcctggacgtgaaagatctgttcacagactatatgtttgtaaagtggaaagttgaatacatcaagactgatgccatagtgtgcgtcgagctcaccagccaggaaaggcagtgtagtttaatcgaggcagggacacggttcaatctgggatctgtgaccattacgctttccgaaccccgcaacatccaacagaaattgcctccagagattatcactctgcatcccagaatagaggaagggtttttcgacctaatgcacgtgcagaaggtcctcagcgcctcgacagtttgcaagctgcagtcttgcacccatggcgtgcctggggatcttcaagtatatcacattggaaatctgttgaaaggcgacaaggtgaacggtcacctcatccataaaattgagccacactttaatacttcctggatgtcatgggatgggtgtgacctggactactattgcaacatgggagattggccgagttgtacatacaccggcgtcacgcagcataatcacgctagcttcgtgaacttactgaatatcgaaaccgactacacaaagtcctttcacttccattctaaaagggttactgcacacggcgatacaccccagctcgaccttaaggtgcggcctacctatggggccggagagatcactgtcctggtggaagtagctgatatggagttgcataccaaaaagattgagataagcggtctaaagtttgcctcactgacatgcaccggctgttacgcgtgcagttccgggatcagctgtaaagttcgcattcacgtggacgaaccagatgagctcactgtccatgtgaagtctgacgatcccgacgtcgtggcagcctcaagtagcctgatggctcgaaaacttgagttcggaacggattccacatttaaggccttctctgcaatgcctaaaacctcgctgtgcttctatatcgttgaaagagaatactgtaagagctgctccaaggaggacactcagaaatgtgtgaacaccaagttggagcaaccacagtcaatactcattgaacacaaaggcacaatcatcggtaagcagaacaatacctgcactgctaaaacaagttgctggctggagtctgtaaagagctttttctatgggttaaagaacatgctgtccggcatttttggaaatttctttatgggcatcttcctatttctcgcccccttcattctgcttatattgtttttcatgtttgggtggaggatcctgttctgttttaaatgctgtcggcgtacgcgcggactcttcaagtacagacacctgaaagacgatgaagagaccggttataggcggattatcgagcgacttaacaataagaaaggcaagaacaagctgttggacggggaacgcctcgcggatagaaggatcgccgagctgttctcaactaaaacacatattgga

SEQ ID NO: 10761 - RNA, 1932 nt, synthetic construct
  misc_feature 1..1932: note = derived and/or modified CDS sequence (opt3) from CCHFV(VLG/TI29414)__AY179961.1__Gc
  source 1..1932: mol_type = other RNA
ttcctggacagcatcgtgaagggcatgaaaaacctccttaattccaccaacctggagacatctttgtcaattgaagccccctggggagctataaatgtccagagtacttttaagcctacggttagcaccgcaaacatcgccttatcctggtcttcggtggagcacagagggaataaaattctggtaacaggtaggtcagaaagcatcatgaagctagaggaacggactggcgtgagttgggatctcggggtcgaggacgcgtccgagtctaaactgcttaccgtgagcattatggatctgtcccaaatgtactcaccagttttcgaatatttgagtggagaccgccaggtggaggaatggccgaaggctacatgcaccggcgattgtcccgagcgatgcggttgtactagctctacatgcctccataaggagtggcctcactcccgtaactggagatgtaatccaacctggtgctgggaagtcgggacgggatgtacttgctgtggctggaacgtgaaagacctgtttaccgatcatatgttcgtaaagtggaaagttgagtacatcaagacagaagccatagtgtgcgtcgagctgacttcacaggaaaggcagtgtagcctcatcgaggcaggcacccggtttaatttagggcccgtgacaattaccctgagtgagcctcgcaacatccaacagaaacttccacccgaaattatcacgttgcaccctaaggtggaggaaggattctttgacctgatgcatgtccagaaggttctatctgcctccactgtgtgcaaactccagagctgcacacacggtataccaggcgatctgcaagtatatcacattgggaatcttctgaagggagacagagtgaacggccatttgatccacaaaattgagccgcatttcaatacctcgtggatgtcttgggatggttgtgacctcgattactattgcaacatgggggactggccctcctgtacttacacaggaatgacccagcacaatcacgctgcatttgtcaacctgttaaacatcgaaacggactataccaagacattccattttcactcaaaaagggtgactgcccatggcgatacccctcagctggacctcaaggctcggccaacatacggcgccggggagatcactgttcttgtggaggtcgcggatatggaactgcacaccaaaaaggtggagattagtggattgaagttcgcaagcctagcctgcacaggttgttacgcttgctcctctggcataagctgtaaagtacgcatccatgttgacgaacccgatgagctgaccgtgcacgtcaagtcaaatgaccctgatgtgattgccgcaagtacttccctcatggctcgaaaactggaatttgggacggacagcacattcaaggccttctctgcgatgccaaaaacctcactttgcttttatatcgccgagagagagtactgtaagagttgcagcgaagaggatactcagaagtgtgtcgacaccaaactggaacaaccccagtccatattgattgagcacaagggaacaatcatcggcaaacagaacgatacctgcactgcaaaggcttcttgctggctcgagtcggtgaaatccttcttttatggtctgaagaatatgttagggagcgttttcggcaactttttcattggaatcctgctatttctcgccccgttcgtgctgcttgtattgtttttcatgtttggctggaagattctgttctgttttaaatgctgtaggcggacacgtgggctcctgaagtaccgccttctgaaagacgacgaagagacgggatatagaaggataatcgaacggttgaataacaagaaaggtaagaatcgactcctggatggcgagcgcttagctgacagaaagattgccgaactgttctcaaccaaaactcatatcggg

SEQ ID NO: 10762 - RNA, 1932 nt, synthetic construct
  misc_feature 1..1932: note = derived and/or modified CDS sequence (opt3) from CCHFV(TADJ/HU8966)__AY179962.1__Gc
  source 1..1932: mol_type = other RNA
ttcctggacagcatcgtgaagggcatgaaaaaccccctcaattccacctctcttgagacatcactgagtattgaagccccttggggagctataaacgtccagagcacttacaagccaacggtttccaccgcaaatatcgccttgtcttggtcgtcaattgagcacagagggaacaatatcttagtgagcggtaggagtgaatccattatgaaactggaggaacggacaggcatctctggggatctaggagtagaggacgcgagcgagtccaagctcctgactgtgtcagtcatggatcttagtcaaatgtatagcccggtgtttgaatacctgtctggcgaccgccaggttgaggaatggcccaaagctacctgcacaggtgattgtcctgagcgatgcgggtgtacctcctcaacttgcttgcataaggagtggccacacagccgtaactggagatgtaatcccacatggtgctggggagtgggcaccggctgtacgtgctgtgggctcgacgtcaaggatctgttcatagactatatgtttgtgaaatggaaggtagattacatcaaaactgaagccattgtttgcgtggagctgaccagtcaggaaaggcagtgttctctcgtcgaggcaggaacacggttcaacttaggtcctgtgactatcaccctgtccgaaccacgcaatattcaacagaaacttccccctgagatcataacattgcatccaagaattgaggaaggctttttcgacctgatgcacgtgcagaaggtcctaagcgcctcgaccgtttgcaagctccagtcttgcacgcatggggtgccgggagatctgcaagtatatcacatcggcaaccttctgaagggtgacaaagagaatgggcacttgattcataagatcgaaccccactttaacacttcctggatgtcatgggatggatgtgacctcgactactattgcaatatgggcgattggcctagttgtacatacaccggcgtgactcagcataaccacgctagcttcgtcaatctgttaaacatcgagacagactacaccaaatcctttcacttccattctaagagggtgacggcacacggggataccccacagctggacctcaaagcccggcccacatatggagctggtgaaattactgttcttgtggaggtcgccgatatggagctgcataccaagaaaatagaaatcacaggcttgaagtttgcgagcctaacttgcaccgggtgttacgcatgctcaagtggaatttcctgtaaggtgcgcatccacgtagacgagcctgatgaactgacagttcatgtgaaaagcgacgatccagacgtcgtggccgcttcttcaagtctcatggcccgaaagctggagttcggcaccgatagcacttttaaagcattctccgctatgcccaagacgtctctttgcttctatatagtcgaaagagagtacaggaaatcgtgtagcaaggaggacacacagaagtgcgtgaacaccaaactggaacaaccgcagtccattttgatcgagcacaagggtactatcattgggaaacagaataacacctgtacagccaaggcgtcatgctggctcgaaagtgttaaatctttcttttatggcctgaagaatatgttaagcggaatctttggcaacgtgttcgtagggatttttctgttcctagccccttttatactcctgatccttttctttatgttcggatggcggattttgtcctgctttaagtgttgccgtcgcaccagaggtctgctcaaacacaggcatctgaaggacgatgaggagactggctaccggcgaatcatcgaacgccttaataacaaaaaggggaaaaataagctgttggacggagagagactcgcagataggcggattgctgaactgttctcaacaaagacgcacataggc

SEQ ID NO: 10763 - RNA, 1932 nt, synthetic construct
  misc_feature 1..1932: note = derived and/or modified CDS sequence (opt3) from CCHFV(Hodzha)__AY223476.1__Gc
  source 1..1932: mol_type = other RNA
ttcctggacagcatcgtgaagggcaccaaaaacctccttaattccacatctctggagacttcattgagtattgaagccccctggggtgctataaacgtccagagcacgtacaagcctaccgtttccacagcaaatatcgccttatcttggtcgtcagtggagcacagaggaaacaaaattctggtaagcggtaggagtgaatccatcatgaagctagaggaacggactggcatttcttgggatctcggggtggaggacgcgagcgagtccaaactgcttaccgtctcagtgatggatctgagtcaaatgtatagcccagtttttgaatacttgtctggagaccgccaggtggaggaatggccgaaggctacatgcaccggcgattgtcccgagcgatgcggttgtacttcctcaacatgcctccataaggagtggcctcacagccgtaattggagatgtaacccaacctggtgctggggagtcgggacgggctgtacttgctgtggcctggacgtgaaagatctgttcaccgactatatgtttgtaaagtggaaagttgattacatcaagacagaagccatagtgtgcgtcgagctcactagccaggaaaggcagtgttctttagtggaggcagggacccggttcaatctgggacccgtgacaatcaccctttccgaacctcgcaacattcaacagaaattgccacccgagatcattacgctgcatcctagaatcgaggaagggtttttcgacctaatgcacgtccagaaggttctcagcgcctcgactgtgtgcaagctgcagtcttgcacacatggcgtaccaggggatcttcaagtgtatcacataggaaatctgttgaaaggcgacaaggtcaacggtcacctcattcataaaatcgagccgcactttaatacctcctggatgtcatgggatgggtgtgacctggactactattgcaacatgggagattggcccagttgtacttacacaggcgtgacccagcataatcacgctagcttcgttaacttactgaatattgaaacggactacaccaagtcctttcacttccattctaaaagggtgacagcacacggcgatactcctcagctcgaccttaaggcccggccaacctatggggctggagagatcacagtcctggtggaagtagccgatatggagttgcatactaaaaagatcgagattaccggtctaaagtttgcgagcctgacatgcaccggctgttacgcatgctcaagtgggatatcctgtaaagttcgcatccacgtggacgaacccgatgagctcactgtccatgtgaagagtgacgatcctgacgtcgtggccgcttcttcaagtctgatggcccgaaaacttgaatttggaacggatagcacatttaaggcattctccgctatgccaaaaacctctctgtgcttctatattgttgagagagaatactgtaagtcgtgcagcaaggaggacactcagaaatgtgtgaacaccaagttggagcaaccccagtccatcctcatagaaaggaaaggcacaattatcggtaagcagaacaatacctgcactgccaaagcgtcatgctggctggagagtgtaaagtctttcttctatgggttaaagaacatgctgagcggcatctttggaaatgtcttcgtgggcatttttctattcctcgccccgtttatcctgcttattttgttctttatgttcgggtggcggatactgttttgtttcaaatgctgtcgtcgcacaagaggactctttaagtacaaacacctgaaggacgatgaagagacgggttataggcggatcattgagcgacttaacaataaaaagggcaagaacaaactgttggacggggaacgcctcgcagatagaaggatcgctgagctgttctccaccaagactcacatcgga

SEQ ID NO: 10764 - RNA, 1932 nt, synthetic construct
  misc_feature 1..1932: note = derived and/or modified CDS sequence (opt3) from CCHFV(Kosovo/9553/2001)__AY675511.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcgttaagtggaaagtggaatacatcaagacagaggccatagtctgcgtggaactgactagccaggagaggcagtgtagtctcatcgaagcagggacccggtttaatttaggacccgtgacaattaccctgtctgagcctcgcaacatccaacagaaacttccacccgagattatcacgttgcaccctaagatagaagagggtttctttgatctgatgcatgtccagaaggttctatccgccagcactgtgtgcaaactccagtcgtgcacacacggcattccaggggacctgcaagtatatcacatcggaaatcttctgaagggcgatagagtgaacggtcatttgattcacaaaatcgaaccgcatttcaatacctcttggatgtcctgggacgggtgtgatctcgactactattgcaacatgggagactggccctcatgtacttacacaggcgtcacccagcacaatcacgctgcatttgtgaacctgttaaatatcgagacggattataccaagacattccattttcacagtaaaagggttactgcccatggcgacacccctcagctggatctcaaggctcggccaacatacggggccggagaaattactgtgcttgtcgaggtggcggacatggagctgcacaccaaaaaggtagaaataagcggtttgaagttcgcatccctagcctgcacaggctgttacgcttgctctagcgggatctcatgtaaagttcgcattcatgtggatgagcccgacgaactgaccgtccacgtgaagagttccgatcctgacgtcgtggccgcaagcacttctctcatggctcgaaaactggagtttggaacggattcaacattcaaggccttcagtgcgatgccaaaaaccagcctttgcttttatatcgttgaaaaggagtactgtaagtcctgctctgaggacgatactaaaaagtgtgtggacaccaaactggaacagccccaatcgatattgattgagcacagaggcacaatcatcggtaagccgaacgatacctgccctgccaaaactagctgctggctcgaatccgtaaagtcattcttttatgggctgaagaacatgttaggcagtgtcttcggaaactttttcattggcatcctgctatttctcgcacccttctttctgtggatgctttctttcatgtttgggtggaaaattttgttctgttttaagtgctgtaggcggacacgtggactgttcaaataccgccatctcaaggacgacgaggagacgggttatagaaggataatcgaacggctgaataataaaaagggcaagaaccgacttctggatggggagcgcttggctgacagaaaaattgccgaactcttcagcaccaagactcacatcgga

SEQ ID NO: 10765 - RNA, 1932 nt, synthetic construct
  misc_feature 1..1932: note = derived and/or modified CDS sequence (opt3) from CCHFV(SPU41/84)__AY900142.1__Gc
  source 1..1932: mol_type = other RNA
ttcctggacagcatcgtgaagggcatgaaaaacctccttaattccacctctctggagacatcattgagtattgaagccccctggggtgctataaacgtccagagcacttacaagcctacggtttccaccgcaaatatcgccttatcttggtcgtcagtggagcacagaggaaacaaaattctggtaagcggtaggagtgaatccatcatgaagctagaggaacggacaggcatttcttgggatctcggggtggaggacgcgagcgagtccaaactgcttactgtctcagtgatggatctgagtcaaatgtatagcccagtttttgaatacttgtctggagaccgccaggtggaggaatggccgaaggctacctgcacaggcgattgtcccgagcgatgcggttgtacctcctcaacttgcctccataaggagtggcctcacagccgtaattggagatgtaacccaacatggtgctggggagtcgggaccggctgtacgtgctgtggcctggacgtgaaagatctgttcactgactatatgtttgtaaagtggaaagttgaatacatcaagaccgaggccatagtgtgcgtcgaactcacaagtcaggagaggcagtgttctttaatcgaagcagggactcggttcaatctgggacccgtgaccattacactttccgagcctcgcaacatccaacagaaattgccacccgagattatcaccctgcatcctagaatagaagaggggtttttcgatctaatgcacgtgcagaaggtcctcagcgcctcgacggtttgcaagctgcagtcttgcactcatggcgtgccaggggaccttcaagtatatcacattggaaatctgttgaaaggcgataaggtgaacggtcacctcgtccataaaatcgaaccgcactttaatacatcctggatgtcatgggacgggtgtgatctggactactattgcaacatgggagactggcccagttgtacctacactggcgtgacacagcataatcacgctagcttcgttaacatgttaaatattgagaccgattacacgaagaactttcacttccattccaaaagggtgaccgcacacggcgacacacctcagctggatctcaaggcccggccaacttatggggctggagaaatcaccgtccttgtggaggtagccgacatggagctgcatacaaagaagatcgaaatttctggtttgaagtttactagcctaacctgcacaggctgttacgcgtgctcaagtgggatatcctgtaaagttcgcatccacgtggatgagcccgacgaactgaccgtccatgtgaaaagcgaggatcctgacgtcgtggcagcctcttcaagtctcatggctcgaaaactggaatttggaactgatagcacgtttaaggccttctccgcaatgccaaaaacatctctttgcttctatattgttgagagagagtactgtaagtcgtgcagcgaagaggacacccagaagtgtgtgaacactaaactggaacaaccccagtccatcttgatagagaggaagggcaccattatcggtaaacagaataacacatgcaaggctaaagccgggtgctggctcgagtcagtaaagagtttcttctatggcctgaagaatatgttatctggaatctttggcaacgtcttcattgggatctttctgttcctagcgccgtttattctcctgatacttttctttatgttcggatggcggatcttgttttgtttcaaatgctgtcgtcgcaccagaggtctgtttaagtacaggcacctcaaagatgacgaagagactggctatcggaagattatcgaacgactgaataacaaaaaggggaagaataaacttctggacggagagcgcttggccgatagaaggatcgcagaactcttcagcacaaagacgcacattggc

SEQ ID NO: 10766 - RNA, 1932 nt, synthetic construct
  misc_feature 1..1932: note = derived and/or modified CDS sequence (opt3) from CCHFV(UG3010)__AY900143.1__Gc
  source 1..1932: mol_type = other RNA
tacctggacagcatcgccaagggcatgaaatccctccttaactctaccaatctggagacatcattgagtattgaagctccctggggagcaataaacgtgcagagcactttcaagcctacggtctccgccgcgaatatcgctttatcttggtcgtcagttgagcacagagggaacaaaattctggtgagcggtaggagtgaatccatcatgaagctagaggaacggaccggcatttcttggagcctcggggtagaggatgcctccgagtcaaaaacactgactgtgagtgtcatggaccttagccaaatgtattctccagtgtttgaatacctgtccggagatcgccaggttgaggaatggccgaaggcaacctgcacaggcgactgtcaggagcgatgcggttgtacctcaagcacttgcttgcataaggagtggccccacagtcgtaattggagatgtaaccctacatggtgctggggagtggggaccggctgtacgtgctgtggcctcgatgtcagggacctgttcactgattatatgatggtgaaatggaaggtagaatacgttaaaaccgaggccatcatgtgcgtggaactgacatctcaggagcggcaatgttccctcatagaagctgggactcgctttaatttaggaccagtcaccatcacactgagcgagcccagaaacattcagcagaggcttccttcggagatcgtgaccttgcatccaaagattgaagagggtttctttgacctgatgcacgtgcagaaagtcctatctgcatccacggtttgcaagctccaatcatgcactcatggcgtgcccggggatctgcaggtatatcacgtgggaaatcttctgaagggcgacaaagtcaacggtcacagtatccataagatagaaagccacttcaatacatcctggatgtcttgggatgggtgtgacttggattacttttgcaacatgggagactggcctagctgtacctatactggcgtgacacagcataatcgggccgctttcattaacatgctcaatatcgagaccgactacacgaaaacctttcacttccactcaaagcgcgttacagcccatggcgatactccacagctggacttaaaagcgcgaccgacctacggggcaggagaagtgacagtcctggtggaggtagccgatctcgagcttcacactaagaaaattgaagttagtggtctgaagtttgcttccttgacctgcagcggctgttatgcctgttcttcagggatcagttgcaaggtgagaatccatgtcaacgagcccgacgagttcacagtgcacgtcaaaagctccgatcctgacgtggttgcagctggatcttcgctaatggccaggaagattgaatttggcgcggatagcaccttcaaagccttctcctcaatgccaaagaacagtctgtgcttttacatagtggaacgggactattgttctagctgcactaatgatgacacgcaaaaatgtgtagatacaaagctcgagcatccccagtccatcctgattgagcacaagggtaccatcatagggaaacagaacgacacttgctcaaccaagacaagctgctggcttgaatctgtcaaatccttcttttacggcctgaagaatatgttgggaggcattttcgggaacgtgtttctcggaatcttcctgtttttagcacctttcgctctgctaatctttttctttttctttggttggcgtctcctgttctgtcttaaatgctgtcgcagaaccaggggcttgctgaagtataagcaactcaaagacgaggaagaggccgggtacaagaaaattatcgagcggctgaatgataagaaaggaaagagtcgacttttcgacggcgaacgcctggctgatagaaagattgccgagttgtttagcactaaaacacacataggt

SEQ ID NO: 10767 - RNA, 1932 nt, synthetic construct
  misc_feature 1..1932: note = derived and/or modified CDS sequence (opt3) from CCHFV(Hy13)__AY900145.1__Gc
  source 1..1932: mol_type = other RNA
ttcagcgactccatcgtgaagggcatgaaaaacctgctcaattctacctcacttgagacaagtctgagcattgaagccccctggggagctataaacgtccagtccacttttaagcctacggtttctgcagccaatatcgcgttgtcgtggtcaagcgtggagcacagagggaacaaaattttagtaagtggtaggtccgaatctatcatgaagctggaggaacggaccggcattagctgggatctaggggtggaggacgcttccgagtcaaaactcctgacagtcagtatcatggatcttagccaaatgtactctccagtgttcgaatatctgtccggagaccgccaggttgaggaatggccgaaggccacttgcaccggcgattgtcccgagcgatgcggttgtacatcaagtacctgcttgcataaggagtggcctcacagtcgtaattggagatgtaacccaacttggtgctggggagtggggacaggctgtacctgctgtggcctcgacgtcaaagatctgtttacggaccatatgttcgtgaagtggaaagtagaatacataaagactgaggcaatcgtttgcgtggaactgacctctcaggagaggcagtgttccctcattgaagccgggacacggtttaatttaggacccgtcactatcaccctgagcgagcctcgcaacattcaacagaaacttccacccgagatcgtgacattgcaccctagaatagaagagggtttctttgatctgatgcatgtgaagaaggtcctatcggcttctaccgtttgcaaactccagtcctgcacgcacggcgtgccaggggacctgcaggtatatcacattggaaatcttctgaagggcgataaagtgaacggtcatttgatccacaagattgaaccgcatttcaatacttcatggatgagttgggacgggtgtgatctcgactactattgcaacatgggagactggcccagctgttcctacacaggcgtcacccaacacaatcacgcagcctttgtgaacatgctgaatatcgagactgattatacaaaaatcttccattttcactctaagagggttaccgctcatggcgacacgcctcagttagatctgaaagcccggccaacctacggggcgggagaaattacagtgctcgtcgaggtggcagacatggagcttcacactaagaagatagaaatcagcggtctgaaattcgcctcattgacctgcacaggctgttacgcttgcagttccgggattagctgtaaggtacgcatccatgttgatgagcccgacgaactaactgtgcacgtcaaatctgaggatcctgacatagtggccgcatcaagtagcctgatggctcgaaagctcgaatttggaaccgattccacattcaaagccttctctgcgatgccaaagacctcgctgtgcttttatattgtcgagagagagtactgtaagagctgctccaaagaagacactcagaagtgtgtgaacacgaaacttgagcagccccaatcaatcctgatcgaacacaagggcacaattatcggtaaacagaacgatacctgcactagcaaggccgggtgctggttggagtctgttaagagcttcttttatggcctcaaaaatatgctgtccggaattttcggcaacgtgtttatagggatcttcttatttctggcaccgttcattctactcatcctgtttttcatgtttggatggaggatccttttctgttttaagtgctgtcggcgtacccgcggtttgttcaaatacagacatctgaaggacgacgaggaaacaggctataggaaaattatagagcggctcaataacaagaaggggaaaaataagctgcttgatggagaacgactggctgaccgcaaaatcgccgagttgttctcaaccaagactcacattggc

SEQ ID NO: 10768 - RNA, 1932 nt, synthetic construct
  misc_feature 1..1932: note = derived and/or modified CDS sequence (opt3) from CCHFV(Semunya)__DQ094832.1__Gc
  source 1..1932: mol_type = other RNA
ttcctggacagcatcgccaagggcaaaaagtccctccttaactctaccaatctggagacatcattgagtattgaagctccctggggtgcaataaacgtgcagagcacttttaaacctacggtctccgccgcgaatatcgctttatcttggtcgtcagttgagcacagaggaaacaagattctggtgagcggtaggagtgaatccatcatgaaactagaggaacggaccggcatttcttggagcctcggggtagaggatgcctccgagtcaaagacactgactgtgagtgtcatggaccttagccaaatgtactctccagtgttcgaatatctgtccggagatcgccaggttgaggaatggccgaaggcaacctgcacaggcgactgtcccgagcgatgcggttgtacctcaagcacttgcttgcataaagagtggcctcacagtcgtaattggagatgtaacccaacatggtgctggggagtggggaccggctgtacgtgctgtggcctcgatgtcagggacctgtttactgattacatgatggtgaagtggaaagtagaatatgttaagaccgaggccatcatgtgcgtggaactgacatctcaggagcggcagtgttccctcatagaagctgggactcgcttcaatttaggacccgtcaccatcacactgagcgagcctagaaacgtgcaacagaggcttccatcggagattgtgaccttgcatcccaaaatcgaagaggggtttttcgacctgatgcacgtccagaaggttctattttgcaagtactctctccaggcaacgtcctgcactcatggcgtgcctggggatctgcaagtatatcacgtgggaaatcttctgaaaggcgacaaggtcaacggtcactcaattcataaaatcgaaagtcacttcaatacaagctggatgtcctgggatgggtgtgacttggattacttttgcaacatgggagactggccatcttgtacctatactggcgtgacacagcataatcgggccgctttcgttaacatgctcaatatagagaccgactacacgaagacctttcacttccacagcaaacgcgtgacagcccatggcgatactccgcagctggacttaaaggcgcgacccacctacggggcaggagaagtcacagtgctggtagaggttgccgatctcgagcttcacactaaaaagattgaagtgtcaggtctgaagtttgctagtttgacctgctccggctgttatgcctgcagctctgggatctcatgtaaagtcaggattcatgtgaacgagcctgacgaatttacagtccacgtgaagagtaacgatccagacgttgtggcagctggaagctccctaatggccagaaaaatcgagttcggcgcggattctaccttcaaggccttctcgagcatgcccaaaaattccctgtgcttttacatcgtagaacgggactattgttcaagttgcactgatgacgatacgcagaagtgtgtcaacattaagctcgagcatcctcaatctatactgatcgagcacaaaggtacaattatcgggaagcagaatgatacctgcccaactaaaaccagctgctggcttgaatccgtgaagtcattcttttacggcctgaaaaacatgttgggaggcatattcgggaatgtttttctcggaattttcctgtttttagcacccttcgctctgctaatcctctttttctttttcggttggcgtctgcttttctgtttgaagtgctgtcgcagaacaaggggcctgctcaagtataaacagctgaaggacgaggaagaggccgggtacaaaaagatcattgagcggcttaacgacaaaaagggaaagagccgactgtttgacggcgaacgcttggctgatagaaaaatcgccaaactcttctctaccaagactcacattggt

SEQ ID NO: 10769 - RNA, 1932 nt, synthetic construct
  misc_feature 1..1932: note = derived and/or modified CDS sequence (opt3) from CCHFV(SPU128/81/7)__DQ157174.1__Gc
  source 1..1932: mol_type = other RNA
ttcctggacagcatcgtgaagggcatgaaaaacctccttaattccacctctctggagacatcattgagtattgaagccccctggggtgctataaacgtccagagcacttacaagcctacggtttccaccgcaaatatcgccttatcttggtcgtcagtggagcacagaggaaacaaaattctggtaagcggtaggagtgaatccatcatgaagctagaggaacggacaggcatttcttgggatctcggggtggaggacgcgagcgagtccaaactgcttactgtctcagtgatggatctgagtcagatgtatagcccagtttttgaatacttgtctggagaccgccaggtggaggaatggccgaaggctacctgcacaggcgattgtcccgagcgatgcggttgtacctcctcaacttgcctccataaggagtggcctcacagccgtaattggagatgtaacccaacatggtgctggggagtcgggaccggctgtacgtgctgtggcctggacgtgaaagatctgttcactgactatatgtttgtaaagtggaaagttgaatacatcaagaccgaggccatagtgtgcgtcgaactcacaagtcaggagaggcagtgttctttaatcgaagcagggactcggttcaatctgggacccgtgaccattacactttccgagcctcgcaacatccaacagaaattgccacccgagattatcaccctgcatcctagaatagaagaggggtttttcgatctaatgcacgtgcagaaggtcctcagcgcctcgacggtttgcaagctgcagtcttgcactcatggcgtgccaggggaccttcaagtatatcacattggaaatctgttgaaaggcgataaggtgaacggtcacctcatccataaaattgaaccgcactttaatacatcctggatgtcatgggacgggtgtgatctggactactattgcaacatgggagactggcccagttgtacctacactggcgtcacacagcataatcacgctagcttcgtgaacttactgaatatcgagaccgattacacgaagaactttcacttccattccaaaagggttaccgcacacggcgacacacctcagctcgatcttaaggcccggccaacttatggggctggagaaatcaccgtgctggtcgaggtggccgacatggagttgcatactaaaaagattgaaatatctggtctaaagtttgcgagcctgacatgcaccggctgttacgcatgctcaagtgggatctcctgtaaagtacgcattcacgttgatgagcccgacgaactcacagtgcatgtcaagagcgatgaccctgatgtggtcgccgcttcttcaagtctgatggcccgaaaacttgagttcggaaccgacagcacttttaaggcattctccgctatgccaaaaacgtctctgtgcttctatatcgtggaaagagagcactgtaagtcgtgcagcgaggaagatacaaagaaatgtgttaacaccaagttggagcagccccaatccatactcattgaacacaaaggcactatcatcggtaagcaaaattcaacctgcacagccaaagcgagttgctggctggagtctgtaaagagctttttctacgggttaaagaacatgctgtccggcatttttggaaatgtgttcatcggcatttttctattcctcgggccgtttatactgcttatcttgttctttatgttcggatggaggattctgttttgtttcaaatgctgtcggcgtacccgcggtctcctgaagtatagacatcttaaagaggacgaagagactggctacaggcggatcatcgaacgactgaacaataagaaagggaagaacaagttgctcgacggagagcgcctggccgatagaaggattgcagaattattttcaacaaaaacgcacataggc

SEQ ID NO: 10770 - RNA, 1932 nt, synthetic construct
  misc_feature 1..1932: note = derived and/or modified CDS sequence (opt3) from CCHFV(ROS/HUVLV-100)__DQ206448.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcgttaagtggaaagtggaatacatcaagacagaggccatagtctgcgtggaactgactagccaggagaggcagtgtagtctcatcgaagcagggacccggtttaatttaggacccgtgacaattaccctgtctgagcctcgcaacatccaacagaaacttccacccgagattatcacgttgcaccctaaggtcgaagagggtttctttgatctgatgcatgttcagaaggtgctatccgccagcactgtatgcaaactccagtcgtgcacacacggcataccaggggacctgcaagtgtatcacattggaaatcttctgaagggcgatagagtcaacggtcatttgatccacaaaattgaaccgcatttcaatacctcttggatgtcctgggacgggtgtgatctcgactactattgcaacatgggagactggccctcatgtacttacacaggcgtgacccagcacaatcacgctgcatttgttaacctgttaaatatcgagacggattataccaagacattccattttcacagtaaaagggtgactgcccatggcgacacccctcagctggatctcaaggctcggccaacatacggggccggagaaatcactgtccttgtggaggtagcggacatggagctgcacaccaaaaaggttgaaattagcggtttgaagttcgcatccctagcctgcacaggctgttacgcttgctctagcgggatatcatgtaaagtgcgcatccatgtcgatgagcccgacgaactgaccgtgcacgtcaagagttccgatcctgacgtggttgccgcaagcacttctctcatggctcgaaaactggagtttggaacggattcaacattcaaggccttcagtgcgatgccaaaaaccagcctttgcttttatattgtggaaagagagtactgtaagtcctgctctgaggaagacactcagaagtgtgtagataccaaactggagcaaccccagtcgatcttgatagaacacaagggcacaattatcggtaaacagaacgatacctgcactgccaaggcaagctgctggctcgagtccgtcaaatcattcttttatgggctgaagaacatgttaggcagtgtgttcggaaactttttcatcggcattctgctatttctcgctccgttcgttctgcttgtgttgtttttcatgtttgggtggaagatcctgttctgttttaaatgctgtaggcggacacgtggactcctgaagtaccgccttctgaaagacgacgaggaaacgggttatagaaggattatagagcggttgaataataagaaaggcaagaaccgactcctggacggggaacgcttagccgatagaaagatcgctgagctgttctctaccaaaactcatattgga

SEQ ID NO: 10771 - RNA, 1932 nt, synthetic construct
  misc_feature 1..1932: note = derived and/or modified CDS sequence (opt3) from CCHFV(AP92)__DQ211625.1__Gc
  source 1..1932: mol_type = other RNA
ttcctggacagcatcgccaagggcgtgaaaaacctccttaattccacctctctggagacatcattgagtattgaagctccctggggagcaataaacgcccagagcacttacaagcctacggcgtcctctgctaatatcgccttaacctggtcgtcagtcgagcacagagggaacaaaattctggttagcggtaggagtgaatccatcatgaagctagaggaacggacaggcatttcttggaatctcggggtggaggatgcaagcgagtcccgcactctgaccatctcagtaatggaccttagtcaaatgtatagcccagtgtttgaatacctgtctggagatcgacaggtcgaggaatggccgaaagccacatgcaccggcaactgtcccgagcgttgcggttgtacttcctcaacatgcttgtataaggagtggcctcatagcagaaattggaggtgtaacccaacctggtgctggggagtggggacgggctgtacttgctgtggcctcgacgttaaggaactgttcaccgatcacatgctggtgaaatggaaggtcgagtacataaaaacagaagctatcgtgtgcgtagagctcaccagtcaggaacggcagtgttctttaattgaggcagggactcgcttttccctgggacccgttacaatcacccttagcgagcctagaaatattcaacagaagttgccacccgaactgatcacgctacatcctaaaatagaggacggttatttcgatctcatgcacgtgcagaaggtcatgtcggcctctactgtgtgcaagctgcagtcctgcacacatggcgtgccaggggaccttcaaatttaccacgtcggaaacctgttgaaaggcgatagggttaatggtcacctcatccataaggtggaaccgcacctgaacacctcatggatgagttgggacgggtgtgatttagactatttttgcaatatgggagattggcccagctgtacttacacaggcgtaacccagcataaccacgctgccttcgcgaatctgctcaacattgagacggactacaccaaaacatttcacttccattccaagcgggtgactgcacacggcgacacccctcagcttgatctgaaagcccgcccacgatatggggctggagaaatcacagtcttggtggaggttgccgacatggagctacatactaagaaagtggaagtcaccggtctgaagtttgcatctctcacatgcagcggctgttacgcttgctcaagtgggatctcctgtaaggtgaggattcacgtagatgagcccgacgaactgaccgttcatgtgaaaagctctgatcctgacatagtcgccgcgtcaagtagccttatggccagaaagatcgagttcggagtggattccacttttaaagcattctcttcgatgccaaaggacagcctgtgcttttatattgtcgaacgggattactgtaactcctgcaaaaatgaggagacgcagcgttgtgtgaacgctaagttggaacaaccccagtcaatcctcatagagcacacaggcaccattatcggtaagcagaatgacacttgcgggagtcgcacctcttgctggctggatagcttcaaatccttcttttatggcttaaagtcaatgctgagcggaatcttcggcaacgtttttctagggattttcctctttctggccccgttcgctcttttgctgtttttctttttctttggatggagaatcctcttctgttttaaatgctgtaggcggacacgaggtctgttcaagtaccgccacattaaagacgacgaagaggtgggctataagaagataatcgagagacttaataacaaaaaggggaaacataggctgttggatggagaacggctcgccgaccgcaagattgcagagctgttctctaccaaaactcacatcggc

SEQ ID NO: 10772 - RNA, 1932 nt, synthetic construct
  misc_feature 1..1932: note = derived and/or modified CDS sequence (opt3) from CCHFV(ArD8194)__DQ211626.1__Gc
  source 1..1932: mol_type = other RNA
ttcctggacagaatcgccaagggcatgaaaagcctccttaactccacctctctggagacatcattgagtattgaagctccctggggtgcaataaatgtgcagagcacttttaagcctacggtctccgccgcgaacatcgctttatcttggtcgtcagttgagcacaaaggaaataagattctggtgagcggtaggagtgaatccatcatgaaactagaggaacggaccggcatttcttggtgcctcggggtagaggatgccagcgagtccaagacactgactgtgtcagtcatggaccttagtcaaatgtacagcccagtgttcgaatatctgtctggagatcgccaggttgaggaatggccgaaggcaacctgtacaggcgactgccccgagcgatgtggttgcacctcctcaacttgtttgcataaagagtggcctcacagccgtaactggagatgcaatccaacatggtgttggggagtggggaccggctgcacgtgttgcggcctcgatgtcaaggacctgtttactgattacatgctggtgaaatggaaggtagaatatatcaaaaccgaggccataatctgtgttgaactcacaagtcaggagaggcagtgctctttaattgaagctgggactcggttcaacctgggacccgtgaccatcacactttccgagcctcgcaatgtccaacagagattgccacccgagattatcaccctgcatcctaagatagaagaggggtttttcgacctaatgcacgtgcagaaggtgatgagcgcatcgacggtctgcaaactccagtcttgtactcatggcgttccaggggatctgcaagtgtaccacgtaggaaaccttctgaagggcgacaaagtgaatggtcactccattcataagatcgaatcacacttgaacacaagttggatgagctgggatgggtgcgacctcgattatttttgtaatatgggagactggccgtcctgcacctacactggcgtcacacagcataaccacgccgctttcattaatatgctgaacatcgagaccgactatacgaaaacctttcacttccattctaagagggtgacagcccacggcgatactccccagttagacctgaaagcgcggcctgcatacggggccggagaaatcaccgttctcgtggaggtcgctgatcttgagctgcatacaaagaagattgaagtgagcggtttgaaatttgcctcactaagttgttccggctgctacgcatgtagctctgggatatcatgcaaggtacgcatccacgttaatgagccagacgaatttactgtgcatgtcaaaagtaacgatcccgacgtggtcgctgccggaagctccctgatggcgcgaaagattgagtctggcgccgattcgacctttaaagcattcagctccatgcctaagaactcactctgtttctatatcgtggaaagagactactgcagttcttgtacagatgacgatacccagaagtgcgttgacataaaactggagcacccacaaagcattcttatcgagcacaagggtactatcattgggaaacagaatgacacgtgccccacaaagacctcctgttggctggaatcaatcaagagctttttctatggcttgaaaaacatgctctctggaatttttggcaatgtgttcctggggatgttactgtttctagctccgttcatactcctgatccttttcttctttttcggatggaggttgctgttttgcctcaagtgttgccggcgtactcgcaaactgcttaagtacaaacatctgagagatgaggaagagtccggttataagaaaattatcgagaggttgaacgacaagaagggcaaaagtcgactcttcgatggggaacggctggccgaccgcaagatcgctgagttatttagcaccaaaacacacattgga

SEQ ID NO: 10773 - RNA, 1932 nt, synthetic construct
  misc_feature 1..1932: note = derived and/or modified CDS sequence (opt3) from CCHFV(ArD15786)__DQ211627.1__Gc
  source 1..1932: mol_type = other RNA
agcctggactccatcgccaagggcatgaaatctctccttaactcaaccagtctggagaccagcttgtccattgaagctccctggggagcaataaatgtgcagtctactttcaagcctacgatctcggccgcgaacattgctttatcatggagcagtgtcgagcacaaagggaataagatcctggtttccggtagatctgaaagcattatgaaactagaggaaaggaccggcatctcctggtgcctcggggtggaggatgcctcagagagtaagacactgactgtaagcgtgatggacctttctcaaatgtactccccagtctttgaatatctgtcaggagatcgccaggtggaggaatggccgaaggcaacctgtacaggcgactgccccgagcggtgtggttgcaccagcagtacttgtttgcataaagagtggcctcactctcgaaactggcgttgcaatccaacatggtgttggggagttgggaccggctgcacgtgttgcggcctcgatgtgaaggacctgttcactgattacatgctggtcaaatggaaggtggaatatataaaaaccgaggccatcatttgtgtagaactcacatcccaggagagacagtgcagcttaatcgaagctgggactaggtttaacctgggacccgttaccattacactttcggagcctcggaatgtgcaacagcgcttgccacccgagatcataaccctgcatcctaagattgaagagggtttctttgacctaatgcacgtccagaaggtgatgtctgcatccacggtgtgcaaactccagtcatgtactcatggcgtcccaggggatctgcaagtttaccacgtgggaaaccttctgaagggcgacaaagtaaatggtcacagtatccataagattgaaagccacttgaacacatcctggatgtcttgggatgggtgcgacctcgattatttctgtaatatgggagactggccgagctgcacctacactggcgtgacacagcataacagagccgcttttatcaatatgctgaacatcgagaccgactatacgaaaaccttccactttcactcaaagagggtcacagcccatggcgatactccccagttagacctgaaagcgcggcctacctacggggcaggagaaattacagtgctcgttgaggtggccgatcttgagctgcacactaagaagatagaagtcagtggtttgaaattcgcttccctaacctgtagcggctgctacgcctgttcttcagggatcagttgcaaggtgcgcattcatgtaaatgagccagacgaatttacagttcacgtgaaaagcaacgatcccgacgtcgtggcagctggatcctctctgatggcccgaaagatcgagtcgggcgcggatagcaccttcaaagccttttcctcaatgcctaagaacagtctctgtttctatatagtcgaaagagactactgctctagctgtactgatgacgatacgcagaagtgcgtggacattaaactggagcatccacaatccatccttatcgagcacaagggtacaattatcgggaaacagaatgacacatgccccactaagacctcatgttggctggaaagcattaaatctttcttttatggcttgaagaacatgctctccggaatattcggcaatatctttctggggatgttactgttcctagcaccgtttgttctcctgattcttttctttttctttggatggaggttgctgttctgcctcaagtgttgccggcgtacacgcaaactgcttaagtacaaacacctgagagatgaggaagagagtggttataagaaaatcatcgagaggttgaacgacaagaagggcaaaagccggctctttgatggggaacgactggctgaccgcaagattgccgagttattctctaccaaaactcatgtggga

SEQ ID NO: 10774 - RNA, 1932 nt, synthetic construct
  misc_feature 1..1932: note = derived and/or modified CDS sequence (opt3) from CCHFV(ArD39554)__DQ211628.1__Gc
  source 1..1932: mol_type = other RNA
ttcctggacagcaccgccaagtccatgaaatctctccttaactcaacaagtctggagactagcttgtccatcgaagctccctggggcgcaattaatgtgcagtctacgtttaagcctaccgcctcgacagcgaacatagctttatcatggagcagtgtcgagcacagagggaataaaatcctggttactggaaggtccgaatctattatgaagctagaggaacggaccggtatcagctggaacctcggcgtggaggatgcctccgagtcaaaaacactgaccgtaagtgtgatggaccttagccaaatgtactctactgtcttcgaatatctgtccggggatcgccaggtggaggaatggccaaaggcaacatgcaccggagactgtccggagcgatgcggctgtacgtcaagcacttgcttgcataaggcctggccccacagtcgtaattggagatgtaaccctacctggtgctggggtgttgggacaggatgtacttgctgtggcctcgatgtgaaaaatctgtttaccgactacatgctgattaagtggaaagtcgagttcatcaagacagaagctatagtgtgcgtagagctcacctctcaggaaaggcagtgttccttaatcgaggcaggcacgcggtttaacctggggccagttactattacacttagcgaaccccgcaatatccaacagaaattgcctccagagctggtgaccctacatcccagagtcgaggaaggattctttgatctcatgcacgtgcagaaggtgctgtcggcctctactgtctgcaagctccagtcctgcacacatggtgttcctggcgacctgcaagtgtatcacgtagggaacttgctcaaaggagataagattaatggcaactcattccacaaaatcgagccaaatctgaacaccagttggatgagctgggacggttgtgatttagactactattgcaatatgggggattggccgtcctgtacgtacaccggagtgacacagcataaccacgctgcctttgtcaacctgctcaatatagaaactgactataccaagaacttccattttcactctaaaagggtgacagcgcacggcgagactccccagcttgacctgaaggcacggcctaaatacggcgccggggaagttaccgtgttggtcgaggtggctgatatggagctacatacaaagaagattgaaatcagcggactgaaattcgcctcacttacctgcactggttgttacgcatgcagttccggcattagctgtaaggtacgcctgcacgttgacgagccagatgaacttacggtgcatgtcaaatctgacgatcccgacgtggtcgctgcctcaagtagcctgatggcgcgaaagatcgagtttgggacagattccaccttcaaagccttctcttcgatgcctaaggacaagttgtgcttttatatcgtggaaagagattactgtagctcctgctcaaaagaggacactcagaagtgtgttaatgcaaaactcgagcaaccacagagtattctgatagaacacaagggaaccatcattggcaaacagaacgatacatgcaccgtgaaggcttcttgctggttagagagcgtaaagtccttcttttatggtctgaaaaatatgctagggggcatcttcggaaacgtcatactcggcattatcatgtttctggcccccttcgctcttttgctgctctttttcctgtttgggtggaggatccttttctgtctgcggtgctgtcgtcgcactagaggattgtttaagtacaaacatattaaggacgacgaagagtcaggttataaaaggatcattgagcggctcaataacaagaagggcaaaaataagctgttcgatggggaacgattagccgacaaaaagatagcagagctgtttagcacaaaaacgcacatcgga

SEQ ID NO: 10775 - RNA, 1932 nt, synthetic construct
  misc_feature 1..1932: note = derived and/or modified CDS sequence (opt3) from CCHFV(C-68031)__DQ211629.1__Gc
  source 1..1932: mol_type = other RNA
ttcagcgactccatcgtgaagggcatgaaaaacctgctcaattctacctcacttgagacaagtctgagcattgaagccccctggggagctataaacgtccagtccacttttaagcctacggtttctgcagccaatatcgcgttgtcgtggtcaagcgtggagcacagagggaacaaaattttagtaagtggtaggtccgaatctatcatgaagctggaggaacggaccggcattagctgggatctaggggtggaggacgcttccgagtcaaaactcctgacagtcagtatcatggatcttagccaaatgtactctccagtgttcgaatatctgtccggagaccgccaggttgaggaatggccgaaggccacttgcaccggcgattgtcccgagcgatgcggttgtacatcaagtacctgcttgcataaggagtggcctcacagtcgtaattggagatgtaacccaacttggtgctggggagtggggacaggctgtacctgctgtggcctcgacgtcaaagatctgtttacggactacatgttcgtgaagtggaaagtagaatatataaagactgaggcaatcgtttgcgtggaactgacctctcaggagaggcagtgttccctcattgaagccgggacacggtttaatttaggacccgtcactatcaccctgagcgagcctcgcaacattcaacagaaacttccacccgagatcgtgacattgcatcctagaatagaagagggtttctttgatctgatgcacgtgaagaaggtcctatcggcttctaccgtttgcaaactccagtcctgcacgcatggcgtgccaggggacctgcaggtataccacattggaaatcttctgaagggcgataaagtgaacggtcacttgatccataagattgaaccgcacttcaatacttcatggatgagttgggacgggtgtgatctcgactattactgcaacatgggagactggcccagctgttcctatacaggcgtcacccaacataatcacgcagcctttgtgaacatgctgaatatcgagactgattacacaaaaatcttccactttcattctaagagggttaccgctcacggcgacacgcctcagttagatctgaaagcccggccaacctacggggcgggagaaattacagtgctcgtcgaggtggcagacatggagcttcatactaagaagatagaaatcagcggtctgaaattcgcctcattgacctgcacaggctgttatgcttgcagttccgggattagctgtaaggtacgcatccacgttgatgagcccgacgaactaactgtgcatgtcaaatctgaggatcctgacatagtggccgcatcaagtagcctgatggctcgaaagctcgaatttggaaccgattccacattcaaagccttctctgcgatgccaaagacctcgctgtgcttttacattgtcgagagagagtattgtaagagctgctccaaagaagacactcagaagtgtgtgaacacgaaacttgagcagccccaatcaatcctgatcgaacacaagggcacaattatcggtaaacagaacgatacctgcactagcaaggccgggtgctggttggagtctgttaagagcttcttttacggcctcaaaaatatgctgtccggaattttcggcaacgtgtttatagggatcttcttatttctggcaccgttcattctactcatcctgtttttcatgtttggatggaggatccttttctgttttaagtgctgtcggcgtacccgcggtttgttcaaatatagacacctgaaggacgacgaggaaacaggctacaggaaaattatagagcggctcaataacaagaaggggaaaaataagctgcttgatggagaacgactggctgaccgcaaaatcgccgagttgttctcaaccaagactcatattggc

SEQ ID NO: 10776 - RNA, 1932 nt, synthetic construct
  misc_feature 1..1932: note = derived and/or modified CDS sequence (opt3) from CCHFV(Drosdov)__DQ211630.1__Gc
  source 1..1932: mol_type = other RNA
ttcctggacagcaccgtgaagggcatgaaaaacctccttaattccacatctctggagacttcattgagtatcgaagccccctggggagctattaacgtccagagcacgtttaagcctaccgtttccacagcaaatatagccttatcttggtcgtcagtggagcacagagggaacaaaatcctggtaactggtaggagcgaaagtattatgaagctagaggaacggaccggcgtgtcctgggatctcggggtcgaggacgcgtctgagagcaaactgcttacagtgtccatcatggatctgtcacaaatgtacagtccagttttcgaatatttgagcggagaccgccaggtggaggaatggccgaaggctacctgcactggcgattgtcccgagcgatgcggttgtacatcttccacatgcctccataaggagtggcctcactcacgtaattggagatgtaacccaacgtggtgctggggagtcgggactggctgtacctgctgtggcgtggacgtaaaagatctgtttacagaccatatgttcgttaagtggaaagtggaatacatgaagactgaggccattgtctgcgtggaactgaccagccaggagaggcagtgtagtctcatcgaagcagggacacggtttaatttaggacccgtgaccataacgctgtctgagcctcgcaacatccaacagaaacttccacccgagattatcactttgcaccctaagattgaagagggtttctttgatctgatgcatgtccagaaggttctatccgccagcacagtgtgcaaactccagtcgtgcacccacggcatcccaggggacctgcaaatatatcacattggaaatcttctgaagggcgatagagtaaacggtcatttgatccacaaaattgaaccgcatttcaatacttcttggatgtcctgggacgggtgtgatctcgactactattgcaacatgggaaattggccctcatgtacatacaccggcgtgacgcagcacaaccacgctgcatttgtcaatctgttaaacatcgagaccgactatacaaagactttccattttcacagtaaaagggtgaccgcccatggcgatacacctcagctggacctcaaggctcggccaacttacggggccggagaaatcaccgttcttgtggaggtcgcggatatggagctgcacaccaaaaaggtggaaattagcggtttgaagttcgcatccctagtatgcaccggctgttacgcctgctctagcgggatatcatgtaaagttcgcatccatgtggacgagcccgatgaactgactgtccacgtgaagagttccgaccctgatgtcgtggctgccagcacgtctctcatggcacgaaaactggagtttggaacagactcaattttcaaggctttcagtgccatgccaaaaaccagcctttgcttttatatcgttgaaagagagtactgtaagtcctgctctgaggatgacactaagaaatgtgtggataccaagctggaacagccccaatcgatattgattgagcacaaaggcacaatcatcggtaagcagaacgatacctgcactgcgaaagccagctgctggctcgaatccgtaaagtcattcttttatgggctgaagaatatgttaggcagtgtcttcggaaactttttcgtgggcattctgctatttctcgcaccgttcgttctgcttgtgttgtttttcatgtttgggtggaaaatcctgttctgttttaagtgctgtaggcggacacgtggactcttcaaataccgccatctgaaggacgacgaggagacgggttatagaaggattatagaacggcttaattctaaaaagggcaagaaccgactgttggacggggagcgcctcgctgatagaaaaatcgccgaactgttcagcaccaagactcacattgga

SEQ ID NO: 10777 - RNA, 1932 nt, synthetic construct
  misc_feature 1..1932: note = derived and/or modified CDS sequence (opt3) from CCHFV(Kashmanov)__DQ211631.1__Gc
  source 1..1932: mol_type = other RNA
ttcctggacagcatcgtgaagggcatgaaaaactccctcaattctacctcacttgagacaagtctgagcattgaagccccctggggagctataaacgtccagtccacttttaagcctacggtttctaccgcaaatatcgccttgtcgtggtcaagcgtggagcacagagggaacaaaattttagtaacaggtaggagtgaatccatcatgaagctggaggaacggactggcgtgtcttgggatctaggggtcgaggacgcgagcgagtccaaactcctgaccgtgtcaattatggatcttagtcaaatgtacagcccagttttcgaatatctgtctggagaccgccaggtggaggaatggccgaaggctacatgcaccggcgattgtcccgagcgatgcggttgtacttcctcaacatgcttgcataaggagtggcctcacagccgtaattggagatgtaacccaacctggtgctggggagtcgggacgggctgtacttgctgtggcgtggacgtaaaagatctctttaccgaccatatgttcgttaagtggaaagtggaatacatcaagacagaggccatagtctgcgtggaactgaccagtcaggagaggcagtgttctctgatcgaagcagggacccggtttaatctcggacccgtgacaattaccttatccgagcctcgcaacatccaacagaaactgccacccgagattatcacgcttcaccctaaggtcgaagagggtttctttgatttgatgcatgttcagaaggtgctgagcgcctcgactgtatgcaaactacagtcttgcacacacggcataccaggggacctccaagtgtatcacattggaaatctgcttaagggcgatagaatcaacggtcatctgattcacaaaatcgaaccgcatttcaatacctcctggatgtcatgggacgggtgtgatttggactactattgcaacatgggagactggcccagttgtacttacacaggcgtcacccagcacaatcacgctgcatttgtgaacctcctgaatatcgagacggattataccaagacattccattttcacagcaaaagggttactgcccatggcgacacccctcagttagatctgaaggctcggccaacatacggggccggagaaattactgtgctcgtcgaggtggcggacatggagcttcacaccaaaaaggtagaaatatccggtctgaagttcgcatctttggcctgcacaggctgttacgcttgcagctcagggatcagttgtaaagttcgcattcatgtggatgagcccgacgaactaaccgtccacgtgaagtccagcgatcctgacgtcgtggccgcatctacttcactgatggctcgaaaactcgagtttggaacggatagtacattcaaggccttcagcgcgatgccaaaaacctccctgtgcttttatatcgttgaaagagagtactgtaagtcttgctcggaggaagacactcagaagtgtgtggataccaaacttgagcaaccccagagcatactgattgaacacaagggcacaatcatcggtaaacagaacgacacttgcactgccaaggcatcctgctggttggagtcagtaaaaagtttcttttatgggctcaagaacatgctgggctctgtcttcggaaactttttcattggcatcttactgtttctagctccgttcgtgctcctggttttgtttttcatgtttgggtggaagattcttttctgttttaaatgctgtaggcggacacgtggactgctcaagtaccgccatctgaaagacgatgaggaaacgggttatagaaggataatcgagcggcttaataataagaaaggcaagaaccgactgttggacggggaacgcctcgccgatagaaagattgctgagctgttcagcaccaaaactcacatcgga

SEQ ID NO: 10778 - RNA, 1932 nt, synthetic construct
  misc_feature 1..1932: note = derived and/or modified CDS sequence (opt3) from CCHFV(Oman)__DQ211632.1__Gc
  source 1..1932: mol_type = other RNA
ttcctggacagcatcgccaagggcatgaaaaacctccttaattccacctctctggagacatcattgagtattgaagctccctggggagcaataaacgtgcagagcacttttaagcctacggtctccaccgccaatatcgcgttatcttggtcgtcagttgagcacagagggaacaaaattctggtgagcggtaggagtgaatccatcatgaagctagaggaacggacaggcatttcttgggatctcggggtagaggacgctagcgagtccaaactgcttactgtgtcagtcatggatctgagtcaaatgtacagcccagtgttcgaatatttgtctggagaccgccaggttgaggaatggccgaaggctacctgcacaggcgattgtcccgagcgatgcggttgtacctcctcaacttgcctccataaggagtggcctcacagccgtaattggagatgtaacccaacatggtgctggggagtggggaccggctgtacgtgctgtggcctggacgtcaaagatctgtttactgactacatgttcgtgaagtggaaagtagaatatatcaagaccgaggcaatagtttgcgtggaactcacaagtcaggagaggcagtgttctttaatcgaagccgggactcggtttaatctgggacccgtcaccattacactttccgagcctcgcaacatccaacagaaattgccacccgagattgtgaccctgcatcctagaatcgaagagggtttctttgatctaatgcacgtgcagaaggtcctcagcgcttcgacggtttgcaagctgcagtcttgcactcatggcgtgccaggggaccttcaagtataccacataggaaatctgttgaaaggcgataaggtgaacggtcacctcattcataaagtcgaaccgcacttcaatacatcctggatgtcatgggacgggtgtgatctggactattactgcaacatgggagactggcccagttgtacctatactggcgtgacacagcataatcacgcagcctttgttaacttactgaatatcgagaccgattacacgaagaacttccactttcatagcaaaagggtgaccgctcacggcgacacacctcagctcgatcttaaggcccggccaaactacggggcgggagaagtcactgtgctggtagaggttgcagacatggagttgcataccaaaaagattgaaatctccggtctaaagttcgcctctctgacatgcactggctgttatgcttgcagctcagggatcagttgtaaagtgcgcattcacgtcgatgagcccgacgaactcaccgtgcatgtcaagtccgaggatcctgacatagtggccgcatctagctcactgatggctcgaaaacttgaatttggaacagatagtaccttcaaggccttcagcgcgatgccaaaaacttccctgtgcttttacatcgttgagagagagtattgtaagtcttgctcgaaggaagacacgcagaaatgtgtgaatgccaagttggagaggccccaaagcattctcatcgaacacaaaggcacaataattggtaagcagaacgatacctgcactgcaaaagcctcctgctggctggagtcagtaaagagtttcttttacgggttaaagaatatgctgtctggcatcttcggaaacgtctttatcggcattttcctatttctcgccccgttcatcctgcttattttgtttttcatgtttgggtggcggatactgttctgttttaaatgctgtcgtcgcaccagaggactcttcaagtataggcacctgaaagacgacgaggaaacaggttaccggaagatcattgagcgacttaataacaaaaagggcaagaataaactgttggatggggaacgcctcgctgacagaaagatcgccgagctgttcagcaccaaaactcatatcgga

SEQ ID NO: 10779 - RNA, 1932 nt, synthetic construct
  misc_feature 1..1932: note = derived and/or modified CDS sequence (opt3) from CCHFV(SPU97/85)__DQ211633.1__Gc
  source 1..1932: mol_type = other RNA
ttcctggacagcatcgtgaagggcaaaaagaacctccttaattccacctctctggagacatcattgagtattgaagccccctggggagctataaacgtccagagcacttttaaacctacggtttccgcagccaatatcgcgttatcttggtcgtcagtggagcacagagggaacaagattctggtaagcggtaggagtgaatccatcatgaaactagaggaacggaccggcatttcttgggatctcggggtggaggacgctagcgagtccaagctgcttacagtctcagtgatggatctgagtcaaatgtacagcccagttttcgaatatttgtctggagaccgccaggtggaggaatggccgaaggccacttgcaccggcgattgtcccgagcgatgcggttgtacatcctcaacctgcctccataaagagtggcctcacagccgtaattggagatgtaacccaacttggtgctggggagtcgggacaggctgtacctgctgtggcctggacgtgaaggatctgtttacggactacatgttcgtaaaatggaaggttgaatatatcaaaactgaggcaatagtgtgcgtcgaactcaccagtcaggagaggcagtgttctttaatcgaagccgggacacggtttaatctgggacccgtgactattaccctttccgagcctcgcaacatccaacagaagttgccacccgagattatcacactgcatcctagaatagaagagggtttctttgatctaatgcacgtgcagaaggtcctcagcgcttcgaccgtttgcaaactgcagtcttgcacgcatggcgtgccaggggaccttcaagtataccacattggaaatctgttgaagggcgataaagtgaacggtcacctcatccataagattgaaccgcacttcaatacttcctggatgtcatgggacgggtgtgatctggactattactgcaacatgggagactggcccagttgtacatataccggcgtcactcagcataatcacgcagcctttgtgaacttactgaatatcgagacagattacaccaaaaacttccactttcatagcaagagggttacggctcacggcgacacccctcagctcgatcttaaagcccggccaacatacggggcgggagaagtgactgtcctggtggaggtagcagacatggagttgcataccaagaagatcgaaatttccggtctaaaattcgcctctctgagctgcacaggctgttatgcttgctcaagtgggatatcctgtaaggttcgcatccacgtggatgagcccgacgaactcactgtccatgtgaaaagcgaggatcctgacattgtcgccgcaggatcttcactgatggctcgaaaacttgaatttggcgccgatagtaccttcaaagcgttcagcgccatgccaaagacatccctgtgcttttacatcgtggagagagagtattgtaagtcttgctcgagggaagacacccagaaatgtgttaacactaagttggagcggccccaaagcatactcattgaacacaaaggtacgatcatcgggaagcagaatgatacatgcaccgcaaaggcttcctgctggctggagtcagtgaagagtttcttttacggcttaaagtctatgctgagcggaattttcggcaacgtatttatcgggattttcctatttatagccccgttcgtcctcctgatcctctttttcatgtttggatggcgtattttgttctgttttaaatgctgtcgcagaactaggggtctgttcaagtatcggcacctcaaagacgacgaggaaaccggctaccgaaagatcatcgagcgcctgaataacaaaaaggggaagaataaacttctggatggagaaagattggctgacaggaagattgccgagcttttctccacaaaatcacatataggc

SEQ ID NO: 10780 - RNA, 1932 nt, synthetic construct
  misc_feature 1..1932: note = derived and/or modified CDS sequence (opt3) from CCHFV(SPU103/87)__DQ211634.1__Gc
  source 1..1932: mol_type = other RNA
ttcctggacaacatcgtgaagggcatgaaaaatctccttaacagcacctccctggagacatctttgtcaattgaagccccctggggtgctataaatgtccagagtacttacaagcctacggttagcaccgcaaacatcgccttatcctggtcttcggtggagcacagaggaaataaaattctggtatcaggtaggagcgaaagtatcatgaagctagaggaacggacaggcatttcctgggatctcggggtggaggacgcgtctgagagcaaactgcttactgtctccgtgatggatctgtcacaaatgtatagtccagtttttgaatacttgagcggagaccgccaggtggaggaatggccgaaggctacctgcacaggcgattgtcccgagcgatgcggttgtacctcttccacttgcctccataaggagtggcctcactcacgtaactggagatgtaatccaacatggtgctggggagtcgggaccggctgtacgtgctgtggcctggacgtgaaagatctgttcactgactatatgtttgtaaagtggaaaatcgaatacataaagaccgaggccatcgtttgcgtggaactcacaagccaggagaggcagtgtagtttaattgaagcagggactcggttcaacctgggacccgtcaccatcacactttctgagcctcgcaatattcaacagaaattgccatccgagatcataaccctgcatcccagaattgaagaggggtttttcgatctaatgcacgtgcagaaggtgctcagcgcctcgacggtctgcaagctgcagtcttgcactcatggcgttcctggggaccttcaagtgtatcacatcggaaacctgttgaaaggcgataaggtaaatggtcacctcgtgcataaaattgaaccacactttaacacatcctggatgtcatgggacgggtgtgatctggactactattgcaatatgggagactggccgagttgtacctacactggcgtcacacagcataaccacgctagcttcgtgaatttactgaacatcgagaccgattacacgaagaactttcacttccattccaaaagggttaccgcacacggcgacacaccccagctcgatcttaaggcccggcctacttatggggctggagaaatcaccgtgctggtcgaggtggccgacatggagttgcatactaaaaagattgaaatatctggtctaaagtttacaagcctgacctgcacaggctgttacgcgtgctcaagtgggatctcctgtaaagtacgcattcacgttgatgagccagacgaactcaccgtgcatgtcaagagcgatgaccccgatgtggtcgcagcctcttcaagtctgatggctcgaaaacttgagttcggaactgacagcacgtttaaggccttctccgcaatgcctaaaacatctctgtgcttctatatcgtggaaagagagtactgtaagtcgtgcagcgaggaagatacccagaagtgtgttaatactaaattggagcaaccacagtccatactcattgaacacaagggcaccatcatcggtaaacagaacaatacatgcaaggctagggccgggtgctggctggagtcagtgaaaagtttcttttatggcttaaagaacatgctgtctggaatttttggcaatgtattcatcgggatttttctattcctcgcgccctttatactgcttatcttgttctttatgttcggatggcggattctgttttgtttcaagtgctgtcgtcgcaccagaggtctctttaaatacaggcacctgaaggacgacgaggaaactggctatcggaaaatcatcgagcgacttaacaataagaaagggaagaacaagctgttggatggagaacgcctcgccgacagaaggattgcagagctgttcagcacaaaaacgcatataggc

SEQ ID NO: 10781 - RNA, 1932 nt, synthetic construct
  misc_feature 1..1932: note = derived and/or modified CDS sequence (opt3) from CCHFV(SPU415/85)__DQ211635.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccgcagccaatatcgcgttatcttggtcgtcagtggagcacagagggaacaaaattctggtaagcggtaggagtgaatccatcatgaagctagaggaacggaccggcatttcttgggatctcggggtggaggacgctagcgagtccaaactgcttacagtctcagtgatggatctgagtcaaatgtacagcccagttttcgaatatttgtctggagaccgccaggtggaggaatggccgaaggccacttgcaccggcgattgtcccgagcgatgcggttgtacatcctcaacctgcctccataaggagtggcctcacagccgtaattggagatgtaacccaacttggtgctggggagtcgggacaggctgtacctgctgtggcctggacgtgaaagatctgtttacggactacatgttcgtaaagtggaaagttgaatatatcaagactgaggcaatagtgtgcgtcgaactcaccagtcaggagaggcagtgttctttaatcgaagccgggacacggtttaatctgggacccgtgactattaccctttccgagcctcgcaacatccaacagaaattgccacccgagattatcacactgcatcctagaatagaagagggtttctttgatctaatgcacgtgcagagggtcctcagcgcttcgaccgtttgcaagctgcagtcttgcacgcatggcgtgccaggggaccttcaagtataccacattggaaatctgttgaagggcgataaagtgaacggtcacctcatccataagattgaaccgcacttcaatacttcctggatgtcatgggacgggtgtgatctggactattactgcaacatgggagactggcccagttgtacatataccggcgtcactcagcataatcacgcagcctttgtgaacttactgaatatcgagacagattacaccaaaaacttccactttcatagcaagcgggttacggctcacggcgacacccctcagctcgatcttaaagcccgcccaacatacggggcgggagaagtgactgtcctggtggaggtagcagacatggagttgcataccaagaaaatcgaaatttccggtctaaagttcgcctctctgacatgcactggctgttatgcttgcagctcagggataagttgtaaggttaaaatccacgtggatgagcccgacgaactcaccgtccatgtgaagtccgaggatcctgacattgtcgccgcaggaagctctctgatggctcgaaaacttgaatttggcgccgattcaacattcaaggcgttcagtgccatgccaaaaaccagcctgtgcttttacatcgtggagagagagtattgtaagtcctgctctagggaagacactcggaagtgtgttaacacgaaattggatcgtccccagtcgatactcattgagcacaagggtacaatcatcgggaaacaaaataatacctgcactgcaaaggctagctgctggctggaatccgtgaaatcattcttttacggcttaaagaacatgctgagtggaattttcggcaacgtatttatcgggattttcctatttatagccccgttcgtcctcctgatcttgtttttcatgtttggatggcgcattcttttctgttttaagtgctgtagaaggacccggggtctgttcaaatatcgacacctcaaggacgacgaggagacaggctaccgcaaaatcatcgaaagactgaataacaagaaagggaagaataaacttctggatggagagaggttggctgaccggaagattgccgaactcttctctaccaagagccatataggc

SEQ ID NO: 10782 - RNA, 1932 nt, synthetic construct
  misc_feature 1..1932: note = derived and/or modified CDS sequence (opt3) from CCHFV(Turkey200310849)__DQ211636.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctgcagtttccacggccaatatcgcgttatcttggtcgtcagtggagcacagagggaacaaaattctggtaaccggtaggagcgaaagtatcatgaagctagaggaacggacaggcgtgtcctgggatctcggggtcgaggacgcttctgagagcaaactgcttactgtgtccattatggatctgtcacaaatgtacagtccagttttcgaatatttgagcggagaccgccaggtggaggaatggccgaaggctacctgcacaggcgattgtcccgagcgatgcggttgtacctcttccacttgcctccataaggagtggcctcactcacgtaattggagatgtaacccaacatggtgctggggagtcgggaccggctgtacgtgctgtggcgtggacgtaaaagatctgtttactgaccatatgttcgttaagtggaaagtggaatacatcaagaccgaggcaatagtctgcgtggaactgacaagccaggagaggcagtgtagtctcatcgaagccgggactcggtttaatttaggacccgtgaccattacactgtctgagcctcgcaacatccaacagaaacttccacccgagattatcaccttgcaccctaagatagaagagggtttctttgatctgatgcatgtccagaaggttctatccgctagcacggtgtgcaaactccagtcgtgcactcacggcattccaggggacctgcaagtatatcacatcggaaatcttctgaagggcgatagagtgaacggtcatttgattcacaaaatcgaatctcatttcaatacatcctggatgtcatgggacgggtgtgatctcgactactattgcaacatgggagactggccgagttgtacctacactggcgtcacacagcacaatcacgcagcctttgtgaacctgttaaatatcgagaccgattatacgaagaccttccattttcacagcaaaagggttacagctcatggcgacactccccagctggatctcaaggcccggcctacctacggggcgggagaaattacagtgcttgtcgaggtggcagacatggagctgcacactaaaaaggtagaaatatccggtttgaagttcgcctctctagcttgcaccggctgttacgcctgcagctcagggatcagttgtaaagttcgcattcatgtggatgagccagacgaactgacagtccacgtgaagtccagcgatcccgacgtcgtggcagcttctacctcactcatggcccgaaaactggagtttggaactgatagtacgttcaaggcgttcagcgccatgcctaaaacatccctttgcttttatatcgttgaaagagagtactgtaagtcttgctcggaggacgatacccagaagtgtgtggacactaggctggaacaaccacagagcatattgattgagcacaaaggcaccatcatcggtaagcagaacgacacatgcaccgcaaaagcctcctgctggctcgaatcagtaaagagtttcttttatgggctgaaaaacatgttaggctctgtcttcggaaatctgtttattggcatcctactcttcctggccccctttgtgcttttggttctgttctttatgttcgggtggaagattctcttttgtttcaagtgctgtcggcgtactcgcggactgtttaaatacagacatcttaaggatgacgaggagacaggttataggcggataatcgaacgactgaacagcaaaaagggcaaaaatcgcttgctcgatggggacagactggctgataggaagattgccgagttattctccacgaagacccacatcgga

SEQ ID NO: 10783 - RNA, 1932 nt, synthetic construct
  misc_feature 1..1932: note = derived and/or modified CDS sequence (opt3) from CCHFV(Iran-52)__DQ446215.1__Gc
  source 1..1932: mol_type = other RNA
ttcctggacagcatcgtgaagggcatgaaaaacctccttaattccacctctctggagacatcattgagtattgaagccccctggggtgctataaacgtccagagcacttacaagcctacggtttccaccgcaaatatcgccttatcttggtcgtcagtggagcacagaggaaacaaagtactggtgagcggtaggagtgaatccattatgaagctagaggaacggacaggcatctcttgggatctcggggtcgaggacgcgagcgagtccaaactgcttactgtgtcagttatggatctgagtcaaatgtatagcccagtgtttgaatacttgtctggagaccgccaggtcgaggaatggccgaaggctacctgcacaggcgattgtcccgagcgatgcggttgtacctcctcaacttgcctccataaggagtggcctcacagccgtaattggagatgtaacccaacatggtgctggggagtggggaccggctgtacgtgctgtggcctggacgtaaaagatctgttcactgactatatgtttgttaagtggaaagtggaatacattaagaccgaggccatcgtctgcgtggaactcacaagtcaggagaggcagtgttctttaatagaagcagggactcggttcaatctgggatccgtgaccatcacacttagcgagccccgcaacattcaacagaaattgcctccagagatcattaccctgcatcccaagatcgaagaggggtttttcgatctaatgcacgtccagaaggttctctcggcctctacggtgtgcaaactgcagtcctgcactcatggcgtacctggggaccttcaagtgtatcacataggaaatctgttgaagggcgatagagtcaacggtcacctcattcataaaatcgaacagcactttaatacatcatggatgagttgggacgggtgtgatctggactactattgcaacatgggagactggccaagctgtacctacactggcgtgacacagcataatcacgcttccttcgttaacttactgaatattgagaccgattacacgaagacctttcacttccattctaaaagggtgacagcacacggcgacactccgcagctcgatcttaaggcccggcccacctatggggctggagaaatcacagtcctggtggaggtagccgacatggagttgcatactaaaaagatcgaaattagcggtctaaagtttgcgggcctgacctgcacagggtgttacgcatgctcaagtggaatatcctgtaaagttcgcatccacgtggaggaacctgatgagctcaccgtccatgtgaagtctgacgatccagacgtcgtggccgcttcttcaagtctgatggcccgaaaacttgagttcggcactgatagcacgtttaaggcattctccgctatgcccaaaacatctctgtgcttctatattgttgagagagagtactgtaagtcgtgcagcaaggaagacacccaaaaatgtgtgaacactaagttggagcagcctcagtccatcctcatagaacacaaaggtaccattatcgggaagcaaaacaatacatgcaccgccaaagcgtcatgctggctggagagtgtaaagagctttttctatggcttaaagaacatgctgggaggcatctttgggaatgtcttcattggaatctttactttcctaacaccatttattctcctgatacttttctttatgttcggttggaggatcttgttttgtttcaaatgctgtcggcgtacgcgcggcctgtttaagtacagacacctcaaagatgacgaggaaaccgggtataggaagattatcgagcggctgaacaataaaaagggaaagaaccgacttctggacggcgaacgcttggccgatagaaaaatcgcagaactcttcagcactaagacacatattggt

SEQ ID NO: 10784 - RNA, 1932 nt, synthetic construct
  misc_feature 1..1932: note = derived and/or modified CDS sequence (opt3) from CCHFV(Iran-53)__DQ446216.1__Gc
  source 1..1932: mol_type = other RNA
ttcctggacagcatcgtgaagggcatgaaaaacctccttaattccacctctctggagacatcattgagtattgaagccccctggggtgctataaacgtccagagcacttacaagcctacggtttccaccgcaaatatcgccttatcttggtcgtcagtggagcacagaggaaacaaagtactggtgagcggtaggagtgaatccattatgaagctagaggaacggacaggcatctcttgggatctcggggtcgaggacgcgagcgagtccaaactgcttactgtgtcagttatggatctgagtcaaatgtatagcccagtgtttgaatacttgtctggagaccgccaggtcgaggaatggccgaaggctacctgcacaggcgattgtcccgagcgatgcggttgtacctcctcaacttgcctccataaggagtggcctcacagccgtaattggagatgtaacccaacatggtgctggggagtggggaccggctgtacgtgctgtggcctggacgtaaaagatctgttcactgactatatgtttgttaagtggaaagtggaatacattaagaccgaggccatcgtctgcgtggaactcacaagtcaggagaggcagtgttctttaatagaagcagggactcggttcaatctgggatccgtgaccatcacacttagcgagccccgcaacattcaacagaaattgcctccagagatcattaccctgcatcccaagatcgaagaggggtttttcgatctaatgcacgtccagaaggttctctcggcctctacggtgtgcaaactgcagtcctgcactcatggcgtacctggggaccttcaagtgtatcacataggaaatctgttgaagggcgatagagtcaacggtcacctcattcataaaatcgaacagcactttaatacatcatggatgagttgggacgggtgtgatctggactactattgcaacatgggagactggccaagctgtacctacactggcgtgacacagcataatcacgcttccttcgttaacttactgaatattgagaccgattacacgaagacctttcacttccattctaaaagggtgacagcacacggcgacactccgcagctcgatcttaaggcccggcccacctatggggctggagaagtcacagtgctggtagaggttgccgacatggagttgcatactaaaaagatcgaaatcagcggtctaaagtttgcgggcctgacctgcacagggtgttacgcatgctcaagtggaatttcctgtaaagtgcgcatacacgtcgatgagcctgacgaactcaccgtgcatgtcaagagcgatgacccagatgtggttgccgcttcttcaagtctgatggcccgaaaacttgagttcggcactgacagcacgtttaaggcattctccgctatgcccaaaacatctctgtgcttctatatcgtggaaagagagtactgtaagtcgtgcagcaaggaggatacccaaaaatgtgtaaacactaagttggaacagcctcagtccattctcatcgagcacaaaggtaccataattgggaagcaaaacaatacatgcaccgccaaagcgtcatgctggctggaaagtgtcaagagctttttctatggcttaaagaacatgctgggaggcatctttgggaatgtgttcatcggaatttttactttcctaacaccatttatcctcctgattcttttctttatgttcggttggaggatattgttttgtttcaaatgctgtcggcgtacgcgcggcctgtttaagtacagacacctcaaagacgacgaggagaccgggtataggaagatcattgaacggctgaacaataaaaagggaaagaaccgacttctggatggcgagcgcttggccgacagaaaaatcgcagaactcttctctactaagacacatatcggt

SEQ ID NO: 10785 - RNA, 1932 nt, synthetic construct
  misc_feature 1..1932: note = derived and/or modified CDS sequence (opt3) from CCHFV(Kosova Hoti)__EU037902.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcatttcctgggatctcggggtggaggacgcgtctgagagcaaactgcttaccgtctccatcatggatctgtcacaaatgtacagtccagtgttcgaatatttgagcggagaccgccaggttgaggaatggccgaaggctacatgcaccggcgattgtccccagcgatgcggttgtacttcttccacatgcctccataaggagtggcctcactcacgtaattggagatgtaacccaacctggtgctggggagtggggacgggctgtacttgctgtggcgtcgacgtgaaagatctgtttaccgaccatatgttcgtaaagtggaaagttgagtacataaagacagaagccatcgtgtgcgtcgagctgactagccaggaaaggcaatgtagtctcattgaggcagggacccggtttaatttaggacccgtgacaatcaccctgtctgaacctcgcaacattcagcagaaacttccacccgagatcataacgttgcaccctaagattgaggaaggtttctttgatctgatgcatgtgcagaaggtcctatccgccagcactgtttgcaaactccaatcgtgcacacacggcatcccaggggaccttcaggtgtatcacattggaaatctgctgaagggcgatagagtaaacggtcatttgatccacaaaatcgagccgcatttcaatacctcttggatgtcctgggacgggtgtgatctcgactactattgcaacatgggagactggccctcatgtacttacacaggcgtgacccagcacaatcacgctgcatttgtcaacctgttaaatattgaaacggattataccaagacattccattttcacagtaaaagggtgactgcccatggcgacacccctcagctggatctcaaggctcggccaacatacggggccggagagataactgttcttgtggaagtcgcggacatggagctgcacaccaaaaaggtggagatcagcggtttgaagttcgcatccctagcctgcacaggctgttacgcttgctctagcgggatttcatgtaaagtacgcatccatgttgatgaacccgacgagctgaccgtgcacgtcaagagttccgatcctgacgtggtcgccgcaggaactagcctcatggctcgaaaactggaatttggcacggattctacattcaaggccttctcagcgatgccaaaaaccagtctttgcttttatatagtggagaaggaatactgtaagagctgctccgaggacgatactaaaaagtgtgttgacaccaaactggagcaaccccagtctattttgatcgaacacagaggtacaatcattgggaagcagaacgatacctgcactgccaaagcatcgtgctggctcgagagcgtgaagtccttcttttatggcctgaagaacatgttaggatcagtattcggcaactttttcatcgggattctgctatttctcgctccgttcgtcctgcttgtgttgtttttcatgtttggatggaaaatactgttctgttttaagtgctgtaggcggacacgtggtctcttcaaataccgccatctgaaggacgacgaagagacgggctatagaaggatcattgagcggcttaataataaaaaggggaagaaccgactgttggatggagaacgcctcgccgacagaaaaatcgctgagctgttcagtaccaagactcacatcggc

SEQ ID NO: 10786 - RNA, 1932 nt, synthetic construct
  misc_feature 1..1932: note = derived and/or modified CDS sequence (opt3) from CCHFV(YL04057)__FJ562094.1__Gc
  source 1..1932: mol_type = other RNA
ttcctggacagcatcgccaagggcaaaaagtccctccttaactctacctcactggagacaagtttgagcattgaagctccctggggagcaataaatgtgcagtccacttttaaacctacggtctctgccgcgaacatcgctttatcgtggtcaagcgttgagcacagaggaaataagattctggtgagtggtaggtccgaatctatcatgaaactagaggaacggaccggcgtaagctggaacctcggggtggaggatgcctccgagtcaaagacactgactgtcagtgtgatggaccttagccaaatgtactctccagttttcgaatatctgtccggagatcgccaggtggaggaatggccgaaggcaacctgcacaggcgactgtcccgagcgatgcggttgtacctcaagcacttgcttgcataaagagtggcctcacagtcgtaattggagatgttctccaacatggtgctggggagtcgggaccggctgtacgtgctgtggcctcgatgtgaaggactttttcactgattacatgctggtaaaatggaaggttgaatatattaaaaccgaggccatcgtgtgcgtcgaactgacatcccaggagaggcagtgtagcctcatagaagctgggactcggtttaacttaggacccgtgaccatcacactgtcggagcctcgcaatgtgcaacagagacttccacccgagattgtcaccttgcatcctaagatcgaagagggtttctttgacctgatgcacgttcagaagattctatctgcatccacggtgtgcaaactccagtcatgcactcatggcgtaccaggggatttccaagtgtaccacgtcggaaacctgcttaggggcgacaaggtgaatggtcacagtatccataaaatagaaccgcactttaacacaagctggatgtcctgggatgggtgtgacctggattatttctgcaatatgggagactggccctcttgtacctacactggcgttacacagcataaccgggccgcttttattaatatgttgaacatcgagaccgactatacgaagaccttccactttcacagcaaacgcgtgacagcccatggcgatactcctcagctcgacctgaaggcgcgaccagcatacggggccggagaagtcaccgtgttagtagaggttgctgatctggagctccacacaaagaaacttgaagtgtcaggtctgaagattgccagtttgacttgctccggctgttacgcatgcagctctgggatctcatgtaaagtcagaatccatgtgaatgagcccgacgaatttaccgtccacgtgaggagtagcgatcctgacgttgtggctgccggatcctctctaatggcgcggaagattgagttcggcgccgattcgacattcaaagcattcagctccatgccaaaggactcactgtgcttttatatagtagaaaaagattactgtagttcttgcaccgacgatgacactcagaagtgtgtcaacacgaagctcgaccatccccaaagcatcctgattgagcacaaaggtacaatcatagggaagcagaacgatacctgctccactaaaacctcatgctggcttgagagcgtgaagggcttcttttatggactgaaaaatatgttgtctggcattttcgggaacgtttttctcggaatcctgttattcctggctccgtttgtgctactcatcttctttttctttttcggttggcgtctgcttttctgtttgaagtgctgtcgcagaacaaggggcctgctcaagtacaaacacctgaaggacgaagaggaagccgggtataaaaagattatcgagcggcttaatgggaaaaagggcaagtcccagctgtttgatggtgagcgattggctgaccgcaaaattgccgaactcttcagtaccaagatacatatcggg

SEQ ID NO: 10787 - RNA, 1932 nt, synthetic construct
  misc_feature 1..1932: note = derived and/or modified CDS sequence (opt3) from CCHFV(V42/81)__GU477490.1__Gc
  source 1..1932: mol_type = other RNA
ttcctggacagcatcgtgaagggcaaaaagaacctccttaattccacctctctggagacatcattgagtattgaagccccctggggagctataaacatccagagcacttttaaacctacggtctccgcagccaatattgcgttatcttggtcgtcagttgagcacagagggaacaagatcctggtgagcggtaggagtgaatccattatgaaactagaggaacggaccggcgtatcttggaatctcggggtggaggatgctagcgagtccaagctgcttacagtctcaatcatggacctgagtcaaatgtacagcccagtgttcgaatatttgtctggagatcgccaggttgaggaatggccgaaggccacttgcaccggcgactgtcccgagcgatgcggttgtacatcctcaacctgcctccataaagagtggcctcacagccgtaactggagatgtaatccaacttggtgctggggagtggggacaggctgtacctgctgtggcgtcgatgtgaaggacctgtttatagatcatatgttcgtaaaatggaaggttgaatacatcaaaacggaggcaattgtgtgcgtcgaactgaccagtcaggagaggcagtgttctctcatcgaagccgggacccggtttaacttaggacccgtgacaattactctgtccgagcctcgcaatatccaacagaaacttccacccgagataattaccttgcaccctaagatcgaagagggtttctttgacctgatgcatgtgcagaaggtcctaagcgcttcgacagtttgcaagctccagtcttgcacccacggcattccaggggatctgcaagtgtatcacatcggaaaccttctgaaaggcgacagagtaaatggtcatttgatccacaagattgaaccgcatttcaacacgtcctggatgtcatgggatgggtgtgacctcgattactattgcaatatgggagactggcccagttgtacttacacaggcgtgacccagcacaaccacgcagcctttgtcaatctgttaaacatagagactgactatacaaaaaccttccattttcacagcaagagggtgacggctcatggcgaaacccctcagctggatctcaaagcccggccagcgtacggggcaggagagatcacagttcttgtggaggtcgccgacatggaactgcacactaagaaggtggagatttccggtttgaaattcgcttctctagcctgcaccggctgttacgcatgcagctcagggatcagttgtaaggtacgcatacatgttgatgaacccgacgagctgacagtgcacgtcaaatccaacgatcctgacgtggtcgctgccagcacttctctcatggcgcgaaagctggaatcaggaaccgatagtacatttaaagccttcagcgcaatgccaaagacctccctttgcttctatattgtggagagagagtactgtaagtcttgctcggaagacgatactcagaaatgtgttgagacgaagctggaacaaccccagagcatcttgatcgagcacaaaggcacaattatcggtaagcagaatgacacttgcactgctaaagcctcctgctggctcgagtcagtgaagagtttcttttatgggctgaagaacatgttaggctctgtatttggaaatttctttattggcatactgctattcctcgctccgtttgtcctgcttgtgttgttctttatgttcgggtggaaaatcctgttttgtttcaagtgctgtaggcggacccgtggactctttaaataccgccatctgaaggaagatgaggaaacaggttatagaaggattatcgagcggcttaacagcaaaaagggcaagaatcgactgttggacggggaacgcctcgccgacagaaaaatcgcagagctgttctccaccaagactcacattgga

SEQ ID NO: 10788 - RNA, 1932 nt, synthetic construct
  misc_feature 1..1932: note = derived and/or modified CDS sequence (opt3) from CCHFV(79121M18)__GU477493.1__Gc
  source 1..1932: mol_type = other RNA
ttcctggacagcaccgccaagggcatgaaatccctccttaactctacatcactggagacgagtttgagcatcgaagctccctggggagcaattaatgtgcagtccacttttaagcctaccgtctctgccgcgaacatagctttatcgtggtcaagcgttgagcacagagggaataaaatcctggtgagtggtaggtccgaatctattatgaagctagaggaacggacaggcgtaagctggaacctcggggtggaggatgcctccgagtcaaaaactctgaccgtcagtgtgatggaccttagccaaatgtactctccagttttcgaatatctgtccggagatcgccaggtggaggaatggccgaaggcaacatgcaccggcgactgtcccgagcgatgcggttgtacttcaagcacatgcttgcataaggagtggcctcacagtcgtaattggagatgtaacccaacctggtgctggggagtcgggacgggctgtacttgctgtggcctcgatgtgaaagactttttcaccgattacatgctggtaaagtggaaagttgaatatatcaagacagaggccattgtgtgcgtcgaactgacttctcaggagaggcagtgttccctcatcgaagctgggacccggtttaatttaggacccgtgacaataaccctgagcgagcctcgcaacgtgcaacagagacttccacccgagatcgtcacgttgcatcctaaaattgaagagggtttctttgacctgatgcacgttcagaagatcctatcggcatctactgtgtgcaagctccagtcctgcacacatggcgtaccaggggatttccaaatttaccacgtgggaaatctgcttaggggcgacaaagtcaacggtcactcaatccataagatagaaccgcactttaataccagttggatgagctgggatgggtgtgacctggattatttctgcaacatgggagactggccctcctgtacttacacaggcgtgacccagcataatcgggccgcttttattaacatgttgaatatcgagacggactataccaaaacattccactttcactctaagcgcgttactgcccatggcgatacccctcagctcgacctgaaagcgcgaccagcatacggggccggagaagtgacagtcttagtggaggtagctgatctggagctccacactaagaaacttgaagttagcggtctgaagattgcctcattgacctgcagtggctgttacgcatgctccagcgggatctcttgtaaggtgagaatccatgtcaacgagcccgacgaatttacagtgcacgtcaggtcaagtgatcctgacgtggttgctgccggaagctccctaatggcgcggaaaattgagttcggcgccgattctaccttcaaggcattctcgagcatgccaaaagactccctgtgcttttatatagtggaaaaggattactgttcaagttgcactgacgatgacacgcagaaatgtgtaaacacaaagctcgaccatccccaatctatcctgattgagcacaagggtaccatcatagggaaacagaatgatacttgcagcaccaagacatcctgctggcttgagtcagtcaaaggcttcttttatggactgaagaacatgttgagcggcattttcgggaatgtgtttctcggaatcttcctgtttttagctccgttcgttctgctaatctttttctttttcttcggttggcgtctcctgttttgtcttaaatgctgtcgcagaaccaggggcttgctgaagtacaagcacctcaaagacgaagaggaagccgggtataagaaaattatcgagcggctgaacggaaagaaaggcaagtctcagcttttcgatggtgagcgactggctgaccgcaagattgccgaattgttttccactaaaatacatatcggg

SEQ ID NO: 10789 - RNA, 1932 nt, synthetic construct
  misc_feature 1..1932: note = derived and/or modified CDS sequence (opt3) from CCHFV(Afg09-2990)__HM452306.1__Gc
  source 1..1932: mol_type = other RNA
ttcctggacagcatcgtgaagggcatgaaaaacctccttaattccacctctctggagacatcattgagtattgaagccccctggggtgctataaacgtccagagcacttacaagcctacggtttccaccgcaaatatcgccttatcttggtcgtcagtggagcacagaggaaacaaagtactggtgagcggtaggagtgaatccattatgaagctagaggaacggacaggcatctcttgggatctcggggtcgaggacgcgagcgagtccaaactgcttactgtgtcagttatggatctgagtcaaatgtatagcccagtgtttgaatacttgtctggagaccgccaggtcgaggaatggccgaaggctacctgcacaggcgattgtcccgagcgatgcggttgtacctcctcaacttgcctccataaggagtggcctcacagccgtaattggagatgtaacccaacatggtgctggggagtggggaccggctgtacgtgctgtggcctggacgtaaaagatctgttcactgactatatgtttgttaagtggaaagtggaatacattaagaccgaggccatcgtctgcgtggaactcacaagtcaggagaggcagtgttctttaatagaagcagggactcggttcaatctgggatccgtgaccatcacacttagcgagccccgcaacattcaacagaaattgcctccagagatcattaccctgcatcccaagatcgaagaggggtttttcgatctaatgcacgtccagaaggttctctcggcctctacggtgtgcaaactgcagtcctgcactcatggcgtacctggggaccttcaagtgtatcacataggaaatctgttgaagggcgatagagtcaacggtcacctcattcataaaatcgaacagcactttaatacatcatggatgagttgggacgggtgtgatctggactactattgcaacatgggagactggccaagctgtacctacactggcgtgacacagcataatcacgcttccttcgttaacttactgaatattgagaccgattacacgaagacctttcacttccattctaaaagggtgacagcacacggcgacactccgcagctcgatcttaaggcccggcccacctatggggctggagaaatcacagtcctggtggaggtagccgacatggagttgcatactaaaaagatcgaaattagcggtctaaagtttgcgggcctgacctgcacagggtgttacgcatgctcaagtggaatatcctgtaaagttcgcatccacgtggatgagcctgacgaactcaccgtccatgtgaagtctgatgacccagatgtcgtggccgcttcttcaagtctgatggcccgaaaacttgagttcggcactgacagcacgtttaaggcattctccgctatgcccaaaacatctctgtgcttctatattgttgaaagagagtactgtaagtcgtgcagcaaggaggatacccaaaaatgtgtgaacactaagttggaacagcctcagtccatcctcatagagcacaaaggtaccattatcgggaagcaaaacaatacatgcaccgccaaagcgtcatgctggctggaaagtgtaaagagctttttctatggcttaaagaacatgctgggaggcatctttgggaatgtcttcattggaatctttactttcctaacaccatttattctcctgatacttttctttatgttcggttggaggatcttgttttgtttcaaatgctgtcggcgtacgcgcggcctgtttaagtacagacacctcaaagacgacgaggagaccgggtataggaagattatcgaacggctgaacaataaaaagggaaagaaccgacttctggatggcgagcgcttggccgacagaaaaatcgcagaactcttcagcactaagacacatattggt

SEQ ID NO: 10790 - RNA, 1932 nt, synthetic construct
  misc_feature 1..1932: note = derived and/or modified CDS sequence (opt3) from CCHFV(Sudan Al-Fulah 3-2008)__HQ378184.1__Gc
  source 1..1932: mol_type = other RNA
ttcctggacagcatcgtgaagggcatgaaaaacctccttaattccacctctctggagacatcattgagtattgaagccccctggggtgctataaacgtccagagcacttacaagcctacggtttccaccgcaaatatcgccttatcttggtcgtcagtggagcacagaggaaacaaaattctggtaagcggtaggagtgaatccatcatgaagctagaggaacggacaggcatttcttgggatctcggggtggaggacgcgagcgagtccaaactgcttactgtctcagtgatggatctgagtcagatgtatagcccagtttttgaatacttgtctggagaccgccaggtggaggaatggccgaaggctacctgcacaggcgattgtcccgagcgatgcggttgtacctcctcaacttgcctccataaggagtggcctcacagccgtaattggagatgtaacccaacatggtgctggggagtcgggaccggctgtacgtgctgtggcctggacgtgaaagatctgttcactgactatatgtttgtaaagtggaaagttgaatacatcaagaccgaggccatagtgtgcgtcgaactcacaagtcaggagaggcagtgttctttaatcgaagcagggactcggttcaatctgggacccgtgaccattacactttccgagcctcgcaacatccaacagaaattgccacccgagattatcaccctgcatcctagaatagaagaggggtttttcgatctaatgcacgtgcagaaggtcctcagcgcctcgacggtttgcaagctgcagtcttgcactcatggcgtgccaggggaccttcaagtatatcacattggaaatctgttgaaaggcgataaggtgaacggtcacctcatccataaaattgaaccgcactttaatacatcctggatgtcatgggacgggtgtgatctggactactattgcaacatgggagactggcccagttgtacctacactggcgtcacacagcataatcacgctagcttcgtgaacttactgaatatcgagaccgattacacgaagaactttcacttccattccaaaagggttaccgcacacggcgacacacctcagctcgatcttaaggcccggccaacttatggggctggagaaatcaccgtgctggtcgaggtggccgacatggagttgcatactaaaaagattgaaatatctggtctaaagtttgcgagcctgacatgcaccggctgttacgcatgctcaagtgggatctcctgtaaagtacgcattcacgttgatgagcccgacgaactcacagtgcatgtcaagagcgatgaccctgatgtggtcgccgcttcttcaagtctgatggcccgaaaacttgagttcggaaccgacagcacttttaaggcattctccgctatgccaaaaacgtctctgtgcttctatatcgtggaaaaggagtactgtaagtcgtgcagcgaggaagataccaaaaagtgtgttaacacaaaattggagcagccccaatccatactcattgaacacaagggcactatcatcggtaaacaaaattcaacctgcacagccaaggtgagttgctggctggagtctgccaagagctttttctatgggttaaaagacatgctgtccggcatttttggaaacgtattcatcggcatttttctattcctcgcgccgtttgtcctgcttgtgttgttctttatgttcgggtggagaatactgctctgttttaggtgctgtcggcgtacccgcggactgttcaagtacagacaccttaaagacgatgaggaaactggttataggcggatcattgagcgactgaataacaagaaaggcaagaataagttgctcgacggggaacgcctggcagatagaaaaatcgctgagttattttcaacaaagacgcatatcgga

SEQ ID NO: 10791 - RNA, 1932 nt, synthetic construct
  misc_feature 1..1932: note = derived and/or modified CDS sequence (opt3) from CCHFV(Sudan AB1-2009)__HQ378187.1__Gc
  source 1..1932: mol_type = other RNA
ttcctggacagcatcgccaagggcatgaaaaacctccttaattccacctctctggagacatcattgagtattgaagctccctggggtgcaataaacgtgcagagcacttacaagcctacggtctccaccgccaatatcgcgttatcttggtcgtcagttgagcacagaggaaacaaaattctggtgagcggtaggagtgaatccatcatgaagctagaggaacggacaggcatttcttgggatctcggggtagaggacgctagcgagtccaaactgcttactgtgtcagtcatggatctgagtcaaatgtatagcccagtgtttgaatacttgtctggagaccgccaggttgaggaatggccgaaggcaacctgcacaggcgattgtcccgagcgatgcggttgtacctcctcaacttgcctccataaggagtggcctcacagccgtaattggagatgtaacccaacatggtgctggggagtggggaccggctgtacgtgctgtggcctggacgtcaaagatctgttcactgactatatgtttgtgaagtggaaagtagaatacatcaagaccgaggcaatagtttgcgtggaactcacaagtcaggagaggcagtgttctttaatcgaagccgggactcggttcaatctgggacccgtcaccattacactttccgagcctcgcaacatccaacagaaattgccacccgagattatcaccctgcatcctagaatagaagaggggtttttcgatctaatgcacgtgcagaaggtgctcagcgcttcgacggtctgcaagctgcagtcttgcactcatggcgttccaggggaccttcaagtgtatcacattggaaatctgttgaaaggcgataaggtaaacggtcacctcatccataaaattgaaccgcactttaatacatcctggatgtcatgggacgggtgtgatctggactactattgcaacatgggagactggcccagttgtacctacactggcgtgacacagcataatcacgccagcttcgtcaacttactgaatatcgagaccgattacacgaagaactttcacttccattccaaaagggtgaccgcccacggcgacacacctcagctcgatcttaaggctcggccaacttatggggccggagaaatcaccgttctggtggaggtcgcggacatggagttgcatacaaagaagattgaaatatctggtctaaagtttgcaagcctgacttgcaccggctgttacgcctgctcaagtgggatctcctgtaaagtgcgcattcacgtagatgagcccgacgaactcacagttcatgtgaaaagcgatgaccctgatgtcgtggctgcctcttcaagtctgatggcacgaaaacttgagttcggaaccgacagcacttttaaggctttctccgccatgccaaaaacgtctctgtgcttctatatcgtcgaaagagagcactgtaagtcgtgcaacgaggaagatacaaagaaatgtgtgaataccaagttggagcagccccaaagcatactcattgaacacaaaggcactatcatcggtaagcagaactctacctgcacagcgagggcctcatgctggctggagagtgttaaatcctttttctacgggttaaagaatatgctgagcggcatttttggaaacgtgttcatgggcatctttctattcctcgcaccgtttattctgcttatattgttctttatgttcgggtggcggatcctgttttgtttcaagtgctgtcgtcgcaccagaggactctttaaatataggcatctgaaggacgacgaggaaactggttaccggcgaattatcgagcgccttaataacaaaaagggcaaaaataagctgttggatggggaaagactcgctgacaggcggatcgccgagctgttctccacaaagacgcacattgga

SEQ ID NO: 10792 - RNA, 1932 nt, synthetic construct
  misc_feature 1..1932: note = derived and/or modified CDS sequence (opt3) from CCHFV(NIVA 118595)__JN572083.1__Gc
  source 1..1932: mol_type = other RNA
ttcctggacagcatcgtgaagggcatgaaaaacctccttaattccacctctctggagacatcattgagtattgaagccccctggggtgctataaacgtccagagcacttacaagcctacggtttccgcagccaatatcgcgttatcttggtcgtcagtggagcacagaggaaacaaaattctggtaagcggtaggagtgaatccatcatgaagctagaggaacggaccggcatttcttgggatctcggggtggaggacgctagcgagtccaaactgcttacagtctcagtgatggatctgagtcaaatgtatagcccagtttttgaatacttgtctggagaccgccaggtggaggaatggccgaaggccacttgcaccggcgattgtcccgagcgatgcggttgtacatcctcaacctgcctccataaggagtggcctcacagccgtaattggagatgtaacccaacttggtgctggggagtcgggacaggctgtacctgctgtggcctggacgtgaaagatctgttcacggactatatgtttgtaaagtggaaagttgaatacatcaagactgaggcaatagtgtgcgtcgaactcaccagtcaggagaggcagtgttctttaatcgaagccgggacacggttcaatctgggatccgtgactattacccttagcgagccccgcaacatccaacagaaattgcctccagagattatcacactgcatcccagaatagaagaggggtttttcgatctaatgcacgtgcagaaggtcctctcggcttctaccgtttgcaagctgcagtcctgcacgcatggcgtgcctggggaccttcaagtatatcacattggaaatctgttgaaaggcgatagggtgaacggtcacctcatccataagattgaacagcacctgaatacttcatggatgagttgggacgggtgtgatttagactactattgcaacatgggagactggccaagctgtacatacaccggcgtcactcagcataatcacgcatcctttgtgaacctgctcaatatcgagacagattacaccaaaacgttccactttcattctaagcgggttaccgcccacggcgacacaccgcagcttgatctgaaagctcgccccacttatggggccggagaaatcaccgtgttggtcgaggtggcggacatggagctacatacaaagaaaattgaaataagcggtctgaagttcgcatcactcagttgcactggctgttacgcctgctccagcgggatctcttgtaaggtacgaatccacgttgatgagcctgacgaactgaccgtgcatgtcaaatcagatgacccagatgtggtcgctgccagtagctcccttatggcaagaaagctggagtctggaacagactcgacctttaaggctttcagcgccatgcccaaaacttccttgtgcttttatattgtggaaagggagtactgtaaaggctgctcaaaggaggatacgcaaaagtgtgttaacacaaaactcgaacagcctcagagtatactgattgagcacaagggtaccatcatcgggaaacaaaacaatacttgcaccgcgaaggcctcttgctggttagaaagcgtgaaatccttcttctatggcctgaagaacatgctatcaggaatttttggcaatgtattcctcgggatctttagcttcctggcaccatttgtccttttgattctgttctttatgttcggatggcggatactcttttgtttcaagtgctgtcgtcgcacaagaggtctgtttaaatacaggcaccttaaggacgacgaggagaccggctatcggaaaatcattgaacgactgaacaataagaaagggaagaacaagttgctcgatggagagcgcctggctgacagaaaaatcgccgaattattctctactaagacacatatcggc

SEQ ID NO: 10793 - RNA, 1932 nt, synthetic construct
  misc_feature 1..1932: note = derived and/or modified CDS sequence (opt3) from CCHFV(NIV 112143)__JN572085.1__Gc
  source 1..1932: mol_type = other RNA
ttcctggacagcatcgtgaagggcatgaaaaacctccttaattccacctctctggagacatcattgagtattgaagccccctggggtgctataaacgtccagagcacttacaagcctacggtttccgcagccaatatcgcgttatcttggtcgtcagtggagcacagaggaaacaaaattctggtaagcggtaggagtgaatccatcatgaagctagaggaacggaccggcatttcttgggatctcggggtggaggacgctagcgagtccaaactgcttacagtctcagtgatggatctgagtcaaatgtatagcccagtttttgaatacttgtctggagaccgccaggtggaggaatggccgaaggccacttgcaccggcgattgtcccgagcgatgcggttgtacatcctcaacctgcctccataaggagtggcctcacagccgtaattggagatgtaacccaacttggtgctggggagtcgggacaggctgtacctgctgtggcctggacgtgaaagatctgttcacggactatatgtttgtaaagtggaaagttgaatacatcaagactgaggcaatagtgtgcgtcgaactcaccagtcaggagaggcagtgttctttaatcgaagccgggacacggttcaatctgggatccgtgactattacccttagcgagccccgcaacatccaacagaaattgcctccagagattatcacactgcatcccagaatagaagaggggtttttcgatctaatgcacgtgcagaaggtcctctcggcttctaccgtttgcaagctgcagtcctgcacgcatggcgtgcctggggaccttcaagtatatcacattggaaatctgttgaaaggcgatagggtgaacggtcacctcatccataagattgaacagcacctgaatacttcatggatgagttgggacgggtgtgatttagactactattgcaacatgggagactggccaagctgtacatacaccggcgtcactcagcataatcacgcatcctttgtgaacctgctcaatatcgagacagattacaccaaaacgttccactttcattctaagcgggttaccgcccacggcgacacaccgcagcttgatctgaaagctcgccccacttatggggccggagaaatcaccgtgttggtcgaggtggcggacatggagctacatacaaagaaaattgaaataagcggtctgaagttcgcatcactcagttgcactggctgttacgcctgctccagcgggatctcttgtaaggtacgaatccacgttgatgagcctgacgaactgaccgtgcatgtcaaatcagatgacccagatgtggtcgctgccagtagctcccttatggcaagaaagctggagtttggaacagactctaccttcaaggctttttcggccatgcccaaaactagcttgtgcttctatattgtggaaagggagtactgtaaaggctgctccaaggaggatacgcaaaagtgtgttaacacaaaactcgaacagcctcagtcaatactgattgagcacaagggtaccatcatcgggaaacaaaacaatacttgcaccgcgaaggccagttgctggttagaatctgtgaaatccttcttttatggcctgaagaacatgctaagcggaattttcggcaatgtatttctcgggatcttctcatttctggcaccattcgtccttttgattctgtttttcatgtttggatggcggatactcttctgttttaagtgctgtcgtcgcacaagaggtctgttcaaatacaggcaccttaaggacgacgaggagaccggctatcggaaaatcattgaacgactgaacaataagaaagggaagaacaagttgctcgatggagagcgcctggctgacagaaaaatcgccgaattatttagcactaagacacatatcggc

SEQ ID NO: 10794 - RNA, 1932 nt, synthetic construct
  misc_feature 1..1932: note = derived and/or modified CDS sequence (opt3) from CCHFV(SCT ex Afghanistan)__KC344856.1__Gc
  source 1..1932: mol_type = other RNA
ttcctgaacagcatcgtgaagggcatgaaaaatctccttaactccaccaatctggagacatctttgtcaattgaagccccctggggagctataaacgtccagagtacttttaagcctacggttagcaccgcaaatatcgccttatcctggtcttcggtggagcacagagggaacaaaattctggtatcaggtaggagcgaaagtatcatgaagctagaggaacggacaggcatttcctgggacctcggggtggaggatgcgtctgagagcaaatccctgactgtctcagtgatggaccttagtcaaatgtacagcccagttttcgaatatctgtctggagatcgccaggtggaggaatggccgaaggctacctgcacaggcgactgtcccgagcgatgcggttgtacctcctcaacttgcttgcataaggagtggcctcacagccgtaattggagatgtaacccaacatggtgctggggagtcgggaccggctgtacgtgctgtggcctcgatgtgaaagacctgtttactgattacatgttcgtaaagtggaaagttgaatatatcaagaccgaggccatagtgtgcgtcgaactgacaagtcaggagaggcagtgttctctcatcgaagcagggactcggtttaatttaggacccgtgaccattacactgtccgagcctcgcaacatccaacagaaacttccacccgagattatcaccttgcatcctagaatagaagagggtttctttgacctgatgcacgtgcagaaggtcctaagcgcctcgacggtttgcaagctccagtcttgcactcatggcgtgccaggggatctgcaagtataccacattggaaatcttctgaaaggcgacaagttgaacggtcacatgatccataaaattgaaccgcacttcaatacatcctggatgtcatgggatgggtgtgacctcgattattactgcaacatgggagactggcccagttgtacctatactggcgtgacacagcataatcacgctgcatttgtcaacctgttaaacatcgagaccgactacacgaagaatttccactttcatagcaaaagggtgaccgcccacggcgatacacctcagctggacctcaaggctcggccaacttacggggccggagaaatcaccgttcttgtggaggtcgcggatatggagctgcatactaaaaagattgacatatccggtttgaagttcgcatctctaacatgcgccggctgttatgcttgcagctcagggatcagttgtaaagtgcgcattcacgtagatgaacccgacgagctgaccgttcatgtgaagtccgaagatcctgacatcgtcgccgcaagcacatctctcatagctcgaaaactggagcttggaaccgattcaacttttaaggccttcagtgcgatgccaaaaacgagcctgtgcttctacattgtggaaagagagtattgtaagtcctgctctaaggaggacacacagaaatgtgtcaacaccaagttggaacacccccaaggcatcctcatcgagcacaaaggtactattatcgggaagcagaatgatacctgcacagccaaagcaggctgctggctggaatcggttaagagctttttctacggattaaagaacatgctgtccggcatttttgggaatgtgttcataggaatctttctattcctcgctccgtttgtgctgcttattttgttctttatgttcggttggaggctgctcttttgtttcaaatgctgtcggcgtacccgcggcctgtttaagtatagacatcttaaagaggacgaggaatcagggtacaggcggatcatcgagcgactgaacaataagaaaggaaagaacaagttgctcgacggcgaacgcctggccgatagaaggattgctgagttattcagtactaaaacacacataggt

SEQ ID NO: 10795 - RNA, 1932 nt, synthetic construct
  misc_feature 1..1932: note = derived and/or modified CDS sequence (opt3) from CCHFV(Zahedan 2007)__KC867273.1__Gc
  source 1..1932: mol_type = other RNA
ttcctggacagcatcgtgaaggatatgaaaaacctccttaattccacctctctggagacatcattgagtattgaagccccctggggcgctataaacgtccagagcacttacaagcctacggtttccaccgcaaatatcgccttatcttggtcgtcagtggagcacagagggaacaaagtactggtgagcggaaggagtgaatccattatgaagctagaggaacggacaggtatctcttgggacctcggcgtcgaggatgcgagcgagtccaaactgcttactgtgtcagttatggacctgagtcaaatgtatagcccagtgtttgaatacttgtctggggatcgccaggtcgaggaatggccgaaggctacctgcacaggagactgtcccgagcgatgcggctgtacctcctcaacttgcctccataaggagtggcctcacagccgtaattggagatgtaacccaacatggtgctggggtgtggggaccggatgtacgtgctgtggcctggatgtaaaagacctgttcactgattatatgtttgttaagtggaaagtggaatacattaagaccgaggccatcgtctgcgtggaactcacaagtcaggagaggcagtgttctttaatagaagcaggcactcggttcaatctggggtccgtgaccatcacacttagcgagccccgcaacattcaacagaaattgcctccagagatcattaccctgcatcccaagatcgaagagggatttttcgacctaatgcacgtccagaaggttctctcggcctctacggtgtgcaaactgcagtcctgcactcatggtgtacctggcgatcttcaagtgtatcacatagggaatctgttgaagggagacagagtcaacggccacctcattcataaaatcgaacagcactttaatacatcatggatgagttgggatggttgtgacctggactactattgcaacatgggggattggccaagctgtacctacactggagtgacacagcataatcacgcttccttcgttaacttactgaatattgagaccgactacacgaagacctttcacttccattctaaaagggtgacagcacacggcgatactccgcagctcgaccttaaggcccggcccacctatggcgctggggaaatcacagtcctggtggaggtagccgatatggagttgcatactaaaaagatcgaaattagcggactaaagtttgcgggtctgacctgcacaggctgttacgcatgctcaagtgggatatcctgtaaagttcgcatccacgtggacgagcctgatgaactcaccgtccatgtgaagtctgacgatccagacgtcgtggccgcttcttcaagtctgatggcccgaaaacttgagttcggaactgatagcacgtttaaggcattctccgctatgcccaaaacatctctgtgcttctatattgttgaaagagagtactgtaagtcgtgcagcaaggaggacacccaaaaatgtgtgaacactaagttggaacagcctcagtccatcctcatagagcacaaaggcaccattatcggtaagcaaaacaatacatgcaccgccaaagcgtcatgctggctggaaagtgtaaagagctttttctatgggttaaagaacatgctgggcggaatctttggcaatgtcttcattgggatctttactttcctaacaccatttattctcctgatattctttttcatgtttggatggaggatccttttctgttttaaatgctgtcggcgtacgcgcggtttgttcaagtacagacacctgaaagacgatgaggagaccggctataggaagattatcgaacggctcaacaataaaaaggggaagaaccgactgcttgacggagagcgcctggccgatagaaaaatcgcagaattgttcagcactaagacacatattggc

SEQ ID NO: 10796 - RNA, 1932 nt, synthetic construct
  misc_feature 1..1932: note = derived and/or modified CDS sequence (opt3) from CCHFV(SPU 44/08)__KJ682805.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccgcagccaatatcgcgttatcttggtcgtcagtggagcacagagggaacaaaattctggtaagcggtaggagtgaatccatcatgaagctagaggaacggaccggcatttcttgggatctcggggtggaggacgctagcgagtccaaactgcttacagtctcagtgatggatctgagtcaaatgtacagcccagttttcgaatatttgtctggagaccgccaggtggaggaatggccgaaggccacttgcaccggcgattgtcccgagcgatgcggttgtacatcctcaacctgcctccataaggagtggcctcacagccgtaattggagatgtaacccaacttggtgctggggagtcgggacaggctgtacctgctgtggcctggacgtgaaagatctgtttacggactacatgttcgtaaagtggaaagttgattatatcaagactgaagcaatagtgtgcgtcgagctcaccagtcaggaaaggcagtgttctttaatcgaggccgggacacggtttaatctgggacccgtgactattaccctttccgaacctcgcaacatccaacagaaattgccacccgagattgtgacactgcatcctagaatcgaggaaggtttctttgacctaatgcacatacagaaggtcctcagcgcttcgaccgtttgcaagctgcagtcttgcacgcatggcgtgccaggggatcttcaaatttaccacatcggaaatctgttgaaaggcgacaaggtaaacggtcacctcattcataaaatcgagccgcacttcaatacttcctggatgtcatgggatgggtgtgacctggactattactgcaacatgggagattggcccagttgtagctatacaggcgtgacccagcataatcacgcagcctttgtcaacatgttaaatatcgaaactgactacacaaagaacttccactttcattccaaaagggtgaccgctcacggcgatacgcctcagctggacctcaaggcccggccaacctacggggcgggagagattacagttcttgtggaagtcgcagatatggagctgcatactaaaaagatagagatctctggtttgaagttcgccagcctaacctgcacaggctgttatgcttgctcaagtgggatttcctgtaaagtgcgcatccacgtagacgaacccgatgagctgactgttcatgtcaagagcgaagaccctgatatagtggccgcatcttcaagtctcatggctcgaaaactggagtttggaaccgacagcacattcaaggccttctccgcgatgccaaaaacctctctttgcttttacattgtggaaagagagtattgtaagtcgtgcagcaaggaggatactcagaaatgtgtcaacacgaagctggaacaaccccagtccatcttgatcgagcacaaaggcacaattatcggtaagcagaatgatacctgcactgccaaagcatcatgctggctcgaaagtattaagtctttcttttacgggctgaagaacatgttaagcggcatattcggaaatgtgtttatcggcattttcctgtttctagctccgttcatcatgctcatcctgtttttcatgtttgggtggaggattcttttctgttttaaatgctgtcggcgtacccgcggattgttcaagtatagacacctgaaagacgacgaggagataggttacaggaagatcattgaacggctcaacaataaaaagggcaagaacaaactgcttgacggggagcgactggccgatcgcaagatcgctgaattgttctccacaaaaacccatattgga

SEQ ID NO: 10797 - RNA, 1932 nt, synthetic construct
  misc_feature 1..1932: note = derived and/or modified CDS sequence (opt3) from CCHFV(SPU 383/87)__KJ682806.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccgcagccaatatcgcgttatcttggtcgtcagtggagcacagagggaacaaaattctggtaagcggtaggagtgaatccatcatgaagctagaggaacggaccggcatttcttgggatctcggggtggaggacgctagcgagtccaaactgcttacagtctcagtgatggatctgagtcaaatgtacagcccagttttcgaatatttgtctggagaccgccaggtggaggaatggccgaaggccacttgcaccggcgattgtcccgagcgatgcggttgtacatcctcaacctgcctccataaggagtggcctcacagccgtaattggagatgtaacccaacttggtgctggggagtcgggacaggctgtacctgctgtggcctggacgtgaaagatctgtttacggactacatgttcgtaaagtggaaagttgattatatcaagactgaagcaatagtgtgcgtcgagctcaccagtcaggaaaggcagtgttctttaatcgaggccgggacacggtttaatctgggacccgtgactattaccctttccgaacctcgcaacatccaacagaaattgccacccgagattgtgacactgcatcctagaatcgaggaaggtttctttgacctaatgcacatacagaaggtcctcagcgcttcgaccgtttgcaagctgcagtcttgcacgcatggcgtgccaggggatcttcaaatttaccacatcggaaatctgttgaaaggcgacaaggtaaacggtcacctcattcataaaatcgagccgcacttcaatacttcctggatgtcatgggatgggtgtgacctggactattactgcaacatgggagattggcccagttgtagctatacaggcgtgacccagcataatcacgcagcctttgtcaacatgttaaatatcgaaactgactacacaaagaacttccactttcattccaaaagggtgaccgctcacggcgatacgcctcagctggacctcaaggcccggccaacctacggggcgggagagattacagttcttgtggaagtcgcagatatggagctgcatactaaaaagatagagatctctggtttgaagttcgccagcctaacctgcacaggctgttatgcttgctcaagtgggatttcctgtaaagtgcgcatccacgtagacgaacccgatgagctgactgttcatgtcaagagcgaagaccctgatatagtggccgcatcttcaagtctcatggctcgaaaactggagtttggaaccgacagcacattcaaggccttctccgcgatgccaaaaacctctctttgcttttacattgtggaaagagagtattgtaagtcgtgcagcaaggaggatactcagaaatgtgtcaacacgaagctggaacaaccccagtccatcttgatcgagcacaaaggcacaattttcggtaagcagaatgatacctgcactgccaaagcatcatgctggctcgaaagtgtgaagtctttcttttacgggctgaagaacatgttaagcggcatctttggaaatgttttcattggcgtgtttctgttcctagctccgtttataatgctcatcctgttctttatgttcgggtggaggattttgttttgtttcaaatgctgtcggcgtacccgcggacttttcaagtatagacacctgaaagacgacgaggagatcggttacaggaagatcattgaacggctcaacaataaaaagggcaagaacaaactgcttgacggggagcgactggccgatcgcaagatagctgaattgttttccacaaaaacccatatcgga

SEQ ID NO: 10798 - RNA, 1932 nt, synthetic construct
  misc_feature 1..1932: note = derived and/or modified CDS sequence (opt3) from CCHFV(SPU 130/89)__KJ682807.1__Gc
  source 1..1932: mol_type = other RNA
agcctggactccatcgtgaagggcatgaaaaacctccttaattctacctcactggagacaagtttgagcattgaagccccctggggtgctataaacgtccagtccactttcaagcctacggtttctgcagccaatatcgcgttatcgtggtcaagcgtggagcacagaggaaacaaaattctggtaagtggtaggtccgaatctatcatgaagctagaggaacggaccggcattagctgggatctcggggtggaggacgcttccgagtcaaaactgcttacagtcagtgtgatggatctgagccaaatgtactctccagtttttgaatatttgtccggagaccgccaggtggaggaatggccgaaggccacttgcaccggcgattgtcccgagcgatgcggttgtacatcaagtacctgcctccataaggagtggcctcacagccgtaattggagatgtaacccaacttggtgctggggagtcgggacaggctgtacctgctgtggcctggacgtgaaagatctgttcacggactacatgtttgtaaagtggaaagttgattatatcaagactgaagcaatagtgtgcgtcgagctcacctctcaggaaaggcagtgttccttaatcgaggccgggacacggttcaatctgggacccgtgactattacccttagcgaacctcgcaacatccaacagaaattgccacccgagattgtgacactgcatcctagaatcgaggaagggtttttcgacctaatgcacatacagaaggtcctctcggcttctaccgtttgcaagctgcagtcctgcacgcatggcgtgccaggggatcttcaaatttaccacatcggaaatctgttgaaaggcgacaaggtaaacggtcacctcattcataaaatcgagccgcactttaatacttcatggatgagttgggatgggtgtgacctggactattactgcaacatgggagattggcccagctgttcctatacaggcgtgacccagcataatcacgcagccttcgtcaacatgttaaatatcgaaactgactacacaaagaactttcacttccattctaaaagggtgaccgctcacggcgatacgcctcagctggacctcaaggcccggccaacctacggggcgggagagattacagttcttgtggaagtcgcagatatggagctgcatactaaaaaggtggagataagcggtttgaagtttgcctcactaacctgcacaggctgttatgcttgcagttccgggatcagctgtaaagtacgcattcacgttgacgaacccgatgagctgactgtgcatgtcaagtctgaagaccctgatatcgtggccgcatcaagtagcctcatggctcgaaaactggagttcggaaccgactccacatttaaggccttctctgcgatgccaaaaacctcgctttgcttctacatagtcgaaagagagcactgtaagagctgctccaaggaggatactcagaggtgtgtgaacacgaaactggaacaaccccagtcaattttgatcgagcacaagggcacaatcattggtaaacagaatgatacctgcactgccaaggcaagttgctggctcgaatctatcaagagctttttctatgggctgaagaacatgttatccggcatttttggaaatgttttcataggcgtgtttctgttcctagctccgtttatcattctcatcctgttctttatgttcgggtggcggatcttgttttgtttcaagtgctgtcgtcgcaccagaggacttctgaaatacaggcatctcaaggacgacgaggagattggttatcggaaaataatcgaacgactgaacaataagaaaggcaagaacaaacttctggacggggagcgcttggccgatagaaaaattgctgaactcttttcaacaaagacccacatcgga

SEQ ID NO: 10799 - RNA, 1932 nt, synthetic construct
  misc_feature 1..1932: note = derived and/or modified CDS sequence (opt3) from CCHFV(SPU 497/88)__KJ682808.1__Gc
  source 1..1932: mol_type = other RNA
ttcctggacagcatcgtgaagggcatgagaaacctccttaattccacctctctggagacatcattgagtattgaagccccctggggagctataaacgtccagagcacttttaaacctacggtttccgcagccaatatcgcgttatcttggtcgtcagtggagcacagggggaacaagattctggtaagcggtcggagtgaatccatcatgaaactagaggaacgcaccggcatttcttgggatctcggggtggaggacgctagcgagtccaagctgcttacagtctcagtgatggatctgagtcaaatgtacagcccagttttcgaatatttgtctggagaccgacaggtggaggaatggccgaaagccacttgcaccggcgattgtcccgagcgttgcggttgtacatcctcaacctgcctccataaggagtggcctcacagcagaaattggaggtgtaacccaacttggtgctggggagtcgggacaggctgtacctgctgtggcctggacgtgaaggatctgtttacggactacatgttcgtaaaatggaaggttgattatatcaaaactgaagcaatagtgtgcgtcgagctcaccagtcaggaacggcagtgttctttaatcgaggccgggacacgctttaatctgggacccgtgactattaccctttccgaacctagaaacatccaacagaagttgccacccgagattgtgacactgcatcctaggatcgaggaaggtttctttgacctaatgcacatacagaaagtcctcagcgcttcgaccgtttgcaagctgcagtcttgcacgcatggcgtgccaggggatcttcaaatttaccacatcggaaatctgttgaagggcgacaaagtaaacggtcacctcattcataagatcgagccgcacttcaatacttcctggatgtcatgggatgggtgtgacctggactattactgcaacatgggagattggcccagttgtagctatacaggcgtgacccagcataatcacgcagcctttgtcaacatgttaaatatcgaaactgactacaccaaaaacttccactttcattccaagcgggtgaccgctcacggcgatacgcctcagctggacctcaaagcccgcccaacctacggggcgggagagattacagttcttgtggaagtcgcagatatggagctgcatactaagaaaatagagatctctggtttgaagttcgccagcctaacctgcacaggctgttatgcttgctcaagtgggatttcctgtaaggtgcgaatccacgtagacgaacccgatgagctgactgttcatgtgaaaagcgaagaccctgatatagtcgccgcatcttcaagtctcatggctagaaagctggagtttggaaccgacagcacattcaaagccttctccgcgatgccaaagacctctctttgcttttacattgtggaaagggagtattgtaaatcgtgcagcaaggaggatactcagaagtgtgtcaacacgaaactggaacaaccccagtccatcttgatcgagcacaagggcacaattatcggtaaacagaatgacacatgcactgcccgggcatcatgctggctcgaaagtattaagtctttcttttacgggctgaaaaacatgttaagcggcatattcggaaatgtgtttatcggcattttcctgtttttcgctccgtttatcatgctaatcctcttctttatgttcgggtggcgtattctgttttgtttcaagtgctgtcgcagaaccaggggacttttcaagtatcggcacttgaaagacgatgaggaggttggttaccgaaagataatcgaacgcctgaacaataaaaagggcaaaaacaagctcctggacggggagagacttgccgataggaagattgctgaactgttttccacaaaaacccatatcgga

SEQ ID NO: 10800 - RNA, 1932 nt, synthetic construct
  misc_feature 1..1932: note = derived and/or modified CDS sequence (opt3) from CCHFV(SPU 18/88)__KJ682810.1__Gc
  source 1..1932: mol_type = other RNA
ttcctggacagcatcgtgaagggcaaaaagaacctccttaattccacctctctggagacatcattgagtattgaagccccctggggagctataaacgtccagagcacttttaaacctacggtttccgcagccaatatcgcgttatcttggtcgtcagtggagcacagagggaacaagattctggtaagcggtaggagtgaatccatcatgaaactagaggaacggaccggcatttcttgggatctcggggtggaggacgctagcgagtccaagctgcttacagtctcagtgatggatctgagtcaaatgtacagcccagttttcgaatatttgtctggagaccgccaggtggaggaatggccgaaggccacttgcaccggcgattgtcccgagcgatgcggttgtacatcctcaacctgcctccataaagagtggcctcacagccgtaattggagatgtaacccaacttggtgctggggagtcgggacaggctgtacctgctgtggcctggacgtgaaggatctgtttacggactacatgttcgtaaaatggaaggttgattatatcaaaactgaagcaatagtgtgcgtcgagctcaccagtcaggaaaggcagtgttctttaatcgaggccgggacacggtttaatctgggacccgtgactattaccctttccgaacctcgcaacatccaacagaagttgccacccgagattgtgacactgcatcctagaatcgaggaaggtttctttgacctaatgcacatacagaaggtcctcagcgcttcgaccgtttgcaaactgcagtcttgcacgcatggcgtgccaggggatcttcaaatttaccacatcggaaatctgttgaagggcgacaaagtaaacggtcacctcattcataagatcgagccgcacttcaatacttcctggatgtcatgggatgggtgtgacctggactattactgcaacatgggagattggcccagttgtagctatacaggcgtgacccagcataatcacgcagcctttgtcaacatgttaaatatcgaaactgactacaccaaaaacttccactttcattccaagagggtgaccgctcacggcgatacgcctcagctggacctcaaagcccggccaacctacggggcgggagagattacagttcttgtggaagtcgcagatatggagctgcatactaagaagatagagatctctggtttgaaattcgccagcctaacctgcacaggctgttatgcttgctcaagtgggatttcctgtaaggtgcgcatccacgtagacgaacccgatgagctgactgttcatgtgaaaagcgaagaccctgatatagtcgccgcatcttcaagtctcatggctcgaaagctggagtttggaaccgacagcacattcaaagccttctccgcgatgccaaagacctctctttgcttttacattgtggaaagagagtattgtaagtcgtgcagcaaagaggatactcagaagtgtgtcaacacgaaactggaacaaccccagtccatcttgatcgagcacaagggcacaattatcggtaaacagaatgacacatgcactgggaaggccggctgctggctcgaatcaattaagagtttcttttacggactgaaaaacatgttatctggcatattcgggaatgtgtttatcggaattttcctgtttctagcaccgttcatcatgctcatcctgtttttcatgtttggttggaggattcttttctgttttaagtgctgtcggcgtacccgcggcttgttcaaatatagacacctgaaggacgatgaggagatagggtacaggaaaatcattgaacggctcaagaacaagaaaggaaagaataaactgcttgacggcgagcgactggctgatcgcaagatcgccgaattgttcagcacaaaaacccatattggt

SEQ ID NO: 10801 - RNA, 1932 nt, synthetic construct
  misc_feature 1..1932: note = derived and/or modified CDS sequence (opt3) from CCHFV(SPU 431/85)__KJ682812.1__Gc
  source 1..1932: mol_type = other RNA
ttcctggacagcatcgtgaagggcagaaagaacctccttaattccacctctctggagacatcattgagtattgaagccccctggggagctataaacgtccagagcacttttaagcctacggtttccgcagccaatatcgcgttatcttggtcgtcagtggagcacagggggaacaaaattctggtaagcggtcggagtgaatccatcatgaagctagaggaacgcaccggcatttcttgggatctcggggtggaggacgctagcgagtccaaactgcttacagtctcagtgatggatctgagtcaaatgtacagcccagttttcgaatatttgtctggagaccgacaggtggaggaatggccgaaggccacttgcaccggcgattgtcccgagcgttgcggttgtacatcctcaacctgcctccataaggagtggcctcacagcagaaattggaggtgtaacccaacttggtgctggggagtcgggacaggctgtacctgctgtggcctggacgtgaaagatctgtttacggactacatgttcgtaaagtggaaagttgaatatatcaagactgaggcaatagtgtgcgtcgaactcaccagtcaggagcggcagtgttctttaatcgaagccgggacacgctttaatctgggacccgtgactattaccctttccgagcctagaaacatccaacagaaattgccacccgagattatcacactgcatcctaggatagaagagggtttctttgatctaatgcacgtgcagcgggtcctcagcgcttcgaccgtttgcaagctgcagtcttgcacgcatggcgtgccaggggaccttcaagtataccacattggaaatctgttgaagggcgataaagtgaacggtcacctcatccataagattgaaccgcacttcaatacttcctggatgtcatgggacgggtgtgatctggactattactgcaacatgggagactggcccagttgtacatataccggcgtcactcagcataatcacgcagcctttgtgaacttactgaatatcgagacagattacaccaaaaacttccactttcatagcaagcgcgttacggctcacggcgacacccctcagctcgatcttaaagcccgaccaacatacggggcgggagaagtgactgtcctggtggaggtagcagacatggagttgcataccaagaaaatcgaaatttccggtctaaagttcgcctctctgacatgcactggctgttatgcttgcagctcagggataagttgtaaggttaaaatccacgtggatgagcccgacgaactcaccgtccatgtgaagtccgaggatcctgacattgtcgccgcaggaagctctctgatggctagaaaacttgaatttggcgccgattcaacattcaaggcgttcagtgccatgccaaaaaccagcctgtgcttttacatcgtggagagggagtattgtaagtcctgctctcgggaagacactcgtaagtgtgttaacacgaaattggatcgcccccagtcgatactcattgagcacaagggtacaatcatcgggaaacaaaataatacctgcactgcaaaggctagctgctggctggaatccgtgaaatcattcttttacggcttaaagaacatgctgagtggaattttcggcaacgtatttatcgggattttcctatttatagccccgttcgtcctcctgatccttttctttatgtttggatggagaattttgttctgttttaagtgctgtaggcggacccgaggtctgttcaaatatcgccacctcaaggacgacgaggagacaggctacagaaaaatcatcgaaaggctgaataacaagaaagggaagaataaacttctggatggagagcggttggctgaccgcaaaattgccgaactcttctctaccaagagccatataggc

SEQ ID NO: 10802 - RNA, 1932 nt, synthetic construct
  misc_feature 1..1932: note = derived and/or modified CDS sequence (opt3) from CCHFV(SPU 48/90)__KJ682813.1__Gc
  source 1..1932: mol_type = other RNA
ttcagagacagcatcgtgaagggcatgaaaaacctgctcaattccacctctcttgagacatcactgagtattgaagccccctggggtgctataaacgtccagagcacttacaagcctacggtttccaccgcaaatatcgccttgtcttggtcgtcagtggagcacaggggaaacaaaattttagtaagcggtcggagtgaatccatcatgaagctggaggaacgcacaggcatttcttgggatctaggggtggaggacgcgagcgagtccaaactcctgactgtctcagtgatggatcttagtcagatgtatagcccagtttttgaatacctgtctggagaccgacaggtggaggaatggccgaaggctacctgcacaggcgattgtcccgagcgttgcggttgtacctcctcaacttgcttgcataaggagtggcctcacagcagaaattggaggtgtaacccaacatggtgctggggagtcgggaccggctgtacgtgctgtggcctcgacgtgaaagatctgttcactgactatatgtttgtaaagtggaaagttgaatacatcaagaccgaggccatagtgtgcgtcgaactgacaagtcaggagcggcagtgttctctcatcgaagcagggactcgcttcaatttaggacccgtgaccattacactgtccgagcctagaaacatccaacagaaacttccacccgagattatcaccttgcatcctaggatagaagaggggtttttcgatctgatgcacgtgcagaaggtcctaagcgcctcgacggtttgcaagctccagtcttgcactcatggcgtgccaggggacctgcaagtatatcacattggaaatcttctgaaaggcgataaggtgaacggtcacttgatccataaaattgaaccgcactttaatacatcctggatgtcatgggacgggtgtgatctcgactactattgcaacatgggagactggcccagttgtacctacactggcgtcacacagcataatcgggctagcttcgtgaacctgttaaatatcgagaccgattacacgaagaactttcacttccactccaaacgcgttaccgcacatggcgacacacctcagctggatctcaaggcccgaccaacttatggggctggagaaatcaccgtgcttgtcgaggtggccgacatggagctgcacactaaaaagattgaaatatctggtttgaagtttgcgagcctaacatgcaccggctgttacgcatgctcaagtgggatctcctgtaaagtaaggattcatgttgatgagcccgacgaactgacagtgcacgtcaagagcgatgaccctgatgtggtcgccgcttcttcaagtctcatggccagaaaactggagttcggaaccgacagcacttttaaggcattctccgctatgccaaaaacgtctctttgcttctatatcgtggaaaaggagtactgtaagtcgtgcagcgaggaagataccaaaaagtgtgttaacacaaaactggagcagccccaatccatattgattgaacataagggcactatcatcggtaaacaaaattcaacctgcacagccaaggtgagttgctggctcgagtctgccaagagctttttctatgggctgaaagacatgttatccggcatttttggaaacgtattcatcggcatttttctgttcctagcgccgtttatactcctgatccttttctttatgttcgggtggcggattttgctgtgttttaagtgctgtcgtcgcaccagaggactcttcaaatacaggcacctgaaggacgatgaggaaactggttatcggcgaatcatcgagcgccttaataacaaaaagggcaagaataaactgttggacggggaaagactcgcagataggcggattgctgagctgttttcaacaaagacgcacatagga

SEQ ID NO: 10803 - RNA, 1932 nt, synthetic construct
  misc_feature 1..1932: note = derived and/or modified CDS sequence (opt3) from CCHFV(SPU 187/90)__KJ682814.1__Gc
  source 1..1932: mol_type = other RNA
ttcctggacagcatcgtgaagggcatgaaaaacctccttaattccacctctctggagacatcattgagtattgaagccccctggggtgctataaacgtccagagcacttacaagcctacggtttccaccgcaaatatcgccttatcttggtcgtcagtggagcacagaggaaacaaaattctggtaagcggtaggagtgaatccatcatgaagctagaggaacggacaggcatttcttgggatctcggggtggaggacgcgagcgagtccaaactgcttactgtctcagtgatggatctgagtcaaatgtatagcccagtttttgaatacttgtctggagaccgccaggtggaggaatggccgaaggctacctgcacaggcgattgtcccgagcgatgcggttgtacctcctcaacttgcctccataaggagtggcctcacagccgtaattggagatgtaacccaacatggtgctggggagtcgggaccggctgtacgtgctgtggcctggacgtgaaagatctgttcactgactatatgtttgtaaagtggaaagttgaatacatcaagaccgaggccatagtgtgcgtcgaactcacaagtcaggagaggcagtgttctttaatcgaagcagggactcggttcaatctgggacccgtgaccattacactttccgagcctcgcaacatccaacagaaattgccacccgagattatcaccctgcatcctagaatagaagaggggtttttcgatctaatgcacgtgcagaaggtcctcagcgcctcgacggtttgcaagctgcagtcttgcactcatggcgtgccaggggaccttcaagtatatcacattggaaatctgttgaaaggcgataaggtgaacggtcacctcatccataaaattgaaccgcactttaatacatcctggatgtcatgggacgggtgtgatctggactactattgcaacatgggagactggcccagttgtacctacactggcgtcacacagcataatcacgctagcttcgtgaacttactgaatatcgagaccgattacacgaagaactttcacttccattccaaaagggttaccgcacacggcgacacacctcagctcgatcttaaggcccggccaacttatggggctggagaaatcaccgtgctggtcgaggtggccgacatggagttgcatactaaaaagattgaaatatctggtctaaagtttgcgagcctgacatgcaccggctgttacgcatgctcaagtgggatctcctgtaaagtacgcattcacgttgatgagcccgacgaactcacagtgcatgtcaagagcgatgaccctgatgtggtcgccgcttcttcaagtctgatggcccgaaaacttgagttcggaaccgacagcatctttaaggcattctccgctatgccaaaaacttctctgtgcttctatatagtggaaagagagcactgtaagtcgtgcagcgaggaagatacgaagaaatgtgttaacacaaagttggagcagccccaatccattctcatcgaacacaaaggcaccatcattggtaagcagaatagcacttgcaccgccaaaacaagttgctggctggagtctgtgaagtcatttttctacgggttaaagaacatgctgtccggcatctttggaaatgtattcattggcatatttctattcctcgcgccgtttatcctgcttattttgttctttatgttcgggtggaggatcctgttttgtttcaaatgctgtcggcgtacccgcggactctttaagtatagacatctgaaagacgacgaggaaactggttacaggcggatcattgagcgacttaacaataagaaaggcaagaacaagctgttggatggggaacgcctcgccgacagaaggatagcagagctgttctcaacaaaaacgcacatcgga

SEQ ID NO: 10804 - RNA, 1932 nt, synthetic construct
  misc_feature 1..1932: note = derived and/or modified CDS sequence (opt3) from CCHFV(Haskovo-V46/13)__KR092379.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcgttaagtggaaagtggaatacatcaagacagaggccatagtctgcgtggaactgactagccaggagaggcagtgtagtctcatcgaagcagggacccggtttaatttaggacccgtgacaattaccctgtctgagcctcgcaacatccaacagaaacttccacccgagattatcacgttgcaccctaagatagaagagggtttctttgatctgatgcatgtccagaaggttctatccgccagcactgtgtgcaaactccagtcgtgcacacacggcattccaggggacctgcaagtatatcacatcggaaatcttctgaagggcgatagagtgaacggtcatttgattcacaaaatcgaaccgcatttcaatacctcttggatgtcctgggacgggtgtgatctcgactactattgcaacatgggagactggccctcatgtacttacacaggcgtcacccagcacaatcacgctgcatttgtgaacctgttaaatatcgagacggattataccaagacattccattttcacagtaaaagggttactgcccatggcgacacccctcagctggatctcaaggctcggccaacatacggggccggagaaattactgtgcttgtcgaggtggcggacatggagctgcacaccaaaaaggtagaaataagcggtttgaagttcgcatccctaacatgcaccggctgttacgcctgctctagcgggatctcatgtaaagttcgcattcatgtggatgagcccgacgaactgactgtccacgtgaagagttccgatcctgacgtcgtggctgccggaacgagcctcatggcacgaaaactggagtttggcacagattctaccttcaaggctttctcagccatgccaaaaaccagtctttgcttttatatcgttgaaagagagtactgtaagagctgctccgaggacgatactcagaagtgtgtggacacaaaactggaacaaccccagtctatattgattgagcacaagggtaccatcatcgggaaacagaacgacacttgcacagcgagggcctcgtgctggctcgaaagcgtaaagtccttcttttatggcctgaaaaacatgttaggatcagtcttcggcaattttctgattgggatcctactcttcctggcaccgtttgtgcttttggttctgttctttatgttcggatggaagattctcttttgtttcaagtgctgtcggcgtacgcgcggtctgtttaaatacagacatcttaaggatgacgaggagaccggctataggcggataatcgaacgactgaacagtaaaaaggggaaaaatcgcttgctcgatggagagagactggctgacaggaagattgccgaattattctctactaagacacacatcggc

SEQ ID NO: 10805 - RNA, 1932 nt, synthetic construct
  misc_feature 1..1932: note = derived and/or modified CDS sequence (opt3) from CCHFV(24-R-2012)__KR814856.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcgttaagtggaaagtggaatacatcaagacagaggccatagtctgcgtggaactgactagccaggagaggcagtgtagtctcatcgaagcagggacccggtttaatttaggacccgtgacaattaccctgtctgagcctcgcaacatccaacagaaacttccacccgagattatcacgttgcaccctaaggtcgaagagggtttctttgatctgatgcatgttcagaaggtgctatccgccagcactgtatgcaaactccagtcgtgcacacacggcataccaggggacctgcaagtgtatcacattggaaatcttctgaagggcgatagagtcaacggtcatttgatccacaaaattgaaccgcatttcaatacctcttggatgtcctgggacgggtgtgatctcgactactattgcaacatgggagactggccctcatgtacttacacaggcgtgacccagcacaatcacgctgcatttgttaacctgttaaatatcgagacggattataccaagacattccattttcacagtaaaagggtgactgcccatggcgacacccctcagctggatctcaaggctcggccaacatacggggccggagaaatcactgtccttgtggaggtagcggacatggagctgcacaccaaaaaggttgaaattagcggtttgaagttcgcatccctagcctgcacaggctgttacgcttgctctagcgggatatcatgtaaagtgcgcatccatgtcgatgagcccgacgaactgaccgtgcacgtcaagagtaacgatcctgacgtggttgccgcatccactagcctcatggctcgaaaactggagtttggaacggattctacattcaaggccttctcagcgatgccaaaaaccagtctttgcttttatattgtggaaagagagtactgtaagagctgctccgaggaagacactcagaagtgtgtagataccaaactggagcaaccccagtctatcttgatagaacacaagggcacaattatcggtaaacagaacgatacctgcactgccaaggcatcgtgctggctcgagagcgtcaaatccttcttttatgggctgaagaatatgttaggctcagtgttcggaaactttttcatcggcattctgctatttctcgctccgttcgttctgcttgtgttgtttttcatgtttgggtggaagatcctgttctgttttaaatgctgtaggcggacacgtggactcctgaagtaccgccttctgaaagacgacgaggaaacgggttatagaaggattatagagcggttgaataacaagaaaggcaagaatcgactcctggacggggaacgcttagccgatagaaagatcgctgagctgttcagtaccaaaactcatattgga

SEQ ID NO: 10806 - RNA, 1932 nt, synthetic construct
  misc_feature 1..1932: note = derived and/or modified CDS sequence (opt3) from CCHFV(36-ST-2014)__KR814857.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcatcaagtggaaagttgaatacataaagacagaggccatcgtgtgcgtcgaactgactagccaggagaggcagtgtagtctcattgaagcagggacccggtttaatttaggacccgtgacaatcaccctgtctgagcctcgcaacattcaacagaaacttccacccgagatcataacgttgcaccctaagattgaagagggtttctttgatctgatgcatgtgcagaaggtcctatccgccagcactgtttgcaaactccagtcgtgcacacacggcatcccaggggacctgcaaatttatcacatcggaaatcttctgaagggcgatagattgaacggtcatctcatccacaaaattgaaccgcatttcaatacctcttggatgtcctgggacgggtgtgatctggactactattgcaacatgggagactggccctcatgtacttacacaggcgtgacccagcacaatcacgctgcatttgtaaacttactgaatatagagacggattataccaagacattccattttcacagtaaaagggtgactgcccatggcgacacccctcagctcgatcttaaggctcggccaacatacggggccggagaaatcactgtcctggtggaggttgcggacatggagttgcacaccaaaaaggtggaaattagcggtctaaagttcgcatccctggcctgcacaggctgttacgcttgctctagcgggatctcatgtaaagtccgcatacatgtggatgagcccgacgaactcaccgtacacgttaagagttccgatcctgacgtggtcgccgcaagcacttctctgatggctcgaaaacttgagtttggaacggattcaacattcaaggccttcagtgcgatgccaaaaaccagcctgtgcttttatattgtggaaagagagtactgtaagtcctgctctgaggacgatactaagaaatgtgtcgacaccaagttggaccagccccaatcgatcctcatcgaacacaaaggcacaattatcggtaagcagaacgatacctgcactgccaaagcaagctgctggctggagtccgtgaagtcattcttttatgggttaaagaacatgctgggcagtgttttcggaaatttctttgtgggcattctactctttctggctccgttcgtacttttggtcctgtttttcatgtgtgggtggaaatttctcttctgctttaagtgttgcaggcggacacgtggactgttcaaataccgccatcttaaggacgatgaagagacgggttatagaaggataatcgagcggctgaactctaaaaagggcaagaatcgattgctcgacggggaacgcctggccgatagaaaaattgctgagttattcagcaccaagtcccacatcgga

SEQ ID NO: 10807 - RNA, 1932 nt, synthetic construct
  misc_feature 1..1932: note = derived and/or modified CDS sequence (opt3) from CCHFV(37-R-2013)__KR814858.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgacgatgcgtctgagagcaaactgcttaccgtgtccattatggacctgtcacaaatgtacagtccagttttcgagtatttgagcggagatcgccaggtggaagagtggccgaaggctacatgcaccggcgactgtcccgaacgatgcggttgtacttcttccacatgcctccataaggagtggcctcactcacgtaattggagatgtaacccaacctggtgctggggagtcgggacgggctgtacttgctgtggcgtggatgtaaaagacctgtttaccgatcatatgttcgttaagtggaaagtggagtacatcaagacagaagccatagtctgcgtggagctgactagccaggaaaggcagtgtagtctcatcgaggcagggacccggtttaatttaggacccgtgacaattaccctgtctgaacctcgcaacatccaacagaaacttccacccgagattatcacgttgcaccctaaggtcgaggaaggtttctttgacctgatgcatgttcagaaggtgctatccgccagcactgtatgcaaactccagtcgtgcacacacggcataccaggggatctgcaagtgtatcacattggaaatcttctgaagggcgacagagtcaacggtcatttgatccacaaaattgagccgcatttcaatacctcttggatgtcctgggatgggtgtgacctcgactactattgcaacatgggagattggccctcatgtacttacacaggcgtgacccagcacaatcacgctgcatttgttaacctgttaaatatcgaaacggactataccaagacattccattttcacagtaaaagggtgactgcccatggcgatacccctcagctggacctcaaggctcggccaacatacggggccggagagatcactgtccttgtggaagtagcggatatggagctgcacaccaaaaaggttgagattagcggtttgaagttcgcatccctagcctgcacaggctgttacgcttgctctagcgggatatcatgtaaagtgcgcatccatgtcgacgaacccgatgagctgaccgtgcacgtcaagagtaacgaccctgatgtggttgccgcatccactagcctcatggctcgaaaactggaatttggaacggactctacattcaaggccttctcagcgatgccaaaaaccagtctttgcttttatattgtggagagagaatactgtaagagctgctccgaggaggatactcagaagtgtgtagacaccaaactggaacaaccccagtctatcttgatagagcacaagggcacaattatcggtaaacagaacgtgacctgcactgccaaggcatcgtgctggctcgaaagcgtcaaatccttcttttatgggctgaagaatatgttaggctcagttttcggaaactttttcatcggcattctgctatttctcgctccgttcgtgctgcttgtcttgtttttcatgtttgggtggaagatcctgttctgttttaaatgctgtaggcggacacgtggactcctgaagtaccgccttctgaaagacgatgaggagacgggttatagaaggattatagaacggttgaataacaagaaaggcaagaatcgactcctggacggggagcgcttagccgatagaaagatcgctgaactgttcagtaccaaaactcatattgga

SEQ ID NO: 10808 - RNA, 1932 nt, synthetic construct
  misc_feature 1..1932: note = derived and/or modified CDS sequence (opt3) from CCHFV(44-ST-2010)__KR814859.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcatcaagtggaaagttgaatacataaagacagaggccatcgtgtgcgtcgaactgactagccaggagaggcagtgtagtctcattgaagcagggacccggtttaatttaggacccgtgacaatcaccctgtctgagcctcgcaacattcaacagaaacttccacccgagatcataacgttgcaccctaagattgaagagggtttctttgatctgatgcatgtgcagaaggtcctatccgccagcactgtttgcaaactccagtcgtgcacacacggcatcccaggggacctgcaaatttatcacatcggaaatcttctgaagggcgatagattgaacggtcatctcatccacaaaattgaaccgcatttcaatacctcttggatgtcctgggacgggtgtgatctggactactattgcaacatgggagactggccctcatgtacttacacaggcgtgacccagcacaatcacgctgcatttgtaaacttactgaatatagagacggattataccaagacattccattttcacagtaaaagggtgactgcccatggcgacacccctcagctcgatcttaaggctcggccaacatacggggccggagaaatcactgtcctggtggaggttgcggacatggagttgcacaccaaaaaggtggaaattagcggtctaaagttcgcatccctggcctgcacaggctgttacgcttgctctagcgggatctcatgtaaagtccgcatacatgtggatgagcccgacgaactcaccgtacacgttaagagttccgatcctgacgtggtcgccgcaagcacttctctgatggctcgaaaacttgagtttggaacggattcaacattcaaggccttcagtgcgatgccaaaaaccagcctgtgcttttatattgtggaaagagagtactgtaagtcctgctctgaggacgatactaagaaatgtgtcgacaccaagttggaccagccccaatcgatcctcatcgaacacaaaggcacaattatcggtaagcagaacgatacctgcactgccaaagcaagctgctggctggagtccgtgaagtcattcttttatgggttaaagaacatgctgggcagtgttttcggaaatttctttgtgggcattctactctttctggctccgttcgtacttttggtcctgtttttcatgtgtgggtggaaaatactcttttgcttcaagtgttgcaggcggacacgtggactgtttaaataccgccatcttaaggacgatgaagagacgggttatagaaggatcattgagcggctgaactctaaaaagggcaagaatcgattgctcgacggggaacgcctggccgatagaaaaatcgctgagttattcagcaccaagtcccacatcgga

SEQ ID NO: 10809 - RNA, 1932 nt, synthetic construct
  misc_feature 1..1932: note = derived and/or modified CDS sequence (opt3) from CCHFV(46-ST-2012)__KR814860.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcgttaagtggaaagtggaatacatcaagacagaggccatagtctgcgtggaactgactagccaggagaggcagtgtagtctcatcgaagcagggacccggtttaatttaggacccgtgacaattaccctgtctgagcctcgcaacatccaacagaaacttccacccgagattatcacgttgcaccctaaggtcgaagagggtttctttgatctgatgcatgttcagaaggtgctatccgccagcactgtatgcaaactccagtcgtgcacacacggcataccaggggacctgcaagtgtatcacattggaaatcttctgaagggcgatagaatcaacggtcatttgattcacaaaatcgaaccgcatttcaatacctcttggatgtcctgggacgggtgtgatctcgactactattgcaacatgggagactggccctcatgtacttacacaggcgtcacccagcacaatcacgctgcatttgtgaacctgttaaatatcgagacggattataccaagacattccattttcacagtaaaagggttactgcccatggcgacacccctcagctggatctcaaggctcggccaacatacggggccggagaaattactgtgcttgtcgaggtggcggacatggagctgcacaccaaaaaggtagaaataagcggtttgaagttcgcatccctagcctgcacaggctgttacgcttgctctagcgggatctcatgtaaagttcgcattcatgtggatgagcccgacgaactgaccgtccacgtgaagagttccgatcctgacgtcgtggccgcaagcacttctctcatggctcgaaaactggagtttggaacggattcaacattcaaggccttcagtgcgatgccaaaaaccagcctttgcttttatatcgttgaaagagagtactgtaagtcctgctctgaggaagacactcagaagtgtgtggataccaggctggagcaaccccagtcgatattgattgaacacaaaggcacaatcatcggtaagcagaacgatacctgcactgccaaagcaagctgctggctcgagtccgtaaagtcattcttttatgggctgaaaaacatgttaggcagtgtcttcggaaactttttcattggcatcctgctatttctcgctccgttcgtgctgcttgttttgtttttcatgtttgggtggaagattctgttctgttttaagtgctgtcggcgtacacgcggactcctgaaatacagacatcttaaggacgacgaggaaacgggttataggcggataatcgagcgactgaataataaaaagggcaaaaaccgcttgctcgacggggaaagactggccgataggaagattgctgagttattctctaccaagactcacatcgga

SEQ ID NO: 10810 - RNA, 1932 nt, synthetic construct
  misc_feature 1..1932: note = derived and/or modified CDS sequence (opt3) from CCHFV(47-ST-2013)__KR814861.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgagtgtcccgagcgatgcggttgtacttcttccacatgcctccataaggaatggcctcactcacgtaattggagatgtaacccaacctggtgctggggagtcgggacgggctgtacttgctgtggcgtggatgtaaaagacctgtttaccgatcatatgttcatcaagtggaaagttgagtacataaagacagaagccatcgtgtgcgtcgagctgactagccaggaaaggcagtgtagtctcattgaggcagggacccggtttaatttaggacccgtgacaatcaccctgtctgagcctcgcaacattcaacagaaacttccacccgaaatcataacgttgcaccctaagattgaggaaggtttctttgacctgatgcatgtgcagaaggtcctatccgccagcactgtttgcaaactccagtcgtgcacacacggcatcccaggggatctgcaaatttatcacatcggaaatcttctgaagggcgacagagtgaacggtcatttgatccacaaaattgagccgcatttcaatacctcttggatgtcctgggatgggtgtgacctcgattactattgcaacatgggagactggccctcatgtacttacacaggcgtaacccagcacaatcacgctgcatttgtgaacctgttaaatatagaaacggactataccaagacattccattttcacagtaaaagggtcactgcccatggcgatacccctcagctggacctcaaggctcggccaacatacggggccggagagatcactgtgcttgttgaggtggcggatatggaactgcacaccaaaaaggtcgaggtgagcggtttgaagttcgcatccctagcctgcacaggctgttacgcttgctctagcgggatttcatgtaaagtacgcatccatgttgacgaacccgatgagctgaccgtgcacgtcaagagttccgaccctgatgtggtcgccgcaagcacttctctcatggctcgaaaactggaatttggaacggactcaacattcaaggccttcagtgcgatgccaaaaaccagcctttgcttttatatagtggagagagagtactgtaagtcctgctctgaagatgacactaagaaatgtgttgataccaagctggagcagccccaatcgattttgatcgaacacaaaggcacaatcattggtaagcagaacgatacctgcactgccaaagcaagctgctggctcgagtccgtgaagtcattcttttatgggctgaagaacatgttaggcagtgtattcggaaactttttcgtcggcatcctgctatttctcgctccgttcgtgctgcttgttttgtttttcatgtttgggtggaaaattctgttctgttttaagtgctgtaggcggacacgtggactcttcaaataccgccatctgaaggacgacgaggaaacgggttatagaaggataatcgagcggcttaattctaaaaagggcaagaatcgactgttggacggggaacgcctcgccgatagaaaaattgctgagctgttcagcaccaagactcacatcgga

SEQ ID NO: 10811 - RNA, 1932 nt, synthetic construct
  misc_feature 1..1932: note = derived and/or modified CDS sequence (opt3) from CCHFV(52-R-2014)__KR814862.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgacgatgcgtctgagagcaaactgcttaccgtgtccattatggacctgtcacaaatgtacagtccagttttcgagtatttgagcggagatcgccaggtggaagagtggccgaaggctacatgcaccggcgactgtcccgaacgatgcggttgtacttcttccacatgcctccataaggagtggcctcactcacgtaattggagatgtaacccaacctggtgctggggagtcgggacgggctgtacttgctgtggcgtggatgtaaaagacctgtttaccgatcatatgttcgttaagtggaaagtggagtacatcaagacagaagccatagtctgcgtggagctgactagccaggaaaggcagtgtagtctcatcgaggcagggacccggtttaatttaggacccgtgacaattaccctgtctgaacctcgcaacatccaacagaaacttccacccgagattatcacgttgcaccctaaggtcgaggaaggtttctttgacctgatgcatgttcagaaggtgctatccgccagcactgtatgcaaactccagtcgtgcacacacggcataccaggggatctgcaagtgtatcacattggaaatcttctgaagggcgacagagtcaacggtcatttgatccacaaaattgagccgcatttcaatacctcttggatgtcctgggatgggtgtgacctcgactactattgcaacatgggagattggccctcatgtacttacacaggcgtgacccagcacaatcacgctgcatttgttaacctgttaaatatcgaaacggactataccaagacattccattttcacagtaaaagggtgactgcccatggcgatacccctcagctggacctcaaggctcggccaacatacggggccggagagatcactgtccttgtggaagtagcggatatggagctgcacaccaaaaaggttgagattagcggtttgaagttcgcatccctagcctgcacaggctgttacgcttgctctagcgggatatcatgtaaagtgcgcatccatgtcgacgaacccgatgagctgaccgtgcacgtcaagagtaacgaccctgatgtggttgccgcatccactagcctcatggctcgaaaactggaatttggaacggactctacattcaaggccttctcagcgatgccaaaaaccagtctttgcttttatattgtggagagagaatactgtaagagctgctccgaggaggatactcagaagtgtgtagacaccaaactggaacaaccccagtctatcttgatagagcacaagggcacaattatcggtaaacagaacgatacctgcactgccaaggcagggtgctggctcgaatcggtcaagagcttcttttatggcctgaaaaatatgttaggatccgtgttcggcaactttttcatcgggattctgctatttctcgctccgttcgttctgcttgtgttgtttttcatgtttggatggaagatcctgttctgttttaaatgctgtaggcggacacgtggtctcctgaagtaccgccttctgaaagacgacgaggagacgggctatagaaggattatagaacggttgaataacaagaaagggaagaatcgactcctggatggagagcgcttagccgacagaaagatcgctgaactgttctcaaccaaaactcatattggc

SEQ ID NO: 10812 - RNA, 1932 nt, synthetic construct
  misc_feature 1..1932: note = derived and/or modified CDS sequence (opt3) from CCHFV(75-R-2012)__KR814863.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcgttaagtggaaagtggaatacatcaagacagaggccatagtctgcgtggaactgactagccaggagaggcagtgtagtctcatcgaagcagggacccggtttaatttaggacccgtgacaattaccctgtctgagcctcgcaacatccaacagaaacttccacccgagattatcacgttgcaccctaaggtcgaagagggtttctttgatctgatgcatgttcagaaggtgctatccgccagcactgtatgcaaactccagtcgtgcacacacggcataccaggggacctgcaagtgtatcacattggaaatcttctgaagggcgatagagtcaacggtcatttgatccacaaaattgaaccgcatttcaatacctcttggatgtcctgggacgggtgtgatctcgactactattgcaacatgggagactggccctcatgtacttacacaggcgtgacccagcacaatcacgctgcatttgttaacctgttaaatatcgagacggattataccaagacattccattttcacagtaaaagggtgactgcccatggcgacacccctcagctggatctcaaggctcggccaacatacggggccggagaaatcactgtccttgtggaggtagcggacatggagctgcacaccaaaaaggttgaaattagcggtttgaagttcgcatccctagcctgcacaggctgttacgcttgctctagcgggatatcatgtaaagtgcgcatccatgtcgatgagcccgacgaactgaccgtgcacgtcaagagttccgatcctgacgtggttgccgcaagcacttctctcatggctcgaaaactggagtttggaacggattcaacattcaaggccttcagtgcgatgccaaaaaccagcctttgcttttatattgtggaaagagagtactgtaagtcctgctctgaggaagacactcagaagtgtgtagataccaaactggagcaaccccagtcgatcttgatagaacacaagggcacaattatcggtaaacagaacgatacctgcactgccaaggcaagctgctggctcgagtccgtcaaatcattcctgtatgggttaaagaacatgctgggcagtgtgtttggaaatttctttatcggcattctactcttcctggctccgtttgttcttttggtgctgttctttatgttcgggtggaagatcctcttttgtttcaaatgctgtaggcggacacgtggactgcttaagtaccgcctgttgaaagacgacgaggaaacgggttatagaaggattatagagcggctcaacaataagaaaggcaagaaccgactgttagacggggaacgcctggccgatagaaagatcgctgagctattttctaccaaaactcatattgga

SEQ ID NO: 10813 - RNA, 1932 nt, synthetic construct
  misc_feature 1..1932: note = derived and/or modified CDS sequence (opt3) from CCHFV(75-ST-2010)__KR814864.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcgttaagtggaaagtggaatacatcaagacagaggccatagtctgcgtggaactgactagccaggagaggcagtgtagtctcatcgaagcagggacccggtttaatttaggacccgtgacaattaccctgtctgagcctcgcaacatccaacagaaacttccacccgagattatcacgttgcaccctaaggtcgaagagggtttctttgatctgatgcatgttcagaaggtgctatccgccagcactgtatgcaaactccagtcgtgcacacacggcataccaggggacctgcaagtgtatcacattggaaatcttctgaagggcgatagagtcaacggtcatttgatccacaaaattgaaccgcatttcaatacctcttggatgtcctgggacgggtgtgatctcgactactattgcaacatgggagactggccctcatgtacttacacaggcgtgacccagcacaatcacgctgcatttgttaacctgttaaatatcgagacggattataccaagacattccattttcacagtaaaagggtgactgcccatggcgacacccctcagctggatctcaaggctcggccaacatacggggccggagaaatcactgtccttgtggaggtagcggacatggagctgcacaccaaaaaggttgaaattagcggtttgaagttcgcatccctagcctgcacaggctgttacgcttgctctagcgggatatcatgtaaagtgcgcatccatgtcgatgagcccgacgaactgaccgtgcacgtcaagagttccgatcctgacgtggttgccgcaagcacttctctcatggctcgaaaactggagtttggaacggattcaacattcaaggccttcagtgcgatgccaaaaaccagcctttgcttttatattgtggaaagagagtactgtaagtcctgctctgaggaagacactcagaagtgtgtagataccaaactggagcaaccccagtcgatcttgatagaacacaagggcacaattatcggtaaacagaacgatacctgcactgccaaggcaagctgctggctcgagtccgtcaaatcattcttttatgggctgaagaacatgttaggcagtgtgttcggaaactttttcatcggcattctgctatttctcgctccgttcgttctgcttgtgttgtttttcatgtttgggtggaagatcctgttctgttttaaatgctgtaggcgggcccgtggactcctgaagtaccgccatcttaaagacgacgaggaaacaggttatagaaagattatagagaggctgaataataaaaagggcaagaaccggttgctcgacggggaacgactggctgatcgcaaaatcgccgagttattctctacgaagacccacattgga

SEQ ID NO: 10814 - RNA, 1932 nt, synthetic construct
  misc_feature 1..1932: note = derived and/or modified CDS sequence (opt3) from CCHFV(3756-ST-2007)__KR814866.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcatcaagtggaaagttgaatacataaagacagaggccatcgtgtgcgtcgaactgactagccaggagaggcagtgtagtctcattgaagcagggacccggtttaatttaggacccgtgacaatcaccctgtctgagcctcgcaacattcaacagaaacttccacccgagatcataacgttgcaccctaagattgaagagggtttctttgatctgatgcatgtgcagaaggtcctatccgccagcactgtttgcaaactccagtcgtgcacacacggcatcccaggggacctgcaaatttatcacatcggaaatcttctgaagggcgatagagtgaacggtcatttgatccacaaaattgaaccgcatttcaatacctcttggatgtcctgggacgggtgtgatctcgactactattgcaacatgggagactggccctcatgtacttacacaggcgtaacccagcacaatcacgctgcatttgtgaacctgttaaatatagagacggattataccaagacattccattttcacagtaaaagggtcactgcccatggcgacacccctcagctggatctcaaggctcggccaacatacggggccggagaaatcactgtgcttgttgaggtggcggacatggagctgcacaccaaaaaggtcgaaattagcggtttgaagttcgcatccctaacatgcaccggctgttacgcctgctctagcgggatctcatgtaaagtgcgcatacatgtagatgagcccgacgaactgactgttcacgtgaagagttccgatcctgacgtcgtggctgccagcacgtctctcatggcacgaaaactggagtttggaacagattcaaccttcaaggctttcagtgccatgccaaaaactagcctttgcttttatattgtcgaaagagagtactgtaagtcctgctctgaggacgataccaagaaatgtgtggacacaaagctggaacagccccaatcgatcttgatcgagcacaaaggcaccattatcggtaagcagaacgacacttgcacagcgaaagccagctgctggctcgaatccgttaagtcattcttttatgggctgaagaacatgttaggcagtgtgttcggatctttctttgtaggcattctgctatttctcacgccgttcgtcctgcttgtgttgtttttcatgtttgggtggaaaatactgttctgttttaagtgctgtaggcggacccgtggactcttcaaataccgccatctgaaggatgacgaggagactggttatagaaggatcattgaacggcttaatagcaaaaagggcaagaaccgactgttggatggggagcgcctcgcagacagaaaaatcgctgaactgttctccacaaagacccacatcgga

SEQ ID NO: 10815 - RNA, 1932 nt, synthetic construct
  misc_feature 1..1932: note = derived and/or modified CDS sequence (opt3) from CCHFV(3809-ST-2007)__KR814867.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcgttaagtggaaagtggaatacatcaagacagaggccatagtctgcgtggaactgactagccaggagaggcagtgtagtctcatcgaagcagggacccggtttaatttaggacccgtgacaattaccctgtctgagcctcgcaacatccaacagaaacttccacccgagattatcacgttgcaccctaaggtcgaagagggtttctttgatctgatgcatgttcagaaggtgctatccgccagcactgtatgcaaactccagtcgtgcacacacggcataccaggggacctgcaagtgtatcacattggaaatcttctgaagggcgatagagtcaacggtcatttgatccacaaaattgaaccgcatttcaatacctcttggatgtcctgggacgggtgtgatctcgactactattgcaacatgggagactggccctcatgtacttacacaggcgtgacccagcacaatcacgctgcatttgttaacctgttaaatatcgagacggattataccaagacattccattttcacagtaaaagggtgactgcccatggcgacacccctcagctggatctcaaggctcggccaacatacggggccggagaaatcactgtccttgtggaggtagcggacatggagctgcacaccaaaaaggttgaaattagcggtttgaagttcgcatccctagcctgcacaggctgttacgcttgctctagcgggatatcatgtaaagtgcgcatccatgtcgatgagcccgacgaactgaccgtgcacgtcaagagttccgatcctgacgtggttgccgcaagcacttctctcatggctcgaaaactggagtttggaacggattcaacattcaaggccttcagtgcgatgccaaaaaccagcctttgcttttatattgtggaaaaggagtactgtagatcctgctctgaggaagacactcagaagtgtgtagataccaaactggagcaaccccagtcgatcttgatagaacacaagggcacaattatcggtaaacagaacgatacctgcactgccaaggcaagctgctggctcgagtccgtcaaatcattcttttatgggctgaagaacatgttaggcagtgtgttcggaaactttttcatcggcattctgctatttctcacaccgttcgttctgcttgtgttgtttttcatgtttgggtggaagatcctgttctgttttaaatgctgtaggcggacgcgtggactcctgaagtaccgccatcttaaagacgacgaggaaaccggttatagaaggattatagagcggctgaataataagaaaggcaagaaccgattgctcgacggggaacgcctggctgatagaaagatcgccgagttattctctactaaaacacacattgga

SEQ ID NO: 10816 - RNA, 1932 nt, synthetic construct
  misc_feature 1..1932: note = derived and/or modified CDS sequence (opt3) from CCHFV(3820-ST-2007)__KR814868.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcatcaagtggaaagttgaatacataaagacagaggccatcgtgtgcgtcgaactgactagccaggagaggcagtgtagtctcattgaagcagggacccggtttaatttaggacccgtgacaatcaccctgtctgagcctcgcaacattcaacagaaacttccacccgagatcataacgttgcaccctaagattgaagagggtttctttgatctgatgcatgtgcagaaggtcctatccgccagcactgtttgcaaactccagtcgtgcacacacggcatcccaggggacctgcaaatttatcacatcggaaatcttctgaagggcgatagagtgaacggtcatttgatccacaaaattgaaccgcatttcaatacctcttggatgtcctgggacgggtgtgatctcgactactattgcaacatgggagactggccctcatgtacttacacaggcgtaacccagcacaatcacgctgcatttgtgaacctgttaaatatagagacggattataccaagacattccattttcacagtaaaagggtcactgcccatggcgacacccctcagctggatctcaaggctcggccaacatacggggccggagaaatcactgtgcttgttgaggtggcggacatggagctgcacaccaaaaaggtcgaaattagcggtttgaagttcgcatccctaacatgcaccggctgttacgcctgctctagcgggatctcatgtaaagtgcgcatacatgtagatgagcccgacgaactgactgttcacgtgaagagttccgatcctgacgtcgtggctgccagcacgtctctcatggcacgaaaactggagtttggaacagattcaaccttcaaggctttcagtgccatgccaaaaactagcctttgcttttatattgtcgaaagagagtactgtaagtcctgctctgaggacgataccaagaaatgtgtggacacaaagctggaacagccccaatcgatcttgatcgagcacaaaggcaccattatcggtaagcagaacgacacttgcacagcgaaagccagctgctggctcgaatccgttaagtcattcttttatgggctgaagaacatgttaggcagtgtgttcggatctttctttgtaggcattctgctatttctcgcaccgttcgtcctgcttgtgttgtttttcatgtttgggtggaaaatactgttctgttttaagtgctgtaggcggacgcgtggactcttcaaataccgccatctgaaggatgacgaggagaccggttatagaaggatcattgaacggcttaatagcaaaaagggcaagaaccgactgttggatggggagcgcctcgctgacagaaaaatcgccgaactgttctccactaagacacacatcgga

SEQ ID NO: 10817 - RNA, 1932 nt, synthetic construct
  misc_feature 1..1932: note = derived and/or modified CDS sequence (opt3) from CCHFV(4495-ST-2008)__KR814869.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcatttcctgggatctcggggtggaggacgcgtctgagagcaaactgcttaccgtctccatcatggatctgtcacaaatgtacagtccagtgttcgaatatttgagcggagaccgccaggttgaggaatggccgaaggctacatgcaccggcgattgtcccgagcgatgcggttgtacttcttccacatgcctccataaggagtggcctcactcacgtaattggagatgtaacccaacctggtgctggggagtggggacgggctgtacttgctgtggcgtcgacgtgaaagatctgtttaccgaccatatgttcgtaaagtggaaagttgaatacataaagacagaggccatcgtgtgcgtcgaactgactagccaggagaggcagtgtagtctcattgaagcagggacccggtttaatttaggacccgtgacaatcaccctgtctgagcctcgcaacattcaacagaaacttccacccgagatcataacgttgcaccctaaggtggaagagggtttctttgatctgatgcatgtccagaaggttctatccgccagcactgtgtgcaaactccagtcgtgcacacacggcattccaggggacctgcaagtatatcacatcggaaatcttctgaagggcgatagagtgaacggtcatttgattcacaaaatcgaaccgcatttcaatacctcttggatgtcctgggacgggtgtgatctcgactactattgcaacatgggagactggccctcatgtacttacacaggcgtcacccagcacaatcacgctgcatttgtgaacctgttaaatatcgagacggattataccaagacattccattttcacagtaaaagggttactgcccatggcgacacccctcagctggatctcaaggctcggccaacatacggggccggagaaattactgtgcttgtcgaggtggcggacatggagctgcacaccaaaaaggtagaaataagcggtttgaagttcgcatccctagcctgcacaggctgttacgcttgctctagcgggatctcatgtaaagttcgcattcatgtggatgagcccgacgaactgaccgtccacgtgaagagttccgatcctgacgtcgtggccgcaagcacttctctcatggctcgaaaactggagtttggaacggattcaacattcaaggccttcagtgcgatgccaaaaaccagcctttgcttttatatcgttgaaagagagtactgtaagtcctgctctgaggaagacactcagaggtgtgtggataccaagctggagcaaccccagtcgatattgattgaacacaaaggcacaatcatcggtaagcagaacgatacctgcactgccaaagcaagctgctggctcgagtccgtaaagtcattcttttatgggctgaaaaacatgttaggcagtgtcttcggaaactttttcattggcatcctgctatttctcgctccgttcgtgctgcttgttttgtttttcatgtttgggtggaagattctgttctgttttaagtgctgtcggcgtgcccgcggactcctgaaatacagacatcttaaggacgacgaggaaacaggttataggaaaataatcgagcggctgaataataagaaaggcaagaaccgattgctcgacggggaacgcctggctgatagaaagattgccgagttattctctacgaaaacccacatcgga

SEQ ID NO: 10818 - RNA, 1932 nt, synthetic construct
  misc_feature 1..1932: note = derived and/or modified CDS sequence (opt3) from CCHFV(4691-ST-2009)__KR814871.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctgcagtttccacggccaatatcgcgttatcttggtcgtcagtggagcacagagggaacaaaattctggtaaccggtaggagcgaaagtatcatgaagctagaggaacggacaggcgtgtcctgggatctcggggtcgaggacgcttctgagagcaaactgcttactgtgtccattatggatctgtcacaaatgtacagtccagttttcgaatatttgagcggagaccgccaggtggaggaatggccgaaggcaacctgcacaggcgattgtcccgagcgatgcggttgtacctcttccacttgcctccataaggagtggcctcactcacgtaattggagatgtaacccaacatggtgctggggagtcgggaccggctgtacgtgctgtggcgtggacgtaaaagatctgtttactgaccatatgttcatcaagtggaaagttgaatacataaagaccgaggccatcgtgtgcgtcgaactgacaagccaggagaggcagtgtagtctcattgaagccgggactcggtttaatttaggacccgtgaccatcacactgtctgagcctcgcaacattcaacagaaacttccacccgagatcataaccttgcaccctaagattgaagagggtttctttgatctgatgcatgtgcagaaggtcctatccgctagcacggtttgcaaactccagtcgtgcactcacggcatcccaggggacctgcaaatttatcacatcggaaatcttctgaagggcgatagagtgaacggtcatttgatccacaaaattgaaccgcatttcaatacatcttggatgtcctgggacgggtgtgatctcgactactattgcaacatgggagactggccctcatgtacctacactggcgtaacacagcacaatcacgcagcctttgtgaacctgttaaatatagagaccgattatacgaagaccttccattttcacagtaaaagggtcacagctcatggcgacactcctcagctggatctcaaggcccggccaacctacggggcgggagaaatcacagtgcttgttgaggtggcagacatggagctgcacactaaaaaggtcgaaattagcggtttgaagttcgcctccctagcttgcaccggctgttacgcctgctctagcgggatctcatgtaaagtgcgcatacatgtagatgagcccgacgaactgacagttcacgtgaagagttccgatcctgacgtcgtggcagctagcacctctctcatggcccgaaaactggagtttggaactgattcaacgttcaaggcgttcagtgccatgccaaaaacaagcctttgcttttatattgtcgaaagagagtactgtaagtcctgctctgaggacgataccaagaaatgtgtggacactaagctggaacagccccaatcgatcttgatcgagcacaaaggcaccattatcggtaagcagaacgacacatgcaccgcaaaagctagctgctggctcgaatccgttaagtcattcttttatgggctgaagaacatgttaggcagtgtgttcggaaactttttcgtaggcattctgctatttctcgccccgttcgtcctgcttgtgttgtttttcatgtttgggtggaaaatactgttctgttttaagtgctgtaggcggactcgtggactcttcaaataccgccatctgaaggatgacgaggagacaggttatagaaggatcattgaacggcttaattctaaaaagggcaagaatcgactgttggatggggagcgcctcgctgacagaaaaatcgccgaactgttcagcacgaagacccacatcgga

SEQ ID NO: 10819 - RNA, 1932 nt, synthetic construct
  misc_feature 1..1932: note = derived and/or modified CDS sequence (opt3) from CCHFV(4701-ST-2009)__KR814872.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcatcaagtggaaagttgaatacataaagacagaggccatcgtgtgcgtcgaactgactagccaggagaggcagtgtagtctcattgaagcagggacccggtttaatttaggacccgtgacaatcaccctgtctgagcctcgcaacattcaacagaaacttccacccgagatcataacgttgcaccctaagattgaagagggtttctttgatctgatgcatgtgcagaaggtcctatccgccagcactgtttgcaaactccagtcgtgcacacacggcatcccaggggacctgcaaatttatcacatcggaaatcttctgaagggcgatagagtgaacggtcatttgatccacaaaattgaaccgcatttcaatacctcttggatgtcctgggacgggtgtgatctcgactactattgcaacatgggagactggccctcatgtacttacacaggcgtaacccagcacaatcacgctgcatttgtgaacctgttaaatatagagacggattataccaagacattccattttcacagtaaaagggtcactgcccatggcgacacccctcagctggatctcaaggctcggccaacatacggggccggagaaatcactgtgcttgttgaggtggcggacatggagctgcacaccaaaaaggtcgaaattagcggtttgaagttcgcatccctaacatgcaccggctgttacgcctgctctagcgggatctcatgtaaagtgcgcatacatgtagatgagcccgacgaactgactgttcacgtgaagagttccgatcctgacgtcgtggctgccagcacgtctctcatggcacgaaaactggagtttggaacagattcaaccttcaaggctttcagtgccatgccaaaaactagcctttgcttttatattgtcgaaagagagtactgtaagtcctgctctgaggacgataccaagaaatgtgtggacacaaagctggaacagccccaatcgatcttgatcgagcacaaaggcaccattatcggtaagcagaacgacacttgcacagcgaaagccagctgctggctcgaatccgttaagtcattcttttatgggctgaagaacatgttaggcagtgtgttcggaggctttttcgtagggattctgctatttctcgcaccgttcgtcctgcttgtgttgtttttcatgtttggatggaaaatactgttctgttttaagtgctgtaggcggacgcgtggtctcttcaaataccgccatctgaaggatgacgaggagaccggctatagaaggatcattgaacggcttaattctaaaaaggggaagaaccgactgttggatggagagcgcctcgctgacagaaaaatcgccgaactgttcagcactaagacacacatcggc

SEQ ID NO: 10820 - RNA, 1932 nt, synthetic construct
  misc_feature 1..1932: note = derived and/or modified CDS sequence (opt3) from CCHFV(Oman-199809166)__KR864901.1__Gc
  source 1..1932: mol_type = other RNA
ttcctggacagcatcgccaagggcatgaaaaacctccttaattccacctctctggagacatcattgagtattgaagctccctggggagcaataaacgtgcagagcacttttaagcctacggtctccaccgccaatatcgcgttatcttggtcgtcagttgagcacagagggaacaaaattctggtgagcggtaggagtgaatccatcatgaagctagaggaacggacaggcatttcttgggatctcggggtagaggacgctagcgagtccaaactgcttactgtgtcagtcatggatctgagtcaaatgtacagcccagtgttcgaatatttgtctggagaccgccaggttgaggaatggccgaaggctacctgcacaggcgattgtcccgagcgatgcggttgtacctcctcaacttgcctccataaggagtggcctcacagccgtaattggagatgtaacccaacatggtgctggggagtggggaccggctgtacgtgctgtggcctggacgtcaaagatctgtttactgactacatgttcgtgaagtggaaagtagaatatatcaagaccgaggcaatagtttgcgtggaactcacaagtcaggagaggcagtgttctttaatcgaagccgggactcggtttaatctgggacccgtcaccattacactttccgagcctcgcaacatccaacagaaattgccacccgagattgtgaccctgcatcctagaatcgaagagggtttctttgatctaatgcacgtgcagaaggtcctcagcgcttcgacggtttgcaagctgcagtcttgcactcatggcgtgccaggggaccttcaagtataccacataggaaatctgttgaaaggcgataaggtgaacggtcacctcattcataaagtcgaaccgcacttcaatacatcctggatgtcatgggacgggtgtgatctggactattactgcaacatgggagactggcccagttgtacctatactggcgtgacacagcataatcacgcagcctttgttaacttactgaatatcgagaccgattacacgaagaacttccactttcatagcaaaagggtgaccgctcacggcgacacacctcagctcgatcttaaggcccggccaaactacggggcgggagaaattactgtcctggtggaggtagcagacatggagttgcataccaaaaagatcgaaatctccggtctaaagttcgcctctctgacatgcactggctgttatgcttgcagctcagggattagttgtaaagttcgcatacacgtggatgagcccgacgaactcaccgtccatgtgaagtccgaggatcctgacatcgtcgccgcatctagctcactgatggctcgaaaacttgaatttggaacagatagtaccttcaaggccttcagcgcgatgccaaaaacttccctgtgcttttacattgtggagagagagtattgtaagtcttgctcgaaggaagacacgcagaaatgtgttaatgccaagttggagaggccccaaagcatcctcatagaacacaaaggcacaattatcggtaagcagaacgatacctgcactgcaaaagcctcctgctggctggagtcagtgaagagtttcttttacgggttaaagaatatgctgtctggcatcttcggaaacgtatttattggcatcttcctatttctcgccccgttcattctgcttatattgtttttcatgtttgggtggcggatcctgttctgttttaaatgctgtcgtcgcaccagaggactcttcaagtataggcacctgaaagacgacgaggaaacaggttaccggaagattatcgagcgacttaataacaaaaagggcaagaataaactgttggatggggaacgcctcgctgacagaaagatcgccgagctgttcagcaccaaaactcatattgga

SEQ ID NO: 10821 - RNA, 1932 nt, synthetic construct
  misc_feature 1..1932: note = derived and/or modified CDS sequence (opt3) from CCHFV(200406546-Turkey)__KR864902.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcaattgagcacagagggaacaaaatcctggtgacaggtaggagcgaaagtattatgaagctagaggaacggactggcgtatcctgggatctcggggtggaggacgcgtctgagagcaaactgcttaccgtctccatcatggatctgtcacaaatgtacagtccagtgttcgaatatttgagcggagaccgccaggttgaggaatggccgaaggctacatgcaccggcgattgtcccgagcgatgcggttgtacttcttccacatgcctccataaggagtggcctcactcacgtaattggagatgtaacccaacctggtgctggggagtggggacgggctgtacttgctgtggcgtcgacgtgaaagatctgtttaccgaccatatgttcgtaaagtggaaagttgaatacataaagacagaggccatcgtgtgcgtcgaactgactagccaggagaggcagtgtagtctcattgaagcagggacccggtttaatttaggacccgtgacaatcaccctgtctgagcctcgcaacattcaacagaaacttccacccgagatcataacgttgcaccctaaggtggaagagggtttctttgatctgatgcatgtccagaaggttctatccgccagcactgtgtgcaaactccagtcgtgcacacacggcattccaggggacctgcaagtatatcacatcggaaatcttctgaagggcgatagagtgaacggtcatttgattcacaaaatcgaaccgcatttcaatacctcttggatgtcctgggacgggtgtgatctcgactactattgcaacatgggagactggccctcatgtacttacacaggcgtcacccagcacaatcacgctgcatttgtgaacctgttaaatatcgagacggattataccaagacattccattttcacagtaaaagggttactgcccatggcgacacccctcagctggatctcaaggctcggccaacatacggggccggagaaattactgtgcttgtcgaggtggcggacatggagctgcacaccaaaaaggtagaaataagcggtttgaagttcgcatccctagcctgcacaggctgttacgcttgctctagcgggatctcatgtaaagttcgcattcatgtggatgagcccgacgaactgaccgtccacgtgaagagttccgatcctgacgtcgtggccgcaagcacttctctcacggctcgaaaactggagtttggaacagattcaaccttcaaggccttcagtgcgatgccaaaaactagcctttgcttttatatcgttgaaaaggagtactgtaagtcctgcaacgaggacgatacccagaaatgtgtggacacaaagctggaacaaccccagtctatattgattgagcacaaaggcaccatcatcggtaagcagaacgacacttgcacagccaaagcatcgtgctggctcgaaagcgtaaagtccttcttttatgggctgaagaatatgttaggctcagtcttcggaaactttttcattggcatcctgctatttctcgctccgttcgtgctgcttgttttgtttttcatgtttgggtggaaaattctgttctgttttaagtgctgtagaaggacgcggggactcttcaaataccgtcatctgaaggatgacgaggagaccggttataaacgcataatcgaaagacttaataacaagaagggcaaaaataggctgttggatggggagcggctcgccgaccgaaagattgctgaactgttcagtactaaaacacacatcgga

SEQ ID NO: 10822 - RNA, 1932 nt, synthetic construct
  misc_feature 1..1932: note = derived and/or modified CDS sequence (opt3) from CCHFV(1-CR/HU-2015)__KU161584.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcgttaagtggaaagtggaatacatcaagacagaggccatagtctgcgtggaactgactagccaggagaggcagtgtagtctcatcgaagcagggacccggtttaatttaggacccgtgacaattaccctgtctgagcctcgcaacatccaacagaaacttccacccgagattatcacgttgcaccctaagatagaagagggtttctttgatctgatgcatgtccagaaggttctatccgccagcactgtgtgcaaactccagtcgtgcacacacggcattccaggggacctgcaagtatatcacatcggaaatcttctgaagggcgatagagtgaacggtcatttgattcacaaaatcgaaccgcatttcaatacctcttggatgtcctgggacgggtgtgatctcgactactattgcaacatgggagactggccctcatgtacttacacaggcgtcacccagcacaatcacgctgcatttgtgaacctgttaaatatcgagacggattataccaagacattccattttcacagtaaaagggttactgcccatggcgacacccctcagctggatctcaaggctcggccaacatacggggccggagaaattactgtgcttgtcgaggtggcggacatggagctgcacaccaaaaaggtagaaataagcggtttgaagttcgcatccctagcctgcacaggctgttacgcttgctctagcgggatctcatgtaaagttcgcattcatgtggatgagcccgacgaactgaccgtccacgtgaagagttccgatcctgacgtcgtggccgcaagcacttctctcatggctcgaaaactggagtttggaacggattcaacattcaaggccttcagtgcgatgccaaaaaccagcctttgcttttatatcgttgaaagagagtactgtaagtcctgctctgaggacgatactaagaaatgtgtggacaccaagctggaacagccccaatcgatattgattgagcacaaaggcacaatcatcggtaagcagaacgatacctgcactgccaaagcaagctgctggctcgaatccgtaaagtcattcttttatgggctgaagaacatgttaggcagtgtcttcggaaactttttcattggcatcctgctatttctcgctccgttcgtgctgcttgttttgtttttcatgtttgggtggaaaattctgttctgttttaagtgctgtaggcggacacgtggactcttcaaataccgccatctgaaggacgacgaggagacgggttatagaaggataatcgaacggcttaataataaaaagggcaagaaccgactgttggatggggagcgcctcgccgacagaaaaattgctgaactgttctctaccaagactcacatcgga

SEQ ID NO: 10823 - RNA, 1932 nt, synthetic construct
  misc_feature 1..1932: note = derived and/or modified CDS sequence (opt3) from CCHFV(Gaib)__KX013445.1__Gc
  source 1..1932: mol_type = other RNA
ttcagcgactccatcgtgaagggcatgaaaaacctgctcaattctacctcacttgagacaagtctgagcattgaagccccctggggagctataaacgtccagtccacttttaagcctacggtttctaccgcaaatatcgccttgtcgtggtcaagcattgagcacagagggaacaaaatcttagtgagtggtaggtccgaatctattatgaagctggaggaacggacaggcatcagctgggatctaggggtagaggacgcgtccgagtcacgcctcctgactgtgagtgtcatggatcttagccaaatgtactctccagtgttcgaatatctgtccggagaccgacaggttgaggaatggccgaaagctacctgcacaggcgattgtcccgagcgttgcggttgtacctcaagcacttgcttgcataaggagtggcctcacagtagaaattggaggtgtaacccaacatggtgctggggagtggggaccggctgtacgtgctgtggcctcgacgtcaaggatctgtttactgactacatgttcgtgaaatggaaggtagaatatataaaaaccgaggccatcgtttgcgtggaactgacatctcaggagcggcagtgttccctcattgaagcagggactcgctttaatttaggacccgtcaccatcacactgagcgagcctagaaacattcaacagaaacttccacccgagatcataaccttgcatcctaggattgaagagggtttctttgatctgatgcacgtgcagaaagtgctatcggcctctacggtctgcaagctccagtcctgcactcatggcgttccaggggacctgcaagtgtaccacatcggaaatcttctgaagggcgataaagtaaacggtcacttgattcataagatcgaaccgcacttcaatacatcatggatgagttgggacgggtgtgatctcgactattactgcaacatgggagactggcccagctgtacctatactggcgtgacacagcataatcacgctgcatttgtcaacctgttaaatatcgagaccgattacacgaaaaacttccactttcattccaagcgggtgaccgcccacggcgacacacctcagctggatctcaaagctcgcccaacttacggggccggagaaattaccgttcttgtggaggtcgcggacatggagctgcatacaaagaaaatagaaatctctggtttgaagttcgcaagcctaacttgcaccggctgttatgcctgctcaagtgggatttcctgtaaggtgcgaatccacgtagatgagcccgacgaactgacagttcatgtgaaaagcgaggatcctgacatagtcgctgcctcttcaagtctcatggcaagaaagctggaatttggaaccgatagcactttcaaggctttctccgccatgccaaagacgtctctttgcttttacattgtggagagggagtattgtaaatcgtgcagccgggaagacacacagaagtgtgtctccaccaagctggagcaaccccagtcaatcttgatcgaacacaaaggcactattatcggtaagcagaacaatacctgcacaaccaaaactacatgctggctcgagagtgtgaagtctttcttttacgggctgaaaaacatgttaagctccattttcggcaatgtttttgtgggaatattctcatttctggcgccgttcatcctactcattctgtttttcatgtttggctggcgtatccttttctgttttaagtgctgtcgcagaacgagggggttgttcaagtatcggcacctgaaagatgacgaggaaaccggataccgacgcatcattgagagactcaacaataagaaaggtaagagcaaactgcttgacggcgaaaggctggccgatcggaagatagcagagttgttctctactaagacacatatcggg

SEQ ID NO: 10824 - RNA, 1932 nt, synthetic construct
  misc_feature 1..1932: note = derived and/or modified CDS sequence (opt3) from CCHFV(Hodzha)__KX013448.1__Gc
  source 1..1932: mol_type = other RNA
ttcctggacagcatcgtgaagggcaaaaagaacctccttaattccacctctctggagacatcattgagtattgaagccccctggggtgctataaacgtccagagcacttacaaacctacggtttccaccgcaaatatcgccttatcttggtcgtcagtggagcacagaggaaacaagattctggtaagcggtaggagtgaatccatcatgaaactagaggaacggacaggcatttcttgggatctcggggtggaggacgcgagcgagtccaagctgcttactgtctcagtgatggatctgagtcaaatgtatagcccagtttttgaatacttgtctggagaccgccaggtggaggaatggccgaaggctacctgcacaggcgattgttccgagcgatgcggttgtacctcaagcacttgcctccataaagagtggccccacagtcgtaattggagatgtaaccctacatggtgctggggagtcgggaccggctgtacgtgctgtggcctggacgtgaaggatctgttcactgactatatgtttgtaaaatggaaggttgattacatcaaaaccgaagccatagtgtgcgtcgagctcacatctcaggaaaggcagtgttccttagtggaggcagggactcggttcaatctgggaccagtgaccatcacacttagcgaaccccgcaacattcaacagaagttgcctccagagatcattaccctgcatcccagaatcgaggaagggtttttcgacctaatgcacgtccagaaggttctctcggcctctacggtgtgcaaactgcagtcctgcactcatggcgtacctggggatcttcaagtgtatcacataggaaatctgttgaagggcgacaaagtcaacggtcacctcattcataagatcgagccacactttaatacatcatggatgagttgggatgggtgtgacctggactactattgcaacatgggagattggccgagctgtacctacactggcgtgacacagcataatcacgcttccttcgttaacttactgaatattgaaaccgactacacgaaatcttttcacttccatagcaagagggtgaccgcacacggcgatacaccccagctcgaccttaaagcccggcctacttatggggctggagagatcaccgtcctggtggaagtagccgatatggagttgcatacaaagaagatcgagattactggtctaaaatttgcgtcactgacctgcacaggctgttacgcatgcagttccgggataagctgtaaggttcgcatccacgtggacgaaccagatgagctcaccgtccatgtgaaatctgacgatcccgacgtcgtggccgcttcaagtagcctgatggcccgaaaacttgagttcggaactgattccacgtttaaagcattctctgctatgcctaagacatcgctgtgcttctatattgttgaaagagaatactgtaagagctgctccaaagaggacacccagaagtgtgtgaacactaaattggagcaaccacagtcaatcctcatagaacagaagggcaccattatcggtaaacaaaacaatacatgcaccgccaaggcgagttgctggctggagtctgtaaagagctttttctatgggttaaagaacatgctgtccggcatctttggaaatgtcttcgtgggcatttttctattcctcgccccctttatcctgcttattttgttctttatgttcgggtggaggatactgttttgtttcaagtgctgtcggcgtactcgcggactctttaaatacaagcacctgaaagacgatgaagagacaggttatagaaggatcattgagcggcttaacaataagaagggcaaaaacaagctgttggacggggaacgactcgcagatcgcagaatcgctgagctgttctcaacgaaaacccacatcgga

SEQ ID NO: 10825 - RNA, 1932 nt, synthetic construct
  misc_feature 1..1932: note = derived and/or modified CDS sequence (opt3) from CCHFV(IbAn7620)__KX013451.1__Gc
  source 1..1932: mol_type = other RNA
ttcctggacagcatcgccaagggcatgaaaaaccccctcaattccacctctcttgagacatcactgagtattgaagctccttggggtgcaatagatgtgcagagcacttacaagccaacggtctccaccgccaacatcgcgttgtcttggtcgtcagttgagcacagaggaaataaaattttagtgagcggtaggagtgaatccatcatgaagctggaggaacggacaggcatttcttgggacctaggggtagaggatgctagcgagtccaaactcctgactgtgtcagtcatggaccttagtcagatgtatagcccggtgtttgaatacctgtctggagatcgccaggttgaggaatggcccaaggcaacctgcacaggcgactgtcctgagcgatgcggttgtacctcctcaacttgcttgcataaggagtggccacacagccgtaactggagatgtaatcccacatggtgctggggagtggggaccggctgtacgtgctgtggcctcgatgtcaaagacctgttcactgattatatgtttgtgaagtggaaagtagaatacatcaagaccgaggcaatagtttgcgtggaactgacaagtcaggagaggcagtgttctctcatcgaagccgggactcggttcaacttaggacctgtcaccattacactgtccgagccacgcaatatccaacagaaacttccccctgagattatcaccttgcatccaagaatagaagaggggtttttcgacctgatgcacgtgcagaaggtgctaagcgcttcgacggtctgcaagctccagtcttgcactcatggcgttccgggggatctgcaagtgtatcacattggaaaccttctgaaaggcgacaaggtaaatggtcacttgatccataaaattgaaccccactttaacacatcctggatgtcatgggatgggtgtgacctcgactactattgcaatatgggagattggcctagttgtacctacactggcgtgacacagcataaccacgccagcttcgtcaatctgttaaacatcgagaccgactacacgaagaattttcacttccattccaaaagggtgaccgcccacggcgatacaccacagctggacctcaaggctcggcccacttatggggccggagaaatcaccgttcttgtggaggtcgcgaacatggagctgcatacaaagaagattgaaatatctggtttgaagtttgcaagcctaacttgcaccggctgttacgcctgctcaagtgggatctcctgtaaagtgcgcattcacgtagatgagcctgacgaactgacagttcatgtgaaaagcgatgacccagatgtcgtggctgcctcttcaagtctcatggcacgaaaactggagttcggaaccgacagcacttttaaggctttctccgccatgcccaaaacgtctctttgcttctatatcgtcgaaagagagcactgtaagtcgtgcagcgaggaagatacaaagaaatgtgtgaacaccaagctggagcagccgcaatccatattgattgaacacaaaggcactatcatcggtaagcaaaattcaacctgcacagcgaaagccagttgctggctcgagtctgttaagagctttttctacgggctgaagaacatgttatccggcatttttggaaatgtgttcatgggcatctttctgttcctagcaccttttattctcctgatacttttctttatgttcgggtggaggatcttgttttgtttcaaatgctgtcggcgtacccgcggactgtttaagtatagacatctcaaagacgacgaggaaactggttacaggcggattatcgagcgactgaacaataagaaaggcaagaacaagctcctggatggggaacgcttggctgacagaaggatcgccgagcttttctcaacaaaaacgcacattgga

SEQ ID NO: 10826 - RNA, 1932 nt, synthetic construct
  misc_feature 1..1932: note = derived and/or modified CDS sequence (opt3) from CCHFV(K128_76)__KX013454.1__Gc
  source 1..1932: mol_type = other RNA
ttccaggacagcatcgtgaagggcatgaaaaacctgctcaattccacctctcttgagacatcactgagtattgaggccccctggggtgctataaacgtccaaagcacttacaagcctgcagtttccgccgcgaatatcgctttgtcttggtcgtcagtggagcacagaggaagcaaaattttagtaagtggtaggtccgaatctatcatgaagctggaggaacggacgggcattagctgggatctaggggtggaggacgcctccgagtcaaaactcctgaccgtcagtgtgatggatcttagccagatgtattctccagtttttgaatacctgtccggagaccgccaggtggaggaatggccgaaggcaacatgcactggcgattgtcccgagcgatgcggttgtacctcaagcacatgcttgcataaggagtggcctcacagtcgtaactggagatgtaatccaacctggtgctggggagtcgggactggctgtacatgctgtggcctcgacgtgaaagatctgttcaccgactatatgtttgtaaagtggaaagttgaatacatcaagacggaggccatagtgtgcgtcgaactgacttctcaggagaggcaatgttccctcatcgaagctgggacccggttcaacttaggacccgtgacaattactctgagcgagcctcgcaatatccagcagaaacttccacccgagattatcaccttgcatcctagaatagaagaggggtttttcgatctgatgcacgtgcagaaggtcctatcggcatctacagtttgcaagctccaatcctgcacccatggcgtgccaggggacctgcaggtatatcacattggaaaccttctgaaaggcgatagggtgaatggtcacttgatccataagattgaaccgcactttaacacgtcatggatgagttgggacgggtgtgatctcgactactattgcaatatgggagactggcccagctgtacttacacaggcgtcacccagcataaccacgcctccttcgtgaatctgttaaacatcgagactgattacacaaaatcttttcacttccatagcaagcgggttaccgctcacggcgacacgcctcagctggatctcaaagcccgcccaaattatggggcgggagaaatcaccgtgcttgtcgaggtggcagacatggagctgcatacaaagaaaattgaaatatcaggtttgaagtttgccagtctaacttgcaccggctgttacgcttgctccagcgggatctcttgtaaggtacgaatccacgttgatgagcccgacgaactgacagtgcatgtcaaatcagatgaccctgatgtggtcgccgcaagtagctccctcatggctagaaagctggagttcggaactgactctacctttaaagccttctcggcgatgccaaagacaagcctttgcttctatattgtggaaagggagtactgtaaatcctgctcaaaggaggatacccaaaagtgtgttaacactaaactggaacagccccagagtatattgattgagcacaagggcacgatcatcggtaaacaaaacaatacatgcaccgccaagacttcttgctggctcgaaagcgtgaaatcctttttctatgggctgaagaacatgttatcaggcatttttggaaatgtattcgtcggcatctttctgttcctagcaccgtttattctcctgatacttttctttatgttcgggtggcggatcttgttttgtttcaagtgctgtcgtcgcaccagaggactgtttaggtacaaacacctcgagaacgacgaggaaacaggttatcggcgaattatcgagcgcctgaataacaagaaaggcaagaataaacttctggacggggaaagattggctgataggcggatcgccgaactcttcagcaccaagactcatattgga

SEQ ID NO: 10827 - RNA, 1932 nt, synthetic construct
  misc_feature 1..1932: note = derived and/or modified CDS sequence (opt3) from CCHFV(K168_40)__KX013457.1__Gc
  source 1..1932: mol_type = other RNA
ttcctggacggcatcgtgaaggggatgaaaaacctccttaatagcacctccctggagacatctttgtcaattgaagccccctggggagctataaacgtccagagtacttacaagcctacggttagcgcagccaatatcgcgttatcctggtcttcggtggagcacagaggtaacaaaattctggtatcaggcaggagcgaaagtatcatgaagctagaggaacggaccgggatttcctgggatctcggagtggaggacgcttctgagagcaaactgcttacagtctccgtgatggatctgtcacaaatgtatagtccagtttttgaatacttgagcggcgaccgccaggtggaggaatggccgaaggccacttgcaccggtgattgtcccgagcgatgcgggtgtacatcttctacctgcctccataaggagtggcctcactcacgtaattggagatgtaacccaacttggtgctggggagtcggcacaggctgtacctgctgtgggctggacgtgaaagatctgttcacggactatatgtttgtaaagtggaaagttgaatacatcaagactgaggcaatagtgtgcgtcgaactcaccagccaggagaggcagtgtagtttaatcgaagccggaacacggttcaatctgggtcccgtgactattaccctttctgagcctcgcaacatccaacagaaattgccacccgagattatcacactgcatcctagaatagaagagggctttttcgatctaatgcacgtgcagaaggtcctctccgctagcaccgtttgcaagctgcagtcgtgcacgcatggggtgccaggagaccttcaagtatatcacattggcaatctgttgaaaggtgataaggtgaacgggcacctcatccataaaattgaaccgcactttaatacttcttggatgtcctgggacggatgtgatctggactactattgcaacatgggcgactggccctcatgtacatacaccggcgtcactcagcataatcacgcaagtttcatcaacttactgaatatcgagacagattacaccaagagctttcacttccattccaaaagggtgacggcccacggggacacccctcagctcgatcttaaggctcggccaaactatggagccggtgaaattacagttctggtggaggtcgcggacatggagttgcatactaaaaagatagaaatctctggcctaaagtttgcaagcctgacctgcacagggtgttacgcctgctcaagtggaatttcctgtaaagtgcgcatccacgtagatgagcccgacgaactcactgttcatgtcaagagcgatgaccctgatgtggtggctgcctcttcaagtctgatggcacgaaaacttgagttcggcaccgacagcacatttaaggctttctccgccatgccaaaaacctctctgtgcttctatatagtcgaaagagagtactgtaagtcgtgcagcaaggaggatactcagaaatgtgtgaacacgaagttggaacacccccaatccattctcatcgagcacaaaggtacaatcattgggaagcagaataatacctgcactgcgaaaacctcatgctggctggaaagtgttaagtcctttttctatggcttaaagaacatgctgagcggaatctttggcaacgtgttcgtagggatttttctattcctcgccccgtttatactgcttatcttgttctttatgttcggatggaggattctgttttgtttcaaatgctgtcggcgtacacgcggtctctttagatacaagcatctggaggacgacgaggaaaccggctataggcggatcatcgagcgacttaataacaaaaaggggaaaaataagctgttggatggagaacgcctcgcagacagaaggattgctgagctgttctccactaagacacacataggc

SEQ ID NO: 10828 - RNA, 1932 nt, synthetic construct
  misc_feature 1..1932: note = derived and/or modified CDS sequence (opt3) from CCHFV(K168_125)__KX013460.1__Gc
  source 1..1932: mol_type = other RNA
ttcctggacagcatcgtgaagggcaaaaagaacctccttaattccacctctctggagacatcattgagtattgaagccccctggggtgctataaacgtccagagcacttacaaacctacggtttccgcagccaatatcgcgttatcttggtcgtcagtggagcacagaggaaacaagattctggtaagcggtaggagtgaatccatcatgaaactagaggaacggaccggcatttcttgggatctcggggtggaggacgctagcgagtccaagctgcttacagtctcagtgatggatctgagtcaaatgtatagcccagtttttgaatacttgtctggagaccgccaggtggaggaatggccgaaggccacttgcaccggcgattgtcccgagcgatgcggttgtacatcctcaacctgcctccataaagagtggcctcacagccgtaattggagatgtaacccaacttggtgctggggagtcgggacaggctgtacctgctgtggcctggacgtgaaggatctgttcacggactatatgtttgtaaaatggaaggttgaatacatcaaaactgaggcaatagtgtgcgtcgaactcaccagtcaggagaggcagtgttctttaatcgaagccgggacacggttcaatctgggacccgtgactattaccctttccgagcctcgcaacatccaacagaagttgccacccgagattatcacactgcatcctagaatagaagaggggtttttcgatctaatgcacgtgcagaaggtcctcagcgcttcgaccgtttgcaaactgcagtcttgcacgcatggcgtgccaggggaccttcaagtatatcacattggaaatctgttgaagggcgataaagtgaacggtcacctcatccataagattgaaccgcactttaatacttcctggatgtcatgggacgggtgtgatctggactactattgcaacatgggagactggcccagttgtacatacaccggcgtcactcagcataatcacgctagcttcatcaacttactgaatatcgagacagattacaccaaatcctttcacttccattctaagagggtgacggcccacggcgacacccctcagctcgatcttaaagctcggccaaactatggggccggagaaattacagttctggtggaggtcgcggacatggagttgcatactaagaagatagaaatcagcggtctaaaatttgcatcactgacctgcacaggctgttacgcctgcagttccgggattagctgtaaggtgcgcatccacgtagatgagcccgacgaactcactgttcatgtgaaatctgatgaccctgatgtcgtggctgcctcaagtagcctgatggcacgaaaacttgagttcggaaccgactccacatttaaagcattctctgccatgccaaagacctcgctgtgcttctatatagtcgaaagagagtactgtaagagctgctccaaagaggatactcagaagtgtgtgaacacgaaattggaacacccccaatcaattctcatcgagcacaagggcacaatcattggtaaacagaataatacctgcactgcgaagaccagttgctggctggaatctgttaagagctttttctatgggttaaagaacatgctgtccggcatctttggaaacgtgttcgtaggcatttttctattcctcgccccgtttatactgcttatcttgttctttatgttcgggtggaggattctgttttgtttcaagtgctgtcggcgtacacgcggactctttagatacaaacatctggaggacgacgaggaaaccggttataggcggatcatcgagcgacttaataacaagaaaggcaagaataagctgttggatggggaacgcctcgcagacagaaggattgctgagctgttctcaactaaaacacacatagga

SEQ ID NO: 10829 - RNA, 1932 nt, synthetic construct
  misc_feature 1..1932: note = derived and/or modified CDS sequence (opt3) from CCHFV(K229_194)__KX013463.1__Gc
  source 1..1932: mol_type = other RNA
ttcctggacagcatcgtgaagggcaaaaagaacctccttaattccacctctctggagacatcattgagtattgaagccccctggggagctataaacgtccagagcacttttaaacctacggtttccaccgcaaatatcgccttatcttggtcgtcagtggagcacagagggaacaagattctggtaacaggtaggagcgaaagtatcatgaaactagaggaacggactggcgtgtcctgggatctcggggtcgaggacgcgtctgagagcaagctgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaagagtggcctcactcacgtaattggagatgtaacccaacctggtgctggggagtcgggacgggctgtacttgctgtggcgtggacgtaaaggatctgtttaccgaccatatgttcatcaaatggaaggttgaatacataaaaacagaggccatcgtgtgcgtcgaactgactagccaggagaggcagtgtagtctcattgaagcagggacccggtttaatttaggacccgtgacaatcaccctgtctgagcctcgcaacattcaacagaaacttccacccgagatcataacgttgcaccctaagattgaagagggtttctttgatctgatgcatgtgcagaaagtcctatccgccagcactgtttgcaagctccagtcgtgcacacacggcatcccaggggacctgcaaatttatcacatcggaaatcttctgaaaggcgatagattgaacggtcatctcatccacaagattgaaccgcatttcaatacctcttggatgtcctgggacgggtgtgatctggactactattgcaacatgggagactggccctcatgtacttacacaggcgtgacccagcacaatcacgctgcatttgtaaacttactgaatatagagacggattataccaaaacattccattttcacagtaagagggtgactgcccatggcgacacccctcagctcgatcttaaagctcggccaacatacggggccggagaaatcactgtcctggtggaggttgcggacatggagttgcacaccaagaaggtggaaattagcggtctaaaattcgcatccctggcctgcacaggctgttactcttgcagctcagggatcagttgtaaggtccgcatacatgtggatgagcccgacgaactcaccgtacacgttaaatccagcgatcctgacgtggtcgctgcctctacttcactgatggcacgaaaacttgagtttggaacggatagtacattcaaggctttcagcgccatgccaaagacctccctgtgcttttatattgtggaaagagagtactgtaagtcttgctcggaggacgatactaaaaagtgtgtcgacaccaaattggaacagccccaaagcatcctcatcgagcacaagggcacaattatcggtaaacagaacgatacctgcactgcgaaggcctcctgctggctggaatcagtgaagagtttcttttatgggttaaagaacatgctgggctctgttttcggaaactttttcgtgggcattctactctttctggcaccgttcgtacttttggtcctgtttttcatgtttgggtggaagatactcttctgttttaaatgctgtaggcggacacgtggactgttcaagtaccgccatcttaaagacgacgaggagacgggttatagaaagatcattgaaaggctgaatagcaagaaaggcaagaatcggttgctcgatggggagcgactggctgaccgcaaaatcgccgaattattctccaccaagactcacatcgga

SEQ ID NO: 10830 - RNA, 1932 nt, synthetic construct
  misc_feature 1..1932: note = derived and/or modified CDS sequence (opt3) from CCHFV(K229_243)__KX013466.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcgttaagtggaaagtggaatacatcaagacagaggccatagtctgcgtggaactgactagccaggagaggcagtgtagtctcatcgaagcagggacccggtttaatttaggacccgtgacaattaccctgtctgagcctcgcaacatccaacagaaacttccacccgagattatcacgttgcaccctaaggtcgaagagggtttctttgatctgatgcatgttcagaaggtgctatccgccagcactgtatgcaaactccagtcgtgcacacacggcataccaggggacctgcaagtgtatcacattggaaatcttctgaagggcgatagagtcaacggtcatttgatccacaaaattgaaccgcatttcaatacctcttggatgtcctgggacgggtgtgatctcgactactattgcaacatgggagactggccctcatgtacttacacaggcgtgacccagcacaatcacgctgcatttgttaacctgttaaatatcgagacggattataccaagacattccattttcacagtaaaagggtgactgcccatggcgacacccctcagctggatctcaaggctcggccaacatacggggccggagaaatcactgtccttgtggaggtagcggacatggagctgcacaccaaaaaggttgaaattagcggtttgaagttcgcatccctagcctgcacaggctgttacgcttgctctagcgggatatcatgtaaagtgcgcatccatgtcgatgagcccgacgaactgaccgtgcacgtcaagagttccgatcctgacgtggttgccgcaagcacttctctcatggctcgaaaactggagtttggaacggattcaacattcaaggccttcagtgcgatgccaaaaaccagcctttgcttttatattgtggaaaaggagtactgtaagtcctgctctgaggaagacactcagaaatgtgtagataccaagctggagcaaccccagtcgatcttgatagaacacaaaggcacaattatcggtaagcagaacgatacctgcactgccaaagcaagctgctggctcgagtccgtcaagtcattcttttatgggctgaagaacatgttaggcagtgtgttcggaaactttttcatcggcattctgctatttctcacaccgttcgttctgcttgtgttgtttttcatgtttgggtggaaaatcctgttctgttttaagtgctgtagaaggacgcggggactcctgaaataccgtcatcttaaggacgacgaggaaaccggttatcgcagaattatagagaggctgaataataaaaagggcaagaaccggttgctcgacggggaacgactggctgatcgcaaaatcgccgagttattctctactaagacacacattgga

SEQ ID NO: 10831 - RNA, 1932 nt, synthetic construct
  misc_feature 1..1932: note = derived and/or modified CDS sequence (opt3) from CCHFV(K315_14)__KX013469.1__Gc
  source 1..1932: mol_type = other RNA
ttcctggacagcatcgtgaagggcatgaaaaagctccttaactccacctctctggagacatcattgagtattgaagccccctggggagctataaatgtccagagcacttttaaacctacggtttccaccgcaaacatcgccttatcttggtcgtcagtggagcacagagggaataagattctggtaacaggtaggagcgaaagtatcatgaaactagaggaacggactggcgtgtcctgggatctcggggtcgaggacgcgtctgagagcaagctgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaagagtggcctcactcacgtaactggagatgtaatccaacctggtgctggggagtcgggacgggctgtacttgctgtggcgtggacgtaaaggatctgtttaccgaccatatgttcatcaaatggaaggttgaatacataaaaacagaggccatcgtgtgcgtcgaactgactagccaggagaggcagtgtagtctcattgaagcagggacccggtttaacttaggacccgtgacaatcaccctgtctgagcctcgcaatattcaacagaaacttccacccgagatcataacgttgcaccctaagattgaagagggtttctttgatctgatgcatgtgcagaaagtcctatccgccagcactgtttgcaagctccagtcgtgcacacacggcatcccaggggacctgcaaatttatcacatcggaaaccttctgaaaggcgatagagtgaatggtcatttgatccacaagattgaaccgcatttcaacacctcttggatgtcctgggacgggtgtgatctcgactactattgcaatatgggagactggccctcatgtacttacacaggcgtaacccagcacaaccacgctgcatttgtgaatctgttaaacatagagacggattataccaaaacattccattttcacagtaagagggtcactgcccatggcgacacccctcagctggatctcaaagctcggccaacatacggggccggagaaatcactgtgcttgttgaggtggcggacatggagctgcacaccaagaaggtcgaaattagcggtttgaaattcgcatccctaacatgcaccggctgttacgcctgctctagcgggatctcatgtaaggtgcgcatacatgtagatgagcccgacgaactgactgttcacgtgaaaagttccgatcctgacgtcgtggctgccagcacgtctctcatggcacgaaagctggagtttggaacagattcaaccttcaaggctttcagtgccatgccaaagactagcctttgcttttatattgtcgaaagagagtactgtaagtcctgctctgaggacgataccaaaaagtgtgtggacacaaaactggaacagccccaatcgatcttgatcgagcacaagggcaccattatcggtaaacagaatgacacttgcacagcgaaggccagctgctggctcgaatccgttaagtcattcttttatgggctgaaaaacatgttaggcagtgtgttcggatctttctttgtaggcattctgctatttctcgcaccgttcgtcctgcttgtgttgtttttcatgtttgggtggaagatactgttctgttttaaatgctgtaggcggacgcgtggactcttcaagtaccgccatctgaaagatgacgaggagaccggttatagaaggatcattgaacggcttaacagcaagaagggcaaaaatcgactgttggatggggagcgcctcgctgacagaaagatcgccgaactgttctccactaaaacacacatcgga

SEQ ID NO: 10832 - RNA, 1932 nt, synthetic construct
  misc_feature 1..1932: note = derived and/or modified CDS sequence (opt3) from CCHFV(K323_27)__KX013472.1__Gc
  source 1..1932: mol_type = other RNA
ttcctggacagcatcgccaagggcatgaaaaacctccttaattccacctctctggagacatcattgagtattgaagctccctggggagcaataaacgtgcagagcacttttaagcctacggtctccaccgccaatatcgcgttatcttggtcgtcagttgagcacagagggaacaaaattctggtgacaggtaggagcgaaagtatcatgaagctagaggaacggactggcgtatcctgggatctcggggtggaggacgcttctgagagcaaactgcttaccgtctccattatggatctgtcacaaatgtacagtccagtgttcgaatatttgagcggagaccgccaggttgaggaatggccgaaggccacatgcaccggcgattgtcccgagcgatgcggttgtacttcttccacatgcctccataaggagtggcctcactcacgtaattggagatgtaacccaacctggtgctggggagtggggacgggctgtacttgctgtggcgtcgacgtgaaagatctgtttaccgaccatatgttcatcaagtggaaagtagaatacataaagacagaggcaatcgtttgcgtggaactgactgggcaggagaggcagtgtagcctcattgaagccggaacccggtttaatttaggtcccgtcacaatcaccctgagtgagcctcgcaacattcaacagaaacttccacccgagatcataacgttgcaccctaagattgaagagggcttctttgatctgatgcatgtgcagaaggtgctatctgcttccactgtctgcaaactccagagctgcacacacgggatcccaggagacctgcaaatttatcacatcggcaatcttctgaagggtgatagagttaacgggcatttgatccacaaaattgaaccgcatttcaatacctcgtggatgtcttgggacggatgtgatctcgactactattgcaacatgggcgactggccctcctgtacttacacaggcgtgacccagcacaatcacgcagcctttgtaaacctgttaaatatagagacggattataccaagacattccattttcactcaaaaagggtgactgctcatggggacacccctcagctggatctcaaggcccggccaacatacggagcgggtgaaatcactgtccttgtggaggttgcagacatggagctgcacaccaaaaaggtggaaattagtggcttgaagttcgccagcctaacatgcaccgggtgttacgcttgctcctctggaatcagctgtaaagtccgcatacatgtggatgagcccgacgaactgactgtacacgttaagtcaagtgatcctgacgtggtcgccgcatccacgagcctcatggctcgaaaactggagtttggcacagattctaccttcaaggccttctcagcgatgccaaaaaccagtctttgcttttatattgtggaaagagagtactgtaagagctgctccgaggacgatactaagaaatgtgtcgacacaaagctggaacagccccaatctatcttgatcgagcacaaaggtaccattatcgggaagcagaacgacacttgcacagccaaagcatcgtgctggctcgaaagcgtgaagtccttcttttatggcctgaagaacatgttaggatcagttttcggcagtttctttgtggggattctgctatttctcgctccgttcgtactgcttgtcttgtttttcatgtttggatggaaaatactgttctgttttaagtgctgtaggcggacgcgtggtctcttcaaataccgccatctgaatgatgacgaggagaccggctatagaaggatcattgaacggcttaactctaagaaagggaagaatcgactgttggatggagagcgcctcgccgacagaaagatcgctgaactgttcagcactaaaacacacatcggc

SEQ ID NO: 10833 - RNA, 1932 nt, synthetic construct
  misc_feature 1..1932: note = derived and/or modified CDS sequence (opt3) from CCHFV(K340_6)__KX013475.1__Gc
  source 1..1932: mol_type = other RNA
agcctggactccatcgtgaagggcatgaaaaacctccttaattctacctcactggagacaagtttgagcattgaagccccctggggagctataaacgtccagtccactttcaagcctacggtttctaccgcaaatatcgccttatcgtggtcaagcgtggagcacagaggaaacaaaattctggtaacaggtaggagtgaatccatcatgaagctagaggaacggactggcgtgtcttgggatctcggggtcgaggacgcgagcgagtccaaactgcttaccgtgtcaattatggatctgagtcaaatgtacagcccagtttttgaatatttgtctggagaccgccaggtggaggaatggccgaaggctacatgcaccggcgattgtcccgagcgatgcggttgtacttcctcaacatgcctccataaggagtggcctcacagccgtaattggagatgtaacccaacctggtgctggggtgtcggaacgggctgtacttgctgtggcgtggacgtaaaagatctgttcaccgaccatatgtttatcaagtggaaagttgaatacataaagacagaggccatcgtgtgcgtcgaactgacaagtcaggagaggcagtgttctctcattgaagcagggacccggttcaatttaggacccgtgacaatcaccctgtccgagcctcgcaacattcaacagaaacttccacccgagatcataacgttgcaccctaagattgaagaggggtttttcgatctgatgcatgtgcagaaggtcctaagcgcctcgactgtttgcaaactccagtcttgcacacacggcatcccaggggacctgcaaatttatcacatcggaaatcttctgaagggcgatagagtgaacggtcatttgatccacaaaattgaaccgcattttaatacctcctggatgtcatgggacgggtgtgatctcgactactattgcaacatgggagactggcccagttgtacttacacaggcgtaacccagcacaatcacgctgcattcgtgaacctgttaaatatagagacggattataccaagacatttcatttccacagcaaaagggtcactgcccatggcgacacccctcagctggatctcaaggctcggccaacatacggggccggagaaatcactgtgcttgttgaggtgaccgacatggagctgcacactaaaaaggtcgaaatttccggtttgaagtttgcgtctctaacctgcactggctgttacgcatgcagctcagggatcagttgtaaagtgcgcatacatgtagatgagcccgacgaactgacggttcacgtgaagtccagcgatcctgacgtcgtggccgcttctacatcactcatggcccgaaaactggagttcggaaccgatagtacttttaaggcattcagcgctatgccaaaaacctccctttgcttctatattgtcgaaagagagtactgtaagtcttgctcggaggacgatacaaagaaatgtgtggacaccaagctggaacagccccaaagcatcttgatcgagcacaaaggcactattatcggtaagcagaacgacacatgcacggccaaagcgtcctgctggctcgaatcagttaagtcctttttctatgggctgaagaacatgttaggctctgtgtttgggagcttctttgtaggcattctgctattcctcgccccgtttgtcctgcttgtgttgttctttatgttcgggtggaaaatactgttttgtttcaagtgctgtaggcggacccgtggactctttaaataccgccatttcaaggatgacgaggagactggttatagaaggatcattgaacggctgaatagtaaaaagggcaagaaccgacttctggatggggagcgcttggcagacagaaaaatcgctgaactcttctcaacaaagacccacatcgga

SEQ ID NO: 10834 - RNA, 1932 nt, synthetic construct
  misc_feature 1..1932: note = derived and/or modified CDS sequence (opt3) from CCHFV(Mamon)__KX013478.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcgttaagtggaaagtggaatacatcaagacagaggccatagtctgcgtggaactgactagccaggagaggcagtgtagtctcatcgaagcagggacccggtttaatttaggacccgtgacaattaccctgtctgagcctcgcaacatccaacagaaacttccacccgagattatcacgttgcaccctaaggtcgaagagggtttctttgatctgatgcatgttcagaaggtgctatccgccagcactgtatgcaaactccagtcgtgcacacacggcataccaggggacctgcaagtgtatcacattggaaatcttctgaagggcgatagagtcaacggtcatttgatccacaaaattgaaccgcatttcaatacctcttggatgtcctgggacgggtgtgatctcgactactattgcaacatgggagactggccctcatgtacttacacaggcgtgacccagcacaatcacgctgcatttgttaacctgttaaatatcgagacggattataccaagacattccattttcacagtaaaagggtgactgcccatggcgacacccctcagctggatctcaaggctcggccaacatacggggccggagaaatcactgtccttgtggaggtagcggacatggagctgcacaccaaaaaggttgaaattagcggtttgaagttcgcatccctagcctgcacaggctgttacgcttgctctagcgggatatcatgtaaagtgcgcatccatgtcgatgagcccgacgaactgaccgtgcacgtcaagagttccgatcctgacgtggttgccgcaagcacttctctcatggctcgaaaactggagtttggaacggattcaacattcaaggccttcagtgcgatgccaaaaaccagcctttgcttttatattgtggaaagagagtactgtaagtcctgctctgaggaagacactcagaagtgtgtagataccaaactggagcaaccccagtcgatcttgatagaacacaagggcacaattatcggtaaacagaacgatacctgcactgccaagacaagctgctggctcgagtccgtcaaatcattcttttatgggctgaagaacatgttaggcagtgtgttcggaaactttttcatcggcattctgctatttctcgcaccgttcgttctgcttgtgttgtttttcatgtttgggtggaagatcctgttctgttttaaatgctgtaggcggacgcgtggactcctgaagtaccgccatcttaaagacgacgaggaaaccggttatagaaggattatagagcggctgaataataagaaaggcaagaaccgattgctcgacggggaacgcctggctgatagaaagatcgccgagttattctctactaaaacacacattgga

SEQ ID NO: 10835 - RNA, 1932 nt, synthetic construct
  misc_feature 1..1932: note = derived and/or modified CDS sequence (opt3) from CCHFV(Min)__KX013481.1__Gc
  source 1..1932: mol_type = other RNA
ttcctggacagcatcgtgaagggcaccaaaaacctccttaattccacatctctggagacttcattgagtattgaagccccctggggagctataaacgtccagagcacgtttaagcctaccgtttccacagcaaatatcgccttatcttggtcgtcagtggagcacagagggaacaaaattctggtaactggtaggagcgaaagtatcatgaagctagaggaacggaccggcgtgtcctgggatctcggggtcgaggacgcgtctgagagcaaactgcttacagtgtccattatggatctgtcacaaatgtacagtccagttttcgaatatttgagcggagaccgccaggtggaggaatggccgaaggctacctgcactggcgattgtcccgagcgatgcggttgtacatcttccacatgcctccataaggagtggcctcactcacgtaattggagatgtaacccaacgtggtgctggggagtcgggactggctgtacctgctgtggcgtggacgtaaaagatctgtttacagaccatatgttcgttaagtggaaagtggaatacatcaagactgaggccatagtctgcgtggaactgaccagccaggagaggcagtgtagtctcatcgaagcagggacacggtttaatttaggacccgtgaccattacgctgtctgagcctcgcaacatccaacagaaacttccacccgagattatcactttgcaccctaaggtcgaagagggtttctttgatctgatgcatgttcagaaggtgctatccgccagcacagtatgcaaactccagtcgtgcacccacggcataccaggggacctgcaagtgtatcacattggaaatcttctgaagggcgatagaatcaacggtcatttgattcacaaaatcgaaccgcatttcaatacttcttggatgtcctgggacgggtgtgatctcgactactattgcaacatgggagactggccctcatgtacatacaccggcgtcacgcagcacaatcacgctgcatttgtgaacctgttaaatatcgagaccgattatacaaagactttccattttcacagtaaaagggttaccgcccatggcgacacacctcagctggatctcaaggctcggccaacttacggggccggagaaattaccgtgcttgtcgaggtggcggacatggagctgcacaccaaaaaggtagaaataagcggtttgaagttcgcatccctagcctgcaccggctgttacgcttgctctagcgggatctcatgtaaagttcgcattcatgtggatgagcccgacgaactgactgtccacgtgaagagttccgatcctgacgtcgtggccgcaagcacgtctctcatggctcgaaaactggagtttggaacagattcaaccttcaaggccttcagtgcgatgccaaaaactagcctttgcttttatatcgttgaaagagagtactgtaagtcctgctctgaggaagacacccagaagtgtgtggatacaaaactggagcaaccccagtcgatattgattgaacacaagggcaccatcatcggtaaacagaacgacacttgcacagccaaggcaagctgctggctcgagtccgtaaaatcattcttttatgggctgaagaacatgttaggcagtgtcttcggaaactttttcattggcatcctgctatttctcgctccgttcgtgctgcttgttttgtttttcatgtttgggtggaagattctgttctgttttaaatgctgtaggcggacgcgtggactcctgaagtaccgccatcttaaagacgatgaggaaaccggttatagaaggataatcgagcggctgaataataagaaaggcaagaaccgattgctcgacggggaacgcctggccgatagaaagattgctgagttattctctactaaaacacacatcgga

SEQ ID NO: 10836 - RNA, 1932 nt, synthetic construct
  misc_feature 1..1932: note = derived and/or modified CDS sequence (opt3) from CCHFV(Nakiwogo)__KX013484.1__Gc
  source 1..1932: mol_type = other RNA
tacctggacagcatcgccaagggcatgaaatccctccttaactctaccaatctggagacatcattgagtattgaagctccctggggagcaataaacgtgcagagcactttcaagcctacggtctccgccgcgaatatcgctttatcttggtcgtcagttgagcacagagggaacaaaattctggtgagcggtaggagtgaatccatcatgaagctagaggaacggaccggcatttcttggagcctcggggtagaggatgcctccgagtcaaaaacactgactgtgagtgtcatggaccttagccaaatgtattctccagtgtttgaatacctgtccggagatcgccaggttgaggaatggccgaaggcaacctgcacaggcgactgtcccgagcgatgcggttgtacctcaagcacttgcttgcataaggagtggcctcacagtcgtaattggagatgtaacccaacatggtgctggggagtggggaccggctgtacgtgctgtggcctcgatgtcagggacctgttcactgattatatgatggtgaaatggaaggtagaatacgttaaaaccgaggccatcatgtgcgtggaactgacatctcaggagcggcagtgttccctcatagaagctgggactcgctttaatttaggacccgtcaccatcacactgagcgagcctagaaacgtgcaacagaggcttccatcggagattgtgaccttgcatcccaagatcgaagagggtttctttgacctgatgcacgtccagaaagttctattctgcaagcattctctccaggcaacgtcctgcactcacggcgtgcctggggatctgcaagtatatcacgtgggaaatcttctgaagggcgacaaagtcaacggtcattcaattcacaagatcgaaagtcattttaatacaagctggatgtcctgggatgggtgtgacttggattacttctgcaacatgggagactggccatcttgtacctatactggcgtgacacagcacaatcgggccgcttttgttaacatgctcaatatagagaccgactacacgaaaaccttccactttcatagcaagcgcgtgacagcccacggcgatactccgcagctggacttaaaagcgcgacccacctacggggcaggagaagtcacagtgctggtagaggttgccgatctcgagcttcatactaagaaaattgaagtgtcaggtctgaagttcgctagtttgacctgctccggctgttatgcctgcagctctgggatctcatgtaaggtcaggattcacgtgaacgagcctgacgaatttacagtccatgtgaaaagtaacgatccagacgttgtggcagctggaagctccctaatggccagaaagatcgagctgggcgcggattctaccttcaaagccttctcgagcatgcccaaaaattccctctgcttttacatcgtagaacgggactattgttcaagttgcactgatgacgatacgcagaagtgtgtcaacacaaagctggagcaccctcaatctattcttatagagcacaagggtaccatcattgggaaacagaatgacacttgcccaaccaagacaagctgctggctggaatccgtgaaatcattcttttacggcttgaagaacatgctcggaggcatcttcgggaatgtttttctgggaatattcttatttctggcacccttcgctctactcattctgtttttctttttcggttggcgtcttttgttttgtctgaaatgctgtcgcagaaccaggggcctcctgaagtataagcagcttaaagacgaggaagaggccgggtacaagaaaatcatcgagcggctgaacgataagaaaggaaagagccgattgttcgacggcgaacgcctcgctgatagaaagattgccgagctgttctctactaaaacacatatcggt

SEQ ID NO: 10837 - RNA, 1932 nt, synthetic construct
  misc_feature 1..1932: note = derived and/or modified CDS sequence (opt3) from CCHFV(Saf)__KX013487.1__Gc
  source 1..1932: mol_type = other RNA
ttcagcgactccatcgtgaagggcatgaaaaacctgctcaattctacctcacttgagacaagtctgagcattgaagccccctggggagctataaacgtccagtccacttttaagcctacggtttctaccgcaaatatcgccttgtcgtggtcaagcgtggagcacagagggaacaaaattttagtaacaggtaggagtgaatccatcatgaagctggaggaacggactggcgtgtcttgggatctaggggtcgaggacgcgagcgagtccaaactcctgaccgtgtcaattatggatcttagtcaaatgtacagcccagttttcgaatatctgtctggagaccgccaggtggaggaatggccgaaggctacatgcaccggcgattgtcccgagcgatgcggttgtacttcctcaacatgcttgcataaggagtggcctcacagccgtaattggagatgtaacccaacctggtgctggggagtcgggacgggctgtacttgctgtggcgtggacgtaaaagatctctttaccgaccatatgttcgttaagtggaaagtggaatacatcaagacagaggccatagtctgcgtggaactgaccagtcaggagaggcagtgttctctgatcgaagcagggactcggtttaatctcggacccgtgacaattaccttatccgagcctcgcaacatccaacagaaactgccacccgagattatcacgcttcaccctaaggtcgaagagggtttctttgatttgatgcatgttcagaaggtgctgagcgcctcgactgtatgcaaactacagtcttgcacacacggcataccaggggacctccaagtgtatcacattggaaatctgcttaagggcgatagagtcaacggtcatctgatccacaaaattgaaccgcatttcaatacctcctggatgtcatgggacgggtgtgatttggactactattgcaacatgggagactggcccagttgtacttacacaggcgtgacccagcacaatcacgctgcatttgttaacctcctgaatatcgagacggattatatgaagaccttccattttcacagcaaaagggtgacagcccatggcgacactcctcagttagatctgaaggctcggccaacctacggggccggagaaatcacagtcctcgtggaggtagcggacatggagcttcacactaaaaaggttgaaatttccggtctgaagttcgtgtctttggcatgcaccggctgttacgcctgcagctcagggataagttgtaaagtccgcatccatgtggatgagcccgacgaactaacagtccacgtgaagtccagcgatcctgacgttgtggctgcctctacctcactgatggcacgaaaactcgagtttggaactgatagtacgttcaaggctttcagcgccatgccaaaaacatccctgtgcttttatattgtagaaagagagtactgtaagtcttgctcggaggaagacacccagaagtgtgtcgatactaaacttgagcaaccccagagcatcctgatagaacacaagggcaccattatcggtaaacagaacgacacatgcaccgcgaaggcctcctgctggttggagtcagtgaaaagtttcttttatgggctcaagaacatgctgggctctgttttcggaaactttttcatcggcattttactgtttctagcaccgttcgtgctcctggtcttgtttttcatgtttgggtggaagatccttttctgttttaaatgctgtaggcggactcgtggactgctcaagtaccgccatctgaaagacgatgaggaaacaggttatagaaggattatagagcggcttaataataagaaaggcaagaaccgactgttggacggggaacgcctcgctgatagaaagatcgccgagctgttcagcacgaaaacccacattgga

SEQ ID NO: 10838 - RNA, 1932 nt, synthetic construct
  misc_feature 1..1932: note = derived and/or modified CDS sequence (opt3) from CCHFV(Ast199)__KX056051.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcatcaagtggaaagttgaatacataaagacagaggccatcgtgtgcgtcgaactgactagccaggagaggcagtgtagtctcattgaagcagggacccggtttaatttaggacccgtgacaatcaccctgtctgagcctcgcaacattcaacagaaacttccacccgagatcataacgttgcaccctaagattgaagagggtttctttgatctgatgcatgtgcagaaggtcctatccgccagcactgtttgcaaactccagtcgtgcacacacggcatcccaggggacctgcaaatttatcacatcggaaatcttctgaagggcgatagattgaacggtcatctcatccacaaaattgaaccgcatttcaatacctcttggatgtcctgggacgggtgtgatctggactactattgcaacatgggagactggccctcatgtacttacacaggcgtgacccagcacaatcacgctgcatttgtaaacttactgaatatagagacggattataccaagacattccattttcacagtaaaagggtgactgcccatggcgacacccctcagctcgatcttaaggctcggccaacatacggggccggagaaatcactgtcctggtggaggttgcggacatggagttgcacaccaaaaaggtggaagtcagcggtctaaagttcgcatccctggcctgcacaggctgttacgcttgctctagcgggatttcatgtaaagtgcgcatccatgtagatgagcccgacgaactcaccgttcacgtgaagagttccgatcctgacgtcgtggccgcaagcacttctctgatggctcgaaaacttgagtttggaacggattcaacattcaaggccttcagtgcgatgccaaaaaccagcctgtgcttttatatagtcgaaagagagtactgtaagtcctgctctgaggacgatactaagaaatgtgtggacaccaagttggaacagccccaatcgattctcatcgagcacaaaggcacaatcattggtaagcagaacgatacctgcactgccaaagcaagctgctggctggaatccgttaagtcattcttttatgggttaaagaacatgctgggcagtgtgttcggaaatttctttgtaggcatcctactctttctggctccgttcgtccttttggtgctgtttttcatttttgggtggaaaatactcttctgttttaagtgctgtaggcggacacgtggactgttcaaataccgccatcttaaggacgacgaggagacgggttatagaaaaatcattgaaaggctgaactctaagaagggcaaaaatcggttgctcgatggggagcgactggccgaccgcaagatcgctgaattattcagcaccaaaactcacatcgga

SEQ ID NO: 10839 - RNA, 1932 nt, synthetic construct
  misc_feature 1..1932: note = derived and/or modified CDS sequence (opt3) from CCHFV(Ast149)__KX056054.1__Gc
  source 1..1932: mol_type = other RNA
ttcctggacagcatcgtgaagggcatgaaaaacctccttaattccacctctctggagacatcattgagtattgaagccccctggggagctataaacgtccagagcacttttaagcctacggtttccaccgcaaatatcgccttatcttggtcgtcagtggagcacagagggaacaaaattctggtaacaggtaggagcgaaagtatcatgaagctagaggaacggactggcgtgtcctgggatctcggggtcgaggacgcgtctgagagcaaactgcttaccgtgtccattatggatctgtcacaaatgtacagtccagttttcgaatatttgagcggagaccgccaggtggaggaatggccgaaggctacatgcaccggcgattgtcccgagcgatgcggttgtacttcttccacatgcctccataaggagtggcctcactcacgtaattggagatgtaacccaacctggtgctggggagtcgggacgggctgtacttgctgtggcgtggacgtaaaagatctgtttaccgaccatatgttcatcaagtggaaagttgaatacataaagacagaggccatcgtgtgcgtcgaactgactagccaggagaggcagtgtagtctcattgaagcagggacccggtttaatttaggacccgtgacaatcaccctgtctgagcctcgcaacattcaacagaaacttccacccgagatcataacgttgcaccctaagattgaagagggtttctttgatctgatgcatgtgcagaaggtcctatccgccagcactgtttgcaaactccagtcgtgcacacacggcatcccaggggacctgcaaatttatcacatcggaaatcttctgaagggcgatagattgaacggtcatctcatccacaaaattgaaccgcatttcaatacctcttggatgtcctgggacgggtgtgatctggactactattgcaacatgggagactggccctcatgtacttacacaggcgtgacccagcacaatcacgctgcatttgtaaacttactgaatatagagacggattataccaagacattccattttcacagtaaaagggtgactgcccatggcgacacccctcagctcgatcttaaggctcggccaacatacggggccggagaaatcactgtcctggtggaggttgcggacatggagttgcacaccaaaaaggtggaagtcagcggtctaaagttcgcatccctggcctgcacaggctgttacgcttgctctagcgggatttcatgtaaagtgcgcatccatgtagatgagcccgacgaactcaccgttcacgtgaagagttccgatcctgacgtcgtggccgcaagcacttctctgatggctcgaaaacttgagtttggaacggattcaacattcaaggccttcagtgcgatgccaaaaaccagcctgtgcttttatatagtcgaaagagagtactgtaagtcctgctctgaggacgatactaagaaatgtgtggacaccaagttggaacagccccaatcgattctcatcgagcacaaaggcacaatcattggtaagcagaacgatacctgcactgccaaagcaagctgctggctggaatccgttaagtcattcttttatgggttaaagaacatgctgggcagtgtgttcggaaatttctttgtaggcatcctactctttctggctccgttcgtccttttggccctgtttttcatttttgggtggaaaatactcttctgttttaagtgctgtaggcggacacgtggactgttcaaataccgccatcttaaggacgacgaggagacgggttatagaaaaatcattgaaaggctgaactctaagaagggcaaaaatcggttgctcgatggggagcgactggctgaccgcaagatcgccgaattattcagcaccaaaactcacatcgga

SEQ ID NO: 10840 - RNA, 1932 nt, synthetic construct
  misc_feature 1..1932: note = derived and/or modified CDS sequence (opt3) from CCHFV(Ast137)__KX056057.1__Gc
  source 1..1932: mol_type = other RNA
ttcctggacagcatcgtgaagggcaccaaaaacctccttaattccacatctctggagacttcattgagtattgaagccccctggggagctataaacgtccagagcacgtttaagcctaccgtttccacagcaaatatcgccttatcttggtcgtcagtggagcacagagggaacaaaattctggtaactggtaggagcgaaagtatcatgaagctagaggaacggaccggcgtgtcctgggatctcggggtcgaggacgcgtctgagagcaaactgcttacagtgtccattatggatctgtcacaaatgtacagtccagttttcgaatatttgagcggagaccgccaggtggaggaatggccgaaggctacctgcactggcgattgtcccgagcgatgcggttgtacatcttccacatgcctccataaggagtggcctcactcacgtaattggagatgtaacccaacgtggtgctggggagtcgggactggctgtacctgctgtggcgtggacgtaaaagatctgtttacagaccatatgttcatcaagtggaaagttgaatacataaagactgaggccatcgtgtgcgtcgaactgaccagccaggagaggcagtgtagtctcattgaagcagggacacggtttaatttaggacccgtgaccatcacgctgtctgagcctcgcaacattcaacagaaacttccacccgagatcataactttgcaccctaagattgaagagggtttctttgatctgatgcatgtgcagaaggtcctatccgccagcacagtttgcaaactccagtcgtgcacccacggcatcccaggggacctgcaaatttatcacatcggaaatcttctgaagggcgatagattgaacggtcatctcatccacaaaattgaaccgcatttcaatacttcttggatgtcctgggacgggtgtgatctggactactattgcaacatgggagactggccctcatgtacatacaccggcgtgacgcagcacaatcacgctgcatttgtaaacttactgaatatagagaccgattatacaaagactttccattttcacagtaaaagggtgaccgcccatggcgacacacctcagctcgatcttaaggctcggccaacttacggggccggagaaatcaccgtcctggtggaggttgcggacatggagttgcacaccaaaaaggtggaagtcagcggtctaaagttcgcatccctggcctgcaccggctgttacgcttgctctagcgggatttcatgtaaagtgcgcatccatgtagatgagcccgacgaactcactgttcacgtgaagagttccgatcctgacgtcgtggccgcaagcacgtctctgatggctcgaaaacttgagtttggaacagattcaaccttcaaggccttcagtgcgatgccaaaaactagcctgtgcttttatatagtcgaaagagagtactgtaagtcctgctctgaggacgataccaagaaatgtgtggacacaaagttggaacagccccaatcgattctcatcgagcacaaaggcaccatcattggtaagcagaacgacacttgcacagccaaagcaagctgctggctggaatccgttaagtcattcttttatgggttaaagaacatgctgggcagtgtgttcggaaatttctttgtaggcatcctactctttctggctccgttcgtccttttggtgctgtttttcatttttgggtggaaaatactcttctgttttaagtgctgtaggcggacgcgtggactgttcaaataccgccatcttaaggatgacgaggagaccggttatagaaaaatcattgaaaggctgaactctaagaagggcaaaaatcggttgctcgatggggagcgactggccgaccgcaagatcgctgaattattcagcactaaaacacacatcgga

SEQ ID NO: 10841 - RNA, 1932 nt, synthetic construct
  misc_feature 1..1932: note = derived and/or modified CDS sequence (opt3) from CCHFV(Ast133)__KX056060.1__Gc
  source 1..1932: mol_type = other RNA
ttcagcgactccatcgtgaagggcatgaaaaacctgctcaattctacctcacttgagacaagtctgagcattgaagccccctggggagctataaacgtccagtccacttttaagcctacggtttctaccgcaaatatcgccttgtcgtggtcaagcgtggagcacagaggaaacaaaattttagtaacaggtaggagtgaatccatcatgaagctggaggaacggactggcgtgtcttgggatctaggggtcgaggacgcgagcgagtccaaactcctgaccgtgtcaattatggatcttagtcaaatgtacagcccagttttcgaatatctgtctggagaccgccaggtggaggaatggccgaaggctacatgcaccggcgattgtcccgagcgatgcggttgtacttcctcaacatgcttgcataaggagtggcctcacagccgtaattggagatgtaacccaacctggtgctggggagtcgggacgggctgtacttgctgtggcgtggacgtaaaagatctctttaccgaccatatgttcatcaagtggaaagttgaatacataaagacagaggccatcgtgtgcgtcgaactgaccagtcaggagaggcagtgttctctgattgaagcagggactcggtttaatctcggacccgtgacaatcaccttatccgagcctcgcaacattcaacagaaactgccacccgagatcataacgcttcaccctaagattgaagagggtttctttgatttgatgcatgtgcagaaggtcctgagcgcctcgactgtttgcaaactacagtcttgcacacacggcatcccaggggacctccaaatttatcacatcggaaatctgcttaagggcgatagagtgaacggtcatctgatccacaaaattgaaccgcatttcaatacctcctggatgtcatgggacgggtgtgatttggactactattgcaacatgggagactggcccagttgtacttacacaggcgtaacccagcacaatcacgctgcatttgtgaacctcctgaatatagagacggattataccaagacattccattttcacagcaaaagggtcactgcccatggcgacacccctcagttagatctgaaggctcggccaacatacggggccggagaaatcactgtgctcgttgaggtggcggacatggagcttcacaccaaaaaggtcgaaatttccggtctgaagttcgcatctttgacatgcaccggctgttacgcctgcagctcagggatcagttgtaaagtgcgcatacatgtagatgagcccgacgaactaactgttcacgtgaagtccagcgatcctgacgtcgtggctgcctctacgtcactgatggcacgaaaactcgagtttggaacagatagtaccttcaaggctttcagcgccatgccaaaaacttccctgtgcttttatattgtcgaaagagagtactgtaagtcttgctcggaggacgataccaagaaatgtgtggacacaaaacttgaacagccccaaagcatcctgatcgagcacaagggcaccattatcggtaagcagaacgacacttgcacagcgaaagcctcctgctggttggaatcagttaagagtttcttttatgggctcaagaacatgctgggctctgtgttcgggagctttttcgtaggcattttactgtttctagcaccgttcgtcctcctggtgctgtttttcatgtttgggtggaaaatattgttctgttttaagtgctgtaggcggacgcgtggactgttcaaataccgccatctcaaggatgacgaggagaccggttatagaaggatcattgaacggcttaattccaaaaagggcaagaaccgacttctggatggggagcgcttggctgacagaaaaatcgccgaactcttctcaagcaagactcacatcgga

SEQ ID NO: 10842 - RNA, 1932 nt, synthetic construct
  misc_feature 1..1932: note = derived and/or modified CDS sequence (opt3) from CCHFV(SK/2015/human)__KX458183.1__Gc
  source 1..1932: mol_type = other RNA
ttcctggacagcatcgtgagaggcatgaagaacctccttaattccacctctctggagacatcattgagtattgaagccccctggggagctataaacgtccagagcacttacaaacctacggtttccaccgcaaatatcgccttatcttggtcgtcagtggagcacagggggaacaagattctggtaagcggtcggagtgaatccatcatgaaactagaggaacgcacaggcgtgtcttgggatctcggggtcgaggacgcgagcgagtccaagctgcttactgtgtcagttatggatctgagtcaaatgtatagcccagtgtttgaatacttgtctggagaccgacaggtcgaggaatggccgaaagctacctgcacaggcgattgtcccgagcgttgcggttgtaccacttccacatgcctccataaggagtggcctcactcaagaaattggaggtgtaacccaacctggtgctggggagtggggacgggctgtacttgctgtggcctggacgtaaaggatctgttcaccgactatatgtttgttaaatggaaggtggaatacattaaaacagaggccatcgtctgcgtggaactcactagccaggggcggcagtgtagtttaatagaggcaggaacccgcttcaatctgggttctgtgacaatcaccctttccgaacccagaaacattcaacataagttgcctccagagatcattacgctgcaccccaggatcgaggaaggctttttcgatctaatgcatgtccagaaagttctcagcgcctcgactgtgtgcaagctgcagtcttgcacacacggggtacctggagaccttcaggtgtatcacataggcaatctgttgaagggtgataaagtcaacgggcatctcattcacaagatcgagccacattttaatacctcctggatgtcatgggacggatgtgatctggactactattgcaacatgggcgactggccgagttgtacttacacaggcgtgacccaacacaatcacgctagcttcgttaacttactgaatattgaaacggattacaccaaaaactttcatttccactccaagcgggtgacagcacatggggacactccccagctcgatcttaaagcccgccctacctatggagctggtgagatcacagtcctggtggaagtagccgacatggagttgcacactaagaaaatcgagatttctggcctaaagtttgcgagcctgacctgcacagggtgttacgcatgctcaagtggaatatcctgtaaggttcgaatccatgtggatgaaccagacgagctcaccgtccacgtgaaaagcgatgaccccgatgtcgtggccgcttcttcaagtctgatggccagaaaacttgaatttggcactgacagcacgtttaaagcattctccgctatgcctaagacatctctgtgcttctatattgttgagagggaatactgtaaatcgtgcagcaaggaggatacccagaagtgtgtgaacactaaattggagcagccacaatccatcctcatagaacaccggggtaccattatcgggaagcagaataacacatgcatcgccaaagcgtcatgctggctggagagtgtaaagtctttcttctatggcttaaagaatatgctgagcggaatttttggcaacctattcctcgggatctttctgttccttgccccctttattttgctgatactcttctttatgttcggatggcgtatcctgttttgtttcaagtgctgtcgcagaaccaggggtctttttaagtaccggcatctgaaagacgacgaagagactggctatcgacgcattatcgagagattgaataacaagaaagggaagaataaactcctggatggagaaaggttagcagaccggcgcatcgctgagctgttctccacaaagacgcacattggc

SEQ ID NO: 10843 - RNA, 1932 nt, synthetic construct
  misc_feature 1..1932: note = derived and/or modified CDS sequence (opt3) from CCHFV(YL16070)__KY354081.1__Gc
  source 1..1932: mol_type = other RNA
ttcctggacagcatcgccaagggcatgaaatccctccttaactctacctcactggagacaagtttgagcattgaagctccctggggagcaataaatgtgcagtccacttttaagcctacggtctctgccgcgaacatcgctttatcgtggtcaagcgttgagcacagagggaataaaattctggtgagtggtaggtccgaatctatcatgaagctagaggaacggaccggcgtaagctggaacctcggggtggaggatgcctccgagtcaaaaacactgactgtcagtgtgatggaccttagccaaatgtactctccagttttcgaatatctgtccggagatcgccaggtggaggaatggccgaaggcaacctgcacaggcgactgtcccgagcgatgcggttgtacctcaagcacttgcttgcataaggagtggcctcacagtcgtaattggagatgtaacccaacatggtgctggggagtcgggaccggctgtacgtgctgtggcctcgatgtgaaagactttttcactgattacatgctggtaaagtggaaagttgaatatattaagaccgaggccatcgtgtgcgtcgaactgacatctcaggagaggcagtgttccctcatagaagctgggactcggtttaatttaggacccgtgaccatcacactgagcgagcctcgcaacgtgcaacagagacttccacccgagattgtcaccttgcatcctaaaatcgaagagggtttctttgacctgatgcacgttcagaagattctatcggcatctacggtgtgcaagctccagtcctgcactcatggcgtaccaggggatttccaagtgtaccacgtcggaaatctgcttaggggcgacaaagtgaacggtcactcaatccataagatagaaccgcactttaatacaagttggatgagctgggatgggtgtgacctggattatttctgcaacatgggagactggccctcctgtacctacactggcgttacacagcataatcgggccgcttttattaacatgttgaatatcgagaccgactatacgaaaaccttccactttcactctaagcgcgtgacagcccatggcgatactcctcagctcgacctgaaagcgcgaccagcatacggggccggagaagtcaccgtgttagtagaggttgctgatctggagctccacacaaagaaacttgaagtgagcggtctgaagattgcctcattgacttgcagtggctgttacgcatgctccagcgggatctcttgtaaggtcagaatccatgtgaacgagcccgacgaatttaccgtccacgtgaggtcaagtgatcctgacgttgtggctgccggaagctccctaatggcgcggaaaattgagttcggcgccgattctacatttaaggcattctcgagcatgccaaaagactccctgtgcttttatatagtagaaaaggattactgttcaagttgcaccgacgatgacactcagaaatgtgtcaacacgaagctcgaccatccccaatctatcctgattgagcacaagggtacaatcatagggaaacagaatgatacctgcagcactaagacctcctgctggcttaaatcattcaagggctttttctatggactgaaaaacatgttgagcggcatttttgggaatgtgttcctcggaatcctgttatttctggctccgttcgttctactcatctttttctttttcttcggttggcgtctgcttttctgtttgaagtgctgtaagaaaacaaagggcctgctcaaatacaagcacctgaaagacaaggaggaagccgggtataagaaaattatcgagcgccttaacggaaagaaaggcaagtctcagctgttcgatggtgaaagattggctaataggaaaattgccgagctcttttccaccaagatacatatcggg

SEQ ID NO: 10844 - RNA, 1932 nt, synthetic construct
  misc_feature 1..1932: note = derived and/or modified CDS sequence (opt3) from CCHFV(Oman_812956)__KY362518.1__Gc
  source 1..1932: mol_type = other RNA
ttctttgacagcatcgccaagggcatgaaaaacctgctcaattccacctctcttgagacatcactgagtattgaagctccctggggtgcaataaacgtgcagagcactttcaagcctacggtctccaccgccaatatcgcgttgtcttggtcgtcagttgagcacagaggaaacaaaattttagtgagcggtaggagtgaatccatcatgaagctggaggaacggacaggcatttcttgggatctaggggtagaggacgctagcgagtccaaactcctgactgtgtcagtcatggatcttagtcaaatgtacagcccagtgtttgaatatctgtctggagaccgccaggttgaggaatggccgaaggctacctgcacaggcgattgtcccgagcgatgcggttgtacctcctcaacttgcttgcataaggagtggcctcacagccgtaattggagatgtaacccaacatggtgctggggagtggggaccggctgtacgtgctgtggcctcgacgtcaaagatctgttcactgactacatgtttgtgaagtggaaagtagaatatatcaagaccgaggcaatagtttgcgtggaactgacaagtcaggagaggcagtgttctctcatcgaagccgggactcggttcaatttaggacccgtcaccattacactgtccgagcctcgcaacatccaacagaaacttccacccgagattgtgaccttgcatcctagaatcgaagaggggtttttcgatctgatgcacgtgcagaaggtcctaagcgcttcgacggtttgcaagctccagtcttgcactcatggcgtgccaggggacctgcaagtataccacataggaaatcttctgaaaggcgataaggtgaacggtcacttgattcataaagtcgaaccgcactttaatacatcctggatgtcatgggacgggtgtgatctcgactattactgcaacatgggagactggcccagttgtacctatactggcgtgacacagcataatcacgcagccttcgttaacctgttaaatatcgagaccgattacacgaagaactttcacttccatagcaaaagggtgaccgctcacggcgacacacctcagctggatctcaaggcccggccaaactacggggcgggagaaattactgtccttgtggaggtagcagacatggagctgcataccaaaaagatcgaaatctccggtttgaagtttgcctctctaacatgcactggctgttatgcttgcagctcagggattagttgtaaagttcgcatacacgtggatgagcccgacgaactgaccgtccatgtgaagtccgaggatcctgacatcgtcgccgcatctagctcactcatggctcgaaaactggaatttggaacagatagtaccttcaaggcctttagcgcgatgccaaaaacttccctttgcttctacattgtggagagagagtattgtaagtcttgctcgaaggaagacacgcagaaatgtgttaatgccaagctggagaggccccaaagcatcttgatagaacacaaaggcacaattatcggtaagcagaacgatacctgcactgcaaaagcctcctgctggctcgagtcagtgaagagtttcttctacgggctgaagaatatgttatctggcatctttggaaacgtattcattggcatctttctgttcctagccccgtttattctcctgatacttttctttatgttcgggtggcggatcttgttttgtttcaaatgctgtcgtcgcaccagaggactgttcaagtataggcacctcaaagacgacgaggaaacaggttaccggaagattatcgagcgactgaataacaaaaagggcaagaataaacttctggatggggaacgcttggctgacagaaagatcgccgagctctttagcaccaaaactcatattgga

SEQ ID NO: 10845 - RNA, 1932 nt, synthetic construct
  misc_feature 1..1932: note = derived and/or modified CDS sequence (opt3) from CCHFV(UCCR4405)__KY484029.1__Gc
  source 1..1932: mol_type = other RNA
ttcctggacagcaccgtgaagggcatgaaaaacctccttaattccacatctctggagacttcattgagtatcgaagccccctggggagctattaacgtccagagcacgtttaagcctaccgtttccacagcaaatatagccttatcttggtcgtcagtggagcacagagggaacaaaatcctggtaactggtaggagcgaaagtattatgaagctagaggaacggaccggcgtgtcctgggatctcggggtcgaggacgcgtctgagagcaaactgcttacagtgtccatcatggatctgtcacaaatgtacagtccagttttcgaatatttgagcggagaccgccaggtggaggaatggccgaaggctacctgcactggcgattgtcccgagcgatgcggttgtacatcttccacatgcctccataaggagtggcctcactcacgtaattggagatgtaacccaacgtggtgctggggagtcgggactggctgtacctgctgtggcgtggacgtaaaagatctgtttacagaccatatgttcgttaagtggaaagtggaatacattaagactgaggccatcgtctgcgtggaactgaccagccaggagaggcagtgtagtctcatagaagcagggacacggtttaatttaggacccgtgaccatcacgctgtctgagcctcgcaacattcaacagaaacttccacccgagatcattactttgcaccctaagatcgaagagggtttctttgatctgatgcatgtccagaaggttctatccgccagcacagtgtgcaaactccagtcgtgcacccacggcataccaggggacctgcaaatttatcacatcggaaatcttctgaagggcgatagagtaaacggtcatttgattcacaaaatcgaaccgcatttcaatacttcttggatgtcctgggacgggtgtgatctcgactactattgcaacatgggaaattggccctcatgtacatacaccggcgtgacgcagcacaaccacgctgcatttgtcaatctgttaaacatcgagaccgactatacaaagactttccattttcacagtaaaagggtgaccgcccatggcgatacacctcagctggacctcaaggctcggccaacttacggggccggagaaattaccgttcttgtggaggtcgcggatatggagctgcacaccaaaaaggtggaaataagcggtttgaagttcgcatccctagtatgcaccggctgttacgcctgctctagcgggatctcatgtaaagttcgcattcatgtggacgagcccgatgaactgactgtccacgtgaagagttccgaccctgatgtcgtggctgccagcacgtctctcatggcacgaaaactggagtttggaacagactcaatcttcaaggctttcagtgccatgccaaaaaccagcctttgcttttatatagttgaaagagagtactgtaagtcctgctctgaggatgacactaagaaatgtgtggataccaagctggaacagccccaatcgattttgatcgagcacaaaggcacaatcattggtaagcagaacgatacctgcactgcgaaagccagctgctggctcgaatccgtaaagtcattcttttatgggctgaagaatatgttaggcagtgtcttcggaaactttttcgtgggcatcctgctatttctcgcaccgttcgttctgcttgtgttgtttttcatgtttgggtggaaaattctgttctgttttaagtgctgtaggcggacacgtggactcttcaaataccgccatctgaaggacgacgaggagacgggttatagaaggataatcgaacggcttaattctaaaaagggcaagaaccgactgttggacggggagcgcctcgctgatagaaaaattgccgaactgttcagcaccaagactcacatcgga

SEQ ID NO: 10846 - RNA, 1932 nt, synthetic construct
  misc_feature 1..1932: note = derived and/or modified CDS sequence (opt3) from CCHFV(UCCR4401)__KY484035.1__Gc
  source 1..1932: mol_type = other RNA
ttcctggacagcaccgccaagggcatgaaaaacctccttaattccacatctctggagacttcattgagtatcgaagctccctggggtgcaattaacgtgcagagcacgtacaagcctaccgtctccacagccaatatagcgttatcttggtcgtcagttgagcacagaggaaacaaaatcctggtgagcggtaggagtgaatccattatgaagctagaggaacggactggcatctcttgggatctcggggtagaggacgctagcgagtccaaactgcttaccgtgtcagtcatggatctgagtcagatgtatagcccagtgtttgaatacttgtctggagaccgccaggttgaggaatggccgaaggccacatgcaccggcgattgtcccgagcgatgcggttgtacttcctcaacatgcctccataaggagtggcctcacagccgtaattggagatgtaacccaacctggtgctggggagtggggacgggctgtacttgctgtggcctggacgtcaaagatctgttcaccgactatatgtttgtgaagtggaaagtagaatacattaagacagaggcaatcgtttgcgtggaactcactagccaggagaggcagtgttctttaatagaagccgggacccggttcaatctgggacccgtcacaatcaccctttccgagcctcgcaacattcaacagaaattgccacccgagatcattacgctgcatcctagaatcgaagaggggtttttcgatctaatgcacgtgcagaaggtgctcagcgcttcgactgtctgcaagctgcagtcttgcacacatggcgttccaggggaccttcaagtgtatcacataggaaatctgttgaaaggcgataaggtaaacggtcacctcattcataaaatcgaaccgcactttaatacctcctggatgtcatgggacgggtgtgatctggactactattgcaacatgggagactggcccagttgtacttacacaggcgtgacccagcataatcacgcaagtttcgtcaacttactgaatattgagacggattacaccaagaactttcacttccattccaaaagggtgacagcccacggcgacactcctcagctcgatcttaaggctcggccaacctatggggccggagaaatcacagttctggtggaggtcgcggacatggagttgcatactaaaaagatcgaaatttctggtctaaagtttgcaagcctggcctgcaccggctgttacgcttgctcaagtgggatatcctgtaaagtgcgcatccacgtagatgagcccgacgaactcacagttcatgtcaagagcgatgaccctgatgtggtggccgcatcttcaagtctgatggctcgaaaacttgagttcggaaccgacagcacttttaaggccttctccgcgatgccaaaaacgtctctgtgcttctatattgtcgaaagagagcactgtaagtcgtgcagcgaggaagatacaaagaaatgtgtgaacaccaagttggagcagccccaatccatcctcatagaacacaaaggcactattatcggtaagcaaaattcaacctgcacagccaaagcaagttgctggctggagtctgttaagagctttttctacgggttaaagaacatgctgtccggcatctttggaaatgtgttcatgggcatttttctattcctcgctccgtttatcctgcttattttgttctttatgttcgggtggaggatactgttttgtttcaaatgctgtcggcgtacccgcggactctttaagtatagacatctgaaagacgacgaggaaactggttacaggcggatcattgagaaacttaacaataagaagggcaagaacaaactgttggatggggaacgactcgccgaccgcagaatcgctgagctgttctcaacaaagacgcacatcgga

SEQ ID NO: 10847 - RNA, 1932 nt, synthetic construct
  misc_feature 1..1932: note = derived and/or modified CDS sequence (opt3) from CCHFV(UCCR4448)__KY484042.1__Gc
  source 1..1932: mol_type = other RNA
ttcctggacagcatcgtgaagggcatgaaaaacctccttaattccacctctctggagacatcattgagtattgaagccccctggggtgctataaacgtccagagcacttacaagcctacggtttccaccgcaaatatcgccttatcttggtcgtcagtggagcacagaggaaacaaaattctggtaagcggtaggagtgaatccatcatgaagctagaggaaaagacaggcatttcttgggatctcggggtggaggacgcgagcgagtccaagctgcttactgtctcagtgatggatctgagtcagatgtatagcccagtttttgaatacttgtctggagaccgccaggtggaggaatggccgaaggctacctgcacaggcgattgtcccgagcggtgcggttgtacctcctcaacttgcctccataaagagtggcctcacagccgaaattggcgttgtaacccaacatggtgctggggagtcgggaccggctgtacgtgctgtggcctggacgtgaaggatctgttcactgactatatgtttgtaaaatggaaggttgaatacatcaaaaccgaggccatagtgtgcgtcgaactcacaagtcaggagagacagtgttctttaatcgaagcagggactaggttcaatctgggacccgtgaccattacactttccgagcctcggaacatccaacagaagttgccacccgagattatcaccctgcatcctcgcatagaagaggggtttttcgatctaatgcacgtgcagaaggtcctcagcgcctcgacggtttgcaaactgcagtcttgcactcatggcgtgccaggggaccttcaagtatatcacattggaaatctgttgaagggcgataaagtgaacggtcacctcatccataagattgaaccgcactttaatacatcctggatgtcatgggacgggtgtgatctggactactattgcaacatgggagactggcccagttgtacctacactggcgtcacacagcataatcacgctagcttcgtgaacttactgaatatcgagaccgattacacgaaaaactttcacttccattccaagagagttaccgcacacggcgacacacctcagctcgatcttaaagccaggccaacttatggggctggagaaatcaccgtgctggtcgaggtggccgacatggagttgcatacaaagaagattgaaatatctggtctaaaatttgcgagcctgacttgcaccggctgttacgcatgctcaagtgggatctcctgtaaggtacggattcacgttgatgagcccgacgaactcacagtgcatgtcaaaagcgatgaccctgatgtggtcgccgcttcttcaagtctgatggcccgcaaacttgagttcggaaccgacagcacttttaaagcattctccgctatgccaaagacgtctctgtgcttctatatcgtggaacgagagcactgtaagtcgtgcagcgaggaagataccaaaaagtgtgttaacacaaaattggagcagccccaatccatactcattgaacacaagggcactatcatcggtaaacaaaattcaacctgcacagccaaggcgagttgctggctggagtctgtaaagagctttttctacgggctgaaaaacatgttatccggcatttttggaaatgtgttcatcggcatttttctattcctcgccccgtttatactgcttatcttgttctttatgttcgggtggaagattctgttttgtttcaaatgctgtagaaggacccggggactctttaagtatcgtcatctgaaagacgacgaggaaactggttaccgcagaatcatcgagaggcttaacaataagaagggcaaaaacaagctgttggatggggaaattctcgcagaccggcgaatagctgagctgttctcaacaaaaacgcacatcgga

SEQ ID NO: 10848 - RNA, 1932 nt, synthetic construct
  misc_feature 1..1932: note = derived and/or modified CDS sequence (opt3) from CCHFV(U2-2-002/U-6415)__AY900144.1__Gc
  source 1..1932: mol_type = other RNA
ttccaggacagcatcgtgaagggcatgaaaaacctgctcaattccacctctcttgagacatcactgagtattgaagccccctggggtgctataaacgtccaaagcacttacaagcctacggtttccgcagccaatatcgcgttgtcttggtcgtcagtggagcacagaggaaacaaaattttagtaagcggtaggagtgaatccatcatgaagctggaggaacggaccggcatttcttgggatctaggggtggaggacgctagcgagtccaaactcctgacagtctcagtgatggatcttagtcagatgtatagcccagtttttgaatacctgtctggagaccgccaggtggaggaatggccgaaggccacttgcaccggcgattgtcccgagcgatgcggttgtacatcctcaacctgcttgcataaggagtggcctcacagccgtaattggagatgtaacccaacttggtgctggggagtcgggacaggctgtacctgctgtggcctcgacgtgaaagatctgttcacggactatatgtttgtaaagtggaaagttgaatacatcaagactgaggcaatagtgtgcgtcgaactgaccagtcaggagaggcaatgttctctcatcgaagccgggacacggttcaatttaggacccgtgactattaccctgtccgagcctcgcaacatccagcagaaacttccacccgagattatcacattgcatcctagaatagaagaggggtttttcgatctgatgcacgtgcagaaggtcctaagcgcttcgaccgtttgcaagctccaatcttgcacgcatggcgtgccaggggacctgcaggtatatcacattggaaatcttctgaaaggcgataaggtgaacggtcacttgatccataaaattgaaccgcactttaatacttcctggatgtcatgggacgggtgtgatctcgactactattgcaacatgggagactggcccagttgtacatacaccggcgtcactcagcataatcacgccagcttcgtgaacctgttaaatatcgagacagattacaccaagtcctttcacttccattctaaaagggttacggcacacggcgacacccctcagctggatctcaaggctcggccaagctatggggccggagaaatcacagtgcttgtcgaggtggcggacatggagctgcatactaaaaagattgaaatatcaggtttgaagtttgcaagtctaacctgcacaggctgttacgcctgctccagcgggatctcttgtaaagtacgcattcacgttgatgagcccgacgagttcactgtgcatgtcaagtcagatgaccctgatgtggtcgctgccagtagctccctgatggcacgaaaactcgaatttggaaccgactctacattcaaggctttctcggccatgccaaaaaccagcctgtgcttttatatcgtggaaagagagtactgtaagtcctgctcagaggaagatactcaaaagtgtgttaacacgaaacttgagcagccccagagtatactgattgaacacaagggcacaatcatcggtaaacaaaacaatacctgcactgcgaaggcctcttgctggttggagagcgtgaaatccttcttttatgggctcaagaacatgctgtcaggcattttcggaaatgtatttgtcggcatcttcttatttctggcaccgttcattctactcatactgtttttcatgtttgggtggaggatccttttctgttttaagtgctgtcggcgtacccgcggattgttcagatacaaacacctggagaacgacgaagagacaggttataggcggattatcgaacgactcaataacaagaaaggcaagaataaactgcttgacggggagcgcctggctgatagaaggatcgccgaattgttcagcaccaagactcatattgga

SEQ ID NO: 10849 - RNA, 1932 nt, synthetic construct
  misc_feature 1..1932: note = derived and/or modified CDS sequence (opt3) from CCHFV(SPU 45/88)__KJ682809.1__Gc
  source 1..1932: mol_type = other RNA
ttcctggacagcatcgtgaagggcaaaaagaacctccttaattccacctctctggagacatcattgagtattgaagccccctggggagctataaacgtccagagcacttttaaacctacggtttccgcagccaatatcgcgttatcttggtcgtcagtggagcacagagggaacaagattctggtaagcggtaggagtgaatccatcatgaaactagaggaacggaccggcatttcttgggatctcggggtggaggacgctagcgagtccaagctgcttacagtctcagtgatggatctgagtcaaatgtacagcccagttttcgaatatttgtctggagaccgccaggtggaggaatggccgaaggccacttgcaccggcgattgtcccgagcgatgcggttgtacatcctcaacctgcctccataaagagtggcctcacagccgtaattggagatgtaacccaacttggtgctggggagtcgggacaggctgtacctgctgtggcctggacgtgaaggatctgtttacggactacatgttcgtaaaatggaaggttgattatatcaaaactgaagcaatagtgtgcgtcgagctcaccagtcaggaaaggcagtgttctttaatcgaggccgggacacggtttaatctgggacccgtgactattaccctttccgaacctcgcaacatccaacagaagttgccacccgagattgtgacactgcatcctagaatcgaggaaggtttctttgacctaatgcacgtccagaatgttctcagcgcttcgaccgtgtgcaagctgcagtcttgcacgcatggcgtaccaggggatcttcaaatataccacattggaaacctgttgaaaggcgacaaggtgaatggtcacctcatccataaaattgagccgcacttcaacacttcctggatgtcatgggatgggtgtgacctggactattactgcaatatgggagattggcccagttgtagctatacaggcgtcacccagcataaccacgcagcctttgtgaatatgttaaacatcgaaactgactacacaaagaacttccactttcattccaaaagggttaccgctcacggcgatacgcctcagctggacctcaaggcccggccaacctacggggcgggagagatcacagtgcttgtcgaagtggcagatatggagctgcatactaaaaagattgagatatctggtttgaagttcgccagcctaacctgcacaggctgttatgcttgctcaagtgggatctcctgtaaagtacgcattcacgttgacgaacccgatgagctgactgtgcatgtcaagagcgaagaccctgatatcgtggccgcatcttcaagtctcatggctcgaaaactggagtttggaaccgacagcacattcaaggccttctccgcgatgccaaaaacctctctttgcttttacatagtcgaaagagagtattgtaagtcgtgcagcaaggaggatactcagaaatgtgtgaatacgaagctggaacaaccccagtccattttgatcgagcacaaaggcacaatcattggtaagcagaacgatacctgcactgccaaagcatcatgctggctcgaaagtgttaagtctttcttttacgggctgaagaatatgttaagcggcatcttcggaaacgtgtttattggcatactgctattcctcgctccgtttatcatgctgattcttttctttatgttcgggtggaggatcttgttttgtttcaaatgctgtcggcgtacccgcggactgtttaagtatagacacctcaaagacgacgaggagatcggttacaggaagattatagaacggctgaataacaaaaagggcaagaataaacttctggacggggagcgattggccgatcgcaagatcgctgaactcttctccacaaaaacccatattgga

SEQ ID NO: 10850 - RNA, 1932 nt, synthetic construct
  misc_feature 1..1932: note = derived and/or modified CDS sequence (opt3) from CCHFV(SR3)__AJ538199.1__Gc
  source 1..1932: mol_type = other RNA
ttcctggacagcatcgtgaagggcatgaaaaacctccttaattccacctctctggagacatcattgagtattgaagccccctggggtgctataaacgtccagagcacttacaagcctacggtttccaccgcaaatatcgccttatcttggtcgtcagtggagcacagaggaaacaaagtactggtgagcggtaggagtgaatccattatgaagctagaggaacggacaggcatctcttgggatctcggggtcgaggacgcgagcgagtccaaactgcttactgtgtcagttatggatctgagtcaaatgtatagcccagtgtttgaatacttgtctggagaccgccaggtcgaggaatggccgaaggctacctgcacaggcgattgtcccgagcgatgcggttgtacctcctcaacttgcctccataaggagtggcctcacagccgtaattggagatgtaacccaacatggtgctggggagtggggaccggctgtacgtgctgtggcctggacgtaaaagatctgttcactgactatatgtttgttaagtggaaagtggaatacattaagaccgaggccatcgtctgcgtggaactcacaagtcaggagaggcagtgttctttaatagaagcagggactcggttcaatctgggatccgtgaccatcacacttagcgagccccgcaacattcaacagaaattgcctccagagatcattaccctgcatcccaagatcgaagaggggtttttcgatctaatgcacgtccagaaggttctctcggcctctacggtgtgcaaactgcagtcctgcactcatggcgtacctggggaccttcaagtgtatcacataggaaatctgttgaagggcgatagagtcaacggtcacctcattcataaaatcgaacagcactttaatacatcatggatgagttgggacgggtgtgatctggactactattgcaacatgggagactggccaagctgtacctacactggcgtgacacagcataatcacgcttccttcgttaacttactgaatattgagaccgattacacgaagacctttcacttccattctaaaagggtgacagcacacggcgacactccgcagctcgatcttaaggcccggcccacctatggggctggagaaatcacagtcctggtggaggtagccgacatggagttgcatactaaaaagatcgaaattagcggtctaaagtttgcgggcctgacctgcacagggtgttacgcatgctcaagtggaatatcctgtaaagttcgcatccacgtggatgagcctgacgaactcaccgtccatgtgaagagtgatgacccagatgtcgtggccgcttcttcaagtctgatggcccgaaaacttgagttcggcactgacagcacgtttaaggcattctccgctatgcccaaaacatctctgtgcttctatattgttgaaagagagtactgtaagtcgtgcaacaaggaggatacccaaaaatgtgtgaacactaagttggaacagcctcagagcatcctcatagagcacaaaggtaccattatcgggaagcaaaataacacatgcaccgccaaagcgtcctgctggctggaatcagtaaagagctttttctatggcttaaagaatatgctgggaggcatctttgggaacgtcttcattggaatctttactttcctaacaccatttattctcctgatacttttctttatgttcggttggaggatcttgttttgtttcaaatgctgtcggcgtacgcgcggcctgtttaagtacagacacctcaaagacgacgaggagaccgggtataggaagattatcgaacggctgaataacaaaaagggaaagaatcgacttctggatggcgagcgcttggccgacagaaaaatcgcagaactcttctctactaagacacatattggt

SEQ ID NO: 10851 - RNA, 4656 nt, synthetic construct
  misc_feature 1..4656: note = derived and/or modified CDS sequence (opt3) from DUGV(ArD44313)__NC_004158.1__GP
  source 1..4656: mol_type = other RNA
atgagcaagagagtgctgatcattgccgtcgttgtgtacctcgtattcaccacacagaaccaaataactggcaatcacacgaccatcaactcctcttcacccagtacaactgaggctagctccacccctacagtgtctaggaccccacagactacaaccacgtcgactgcagtctcaaccacaattactgccaccacaaccccgacggcgagctggactacacagagtcagtattttaataaaaccactcaacatcactggcgggaagagacaatgatctcccgcaaccccaccgtgcttgaccgacagtctcgtgctagctccgttagagaactgttgaatacgaagttcttaatgctgctagggtttattcctaaaggagaggtgaaccatctcgaaaatgcctgcaacagggagggtaagaattgtaccgagctgatccttaaagaacggatagcacgcttcttttcagagacagaaaaggagagttgctacaacacttatctggagaagcacttgagaagcgtctctccagaagtgtccctcaccccctacagggtactgggcctgcgggaggatatcctcttaaaagaaattgaccgccgaatcattagattcgagacagattcacagagggttacttgtctgagcgccagtcttttgaagcctgacgtgtttatccgggaacagcgtatagatgctaaaccatctaatgggcccaagattgtccctgtggactccgtggcatgcatgaacctggaggccaatgtcgatgttcgcagcaacaagctagtgatccaatcgctcatgaccacagtaaagatttctctgaagaattgtaaagtggtcgtgaactccagacagtgcatccatcagcagaccggatcaggcgttatcaaggtgccaaaattcgagaagcaacagggtgggacttggagtagctatattgctggagtctacacggccacaatagaccttctggatgaaaacaatcagaactgtaaattgtttaccgagtgcatcgtgaagggcagggaactcgtaaaaggccaatccgagctgaagtctttcaatattgaagttttactgccgcgggtgatgaagactcgacgcaaactccttgcggtcaccgacgggagcacagagtgtaactcaggaacccagctgatcgagggtaagagtatagaagtgcacaaacaggatattggcgggcccggaaagaaattgactatctgcaatggcacatccgtcctagacgtgcctctggatgagggtcacgggtgttatacgatcaacgttattaccagcaagagagcatgcaggccaaagaactctaaactccagtgctcaatcgacaaggaactgaaaccctgtgacagtggaaagtgccttagcatttcccaaaaaggcgccggccatataaaggtgtctcgggggaagactatcctgattacagagtgtaaagaacactgccagatccctgtaccaaccggaaagggtgatatcatggtcgactgttcgggcgggcgccagcattacttggaggtgaatattgttgatatacactgccccaatacaaaatttctcggaggcatcatgctgtacttctgtagaatgagctccaggccgactgtggctttactgctaggtatttggatcgggtgcggctatattctcacctgtatcttttcattcctgctttaccacttgatactgttctttgccaactgcatcaagcagtgtcgtaaaaagggagagcggctcggcgaaatttgcgtcaagtgcgagcaacagacggtgaatctgatggaccaggaacttcatgatctgaactgtaatttcaacttgtgcccttattgttgcaatcgaatgagtgacgaggggatgtctagacacgtaggaaaatgtcccaagaggctcgagcgcctgaacgaaatcgagttatacctgaccacaagcgaatgcctatgtctctccgtgtgctatcagctgcttatttcagttggtatctttttgaaacggactacctggctggtcgtgctcctggtgttactgggccttgcaataagcccagtccaaggggctcctacagaggtttctaacgtgaagcaggatggagactactccatttgttatttcatctttggctgcttggtgactgccgcgctcctgctaaaagtaaagagaaccaatagtaacggtattgtcgtggttgtggatagcttcgggaggtgtccctactgcaatgaatttacggactctctgttcgaggaggtcctccatgatacactgtgctccctttgtgtgtgcccattttgtgaaaaacaggccttggacctggttaccttagaggaacacgtgaaggagtgctacaaggtagcaactcgcaaagacatcttcaagatactcggccgaaaatttacaaacgctctggtccggcgtgaaaaacttttcaccactggactgcagttgtttatcaataaaaccaacgtggtggtcttcgccctcattatgtgtttcctgctactgctcacaggccataatgcttcagcctttgatagtggggacctgcccgatggagtttgggaggagagctcgcaacttgtgaagtcctgcacgcagttctgttatatcgaagaggacgtatgctactgtcctgcagaagatggtgtgggcagaaagttgctgtttttcaacgggttacaaaattctgtcaaaaggctcagcgactcacacaagctgcttaccagtgtgtccattgatgccccatggggacgcatcaacgttgagtctacttggaaaccgacactggctgcgagcaatatagcaatgtcctggtcaagcaccgacattaagggcgaaaaagtgatcctaagtggtcggtctacatccatcattaagctcaaggagaaaactggggtcatgtggaagctggtgggcagcggattggcctcggagaaaaagaaaccctttagattccctatcatggattttgctcaggtttataactcagtgttccagtacattaccggcgacaggctgttatctgaatggccaaaggccgtctgcacgggggattgtccccaccgatgcggatgccagacaagtacctgtatggcaaaggagtgccatactcaggaatgtgtatccacccacatggtgctcggcataggtacagggtgcacttgttgcggaatggacgttgagcgcccttttaataaatatctgggcgtgaagtggagcaccgagtaccttcggacagaagtcctggtgtgtgtagaggtgacggaagaggaaagacattgcgagatcgtcgaggccggtaccaggttcaacattggcccaatcactattacaatctctgatccccaaaatatagggagcaaattgccggaatccctcatgaccgttcaggagatcgacgactcaaactttgtggatattatgcacgtgggaaacgtcatcagtgctgacaatagctgtcgtctgcagtcttgcactcacggctccgccgtgacaacccgcttcacggcactaactgcgctgattaaggatgaccattcaagtgggcttaacctcgctgttctggatcctaaagtaaatagctcctggttgtcttgggaaggatgtgacatggattattactgcaacgtgggcgactggccaacctgcacatacaccggtgtcgtgactcagaagctgcgggagtttttaaaactcgatcaacacagaaagaggctgcatacaaccctttcgttcagcctgaagaaaaatttgtcaaagcgatcccacacaagtgttcggctcgaagggaaaactgtgacccgcatggaggtcaaggtgacggccctgatcgaggtagacggaatggaactacattctaaaacaataagactgagcggcattaggcttaccggtctcaagtgttccggctgcttctcatgtacttctgggatcagctgcagtgtcaacgcaaagctgacctcccccgatgagtttacattgcacttacggagcacttctcctaatgtggttgtggccgaaacctcaatcattgctcgaaaaggaccctccgccacgacaagtagattcaaggtctttagcgtgcgcgacaccaaaaagatatgtttcgaggttgtggaaagggagtattgcaaagattgtactccagacgagctgacaacctgcactggcgtcgaactcgagcctacaaaggacatcctgcttgaacaccgtgggaccattgtgcagcatcagaacgatacgtgtaagtcgaaaatcgactgctggtctaattccattagctcatttgcaagtggaatcggcgatttctttaagcactacataggttctatcgctgtaggggtgctgggaactgttttgcccttcgccctactgattctctttttcatctatggcgacaaaatgctgtggccatttaaggtcttctgtcggccgtgcagaaggtgctgtcgcaaaaacgagggttacaataaacttgcggaggaagaggaattacgagatattatcagaaagttctccaaaagcggcgagctgataaacaaggacgccaaagataagcggaccctcgctaggttgtttatgtcagacaatcctaaactgaagaaggaaaagaagctcagtgagattgcatga

SEQ ID NO: 10852 - RNA, 4656 nt, synthetic construct
  misc_feature 1..4656: note = derived and/or modified CDS sequence (opt3) from DUGV(IbAr1792)__KU925456.1__GP
  source 1..4656: mol_type = other RNA
atgagcaagagagtgctgatcattgccgtcgttgtgtgcctcgtattcaccacacagaaccaaatagctggcaatcacactacggcaaactccgggtctccctcaaccaaagaggccagtagcatgcctacagtgtccgacactccacagaccacaaccacttctacagcggtctcgaccacgatcactgctaccacaactccgaccgcctcatggacaacccagagccagtactttaataagacgactcaacatcactggagggaagagacaatggtgagtcggaaccccaccgttcttaatcgccagcgacgtgcatcctctgtgaaagaactgttgaacactaagttcttaatgctgctaggatttattcctaaaggtgaggtcaatcatctcgaaaacgcctgtaatagagagggcaagaactgcacagagctgatccttaaggaaaggattgctcggttctttagcgagaccgaaaaagagtcctgttataatacgtacctggagaagcacttgtgctcagtgagtccagaagtaagcctcaccccctatcgcgttctggggctgagagaggatatcctccttaaaaagatagacaggcggatcattcgcttcgaagcagattctcagcgagtgacatgtctgtccgcctcacttttgaaacctgacgtctttatcagagagcagaggattgatgctaagccaagcaacggacccaagatcgtgcctgtggacagtgtccggtgcataaatctggaagccaacgttgatgtgcgttctaataagctagtaattcaatccctcatgactaccgtgaagatcagcctgaaaaactgtaaggtcgtggttaactcgcgccagtgcattcatcagcagacaggctctggtgtgatcaaagtcccaaagttcgagaaacaacaagggggaacttggtcctcatacatcgcgggcgtgtataccgcaacaattgaccttctggatgagaagaatcagaactgtaagttgtttaccgaatgcatagtaaaaggcagagagctcgttaaggggcagagtgaactgaaatccttcaatatcgaggtgttactgccgagggtcatgaagactcggcgaaaactccttgccgtgacggacggatccacagaatgtaactctggtacccagctgattgagggcaagagcatcgaggtccacaagcaggatatagggggacccggcaaaaagttgactatttgcaatggtacctcagtgctagacgttcctctggatgaagggcacggatgctacacaatcaacgtgatcaccagtaaacgcgcttgtagaccaaagaatagcaaactccagtgcagcattgacaaggagctgaagccctgtgactctggcaaatgcctttcaatcagtcaaaagggcgccgggcatattaaagtaagcaggggaaagactatactgatcacagaatgtaaagagcactgccagattcctgtcccaacgggtaagggcgatatcatggtggactgttccgggggacggcagcattatttggaagttaacatcgtggatattcactgccccaataccaagtttctcggcggtataatgctgtacttctgtcgcatgtcttcgagaccgactgtcgcattactgctagggatctggattggctgcggatacatcctcacatgtatttttagcttcctgctttatcacttgatcctgttctttgctaactgcataaaacagtgcaggaagaaaggcgagcgtctcggggagatctgtgtgaagtgcgaacaacagaccgtaaatctgatggaccaggagcttcatgatctgaactgtaatttcaacttgtgcccttactgttgcaatcggatgtccgacgaaggaatgtcacgacacgtgggtaaatgtcccaagagactcgagaggctgaacgagattgaattatatctgaactacaaacgcgttccaagttgcctacggtgtatgctctctacaagcatctccgtcggcatttttctgaagagaactacctggcttgtggtgttgctggtcctcctggggttagccatctcacctgttcagggagcgcccgccgaggtgagcaatgtgaagcaagatggcgactattctatatgctacttcatttttggttgtctggtaacggcagctcttttgctcaaagtcaagaggaccaactccaatgggatcgtggttgtggtcgatagtttcggccgctgcccatattgcaacgaatttacagacagcctgttcgaggaagtgctacatgatactctgtgttctctctgcgtttgtcccttttgcgagaaacaggccctggaccttgtgaccttggaggaacacgtaaaggagtgttacaaagtcacaactcgaaaggacattttcaagatcctgggacggaaatttaccaatgctttagtgcgtagagaaaaactcttcacgacaggcctgcagctttttataaacaaaaccaatgtggtcgttttcgccctgatcatgtgcttcttgctcctgctaactgggcataacgcatccgcctttgattcaggagacctgcctgatggtatttgggaggaaagtagccagctcgtgaagtcgtgtacacaattctgctacatcgaggaggacgtatgttattgcccagctgaaaatggcgtggggaggaaactgttatttttcaacggattgcaaaattccgtcaagcgcctgtctgatagccacaagttactcacctcagtgagtattgacgcgccgtggggcgcaatcaacgttgagtccacttggaaacccaccctggccgcttctaatatagccatgagctggtcctcaacagatattaagggtgaaaaagtgatccttagcgggcggagtacgtctatcattaagctgaaagagaagaccggcgtcatgtgggaactaggatccgagctcgcaagcgagaagaaaaagctgttggtgtcgatcatggactttgcccaggtttacaactcagtgttccagtatattactggcgatagactgttatctgaatggcctaaagctgtctgtacaggggactgcccacacaggtgcggatgtcagaccagtacatgcatggccaaggagtggccccatactcgaaattggcgctgtaaccctacctggtgctggggcataggtacggggtgtacatgctgtggaatggatgtagaacggccatttaacaaatacctcggcgtgaagtggtccaccgagtatctgagaactgaggttcttgtgtgcgtcgaagtgaccgacgaggaaaggcactgtgagatcgtagaagcaggtacacgtttcaatattggccccatcactattaccatcagcgatccgcagaacatagggtctaaactgcctgagagcttgatgacagtgcaggagatcgacgactccaattttgtcgatattatgcatgttggaaacgtgatctcagcggacaatagttgccgcctccaaagctgtacgcacggctctgctggggattaccagatttattccaccgactcactgatcaaggatgaccacagtagcggactaaacctggccgtgcttgatccaaaggtcaattcctcttggctctcgtgggaaggctgcgacatggattactactgcaacgtgggtgactggcccacttgtacatataccggggttgtaactcagaatagcgagtcattctccaacctgataaatattgaaaaagattacacacagcggtttcatttccacagtaagagaatctctgcaaaaggacataccttgcaactggacttaaaggccaggcctaaccaggatggcggtgaggtgacggctctcatcgaagtcgacggcatggagctgcacagcaaaactattcgactttccgggatacggctgaccggattgaagtgctcaggctgtttttcttgcacaagcgggatcagttgttccgtgaatgccaagctcaccagccccgacgagttcactctgcatctacgctctacatcaccaaacgttgtggtcgcagaaacctccattatcgctagaaaaggacctagtgccacaactagcaagttcaaagtgttttcggtaagggataccaagaaaatttgcttcgaggtcgtggaacgggagtattgtaaggactgctctcccgatgaactgacgacatgtaccggcgttgagcttgagccaccgaaggacatcctcctggaacaccgaggtactatagtgcagcaccagaatgatacctgcaaatccaagatcgactgttggagcaactcaattagttcttttgcgtccgggatcggagatttctttaaacattacattggcagcatcgccgtcggtatattgggcacagtgttacctttcgctctgctcattctgtttttcatctatggggacaagatgctttggccctttaaagttttctgcagaccatgcaggcgctgttgccgtaagaacgagggatacaataagctggcagaagaggaggaattgcgggatatcattagaaaattttcaaagagtggcgagctaatcaacaaagacgccaaggataaaaggactctggctcgcctcttcatgagcgacaatcccaagctgaagaaagaaaagaaactttccgagatagcctga

SEQ ID NO: 10853 - RNA, 4884 nt, synthetic construct
  misc_feature 1..4884: note = derived and/or modified CDS sequence (opt3) from NSDV(Jilin)__NC_034391.1__GP
  source 1..4884: mol_type = other RNA
atggtgagcctggagaagggcctcatccttctgttgttaatgcacattgccatagcttccaccgggggatctctgggtctacccggcctcaacggggaagaccatacagatgaccctgaggtcggaggcgatggtccaactgaagagtacacggaagacgatccggagtcaaccacagttagtatccccactacccctccagtgctggggcagggaacagaggaagtacccgcaaccagcggcgaggccgaagcgggctattccactacagacgtgcctgataccgtctctgagaaagtggaggacgaacaagatacgactccatcgacccaggttacacccgaccagcctgagcagtcaactaccagccttccagatccgtggacagctattagtaccagaatcgggagggaactgttgtccgtggagtctgacacgactaagagctccctcgtcacagtgggacacccccaacagcctattttcctggatggtcagccagtagaagaggttacccatcccgtgaatgagcgggacgtcactgaagccctgcgcaaatacgacaagatgaaaaagctcttatcacagcgaatcctgagtaagatgggcatggcacgtgattttacagacgaggaacttgatgtgtggtgccacgagagattcgacaactgtagctctaatgatatagaaaacaggatccgggactttttcttgatttccgatcaaaccgagtgctttgacgaggtgctggtcaaacgcctatgtgaatcaacgaatcctatcgttggggagccatggcaagtggccggaattaaggaagagatcgtaagaagggaaatgggccggcgcatattccgatttttcacccccacactcaaagtgacttgcgtcagcggtagtctgaacccgtctgatcagtttgtgagattctatgaccctgttattgagaggacctccgggcccacaatccagaattacgatagcatgcattgtcttaacattgagaatggactggctaagccatcgaaaatggtggtcttgaacgtgctcatgactaccgtagaagttcggctggagtcttgccgtgcatttatcaatgcccaccagtgtatctatacacagcacgctgacggccaggtgatggtccctaccttcgtggaccattccggcactcgcagaacgattggggcctacacaatgtcatttaacttaaccgatgaaaggaatcgggcgtgcataatccgaactacctgtgtcgtgaagggaaaggaggttaaaaagggtcaaagtcagctgcgcggcttccccacaagcattagactcttcaaatccgtgaccgggaagaggcggcttatggcagaggaaggagactggactgattgcggctctggtacacagctggacatgacgatggccgtaagcgtccacaacgataaaaagggaggcccagggaaaaagttgaccatctgtaatggcactacagtgtcagacagtaccctaaacgaggggctgggatgctatacaataaacaaggttattactggtaaggcttgcaaagtgggcaattccaccgggagctgtgaagtccagacggagctccaaaaatgcgaaaccggaaagtgtatcctggtgaaacagaagtctaagggcgtagtgaaacttaagcgcggtaaaacagttatcattactgagtgccaggggtcatgtctgtttgccatcccccaggataccggcgacattacaatagattgcagtggaggcagacaacattacttggagatcaacattgtcgacatccactgtcctgggaaggataaatggaagggattcatgctctacatctgcagggtgagctcccgtccactgattgcattaacttttggtctgtggctagctgccggctatctcataacctgtctggtgtctttcatcatttacaatgcggtccttttgctgtcgatcgccattaagaaagttcggcaggggcgagaaaagaaaggagacctctgcatcaagtgtgagcagcactgcatgaacctgtatgatcaggaacttcatgagctgaattgcagctttaacttgtgtccgtactgcgcaaatagactctccgacgaaggcctgcccaggcacgtgcctcgctgtcccaaaaagtcagagcggttagaggaaatagagctgtatatcaactacacgagagtgccctgcattctaaggtggatcctcagtacatctgtacaagtcggtaccgctgtgaagcgcctgagctggttctccgttcttgtgactttgtttattctgacaatctcacctgtccaggggttcccactcgaaagcccaccgataggcgccgctaccgactctcgaattatgtatggagtggttggctttatgttcgccctgatcatgatgttaaatctgaaaaagtcccattacgggagtatttttcacgtgatcgatggattcggccggtgtaacctttgcgacactcgtatagatagcttgatggaggaaaccgcacatgacctctgttgcatgtttgattgttgcccttactgtcacagagtatctgagtccaatggttcacactgcttccatgtcaggatctgcgtggccaaagagattagtaagaaaatgctgaaggctgggggacgcctattcacaaacaaactggtgagccgggaaggcacgtttgcgaatagaatccagctcctgtataggcgatcgaaggtcgtttccacccttgtggtaactgtgttgctgttactcgtcctgcttaagccaacaaccgcattcgactctggtcccctgcctgatggcacatgggaggaagaggagaaattggtgcgcaactgtgggcaggaatgcattctcgaccaaggagagtgtctgtgccccggcgaacaccgggccgggagaaagctactgtttctcaatggactgcaggatgctgccaggcgtatgactgagagccatcgccttttgacctcagttagtatcgacgcaccatggggcgccataaacattgaatccacgttcaaacctgtgctggctgcctctaacatcgatttaagctggaactccgcagaggagcagggtgacaagatcattctctcagggcggagcacaggaatcattaaactgcaagaaagaaccggccttatgtggaagatgagttctgagaaggcgtccgaaagcaaaaatctgctagtctcggtgatggatttttcacagctctacaattctatattccagtatatcactggtgacaggagtctgtccgagtggcccaaggctgtttgtaccggcgactgcccagatcgatgtgggtgccagacaagcacttgttaccacaaagaatggccgcacacccggaactggcgctgcaatcctacatggtgttggggaattggcacggggtgtacctgctgcggaatggacgtggagagatattttaacaagtacttcggcgtcaaatgggccttggagtatgtaaggactgatgtggttgtgtgcgtcgaactgacaaatgaggaacggcattgtgacttagtgcaagcaggttctcgatttagcatcgggcccgtatccgtgaccctctcagatccacagaacgtcgttaatagactgagtagcaacattatgactatccaggagatagccgacaatggaatccttgatctgatgcacgtgtctaaggtgatttccgctgaaaacgcctgcaagttgcagtcatgtacacatggcagtcccggtgacctccaaatcctgcacaccgataatctaattaaaggcgacatgagcgggggaatcaacctggcacatcttgatcctcaggtcaatacgtcctggatgtcttgggagggctgcgacctcgactactactgtactgtgggggattggccatcgtgcacctatacaggagttaacagcataaacaccgactcattcactaatctgattaacacagagaccgattacacaggcaagtttcacttccactccaaacgcatcagtgctagggacgatactttgcagatggacctgaaggcccgtcccaattctggtgggggagaaatgaccgtattagtggaggtcaacggcctcgaactgcatagcaaacggatctcccttaagggcctgagattgacgaatctcaagtgtgatgggtgctttgcgtgttcacagggactgacatgcaccattactgccaaactagagtctcctgacgagttcaccatacacctgaggagcacaagtcgcgatgtggttgtggctgaaacttccgtcaccgcacgaaaggtggagacgggtgccagaagcggcttccgggcttttgccgtaagggacgtcaaaaagctctgccttgaagtggttgagaaagattattgtccgtcttgcacagtggaagacctgaagatctgtgtcgatgtgtcattggagccacccaaagacattttaatcgagcataaggggaccattatccaacactacaacaagtcctgcgacgaaggatataattgttgggttggcagtgtgagcggtttctttgtcggggtgaaagatttctttgagaagaacctgggaggcgtactcataggcctggtgtcgactatccttcctctggttttgacagtcctattctttatttacgggaaaaagctgttctgcctctgtcgcctgtgccataaaaagtgttgccgtggatctggtagaggccgggacgggtattccaggcttagccaggaagaggaaatcaaggagattatcaaaaagttttcacgcaatggagagttactgggcaaaggtgaaaacgataagcgaaccgtggcaagaatgttcatggacgggcagagtactaaaaaggcgataaaggaggtggcctga

SEQ ID NO: 10854 - RNA, 4884 nt, synthetic construct
  misc_feature 1..4884: note = derived and/or modified CDS sequence (opt3) from NSDV(708)__EU697952.1__GP
  source 1..4884: mol_type = other RNA
atggtgagcctggagaagggcttctttttcctccttctgttgcacatcgtcaccgcctccacagggggaccccctggtttaccaggcccgaacgggaaagaccagactgatggacccgaaggcggtggggacggacctacggaggaatacaccgaggatgactttgaatctacaactttctcaattccaaccacaccccctgttagtgagcaagatgctaaggaggtgagcgcaacctccgaagaggccgaagtagaggactctactctgatagtgccaaaaacaatgtcggagaaggtcggcgatgaacagtcaaccacgagcaatatgcaagtgactaccagtcagcccgagcagtccacaactggcatgcctgggccatggatggcgtctagcatcaaaattggaagagaactactctccgttgagtcagacaccacaaagagtagcctggtgaccgtcggttatccgcagcagcccatctttcttgatggccagcctgtggaagaggtaacgcatccagtttctgagagggacgtggctgaagccctgcggaagtacgataaaatgaagaaattgctctcccaacgcattctgtcaaagatggggatggcacgagacttcactgatgacgagctggacgcctggtgccacgaacgttttgataactgtagcagtaatgacatcgagaacagaataaaagatttctttctcatctctgaccagacagaatgcttcgatgaggtcttagtgaagaggctgtgtgagtccaccaatcccattatcggagaaccttggcaagtggctggcattaaggaggaagtcgttcggcgcgagatgggtagaaggatctttcggttctttactccaacacttaaagtgacctgcgtaagcgggtcgttgaacccctctgaccagttcgtgcgcttctataatccggtcatagaacgaacgtccggacctaccattcagaactacgattcaatgcattgtctgaatatcgagaacggcctaattaagcccagtaaagtggttatcctcaatgtgctgatgacaactgtcgaggtgagacttgaaagctgcagggcatttgtaaacgcccaccagtgtatctatacccagcatgctgacggccaagttcgggtgccaacattcgtcgatcactccgggactaagcgtaccattggagcctacacaatgtcttttaatctgaccgacgagcgcaacaaagcgtgcataatcagaactacgtgtgtggtcaagggtaaagaagtgaagaagggccagagccagttgagggggttccctacatcaattcggctctttaaaagtgttaccggaaagcgacgcctgatggcagaggagggcgattggactgactgcggttccgggacccagttagacatgacaaccgccgtgagcgtacacaatgatagaaaaggcggacccggcaagaaactgactatctgtaacgggacaacggtctctgactcaaccctcaacgaaggacttggttgctatactataaataaggtgatgacaggcaaggcttgcaaagttgggaacagtaccggaagctgtgaggtgcaaccagaactgcagaagtgcgagacaggcaaatgtattttggtcaagcagaaaaataagggtgtggtaaagctaaaaagggggaagactgtgatcatcaccgaatgccagggctcctgtctgttcgccattccccaagatacgggagacatcaccattgattgctctggcgggcggcagcattacctcgaggttaacatagtcgacatccactgtcctggaaaagataagtggaaaggttttatgctgtacatgtgccgcgtgtcgagcagaccacttattgcactgacattcggcttgtggctcgctgccgggtatctgatcacttgtttagtgtcctttatcatttacaatgcggtcctgctactctcaatagccatcaagaaggttaggcagggacgtgagcggaaaggcgacctgtgcattaagtgtgaacagcattgcatgaacctttatgatcaagagttgcacgaactgaattgcagtttcaacctctgtccgtactgcgcaaatcgactgtctgacgagggtcttcccagacacgtgcctaggtgtcccaaaaagaccgaacgcctggaggagatcgaattgtatattaactacacacgggtgccatgcatcctcagatggatactgagcacttccgtacaggtcgggaccgctgtgaaaaggttatcatggtttagcgttctggtgatcctattcgtcctcacgatttctcctgtgcagggctttccactggagaatacacccatcggatccaccactgatagtcgcattatctatggcgttgtggggttcatattcgcccttattatgatgttgaacctgaagaaaagccattacggatctatctttcacgtaattgacggcttcggtcgatgtaatctctgcgatacacggatcgactccctgatggaagagaccgctcatgacttatgttgcatatttgattgttgcccgtactgtcaccgtgtctcagaaagtaacgggagccattgcttccacgtgagaatgtgcgtggccaaggagatctcgaagaaaatgctgaaggcagccggaaggctttttactaataaattggtctcccgcgagggcattttcgctaaccgggttcagctcctgtatagaaggtctaaggtggtaagcacctttgtggtcacagtgctactgctcctggttttccttcgacctgcgacggcatttgactcaggtccattgcccgatggcacctgggaagaggaagaacgcctggtgcggaactgtgggcaagagtgcgtcttagaccaggatgaatgtctctgccctggagagaatagagccggcaggcgtctgcttttcctgaacgggttgcaggacgctgtgcgccggatgactgaaagtcacagactcctgacatccgtttctatcgatgccccctggggagcaattaatatcgagagcacctttaaaccagtgctagccgcttccaacatagacctgtcatggaatagcgccgaggagcaaggcgataagattatcctcagtggtaggtctacagggatcattaagctgcaggagcgaactggacttatgtggcggatgtccagcgaaaaagcatcggagtcaaagaacttgctggtctctgtaatggacttcagtcagttatacaattccatctttcagtatattaccggcgatcgcagcctctctgaatggcctaaagcggtgtgtacgggtgactgccccgatagatgtggctgccaaacaagcacctgttaccataaggagtggccacacactaggaactggcggtgcaatccgacctggtgttgggggataggaacaggctgcacttgctgtgggatggacgttgaaaaatatttcaacaagtacttcggagtgaagtgggctctggagtatgtccgaaccgacgtggtagtgtgcgtcgagcttacaaatgaagagagacattgtgatctggttcaggccggctcccgcttttcaatcggtcctgtgagtgtgacgctaagcgacccccagaacgtcgtgaataggctctcttccaacattatgaccatccaggaaattgcagataatgggatcctggacttgatgcacgtttcaaaagtaataagtgccgagaacgcttgcaagctgcaaagctgtactcacggatccccaggcgatttacagatcctccatacagacaacctgattaaaggtgatatgtctggcgggatcaatcttgcccacctggacccccaggtgaacacctcgtggatgagctgggaaggatgcgatttggactactactgtactgtcggcgattggccttcatgcacatataccggggttaattccattaacacggacagtttcactaatctcatcaacaccgagacagactacacctctaagtttcatttccacagcaaacgtatatccgcacgggatgacactctgcagatggatctaaaggctagaccaaatacaggaggcggtgagatgaccgtgctggtggaagtcaacgggcttgagctccattcaaagaggattaatctgaaaggattgcgcctgacaaacttaaagtgtgacggctgctttgcctgttctcaaggcctcacttgcaccgtgatcgcgaaactggtaagccccgatgagttcacgatccaccttcgaagtacatccagagacgtcgtggttgccgaaaccagcattactgctcggaaggtggataccggggcaaggtcttcatttcgcgccttcgctgtccgtgacgtgaaaaagctgtgcttggaggttgtggaaaaagattattgtccttcctgcacagtcgacgatctcaagatgtgtgtggacgtaagtctggagccgccaaaggatatactaatcgaacacaaaggaactattatccagcattacaataagagctgcgacgagggttataactgttgggtgggctcggtttctgggtttttcgtcggagtgaaagactttttcgaaaagaatctgggcggtgtgcttattgggctcgtcggaaccatcctgcccttggtattaacgatactgttctttatctacggcaaaaagctgttctatctctgcagactttgtcacaagaaatgctgtaagggctccgggcggggaagggatggttacagccgcatttcacgagaggaggaaatcaaagagattatcaagaaatttagtagaaacggcgaactgttggggaagggagagaatgacaagcggacagtggccaggatgttcatggatggccagtctaccaaaaaggcaataaaagaagttgcgtga

SEQ ID NO: 10855 - RNA, 4875 nt, synthetic construct
  misc_feature 1..4875: note = derived and/or modified CDS sequence (opt3) from NSDV(779)__HQ286599.1__GP
  source 1..4875: mol_type = other RNA
atggccctggtggctaagggcctcatccttatgctgttgttatacatgttcaaagcaagcgaggtcaacctggaactaccctcctggaactctaccgaggggacagaatatgccgacgagctccctactgaaccaccgtcagaggaggaacccaagctggcggctgttagtacggtgaccactcctgccccacccaaagagagcactgaagataccattgagtcccctgacggaggtgagacaatggcaccaaccactcccgcccctgtaacagattctgcttcgaaacttgaagaggaaccaggcaccacgcagcaagcacagtcaactcagatgcagaatagccaagccccgatagggatgcccgaggcttggagtacctccccttctagagtgggaaggaaaccactgagcgcctcccccgacgtctcagaacctgatcagaatacagaggcgcagactcacccacccgtgtttttggacggccggccggttgaggaagaggaacatagtgtgggtacccgcgatgtcgcaagcgacctccgagagtacaaccagatgaagcaactgctgtctcagcgtatcctcgccaagatggggatggctgtggatttcacagacgatgaattagacacctggtgctatagaaggtactccaattgttcaagcaacgatattgagagtcggatccgcgactttttcctgattacggacagatctgagtgctttgatgaagtacttgttaaaaggttgtgtgagactacatcccctatcatagaccgggcctggaagatcgcaggactgaaagaagaggtggtcctacgcgaaatgggccgaagaattttcaggtttttcacccccgctctcaaggtgacttgcatgagcggctcgctgaatccatctaaccagtttgtgcggttctataatcctacacttgagcgtacctccgggcccacgatccagaactacgatggaatgcactgtctgaatattgagaacggtttgatcaaaccatcaaaggtcgttgtgataaatgtactcatgaccacagtggacattcgcctggaaagttgcagagcctttatcaacgcgcaacagtgtacttatacccagcatgccgatggcttagtcagggtgcccacattcgttgggcctcacggagagaagcggattatcggcgcatacactatgagctttaatctgaccgacgaaaagaacaaggcttgcacaatcaaaaccacttgtgtggtcaagggtaaagaggtgaagaaagggcaatcccagctccgaggattcccaacgacaattcgccttttcaagtctgtaaccggcaagagaaggctgatgagcaacgaggaagagtggactgaatgcggctcagggacccagttgaatatggccacagctgttagtgtgcataacgataaactaggaggtccgggcaagaaactgaccatatgtaatgggactacagtctccgacatcgccctcaacgagggactgggctgctacacgattaataagatcataaccggtaaagtgtgcaagactgggaacacaaccggcagctgtgaagtccagcccgagcttcaaaagtgcgagacaggaaaatgtattctgatcaagcagaaaaataagggcgtggttaaattgaagcgggggaagactgtgatcattaccgaatgccagggatcttgtctctttgcaatccctcaggatacgggtgacattaccatagattgctcaggcgggcgccaacactatctggagatcaacattgtagacatccactgtccaggaaaagacaagtggaaaggcttcatgttatacatctgcagagtcagtagcaggcccctggtggccctaacatttggtatttggctcactgctgggtatctgataacctgtcttgcgtccttcatcttgtacaatgcaattctgctcatctctattgccatcaagaaactgaagcagaagcgtgagaaaaagggcgatctttgcataaaatgtgaacagcattgcatgaacctgtatgaccaggaattgcacgagctcaattgctcgtttaacctgtgtccttactgcgctaatcggttaagcgatgacggactgccacgacatgttcccagatgtccgaagaggggcgagcgcctagaagagatcgaactctatattaactacacacgggtgccttgcctgcttagatgggccttgtccacttcagtccaagtggggaccgtaatcaaaaggctgagttggttcggagtgctcctgacgttatttttcctgacaatttctccagttcagggttttccccttgagaatcctcccatcggcaccgcaactgatagcaacataatttacgggttggccggattcatctttgctctcgtcctgatgctaaacctgaagaaaacacactatggctccgtgttccacgtgattgacggtctcgggctgtgttcactttgcgatacccgcatcgacagcttgatggaagagactgcccatgagctgtgttgcgcatttgattgttgcccatactgtcaccaggtctctgaatccaatggcagtcattgcttccacatgcgaatatgcgttagcaaggagatctctaagaaaatgttaaaggcggctggaaaactcttcaccaacaagctggtgtcccgggaaggctttttcgccaataaaattcagcttctgtatcaacgttcaaaggtggtaagtacattgatcctcacggtcctgctactgctcattatcctgaagcctgcagccgcttttgacagcgggccccttccagatggaacctgggaggaggaagagtcgttgataagatcctgtgaccaggaatgcgtgctggagcaggatgaatgtttatgcccgggcgagcatagggccggtcgccggctcctgttcctttctgggctgcaagacgcagctagaaggatgactgagagccaccgactactcacatcagttagtattgacgccccttggggagcgatcaacatcgaatccacctttaaacccctgttggccgcttctaatattgatctgagctggaactccgcagaggaacagggcgacaagatcgtgttatcaggtcgcagcacaggcattataaaactccaggagcggactgggctgatgtggaagatgagttctgaaaaagcctccgagagcaagaatcttctggtctcgatcatggatttctcacagttgtacaactctatttttcaatatatcaccggagacagaagtctctccgagtggccaaaggctgtgtgtacgggcgaatgccccgataggtgtgggtgccagacaagcacctgttaccacaaagagtggcctcatactcgtaattggcgctgcaacccaacctggtgttggggaattggcacaggttgcacttgctgtgggatggacgttgaacggtatttcaataagtactttggagtgaaatgggccctggagtacgtaagaaccgatgtcgtggtgtgcgtcgaactaacaaacgaggagaggcactgtgacctggttcaggcaggctctcgattcagcatcggtcccgtgtccgtaacgctttcagatcctcagaatgtggtcaaccggctcagtagctctataatgaccatccaagaaatttccgacaatggcatcctggatgtgatgcatgtttcaaaggtgattagtgcggagaacgcctgcaaattgcagagctgtactcacgggtccccgggagacctgcagatcttacacacagataacctcataaagggcgaaatgtcttcggggattaatctggctcatcttgacccacaggtcaacaccagctggatgtcatgggagggatgcgacctggattatttttgtactgtgggcgactggccctcctgcacatacaccggtgttaatagtatcaacacggattctttcactaatttgatcaacaccgagacagactataccagcaagtttcacttccattccaaacgcatttcagccagaggggatactctccaaatggacctgaaggcaaggcctaatgtgggaggcggtgaaatgacagtcctagtagaggtgaacggcctggaacttcactctaaaaagataagcctcaaagggctgaagttgagtaatttaaaatgttccggatgcttcgcttgtagcccaggcctgtcttgcaccgttatcgcccggctcgagtcacccgatgaatttacaattcatctgcgatccacaagtagagacgtggtcgtggcagagaccagcgtaacggcccgcaaggctgagacaggggcgaagtcgtctttcagggcctttgcagtgaaagatgtcaaggaaatctgccttgaggttgtggaaaaagagtactgtccttcctgcagcattgaagacctgaagatctgtatatcagtgaccttggagccgcccaaagatatcctaattgagcacaagggaactatcgtccagcactataacaagagttgcgacgaaggctacaattgttggattggttctgtgtccgggttctttgttggagtaaaagacttctttgagaagaacttcggcagcgtgatcataggcattgtctcaaccgtgctgccactcatcctgacagttcttttctttgtgtatgggcgtcggttattttgcctgtgtagactctgccataaaaagtgttgcaggggaagtagccgcggtcgagatggctactccagattgtctcaggaagaggaaatcaaagagattatcaagaagttcaatcggaacggggagctgctcggaaggggcgaaaatgacaaacgcactgtcgctcgtatgttcatggatagccaatccgccagaaaggccgtgaaagaggtagcttga

SEQ ID NO: 10856 - RNA, 4302 nt, synthetic construct
  misc_feature 1..4302: note = derived and/or modified CDS sequence (opt3) from BUNV__NC_001926.1__GP
  source 1..4302: mol_type = other RNA
atgagaatcctgattctccttctggccgtgacccagttggctgtcagctcccccgttataacaaggtgcttccacggcgggcaattaatcgcagagcggaagtctcagacttcaattagtgaattttgtatcaaagacgatgtgagcatgctgaagtccgagattgtatacacgaaaaacgacaccggaatcttcggtcattctaaggtgtttcgccactggacaataactgattggaaagcctgcaatcctgtcgtgaccgcgggcgggtcgatcaacgttattgaagtggacaagaatctaaacctcgtcacacgaaattatgtgtgtaccggagattgcactatcacagtagaccgtaagaacgctcagattatcttccagaccgataaactgaatcattttgaggttacgggcactaccatatcaacaggttggttcaagagcaaagccagtgtgactcttgacagaacctgtgaacacattaaggtctcctgcgggaaaaagacactgcaatttcatgcatgtttcaagcagcacatgtcttgcgtgaggtttttgcaccggagcatcctcccaggatccatggccatttcaatctgtcagaacatcgagctgattataatcaccattctggctctctgcatcttcataattatgatcatcttaacgaaaacttacatttgttatgtgctgatcccggtctttatgcccattgcattcgcctacggctgggcttataatcgcagttgcaagaaatgcacatgttgcggccttgcctaccatccttttaccaactgtgggagctattgcgtttgtggatctaagttcgagacttccgatagaatgaggatgcaccgggaatcaggtttgtgccagggcttcaaaagcctgcgcgtggcgcgaagactatgtaagagtaaagggtcttccctcataatcagcattctgctttcggtactgatcttgtcttttgtgacaccaatcgagggaaccctcacgaattaccccaccgaccaaaagtacacactggatgaaattgcagacgtcttacaggccaagactcatgaggattccaccaaatattacataatcctgtatacatcactcttcggcgctggtcttactattatctttgccggggtggcactgggattgaccattatcctagaggttctgacaaagataaacgtgatcttctgcaatgaatgtaacatgtaccacagtaaaaagagcattaaatatgtcggcgactttaccaataagtgcggcttctgtacttgcgggctcctggaggaccctgaaggagtggtagttcacaaggctaaaaagtcctgcacgtactcttatcagatcaactgggtgaggggtattatgatctttgtcgccttcctttttgtgatacagaacacaattatcatggtcgcggccgaggaagattgttggaaaaatgaggagctgaaggaagactgcgtgggcccattgattgcacccaaagattgtaccgacaaggatcataagacttacctcagcgaggcttcactgttagccaccgctaaaaagatcacacaagttgacgccgaaaacgtggagatactggggaaaaccatggaaagtgcaatccgggtaattgagcgtcagaagacttaccaccgcatgcatctactcgaggccgtcttcctgaataaacactgcgattattacaagatgtttgaacataactccggatatagccaggtgaagtggagaatgatgatcaaaacacaacacttcgacatttgtgcgcttcaggctaattctcctttttgcgcacagtgtatcgccgataactcatgcgctcagggcagttgggagttcgacacgcacatgaatagcacctactcctctaaggttgataacttcaaacatgacttttcgttgttcctgaggatatttgaagccgcattcccaggtactgcctatgtgcacctcctgacaaatattaaggagaaaaagccgtaccaagctgtcagcatgatcgaaaagatcaagaagaaatttcccaacaataagttgctgattgggtatttggacttcggcaaatacctcctgggattatcccatgcctcaacctacgagctgcagcagcggcagctagataagctctatcaacctacagagctgactcgaagtggcgggcagcagacctctcttgcaaacagcgtggtaggacaggcgacgaaagaatgtaagaagtacaaagacgtgtcctgcttgtcaccacgctttggtatccccctggaggatctcattagctgttgcgaccaacctaattataacatatacaagaaaccaaagaaagtttataaggctcacgataaggaagagacctggtgcatcaatgaccagcactgtctggtcgatttcgtgcccgccgaggcagacacagtggaaaaattaaagccgatgaaatgctggctggtcgatcctggcaagaacgacgatgtttactctattgccatcaaaacttgtagagtggtggacaagggggtatgcaccgtcaactcccagaagtggaatattatcaaatgtgatagtggacccctttattacagcgaccatataccaggcgaggacacaggtaacgatatcgggcactactgcgtgtctgctggctgtaagactgacaggtatcctattaatcccgatgttgtgaccgactgcgtctgggaatttacgtcccggaaatcacagtacatcggaaagattagtatgcaaagccttgaggattatgaaaaagccctcacagaccgcctgacccatactctagagacatactcgttcgcaccactggagaacctcccccacatcaagcctgtgtataaatacataaccgctcagggcgttgaaaattccgatgggattgagggagcctttatcactgcgtctatcccagccgctggtggcaccagcattgggtataacgtgagatcaaaggacggattcccgctgcttgatttgatagtatttgtcaagagtgcagtgatcaaatccacatacaatcatatttacgacacgggccccaccatctctattaacactaagcacgatgaacactgtacaggtcagtgccctagcaatatcgagcatgaagccaactggctgaccttctcccaagagaggacatcacgttgggggtgtgaggagttcggctgcttagctgtgaatactggatgcgtctttggcagctgtcaggacgttatacggccagaaaccaaagtgtatcgaaaggccgtagatgaagtggtcatcctcacggtgtgcattacataccccgggcacaccttctgtactgagatcaacgcaattgaacctaaaatcaccgaggagatagaactgcagtttaagacagttgacactaagacccttccatatattgtggcggtcaataaccataaactgtacagtggacagatcaatgacttgggcacattcggtcaaatgtgcgggaacgtgcagaagacgaactcttccatcctcggaaccggcactcccaaatttgattatacatgtcacggtgccagcagaaaggacattatcgttaggcgctgctacaataacaatttcgattcgtgtaaactgctaaaggaggaaacccagctgatatttaacgacgatcatgacactattacagtgtataataccaaccacctcatcggcgagctggctattaaacttatcttgggggatatacagtacaaactgttcacggagactttagacctccaaattgatgccaagtgcgtcggatgtccggactgctttgaatcatactcttgtaatttccagatcgtaagtaacatcgataccatttgctccctggagggcccttgcgacacatttcacaatcggatcagcattaaagcaatgcagcagaactatgctgtgaaactttcttgtcaaaaggacccaagacccagcgggaccttcaagatatgcaatagggaatacactgttgtgttccatacagtcgccaaggatgacaaaatcgagattaacgtgggagatcagacctcctttatcaaggaaaaagacgatcgctgtaagacatggctgtgccgagtacgggacgagggcatctcagtgattttcgagcctataaaagcatttttcggtagttattttagcatcttcttttacattatcgtcgttgtggtggtcgggttcctaattatctatatatttatgcccatgttcatgaagctcaaggaagtgctgaaagccaatgagaagttgtacctgcaggaaatcaaacaaaagtga

SEQ ID NO: 10857 - RNA, 4311 nt, synthetic construct
  misc_feature 1..4311: note = derived and/or modified CDS sequence (opt3) from BUNV(SFCrEq231)__KP063893.1__GP
  source 1..4311: mol_type = other RNA
atgaagatgatcctgctcattataatcctttgcgtgaacctggccgctgcaaatcccgtcgccaccagatgtttccacggcgggcagttgattgcggagacaaggagcgctacttccatctctgaattttgcttaaaagacgatgtttcaatgattaagagtgagatcacgtacaccaaaaacgacacaggaatattcggtcatagcaagatctataaatcctggctgattaaggattggaagctatgtaatcctgtgccaactgccggcgggtctatcaacgtaattgaagttaattcggacctctcactgaccacaaaagcatacgtctgcagccgggattgtaccatcactatagacaaggaggaagcccaaattatctttcagacagataaacttaaccacttcgaggtgagtggaaccacgctgtcctctggctggtttaagactaaagctagcgttaccttggaccgcacatgcgagcatattaaggtgacttgtggtaagaaaaccctccagttccacgcatgctttcgacatcacatgtcctgtgtccgtttctttcacaatacaatcctgccggggaccatggtgaactcaatgtgccagaatatcgaactgattataatcctcggattaacgctgattatcttcactcttatggtaatattgacaaagacctatatttgttacatcctgatgcccctatttatgcctatcgcctatgcttacggctgggcctataacaaaagttgcaagaaatgcaattgttgcggcctcgcgtaccatccattcactaactgtgggagccactgcgtttgtggactgaagtttgaggcatctgatagaatgaggattcatcgggaatccggtctttgccaaggctacaaatcactgcgcatcgccagattgctctgtaagagcaaggggagttctctgattatatccacattactgagcatgctccttctgtcgttcatcacccccattgagggaacgatgaccaattatcctgagacaaggcagtactctttggaagagatcgctgacgtggtcgaaggcctactgtccgagcagaacatcaaagaatatgtggtgttctacacttcactctttggtagtctgattcttctgttggccttcatactcagcatcaccctgacaaaggtcactaatgcattagctcggaccaacgttatttattgcgaggagtgttccatgtaccacgccaaaaaggggatcaaatataacggagattttacaaataagtgcggcttctgtacctgcgacgaacaggaggatgaagagggcattatcatacacaaggtgtctaaaaagtgcacttaccgctaccaactgcagtgggcgaaaatcattatgatcattctagtaatgctcctgatgatgcagaacacgatccttatagtggccgcagaaacagactgttggaccaagaatagcttggagctggactgcattgggccactcctgactatctcagattgtagtaacaaagagtccaagaattatgaagaggaagctgccaaacttgtcagccagtctaaaattacccaagctgacgccgaacaggtgacaatcctgggaaacaccatagatactgcattgaaggccatccgatcacagaaaacataccaaacgatgcatctcctggaaagtgtgtttttaatgaagaattgcgactattacagctccttcgagcccaactctggttattcgcaggctaaatggagactgattgcgaagaccagccactttgatatctgttccaggcattcaatgcaccatttctgccggtgtgtggcagacggcactaagtgccagaatggggattgggactttgccggagagatgaacaatatttacagtacaaagaacgatttctatctacacgacctcaatctgtttttcacccttcacgaaacagcttttcctggcactaccgagtctttgttctaccagctgatcgccaagaaaaacacgaccggtgcaagcaagctcctggggaaattaataacaaagtacggcaataacaaactgttcgtcggaatttggaagtttggccaatatcttttgactctcccatacgtgaacaccacagaactgtccaagactcgtcgcgagaccatcctaaaaacgcatcagatcctgacaagatcacaagggggaaggagcgagtctatgtccagtgccgaagtaggtcagattgctaaggagtgtgccaatgcaaagaacgttggctgcatcagcccgcggttcgggattcccataggaaatctcaccgcgtgtggcaactctcctaattataagatctacaaaactccaaacaagatttataagtccaataaccgaggtgaagtgtggtgctcagaggatgtccactgcctggctgactttgaacccgccgacacagaggtggtcaataaagtgaagaaaatgacctgtttccttagtgatgttaacactcgcgcagacatctttagcattgccatctcggcttgcagaatggtggataagggggtatgtaccgtcaatggcgccaaatggaacatattgaagtgcgagtccggactgtactatttcacagaccatagggaaggccaggatacggggaatgactttggagagtactgtatctctcacagctgcaacaccgaacggtaccctattaatccagatatcttaaaggagtgtatttgggaatatcactcacgcaaaagtaagtacatctccactataaacctcgagtctctggaggagttcaaaagagcaatgagcgacaaactttcccatacactgatggtgtataactttaaacccaccgctaatttgccgcacattaagccttcatacaagttcatcacagccaacggtatcgagaatagcgatggcctcgaaagtgcgtatattctgtcttccatacccgccatcgggggaatgagcattggctacaacatccagactaaagacaattttccactactggatctcattgttttcgtgaagtcggctgtcatcaaaaccacgtataaccatatatacgacacaggtcctaccatcgggattaatactaaccacgatgagcattgcaccggcccctgtccaacaatcattccccacaaggaaaattggctgactttttcacaggagaggacctctcgttggggatgcgaggagttcggctgtcttgcaatcaacacagggtgcgtgttcggaagttgccaggacgtaatacaccctgaaacgaaaatttaccggaaggccgtggaagaggaggttgtcttgaccgtgtgtatcaattttccaggcaacactttctgcacagaaatcaatgctattgagccgaaaatcaccgacgaaatagagctgcaatttaagactgtggatacaaagaccttacccaacctcctggccgtccagaatcataaactttattccggtcagattaacgacctggggagcttctctcagggatgtggcaacgttcaaaagacgaatcagagcatcctaggtgcaggcactgtgaaatttgattacgtgtgccacggggcgtcccgaaaggacattatcgtaagaaggtgttataccaacaattacgattcatgcaaactcctgaaggaggaacgcagtttgatattcgccgacaaccatgagacactggaagtcgctaatacccggcacttaattggagagctccagtttaagatcatgctgggcgatatcagatataaagccttcgcagaaaagcctgagcttgaaattgacgctaaatgtgtggggtgcccaagctgttttgagtcttactcctgcaacttccaaatcgttacttcaattgatacagtgtgtagtgtcgagggaccctgcaccctgtttcataataggataatcattacagccgcaaagcagagctatggcgtgaaaatgtcctgcaagactaagcctggtccagttgaagagttcaccatctgtaaccgcaattaccgagtgtctttcgccacgatcgacaaaaacgataagattgaaataaatacaggggaccagacctcgtacatcgtagagaaagatagccggtgcaagacttggttgtgtcgtgtcagagacgaaggaatttcagtgatctttgagcccctcaaggctttctttggctcctatttcagtattgcgttttacatcataatcggtattgccgcactgttcctaatcatttatatctttctgccgatgttctttaaacttagggacgtgctcaagaaaaacgagtacctgtatttgcaggaactgaagcacaaatga

SEQ ID NO: 10858 - RNA, 4302 nt, synthetic construct
  misc_feature 1..4302: note = derived and/or modified CDS sequence (opt3) from BUNV(GSA/S4/11232/WT)__KM507339.1__GP
  source 1..4302: mol_type = other RNA
atgagaatcctgattctccttctggccgtgaccaagttggctgtcggcagccccgttgtgacaaggtgcttccacgggggacagttaatagcagagcggaaatcccaaacttctatctcagaattttgtattaaggacgatgtaagtatgctgaaaagcgagatcgtgtacacgaagaacgacaccggtattttcggccattccaaagtctttcgccactggacaatcactgattggaaggcctgcaatcctgtggttaccgctgggggatctataaacgtgatcgaagtcgacaagaatctaaacctcgtgacacgaaattatgtatgtaccggcgattgcactattacagttgacaaagagaacgctcagatcattttccagaccgatcgtctgaatcattttgaagtgacgggtactaccatctcgacagggtggttcaagtcaaaagccagcgtcactcttgacagaacctgtgagcacataaaggtgagttgcggcaaaaagacactgcagtttcatgcatgtttcaagcaacacatgtcctgcgtgaggtttttgcaccggtctattctcccaggaagcatggccatctccatttgtcagaacatcgagctgatcattataaccatcctggctctctgcattttcatcataatgattatcttaacgaaaacttacatctgttatgtcctgattccggtttttatgcccatcgcattcgcctacggctgggcttataatcgctcatgcaagaaatgcacatgttgcgggcttgcctaccatccttttaccaactgtggaagttattgcgtgtgtggtagcaagttcgaaacttctgatagaatgaggatgcaccgggagtccggcttgtgccaggggttcaaatcactgcgcgtagcgcgaagactatgtaagagcaaaggaagttctctcattatatccatcctgcttagcgtgctgattttgtcgtttgtcacaccaatcgaaggcaccctcacgaattaccccaccgaccagaagtacacactggatgagatcgcagacgtgttacaagccaagactcatgaggattctaccaaatattacattatactgtatacatccctcttcggtgctgggcttactatcatttttgccggagttgcactgggcttgaccatcattctagaagtgctgacaaagatcaacgtcatattctgcaatgagtgtaacatgtaccacagtaaaaagtcaatcaaatatgtgggcgactttaccaataagtgcgggttctgtacttgcggactcctggaagaccctgagggtgtagttgtgcacaaggctaaaaagagctgcacgtactcctatcagatttcttgggtcaaaggcatcatgatttttgtggccttcctttttgtcatccagaacacaataattatggtggcggccgaagaggattgttggaagaacgaggaactgaaagaggactgcgttgggccattgatcgcacccaaggattgtaccgacaaggataggaaaacttacctcagcgaggcttcactgttagccaccgctaagaaaattacacaggtggacgccgaaaatgtagaaatcctgggaaagaccatggagagtgcaatacgggtcatcgagcgtcagaaaacttaccatcgcatgcacctactcgaagccgtgttcctgaacaagcattgcgattattacaagatgtttgagcacaattccggctatagccaagttaaatggagaatgatgattaagacacagcatttcgacatctgtgcgcttcaagcgtcttcacctttttgcgcacagtgtattgccgataacagttgcgctcagggtagctgggagttcgacacgcacatgaactccacctactcttcgaaagtggataatttcaagcacgactttagcttgttcctgaggatctttgaagccgcattcccagggactgcctatgtccatctcctgacaaatataaaagaaaagaaaccgtaccaggctgtgtccatgattgagaagatcaagaaaaagtttcccaacaataaacttctgatcggctatttggacttcggaaagtacctcctgggcttatcacacgccagtacctacgagctgcaacagtctcagctagataaactctatcagcctacagaactgactcggagcgggggacaacagacctcccttgcatcaagcgtagtgggtcaggcgacgaaggagtgtaagaaatacaaggacgtttcttgcttgtccccacgatttggcattcccctggaagatctcatcagttgtggggaccagcctaactataatatttacaaaaagcccaaaaaggtctataaggctcataacaaagaggagacctggtgcataaatgatcaacactgcctggtggacttcgtgccagccgaagcagatacagtcgagaagttaaaaccgatgaagtgttggctggttgaccctggcaaaaacgatgacgtgtacagcatcgccattaagacttgccgcgtgatcgataagggagtatgtaccgtcaattctcagaaatggaacattatcaagtgcgactccgatcttttgtattactcagaccacgtgcccggtgaagacacagggaacgatataggccattactgtgttagtgctggatgcaaaactgacagatatccaatcaatcctgatgtggtcaccgactgtgtgtgggagtttacgagcaggcggtcgcagtacattggcaagatctccatgcagtctctcgaagattataaaaaggccctgacagaccgcctaacccacactctggagacatacagcttcgcacccctcgagaacctgccacatattaaacccgtttataagtacatcaccgctcaaggggtggaaaattcagatggaatagagggtgcctttattactgcgagtatccctgccgctggcgggacctccatcggatataacgtaagatctaaggacggcttcccacttttggatctgattgtctttgtgaaaagcgcagtgataaagtccacatacaatcacatctacgacacgggtccgaccatttcaatcaacactaaacatgatgaacactgcacagggcagtgtcccagcaatattgagcacgaagccaactggttaaccttcagtcaggagaggacatctcgttggggctgcgaggagttcggatgtctcgctgtcaatactggctgcgtttttgggtcctgccaagacgtgatccggcctgaaaccaaggtatatcgaaaagccgtggatgaaatagtcatcctgacggtgtgtattacatacccaggacataccttctgcactgagatcaacgcaattgaacccaagatcaccgaggagatagaacttcagtttaagacagttgacactaaaaccctgccttatattgtggcggtcaataaccacaagttgtacagcggccagatcaatgacctcggtacattcgggcagatgtgtggaaacgtgcagaaaaccaattcgtcaatcctgggcacgggtactccaaagtttgattatacatgccatggcgcctctagaaaagacattatcgttaggcgctgttacaacaacaatttcgatagttgcaagctactgaaggaggaaacccaactcatatttaacgacgatcacgacactattacagtgtataataccaaccatctgatcggggagcttgctattaaattgatcctgggagatatacagtacaagttattcacggagactctcgacctgcagattgatgccaaatgtgtcggctgccccgactgttttgaatcctacagctgcaatttccaaatcgtatctaacatcgataccatttgtaatcttgaggggccgtgcgacacatttcacaaccggatcagcattaaggcaatgcagcagaattatgctgtgaaactgtcctgccagaaggaccctggaccatcaggcaccttcaagatatgtaacagagaatacactgttgtgttccacacagtcgccaaagatgacaagatcgagattaatgtgggtgatcaaaccagttttatcaaagaaaaggacgataggtgcaaaacatggctatgtcgcgtacgagacgaggggatcagcgtgattttcgagcccataaaggcatttttcggatcttatttttccatcttcttttacattatcattatcgtcgttgtgggcttcctcataatctatatttttatgcctatgttcatgaagctgaaagaagtgttgaaggccaacgagaaactgtacttacaggaaatcaagcagaaatga

SEQ ID NO: 10859 - RNA, 4302 nt, synthetic construct
  misc_feature 1..4302: note = derived and/or modified CDS sequence (opt3) from BUNV(MGD/S1/12060/WT)__KM507340.1__GP
  source 1..4302: mol_type = other RNA
atgagaatcctgattctccttctggccgtgaccaagttggctgtcggcagccccgttgtgacaaggtgcttccacgggggacagttaatagcagagcggaaatcccaaacttctatctcagaattttgtattaaggacgatgtaagtatgctgaaaagcgagatcgtgtacacgaagaacgacaccggtattttcggccattccaaagtctttcgccactggacaatcactgattggaaggcctgcaatcctgtggttaccgctgggggatctataaacgtgatcgaagtcgacaagaatctaaacctcgtgacacgaaattatgtatgtaccggcgattgcactattacagttgacaaagagaacgctcagatcattttccagaccgatcgtctgaatcattttgaagtgacgggtactaccatctcgacagggtggttcaagtcaaaagccagcgtcactcttgacagaacctgtgagcacataaaggtgagttgcggaaagaagacactgcagtttcatgcatgtttcaagcaacacatgtcctgcgtgaggtttttgcaccggtctattctcccaggcagcatggccatctccatttgtcagaacatcgagctgatcattataaccatcctggctctctgcattttcatcataatgattatcttaacgaaaacttacatctgttatgtcctgattccggtttttatgcccatcgcattcgcctacggctgggcttataatcgctcatgcaagaaatgcacatgttgcgggcttgcctaccatccttttaccaactgtggaagttattgcgtgtgtggtagcaagttcgaaacttctgatagaatgaggatgcaccgggagtccggcttgtgccaggggttcaaatcactgcgcgtagcgcgaagactatgtaagagcaaaggaagttctctcattatatccatcctgcttagcgtgctgattttgtcgtttgtcacaccaatcgaaggcaccctcacgaattaccccaccgaccagaagtacacactggatgagatcgcagacgtgttacaagccaagactcatgaggattctaccaaatattacattatactgtatacatccctcttcggtgctgggcttactatcatttttgccggagttgcactgggcttgaccatcattctagaagtgctgacaaagatcaacgtcatattctgcaatgagtgtaacatgtaccacagtaaaaagtcaatcaaatatgtgggcgactttaccaataagtgcgggttctgtacttgcggactcctggaagaccctgagggtgtagttgtgcacaaggctaaaaagagctgcacgtactcctatcagatttcttgggtcaaaggcatcatgatttttgtggccttcctttttgtcatccagaacacaataattatggtggcggccgaagaggattgttgggagaacgaggagctgaaggaagactgcgttgggccattgatcgcacccaaagattgtaccgacaaggataggaagacttacctcagcgaggcttcactgttagccaccgctaaaaagattacacaggtggacgccgaaaatgtagagatcctgggaaaaaccatggagagtgcaatacgggtcatcgaacgtcaaaagacttaccatcgcatgcacctactcgaggccgtgttcctgaacaaacattgcgattattacaagatgtttgaacacaattccggctatagccaggttaagtggagaatgatgattaaaacacagcatttcgacatctgtgcgcttcaagcgtcttcacctttttgcgcacagtgtattgccgataacagttgcgctcagggtagctgggagttcgacacgcacatgaactccacctactcttcgaaggtggataatttcaaacacgactttagcttgttcctgaggatctttgaagccgcattcccagggactgcctatgtccatctcctgacaaatataaaggagaaaaagccgtaccaggctgtgtccatgattgagaaaatcaagaagaaatttcccaacaataaacttctgatcggctatttggacttcggaaaatacctcctgggcttatcacacgccagtacctacgaactgcaacagtctcagctagataagctctatcagcctacagagctgactcggagcgggggacaacagacctcccttgcatcaagcgtagtgggtcaggcgacgaaagaatgtaagaagtacaaagacgtttcttgcttgtccccacgatttggcattcccctggaggatctcatcagttgtggggaccagcctaactataatatttacaagaaaccaaagaaagtctataaggctcataacaaggaggaaacctggtgcataaatgatcaacactgcctggtggacttcgtgcccgccgaggcagatacagtcgaaaaattaaagccgatgaaatgttggctggttgaccctggaaagaacgatgacgtgtacagcatcgccattaaaacttgccgcgtgatcgataagggcgtatgtaccgtcaattctcagaagtggaacattatcaaatgcgactccgatcttttgtattactcagaccacgtgcccggtgaggacacagggaacgatataggccattactgtgttagtgctggatgcaagactgacagatatccaatcaatcctgatgtggtcaccgactgtgtgtgggaatttacgagcaggcggtcgcagtacattggcaaaatctccatgcagtctctcgaggattataagaaagccctgacagaccgcctaacccacactctggagacatacagcttcgcacccctcgaaaacctgccacatattaagcccgtttataaatacatcaccgctcaaggggtggaaaattcagatggaatagaaggtgcctttattactgcgagtatccctgccgctggcgggacctccatcggatataacgtaagatctaaggacggcttcccacttttggatctgattgtctttgtcaagagcgcagtgataaaatccacatacaatcacatctacgacacgggtccgaccatttcaatcaacactaagcatgatgagcactgcacagggcagtgtcccagcaatattgaacacgaggccaactggttaaccttcagtcaggagaggacatctcgttggggctgcgaagagttcggatgtctcgctgtgaatactggctgcgtttttgggtcctgccaagacgtgatccggcctgaaaccaaagtatatcgaaaggccgtggatgagatagtcatcctgacggtgtgtattacatacccaggacataccttctgcactgaaatcaacgcaattgagcccaaaatcaccgaggaaatagagcttcagtttaagacagttgacactaagaccctgccttatattgtggcggtcaataaccacaaattgtacagcggccagatcaatgacctcggtacattcgggcagatgtgtggaaacgtgcaaaagaccaattcgtcaatcctgggcacgggtactccaaaatttgattatacatgccatggcgcctctagaaaggacattatcgttaggcgctgttacaacaacaatttcgatagttgcaaactactgaaggaagagacccagctcatatttaacgacgatcacgacactattacagtgtataataccaaccatctgatcggggagcttgctattaagttgatcctgggagatatacagtacaaattattcacggaaactctcgacctgcagattgatgccaagtgtgtcggctgccccgactgttttgagtcctacagctgcaatttccaaatcgtatctaacatcgataccatttgtaatcttgaagggccgtgcgacacatttcacaaccggatcagcattaaagcaatgcagcagaattatgctgtgaagctgtcctgccagaaagaccctggaccatcaggcaccttcaagatatgtaacagagagtacactgttgtgttccacacagtcgccaaggatgacaaaatcgaaattaatgtgggtgatcaaaccagttttatcaaggagaaagacgataggtgcaagacatggctatgtcgcgtacgagacgaggggatcagcgtgattttcgaacccataaaagcatttttcggatcttatttttccatcttcttttacattatcattatcgtcgttgtgggcttcctcataatctatatttttatgcctatgttcatgaagctgaaggaggtgttgaaagccaacgaaaagctgtacttacaggagatcaaacagaagtga

SEQ ID NO: 10860 - RNA, 4308 nt, synthetic construct
  misc_feature 1..4308: note = derived and/or modified CDS sequence (opt3) from Ab-BUNV(Cu20-XJ)__KJ710423.1__GP
  source 1..4308: mol_type = other RNA
atggccatcagcattgtgctgatgataatcttctccaccacatcttgcctcgctagagcagccccctcaattagtaagtgttttcaggacggcgtccttatcgcggagaaaaagagctcctctgggatttcggagttctgcatcaaagatgacatatcaatcctaaagagcgaaattaactacagtaaaaatgatactggaatctttatgcactccaaggttttcaggcattggacggtggctgactggaagcaatgtcagcctattccatctgccggtggcagcatcaacgtattggaagtggataaaaatttaaacctggtcgcaaagaattatatgtgcacccggccgtgtgtgataacaattgacaaagagaacgcccagctactctttcagactgaacaactgaatcagttcgaggttaccgggacaaccatctccactggatggtttaagtcaaaaacaagtgtgagccttgataatacctgcgagcacattaaggtcacgtgtggcaagaaatctctgcagttccatgcttgctttaagcagcacatgtcctgtgtgcgcttcttgcatcgatcagtactccccggttacatggcaaacagcatctgccaaaacatcgaactgattataatcattactctgaccctcgccatctttatattcatgtgtattatcacacgtacttatatctgctacattatgttacctctgtttgctccaatcgcctatatttacgggtggctttataatagaagttgcaaaaagtgtatatgctgtggattggcgtaccaccccttcaccaactgcggctcttactgtgtttgcggctccaggttcgagacaagcgaccggatgcgcctgcacagagaatcggggctatgtcagggatttaaatctctcagggtggcacggaccctgtgcaagtccaaaggttcaagtcttgtcatcagcgtgctgacggccatgttgattctctccttcgtgactcctctggaggctatctctacaaattatccaaccgatcgcaagtacactttaaacgaggtcaatgacatcgttctgggcaaggggacagaaaacgagctcaaaaccagcattcttgccctggtgtcaatatgtggaatcggcattatcattatctttatagcattgacgatgctactggatatcgtactcgaagctattgccaagcgaagtaccatcttctgcacagagtgtaacctgattcatgacaaaaaggcgatgaaatttgtgggtgatttcactaataagtgcgggttttgcccctgtggagaacttgaggaccctgagggcctggtcatccacaccacaagaaagtcctgcacttattacataaaaattaggaacttgaagctcatcatgctggtgttcagcattgccatcttaatgcagaataccgcaatgctggttgtggctgacgaaaactgttggacaaataccgagataaaagccgattgcgtcggcccactaatcgggccgactacgtgtacaaacaagggatctaaaacctataaggctgtggcccaggaactcgtaacttcaaataagattacccaactggacgcagataaatacacacttttgggtgacaccatcgagagtgccctgagcgctattactgaacagaagcattattccgcgatccacctcctggagacaatatttcttatgaaacactgcgattactacaaggtttatgagcataactctggctactcgcagacgaaatggcggctgattgcaaagaccaatagcttcgacatctgttccatcccctcaactcctaacttttgcaagtgtttgagtgattctagctgctccacatcaaccctcaatttcgccacaagcatgaactctacttatacctccaaagctgaatactttaatcacgacttcacgctgttcttaaacatttttgaggccgcattcccagggagtgccaccgcttttctgttcaagaaaatcaaggaaaaagccccctatcaagcatttgagatgatgggaaagattgcgaataaataccctaacaacaagctactcgtggtcctgcttaagtatggccagtacatggtgggtttgagccatgcttctacataccagctgaaacaggaatggatagccaagtccctctcactggtccgtagtactaaaaccgggttaaagatggcaatgacaaatgccgagccaggccccgctactaaagagtgtagcgatgccaagaccatcgcatgcctgacgccgaagttccaagtggaagttaacaatcttatgtcgtgcggagcttcccctaactttaaaatttatatgaagtctggcgagttgtacaaagcccacgaccgcaatagcgtgtggtgtctcaacgatatgcattgcctgacaccctataccccagcgaatgccgaactggtagctactatgaagaaaatggagtgttggcaggacaaccctaagcagcccacaaatgactacgcaaccccaagaaggtcatgccagatgaaggatcgggggctgtgtaacgtcggagccgacaaatggaaggtgatcaaatgcgatgacgatctcatgttctatactgacgctctggagagtcccgatcctgccgcagacattggtcaatactgtttttccgaaaagtgccagatcgagcgatatccaataaatccgacctctcttacaaactgtgaatggttgtaccgcgcggttaaaccccagtacatcaagagactgagcttacagacgattgaggaatataagaaagccatcaccgataagctcactcacacactgcaactttaccacttcgctcctctggagaatttgccacatattaggcccacctatgagtacatcacagcccagggcacttataccgcagacgggatagaaggagcttccattatcacgtcaatccctgccctcagcggcacaagtgtgggttttaaaattaacgcaaaggatgggaccgccctgctagacatagtcgtgtacatcaaatcttccgtagttaagagcgtgtataatcacatttacgatactggcccaaccatcaacattaactcgaaacatgacgagctgtgcacaggacagtgtcccaagcggatcccggctgaccctaattggctcactttctcacaggaacgcacctctagatggggctgcgaggaatttgggtgcctggcgataaacacaggatgtgtctacggtagttgccaagatgtgatcaggacggagaccaaggtgtatcgtaaagccaatgaggaaactgtcatgcttacagtttgtattacctacccaggccacactttctgcacagacgtgaacgcattggagcccaagatcaccgatgaactggagttacagttcaaaacgattgacatcaagtccctccctaatctggtggctataactaaccacaaactttataccgggcagattaatgatctgggaacatttggccaaatgtgtggtaacgtacagaagaccaatactagcatcctaggggccggcacacccaagttcgactatacctgctactctgccagccggaaagatatcattatccgaagatgttacaacaataactatgactcctgcaggctcctgaagcaggaaggagatttgctgtttgacgataatcatgagacattaatagtctacaacaataaacgcctcaacggcgagctgactatgaagttgctgttgggggacattcagtacaaactctataccgaaaacatggagctggaactagaggctaagtgtgtgggatgcgttggctgtttcgagtcataccaatgcaatctgcagatcacgagtagccttgatggtaactgcgcaatttctgggccatgtgaaacatttcacgaccggatccagataaagaccactaaaaaggactatgccctcaaactggcgtgcaccaaggatcctggagacaaagctacattcagagtgtgtggcaaggattacgactttaatttccatactgtcgtgaagaacgataaaattgaggttaatgtgggtgacgaaacctcctatatcaaggagaaagatgccaggtgcggcacgtggttgtgtcgcgtacgagacgaagggctgtcagtcatctttgagcccttaaagaacttctttggaaattacctcaacatgttcctgtatattcttggcggggtgctgcttctcttcctgagtctatacatcattatgccagtgtgcgcacggctgcgtgatgagcttaaaaagaatgaaaagctccaccagatggagatgaaaaagagatga

SEQ ID NO: 10861 - RNA, 4305 nt, synthetic construct
  misc_feature 1..4305: note = derived and/or modified CDS sequence (opt3) from ANADV(EIV-13128Kam)__KT313718.1__GP
  source 1..4305: mol_type = other RNA
atgttcctgatcctcgtgcttctgattcccttttacataaccgccacacctgtcactacgagatgcttccacggcgggcagttgatcgctgagagcaagtccttaaccgcaatttctgaattttgtctgaaagacgatgtttcaacagtgaagagtgagatcacttatctcaaaaacgacaccggaattttcgcccatagcaaggtactaaggaattggatcataaaagattggaagaactgcaatccagtgccgacagcgggtggctccatcaacgtcattgaagtgaataccgacctgtctctttcgactaagacatacgtttgttcacgggattgcaccatcacggtggacaaagaggatgctcaaattatctttcagactgacaagctgaaccacttcgaagtcagcgggaccacattgagttccggatggtttaaaactaaggcctctgtgaccctcgatcgcacatgtgagcatataaaagtaacctgcggcaagaagacgctgcagttccacgcatgttttaaacatcacatgagctgcattcgattctttcacaatactatcctgcccggtacaatggccgtttccatttgtcagaacatcgagctcatcattataacctcattaactctgatcattttcatccttatggtgatattgacaaagacctatatttgctacgtcctgatgcctctatttatgccagtggcttatctctacgggtgggcatataatcgtagttgtaaaaagtgcagctgctgtggactggcctaccatcccttcacgaactgcggctctcactgtgtgtgcggccttaaattcgaggcttccgacagaatgaggatccatcgggagtcagggctgtgtcaaggatacaagagcttgcgcgtcgccagactcctgtgcaaaagtaagggttcttccttaatcattagcatcctgctctcggttcttattctgtcttttgtgacccctatagaaggcacattgactaattatccagagtccaagaaatactcactagaggaaatcgcggatgtaattgaggggttcatcgcagaaaagggaatcaaagagtatattgtgctgtacaccagtatatttggcgccctcctgcttctgatcgctttgattatcacagtcagcctcaacaggattactgaatatctgaccaatttaaacgtgatctactgtcacgagtgctccatgtatcactctaagaaaaatataaagtacatcggtgacttcacaaacaagtgtgggttttgcacctgtggagagctggaagatcaggagggcctaaacatgcataaagttagcaagaaatgcatttaccggtatcagctcacttggtcaaaggtgatcatgacgattctggtctgccttttgatcgcccagaatacagtgctgatagtagcagctaacgacgactgttgggccaaacaaagtctcgaaattgagtgcgttggccccctgcaacaggtggatgcgtgtgaagacaagtccagccgctcttacaatggggaggccaagaaacttgtcggaacctcaaaggtgactgagctggatgcaggtcaggtcaacttgctcggccagaccatcgaaagtgctattatcgccatacgaaaacagagaacatatgctaccatgcacttcctggagagcgtgtttttagggaggcattgcgactactataaggttttcgaacacaattccggatactctcaggccaaatggcggctgctagcaaagactaaccattttgatatctgttcgcgtcacagcacacaccatttctgccgctgtatgtccgacggcacgaagtgcgagaatggtaactgggattttgccggggaaatgaataccacttatcactcaaaaagagacttctttaagcatgatttcaacctcttctgtacactgcttgagaatgcttttcctggcaccacagagagtttgtactaccaactgctctctaaaaggaacactaccggagcgagcaagctgttaggcaaactgattacgaagttcgggaataacaatctttttgtgggaatctggaaattcggtcagtttttgctctccctgccatatgtaaacaacaccgaactatcagcactgcagagctctaagattctcgagtccccggaacccctgcttcggagtgccagcggccgacaggagtctttgtcctcaacaactcctggggaggctagtaaggaatgccgcaatgccaaaaagatcagctgtatatcgccaagattcggagtccccatggagaacctgaccgcatgcggcgaatcccctaattacaaaatttataagacaccaactaggatctacaaatctaacaataagggtgagatctggtgcgccggggacgtgcactgttttcaagaatttacccccgttttacaggaggtggtcgataagctcaaaaagatgacgtgctttctgacagagccggaagctgaggaagacgccttcagcattgcaatcgcgatgtgtaaaattcttgacaagggcgtgtgcaccataaactcagagcggtggaatatcattaaatgtgatagtggactgatgtattacactgaccagcgcgatggccaggacacagggaacgattttggagaatattgcatctcccacaattgtaagaccgagagattccctattaacccctctatcataagcgactgcatctgggagtaccattccaggaagtcacgttacattagcactttgaatctcgaaagtctggaggaatttaaacgggctatctctgagaagctatcccacaccctggtagtgtatcaattcaaaccaacaagcaacctccctcatatgaagcccgtttacaaatatattacggcccagggtgtcgaaaattcggatggcatcgactcagcattcataaccgcctctatgccagctctgagtgggacttccattggatacaacgtgatgagcaaggataattttccccttttcgacatcatcatttttataaagtctgccgtgatcaaaacaacctataaccacatttacgatacaggccctactatcggtattaacgtcatgcatgacgagcactgtaccgggcagtgcccaatcgagataccgcacaaggaaaattggttgacgttcagccaggagcgaacatccagatggggctgtgaagagtttggatgcctggcaatcaacaccggctgcgttttcgggtcatgtcaagatattatcaggcccgagactaaagtgtatcgcaaggctattgaagagagtgtgttactcaccgtatgcgtcacataccctggaaatactttttgtaccgaaatcaacgccatagagccaaaaattacagacgaactggagcttcagttcaagacggtggacaccaaaactctgcccaatctactcgcggttcagaaccataagctgtacagcggccagatcaatgatttgggttcttttgcccaagggtgcggaaacatccagaagacaaatctgtccgtgattggcaccggtactgctaaattcgactatatctgtcacggcgcatcacggaaggatatagtcgtgagaaggtgctacaacaataactatgagagttgtaaattactcaaggaagaacctagcctgattttctccgacaatcatgaaacaatcgaggttgccaacattcgccaccttctgggggaattgcagttcaaactcatgctgggagatctacgatacaagtctttcgctgagaatccagagctggaaatcgaggccaagtgcgtgggctgtccctcgtgctttagctcatattcctgtaacttccggataagttctagcattgacaccgtatgcgcaatcgatgggccgtgcacgatctttcataaccgtcttattatctcctcaactaaacaagactacggaattaagatgtcttgtaaagaaaagcctaatccagtcgagaaattcaacatatgcaagagaatctatagcgtgctctttaccacaattgataagagtgacaaaatcgaaatcaataccggcgatcagacttccttcattcaggagaaggacgataggtgtaaaacatggctgtgccgcgtgcgggacgagggtataagcgtcatctttgaacccattaaggcgttctttgggtcttacttctcaatcgccttttacgttgtgattggaatcatagctttgttcatcaccatttatatctttctgcctatggtattcaaattaaaggacattctcaagaaaaacgagctgctttacctgcaggaaatgaagtataaatga

SEQ ID NO: 10862 - RNA, 4305 nt, synthetic construct
  misc_feature 1..4305: note = derived and/or modified CDS sequence (opt3) from ANADV(EIV-13130Kam)__KT313721.1__GP
  source 1..4305: mol_type = other RNA
atgttcctgatcctcgtgcttctgattcccttttacataaccgccacacctgtcactacgagatgcttccacggcgggcagttgatcgctgagagcaagtccttaaccgcaatttctgaattttgtctgaaagacgatgtttcaacagtgaagagtgagatcacttatctcaaaaacgacaccggaattttcgcccatagcaaggtactaaggaattggatcataaaagattggaagaactgcaatccagtgccgacagcgggtggctccatcaacgtcattgaagtgaatgctgacctgtctctttcgaccaagacttacgtttgttcacgggattgcacaatcaccgtggacaaagaggatgcccaaattatctttcagacggacaagctgaaccacttcgaagtcagcgggactaccttgagttccggatggtttaaaacaaaggcatctgtgactctcgatcgcacctgtgagcatataaaagtaacatgcggcaagaagaccctgcagttccacgcctgttttaaacatcacatgagctgcattcgattctttcacaatacgatcctgcccggtactatggctgtttccatttgtcagaacatcgagctcatcattataacatcattaaccctgatcattttcatccttatggtgatattgactaagacatatatttgctacgtcctgatgcctctatttatgccagtggcatatctctacgggtgggcctataatcgtagttgtaaaaagtgcagctgctgtggactggcttaccatcccttcaccaactgcggctctcactgtgtgtgcggccttaaattcgaagcctccgacagaatgaggatccatcgggagtcagggctgtgtcaaggatacaagagcttgcgcgtcgcgagactcctgtgcaaaagtaagggttcttccttaatcattagcatcctgctctcggttcttattctgtcttttgtgacgcctatagaaggcaccttgacaaattatccagagtccaagaaatactcactagaggaaatcgcagatgtaattgaggggttcatcgccgaaaagggaatcaaagagtatattgtgctgtacaccagtatatttggcgctctcctgcttctgatcgccttgattatcactgtcagcctcaacaggattacagaatatctgactaatttaaacgtgatctactgtcacgagtgctccatgtatcactctaagaaaaatataaagtacatcggtgacttcaccaacaagtgtgggttttgcacatgtggagagctggaagatcaggagggcctaaacatgcataaagttagcaagaaatgcatttaccggtatcagctcacctggtcaaaggtgatcatgactattctggtctgccttttgatcgcacagaatacggtgctgatagtagctgccaacgacgactgttgggcgaaacaaagtctcgaaattgagtgcgttggccccctgcaacaggtggatgcctgtgaagacaagtccagccgctcttacaatggggaggcaaagaaacttgtcggaacatcaaaggtgaccgagctggatgctggtcaggtcaacttgctcggccagactatcgaaagtgccattatcgctatacgaaaacagagaacctatgccacaatgcacttcctggagagcgtgtttttagggaggcattgcgactactataaggttttcgaacacaattccggatactctcaggcaaaatggcggctgctagccaagaccaaccattttgatatctgttcgcgtcacagcactcaccatttctgccgctgtatgtccgacggcacaaagtgcgagaatggtaactgggattttgctggggaaatgaatacgacctatcactcaaaaagagacttctttaagcatgatttcaacctcttctgtactctgcttgagaatgcgtttcctggcacaaccgagagtttgtactaccaactgctctctaaaaggaacacaactggagcaagcaagctgttaggcaaactgattaccaagttcgggaataacaatctttttgtgggaatctggaaattcggtcagtttttgctctccctgccatatgtaaacaacacggaactatcagccctgcagagctctaagattctcgagtccccggaacccctgcttcggagtgctagcggccgacaggagtctttgtcctcagccacccctggggaggcaagtaaggaatgccgcaatgccaaaaagatcagctgtatatcgccaagattcggagtccccatggagaacctgacagcttgcggcgaatcccctaattacaaaatttataagactccaaccaggatctacaaatctaacaataagggtgagatctggtgcgccggggacgtgcactgttttcaagagttcacacccgttttacaggaggtggtcgataagctcaaaaagatgacttgctttctgaccgagccggaagcagaggaagacgcgttcagcattgctatcgccatgtgtaaaattcttgacaagggcgtgtgcacgataaactcagagcggtggaatatcattaaatgtgatagtggactgatgtattacacagaccagcgcgatggccaggacaccgggaacgattttggagaatattgcatctcccacaattgtaagactgagagattccctattaacccctctatcataagcgactgcatctgggagtaccattccaggaagtcacgttacattagcacattgaatctcgaaagtctggaggaatttaaacgggcaatctctgagaagctatcccacaccctgattgtatatcaattcaaaccaactagcaacctccctcatatgaagcccgtgtacaaatatatcaccgcccagggtgttgaaaattcggatggcatagactcagctttcattacagcctctatgccagcactgagtgggacgtccatcggatacaacgtcatgagcaaggataattttccccttttcgacatcattatatttatcaagtctgctgtgattaaaaccacttataaccacatctacgatacaggccctaccattggtatcaacgtgatgcatgacgagcactgtacagggcagtgcccaatagagatcccgcacaaggaaaattggttgactttcagccaggagcgaacctccagatggggctgtgaagagtttggatgcctggccattaacacgggctgcgtcttcgggtcatgtcaagatatcattaggcccgagacaaaagtttatcgcaaggcgatcgaagagagtgtgttactcaccgtgtgcgtaacttaccctggaaataccttttgtacagaaataaacgccattgagccaaaaatcactgacgaactggagcttcagttcaagaccgtcgacacaaaaacgctgcccaatctactcgctgtgcagaaccataagctgtacagcggccagatcaatgatttgggttcttttgcacaagggtgcggaaacattcagaagaccaatctgtccgttatcggcactggtacagccaaattcgactatatatgtcacggcgcttcacggaaggatattgtggtcagaaggtgctacaacaataactatgagagttgtaaattactcaaggaagaacctagcctgatcttttccgacaatcatgaaaccattgaggtggccaacatccgccaccttctgggggaattgcagttcaaactcatgctgggagatctacgatacaagtctttcgcagagaatccagagctggaaatagaggcgaagtgcgttggctgtccctcgtgctttagctcatattcctgtaacttccggattagttctagcatcgacactgtgtgcgccatcgatgggccgtgcacaatttttcataaccgtcttatcatttcctcaaccaaacaagactacggaataaagatgtcttgtaaagaaaagcctaatccagtagagaaattcaacatctgcaagagagtctatagcgtgctctttacgactattgataagaatgacaaaatcgaaatcaacaccggcgatcagacaagtttcattcaggagaaggacgataggtgtaaaacctggctgtgccgcgtgcgggacgagggtatatccgtcatctttgaacccattaaggctttctttgggagctacttctctatcgccttttacgttgtgattggaatcatagcattgttcatcactatttatatctttctgcctatggtattcaaattaaaggacattctcaagaaaaatgagctgctttacctgcaggaaatgaagtataaatga

SEQ ID NO: 10863 - RNA, 4305 nt, synthetic construct
  misc_feature 1..4305: note = derived and/or modified CDS sequence (opt3) from ANADV(EIV-13395Mg)__KU159765.1__GP
  source 1..4305: mol_type = other RNA
atgttcctgatcctcgtgcttctgattcccttttacataaccgccacacctgtcactacgagatgcttccacggcgggcagttgatcgctgagagcaagtccttaaccgcaatttctgaattttgtctgaaagacgatgtttcaacagtgaagagtgagatcacttatctcaaaaacgacaccggaattttcgcccatagcaaggtactaaggaattggatcataaaagattggaagaactgcaatccagtgccgacagcgggtggctccatcaacgtcattgaagtgaatgctgacctgtctctttcgaccaagacttacgtttgttcacgggattgcacaatcaccgtggacaaagaggatgcccaaattatctttcagacggacaagctgaaccacttcgaagtcagcgggactaccttgagttccggatggtttaaaacaaaggcatctgtgactctcgatcgcacctgtgagcatataaaagtaacatgcggcaagaagaccctgcagttccacgcctgttttaaacatcacatgagctgcattcgattctttcacaatacgatcctgcccggtactatggctgtttccatttgtcagaacatcgagctcatcattataacatcattaaccctgatcattttcatccttatggtgatattgactaagacatatatttgctacgtcctgatgcctctatttatgccagtggcatatctctacgggtgggcctataatcgtagttgtaaaaagtgcagctgctgtggactggcttaccatcccttcaccaactgcggctctcactgtgtgtgcggccttaaattcgaagcctccgacagaatgaggatccatcgggagtcagggctgtgtcaaggatacaagagcttgcgcgtcgcgagactcctgtgcaaaagtaagggttcttccttaatcattagcatcctgctctcggttcttattctgtcttttgtgacgcctatagaaggcaccttgacaaattatccagagtccaagaaatactcactagaggaaatcgcagatgtaattgaggggttcatcgccgaaaagggaatcaaagagtatattgtgctgtacacttccatatttggcgctctcctgcttctgatcgccttgattatcaccgtcagcctcaacaggattacagaatatctgactaatttaaacgtgatctactgtcacgagtgctccatgtatcactctaagaaaaatataaagtacatcggtgacttcaccaacaagtgtgggttttgcacatgtggagagctggaagatcaggagggcctaaacatgcataaagttagcaagaaatgcatttaccggtatcagctcacctggtcaaaggtgatcatgactattctggtctgccttttgatcgcacagaatacggtgctgatagtagctgccaacgacgactgttgggcgaaacaaagtctcgaaattgagtgcgttggccccctgcaacaggtggatgcctgtgaagacaagtccagccgctcttacaatggggaggcaaagaaacttgtcggaacatcaaaggtgaccgagctggatgctggtcaggtcaacttgctcggccagactatcgaaagtgccattatcgctatacgaaaacagagaacctatgccacaatgcacttcctggagagcgtgtttttagggaggcattgcgactactataaggttttcgaacacaattccggatactctcaggcaaaatggcggctgctagccaagaccaaccattttgatatctgttcgcgtcacagcactcaccatttctgccgctgtatgtccgacggcacaaagtgcgagaatggtaacagagattttgctggggaaatgaatacgacctatcactcaaaaagggacttctttaagcatgatttcaacctcttctgtactctgcttgagaatgcgtttcctggcacaaccgagagtttgtactaccaactgctctctaaacggaacacaactggagcaagcaagctgttaggcaaactgattaccaagttcgggaataacaatctttttgtgggaatctggaaattcggtcagtttttgctctccctgccatatgtaaacaacacggaactatcagccctgcagagctctaagattctcgagtccccggaacccctgcttcgaagtgctagcggccgccaggagtctttgtcctcagccacccctggggaggcaagtaaggaatgcagaaatgccaaaaagatcagctgtatatcgccaaggttcggagtccccatggagaacctgacagcttgcggcgaatcccctaattacaaaatttataagactccaacccggatctacaaatctaacaataagggtgagatctggtgcgccggggacgtgcactgttttcaagagttcacacccgttttacaggaggtggtcgataagctcaaaaagatgacttgctttctgaccgagccggaagcagaggaagacgcgttcagcattgctatcgccatgtgtaaaattcttgacaagggcgtgtgcacgataaactcagagcgctggaatatcattaaatgtgatagtggactgatgtattacacagaccagagagatggccaggacaccgggaacgattttggagaatattgcatctcccacaattgtaagactgagaggttccctattaacccctctatcataagcgactgcatctgggagtaccattcccgtaagtcacggtacattagcacattgaatctcgaaagtctggaggaatttaaacgagcaatctctgagaagctatcccacaccctggtagtgtatcaattcaaaccaactagcaacctccctcatatgaagcccgtttacaaatatattaccgcccagggtgtcgaaaattcggatggcatcgactcagctttcataacagcctctatgccagcactgagtgggacgtccattggatacaacgtgatgagcaaggataattttccccttttcgacatcatcatttttataaagtctgctgtgatcaaaaccacttataaccacatttacgatacaggccctaccatcggtattaacgtcatgcatgacgagcactgtacagggcagtgcccaatcgagataccgcacaaggaaaattggttgactttcagccaggagagaacctccaggtggggctgtgaagagtttggatgcctggccatcaacacgggctgcgttttcgggtcatgtcaagatattatccgccccgagacaaaagtgtatcggaaggcgattgaagagagtgtgttactcaccgtatgcgtcacttaccctggaaataccttttgtacagaaatcaacgccatagagccaaaaattactgacgaactggagcttcagttcaagaccgtggacacaaaaacgctgcccaatctactcgctgttcagaaccataagctgtacagcggccagatcaatgatttgggttcttttgcacaagggtgcggaaacatccagaagaccaatctgtccgtgattggcactggtacagccaaattcgactatatctgtcacggcgcttcaagaaaggatatagtcgtgaggcgctgctacaacaataactatgagagttgtaaattactcaaggaagaacctagcctgatttttagtgacaatcatgaaaccatcgaggttgccaacattcgacaccttctgggggaattgcagttcaaactcatgctgggagatctacggtacaagtctttcgcagagaatccagagctggaaatcgaggcgaagtgcgtgggctgtccctcgtgctttagctcatattcctgtaacttccgtataagttctagcattgacactgtatgcgccatcgatgggccgtgcacaatctttcataacagacttattatctcctcaaccaaacaagactacggaattaagatgtcttgtaaagaaaagcctaatccagtcgagaaattcaacatatgcaagagggtgtatagcgtgctctttacgactatcgataagaatgacaaaattgaaatcaacaccggcgatcagacaagtttcatccaggagaaggacgatcgctgtaaaacctggctgtgccgggtcagagacgagggtatttccgttatatttgaacccatcaaggctttctttgggagctacttctctattgccttttacgtggtaatcggaattatcgcattgttcataactatctatatttttctgcctatggtgttcaaattaaaggacatcctcaagaaaaatgagctgctttacctgcaggaaatgaagtataaatga

SEQ ID NO: 10864 - RNA, 4305 nt, synthetic construct
  misc_feature 1..4305: note = derived and/or modified CDS sequence (opt3) from ANADV(EIV-16002Mg)__KT313724.1__GP
  source 1..4305: mol_type = other RNA
atgttcctgatcctcgtgcttctgattcccttttacataaccgccacacctgtcactacgagatgcttccacggcgggcagttgatcgctgagagcaagtccttaaccgcaatttctgaattttgtctgaaagacgatgtttcaacagtgaagagtgagatcacttatctcaaaaacgacaccggaattttcgcccatagcaaggtactaaggaattggatcataaaagattggaagaactgcaatccagtgccgacagcgggtggctccatcaacgtcattgaagtgaatgctgacctgtctctttcgaccaagacttacgtttgttcacgggattgcacaatcaccgtggacaaagaggatgcccaaattatctttcagacggacaagctgaaccacttcgaagtcagcgggactaccttgagttccggatggtttaaaacaaaggcatctgtgactctcgatcgcacctgtgagcatataaaagtaacatgcggcaagaagaccctgcagttccacgcctgttttaaacatcacatgagctgcattcgattctttcacaatacgatcctgcccggtactatggctgtttccatttgtcagaacatcgagctcatcattataacatcattaaccctgatcattttcatccttatggtgatattgactaagacatatatttgctacgtcctgatgcctctatttatgccagtggcatatctctacgggtgggcctataatcgtagttgtaaaaagtgcagctgctgtggactggcttaccatcccttcaccaactgcggctctcactgtgtgtgcggccttaaattcgaagcctccgacagaatgaggatccatcgggagtcagggctgtgtcaaggatacaagagcttgcgcgtcgcgagactcctgtgcaaaagtaagggttcttccttaatcattagcatcctgctctcggttcttattctgtcttttgtgacgcctatagaaggcaccttgacaaattatccagagtccaagaaatactcactagaggaaatcgcagatgtaattgaggggttcatcgccgaaaagggaatcaaagagtatattgtgctgtacaccagtatatttggcgctctcctgcttctgatcgccttgattatcactgtcagcctcaacaggattacagaatatctgactaatttaaacgtgatctactgtcacgagtgctccatgtatcactctaagaaaaatataaagtacgttggtgacttcaccaacaagtgtgggttttgcacatgtggagagctggaagatcaggagggcctaaacatgcataaagtgagcaagaaatgcatctaccggtatcagctcacctggtcaaaggtcattatgactatcctggtgtgccttttgattgcacagaatacggtactgatcgttgctgccaacgacgactgttgggcgaaacaaagtctcgaaatagagtgcgtgggccccctgcagcaggtcgatgcctgtgaagacaagtccagccgctcttacaatggggaggcaaagaaacttgtgggaacatcaaaggtcaccgagctggatgctggtcaggtgaacttgctcggccaaactattgaaagtgccatcattgctatccgaaaacagagaacctatgccacaatgcacttcctggagagcgttttcttagggaggcattgcgactactataaggtgttcgaacacaattccggatactctcaggcaaaatggcggctgctagccaagaccaaccattttgatatatgttcgcgtcacagcactcaccatttctgccgctgtatgtccgacggcacaaagtgcgagaatggtaactgggattttgctggggaaatgaatacgacctatcactcaaaaagagacttctttaagcatgatttcaaactcttctgtactctgcttgagaacgcgtttcctggcacaaccgagagtttgtactaccaactgctctctaagaggaatacaactggagcaagcaaactgttaggcaagctgatcaccaaattcgggaacaataacctttttgtaggaatttggaagttcggtcagtttttgctctccctgccatatgtcaataacacggaactatcagccctgcagagctctaagatcctcgagtccccggaacccctgcttcggagtgctagcggccgacaggagtctttgtcctcagccacccctggggaggcaagtcgcgaatgcagaaacgccaaaaagattagctgtatctcgccaaggttcggagtgcccatggagaatctgacagcttgcggcgaatcccctaactacaaaatatataagactccagcccggatttacaaatctaataacaagggtgagatctggtgcgcaggggacgttcactgttttcaagaatttacccccgtgttacaggaggtcgtggataagctcaaaaagatgacatgctttctgactgagccggaagcggaggaagacgctttcagcatcgccattgcaatgtgtaaaatccttgacaagggcgtatgcaccattaattcagagcgctggaacataatcaaatgtgatagtggactgatgtattacacggaccagagagatggccaggacacagggaatgattttggagaatattgcatttcccacaactgtaagaccgagaggttccctatcaatccctctattatcagcgactgcatatgggagtaccattcccgtaagtcacggtacatcagcactttgaacctcgaaagtctggaggaatttaaacgagccatttctgagaagctatcccacacactggtggtttatcaattcaaaccaaccagcaatctccctcatatgaagcccgtctacaaatatatcactgctcagggtgtggaaaactcggatggcattgactcagccttcatcaccgcatctatgccagctctgagtgggacatccataggatacaatgtgatgagcaaggataactttccccttttcgacattatcatctttattaagtctgccgtcataaaaacgacctataatcacatctacgatactggccctacaattggtatcaacgttatgcatgacgagcactgtaccgggcagtgcccaattgagatcccgcacaaggaaaactggttgacattcagccaggagagaacttccaggtggggctgtgaagagtttggatgcctggcgataaataccggctgcgtgttcgggtcatgtcaagatatcattcgccccgagacgaaagtgtatcggaaggccatcgaagagagtgtattactcacagtctgcgtgacctaccctggaaacactttttgtaccgaaattaatgctatcgagccaaaaataacagacgaactggagcttcagttcaagactgttgacaccaaaacactgcccaacctactcgcagtgcagaatcataagctgtacagcggccagattaacgatttgggttcttttgcccaagggtgcggaaatatccagaagacgaacctgtccgtcatcggcaccggtactgctaaattcgactatatttgtcacggcgcctcaagaaaggatatcgtggttaggcgctgctacaataacaattatgagagttgtaaattactcaaggaggaacctagcctgatattttccgacaaccatgaaacaattgaggtggcaaatatccgacaccttctgggggaattgcagttcaaactcatgctgggagatctacggtacaagtctttcgcggagaacccagagctggaaattgaggccaagtgcgtaggctgtccctcgtgctttagctcatattcctgtaatttccgtatcagttctagcatagacaccgtctgcgctattgatgggccgtgcactgtgtttcataacagacttatcatctcctcaacaaaacaagactacggaattaagatgtcttgtaaagaaaagcctaacccagtggagaaattcaatatctgcaagagggtctatagcgttctctttaccacgattgataagaacgacaaaatagaaatcaatactggcgatcagaccagtttcattcaggagaaggacgatcgctgtaaaacatggctgtgccgggtgagagacgagggtatctccgtaatctttgaacccattaaggccttctttgggagctacttctctatagcattttacgtggtcatcggaattatcgctttgttcattaccatctatatatttctgcctatggtgttcaaattaaaggacatcctcaagaaaaacgagctgctttacctgcaggaaatgaagtataaatga

SEQ ID NO: 10865 - RNA, 4305 nt, synthetic construct
  misc_feature 1..4305: note = derived and/or modified CDS sequence (opt3) from ANADV(EIV-16199Mg)__KT313730.1__GP
  source 1..4305: mol_type = other RNA
atgttcctgatcctcgtgcttctgattcccttttacataaccgccacacctgtcactacgagatgcttccacggcgggcagttgatcgctgagagcaagtccttaaccgcaatttctgaattttgtctgaaagacgatgtttcaacagtgaagagtgagatcacttatctcaaaaacgacaccggaattttcgcccatagcaaggtactaaggaattggatcataaaagattggaagaactgcaatccagtgccgacagcgggtggctccatcaacgtcattgaagtgaatgctgacctgtctctttcgaccaagacttacgtttgttcacgggattgcacaatcaccgtggacaaagaggatgcccaaattatctttcagacggacaagctgaaccacttcgaagtcagcgggactaccttgagttccggatggtttaaaacaaaggcatctgtgactctcgatcgcacctgtgagcatataaaagtaacatgcggcaagaagaccctgcagttccacgcctgttttaaacatcacatgagctgcattcgattctttcacaatacgatcctgcccggtactatggctgtttccatttgtcagaacatcgagctcatcattataacatcattaaccctgatcattttcatccttatggtgatattgactaagacatatatttgctacgtcctgatgcctctatttatgccagtggcatatctctacgggtgggcctataatcgtagttgtaaaaagtgcagctgctgtggactggcttaccatcccttcaccaactgcggctctcactgtgtgtgcggccttaaattcgaagcctccgacagaatgaggatccatcgggagtcagggctgtgtcaaggatacaagagcttgcgcgtcgcgagactcctgtgcaaaagtaagggttcttccttaatcattagcatcctgctctcggttcttattctgtcttttgtgacgcctatagaaggcaccttgacaaattatccagagtccaagaaatactcactagaggaaatcgcagatgtaattgaggggttcatcgccgaaaagggaatcaaagagtatattgtgctgtacacttcgatatttggcgctctcctgcttctgatcgccttgattatcaccgtcagcctcaacaggattacagaatatctgactaatttaaacgtgatctactgtcacgagtgctccatgtatcactctaagaaaaatataaagtacatcggtgacttcaccaacaagtgtgggttttgcacatgtggagagctggaagatcaggagggcctaaacatgcataaagttagcaagaaatgcatttaccggtatcagctcacctggtcaaaggtgatcatgactattctggtctgccttttgatcgcacagaatacggtgctgatagtagctgccaacgacgactgttgggcgaaacaaagtctcgaaattgagtgcgttggccccctgcaacaggtggatgcctgtgaagacaagtccagccgctcttacaatgaggaggcaaagaaacttgtcgggacatcaaaggtgaccgaactggatgctggacaggtcaacttgctcggtcagactatcgagagtgccattatcgctatacgaaaacagagaacctatgccacaatgcacttcctggaaagcgtgtttttaggcaggcattgcgactactataaggttttcgagcacaattccgggtactctcaggcaaaatggcggctgctagccaagaccaaccattttgatatctgttcgcgtcacagcactcaccatttctgccgctgtatgtccgacggaacaaagtgcgaaaatggcaactgggattttgctggtgagatgaatacgacctatcactcaaaaagagacttctttaagcatgatttcaacctcttctgtactctgcttgagaatgcgtttcctgggacaaccgaaagtttgtactaccaactgctctctaaaaggaacacaactggcgcaagcaagctgttaggaaaactgattaccaagttcggcaataacaatctttttgtggggatctggaaattcggacagtttttgctctccctgccatatgtaaacaacacggagctatcagccctgcagagctctaagattctcgaatccccggagcccctgcttcggagtgctagcggtcgacaggagtctttgtcctcagccacccctggcgaagcaagtaaggagtgccgcaatgccaaaaagatcagctgtatatcgccaagattcggggtccccatggaaaacctgacagcttgcggagagtcccctaattacaaaatttataagactccaaccaggatctacaaatctaacaataagggcgaaatctggtgcgccggtgacgtgcactgttttcaagagttcacacccgttttacaggaggtggtcgataagctcaaaaagatgacttgctttctgaccgaaccggaggcagaagaggacgcgttcagcattgctatcgccatgtgtaaaattcttgacaagggggtgtgcacgataaactcagaacggtggaatatcattaaatgtgatagtggcctgatgtattacacagaccagcgcgatggacaggacaccggcaacgattttggggagtattgcatctcccacaattgtaagactgagagattccctattaacccctctatcataagcgactgcatctgggaataccattccaggaagtcacgttacattagcacattgaatctcgagagtctggaagagtttaaacgggcaatctctgaaaagctatcccacaccctgattgtatatcaattcaaaccaactagcaacctccctcatatgaagcccgtgtacaaatatatcaccgcccagggagttgagaatagtgatggtatagactcagctttcattacagcctctatgccagcactgagtggcacgtccatcgggtacaacgtcatgagcaaggataattttccccttttcgacatcattatatttatcaagtctgctgtgattaaaaccacttataaccacatctacgatacaggacctaccattggcatcaacgtgatgcatgacgagcactgtacaggtcagtgcccaatagaaatcccgcacaaggagaattggttgactttcagccaggaacgaacctccagatgggggtgtgaggagtttggctgcctggccattaacacgggatgcgtcttcggctcatgtcaagatatcattaggcccgaaacaaaagtttatcgcaaggcgatcgaggaaagtgtgttactcaccgtgtgcgtaacttaccctgggaataccttttgtacagagataaacgccattgaaccaaaaatcactgacgagctggagcttcagttcaagaccgtcgacacaaaaacgctgcccaatctactcgctgtgcagaaccataagctgtacagcggacagatcaatgatttgggctcttttgcacaaggttgcgggaacattcagaagaccaatctgtccgttatcggaactggcacagccaaattcgactatatatgtcacggtgcttcacggaaggatattgtggtcagaaggtgctacaacaataactatgaaagttgtaaattactcaaggaggaacctagcctgatcttttccgacaatcatgagaccattgaagtggccaacatccgccaccttctgggcgagttgcagttcaaactcatgctgggggatctacgatacaagtctttcgcagagaatccagaactggagatagaagcgcggtgcgttggatgtccctcgtgctttagctcatattcctgtaacttccgtattagttctagcatcgacactgtgtgcgccatcgatggcccgtgcacaatttttcataacagacttatcatttcctcaaccaagcaagactacgggataaaaatgtcttgtaaggagaaacctaatccagtagaaaagttcaacatctgcaaaagggtctatagcgtgctctttacgactattgataagaatgacaagatcgagatcaacaccggagatcagacaagtttcattcaggagaaagacgatcgctgtaagacctggctgtgccgggtgagagacgaaggcatatccgtcatctttgagcccattaaggctttctttggtagctacttctctatcgccttttacgttgtgattgggatcatagcattgttcatcattatctatatttttctgcctatggtattcaaattaaaagacatcctcaagaagaatgaactgctttacctgcaggagatgaaatataagtga

SEQ ID NO: 10866 - RNA, 4305 nt, synthetic construct
  misc_feature 1..4305: note = derived and/or modified CDS sequence (opt3) from ANADV(EIV-16208Mg)__KT313733.1__GP
  source 1..4305: mol_type = other RNA
atgttcctgatcctcgtgcttctgattcccttttacataaccgccacacctgtcactacgagatgcttccacggcgggcagttgatcgctgagagcaagtccttaaccgcaatttctgaattttgtctgaaagacgatgtttcaacagtgaagagtgagatcacttatctaaagaacgacaccggaattttcgcccatagcaaggtactcaggaattggatcataaaagattggaagaactgcaatccagtgccgacagcgggtggctccatcaacgtcattgaagtgaatgctgacctgtctctttcgaccaagacttacgtttgttcacgggattgcacaatcaccgtggacaaagaggatgcccaaattatctttcagacggacaagctgaaccacttcgaagtcagcgggactaccttgagttccggatggtttaaaacaaaggcatctgtgactctcgatcgcacctgtgagcatataaaagtaacatgcggcaagaagaccctgcagttccacgcctgttttaaacatcacatgagctgcattcgattctttcacaatacgatcctgcccggtactatggctgtttccatttgtcagaacatcgagctcatcattataacatcattaaccctgatcattttcatccttatggtgatattgactaagacatatatttgctacgtcctgatgcctctatttatgccagtggcatatctctacgggtgggcctataatcgtagttgtagaaaatgcagctgctgtggactggcttaccatcccttcaccaactgcggctctcactgtgtgtgcggccttaagttcgaagcctccgacaggatgcggatccatcgcgagtcagggctgtgtcaaggatacaagagcttgagagtcgcgaggctcctgtgcaagagtaaaggttcttccttaatcattagcatcctgctctcggttcttattctgtcttttgtgacgcctatagaaggcaccttgacaaattatccagagtccaagaagtactcactagaggaaatcgcagatgtaattgaggggttcatcgccgaaaaaggaatcaaggagtatattgtgctgtacacttccatatttggcgctctcctgcttctgatcgccttgattatcaccgtcagcctcaaccggattacagaatatctgactaatttaaacgtgatctactgtcacgagtgctccatgtatcactctaaaaagaatataaaatacatcggtgacttcaccaacaagtgtgggttttgcacatgtggagagctggaagatcaggagggcctaaacatgcataaggttagcaaaaagtgcatttaccgctatcagctcacctggtcaaaagtgatcatgactattctgatctgccttttgatagcacagaatgctgtcctgattgtggccgcgaacgacgactgttgggccaagcaaagtctcgaaatcgagtgcgtaggccccctgcagcaggttgatgcatgtgaagacaaatccagccgatcttacaatggggaggctaagaaacttgtgggaacgtcaaaagtcacagagctggatgccggtcaggtgaacttgctcggccaaaccattgaaagtgctatcatagccatcagaaagcagaggacttatgcaaccatgcacttcctggagagcgtctttttagggcggcattgcgactactataaagtgttcgaacacaattccggatactctcaggccaagtggcgtctgctagctaaaacaaaccattttgatatttgttcgcgccacagcacccaccatttctgcagatgtatgtccgacggcactaagtgcgagaatggtaactgggattttgcgggggaaatgaatacaacgtatcactcaaagagggacttctttaaacatgatttcaaactcttctgtaccctgcttgagaacgcatttcctggcactacagagagtttgtactaccaactgctctctaaacggaataccacaggagccagcaagctgttaggcaaactgatcactaagttcgggaacaataacctttttgttggaatttggaaattcggtcagtttttgctctccctgccatatgtgaataacaccgaactatcagctctgcagagctctaagatcctcgagtccccggaacccctgcttcgaagtgccagcggccgccaggagtctttgtcctcagcaacgcctggggaggccagtaaggaatgcagaaacgctaaaaagataagctgtatttcgccaaggttcggagtacccatggagaatctgaccgcctgcggcgaatcccctaactacaaaatctataagacaccaactcggatctacaaatctaataacaagggtgagatttggtgcgcaggggacgtccactgttttcaagagttcacccccgtgttacaggaagttgtggataagctcaaaaagatgacatgctttctgactgagccggaagcggaggaagacgctttcagcatcgccattgcaatgtgtaaaatacttgacaagggcgtctgcaccatcaattcagagcgctggaacattatcaaatgtgatagtggactgatgtattacacggaccagagagatggccaggacacagggaatgattttggagaatattgcatttcccacaactgtaagaccgagaggttccctatcaatccctctataatcagcgactgcatttgggagtaccattcccgtaagtcaaaatacatcagcactttgaacctcgaaagtctggaggaatttaagcgggccatttctgagaaactatcccacacactggtggtatatcaattcaagccaaccagcaatctccctcatatgaaacccgtgtacaagtatatcactgctcagggtgttgaaaactcggatggcatagactcagccttcattaccgcatctatgccagctctgagtgggacatccatcggatacaatgtcatgagcaaggataactttccccttttcgacatcattatatttatcaaatctgccgtgattaagacgacctataatcacatctacgatactggccctacaattggtatcaacgtgatgcatgacgagcactgtaccgggcagtgcccaatagagatcccgcacaaagaaaactggttgacattcagccaggagcgaacttccagatggggctgtgaagagtttggatgcctggcgattaataccggctgcgtcttcgggtcatgtcaagatatcattaggcccgagacgaaggtttatcgcaaagccatcgaagagagtgtgttactcacagtgtgcgtaacctaccctggaaacactttttgtaccgaaataaatgctattgagccaaagatcacagacgaactggagcttcagttcaaaactgtcgacaccaagacactgcccaacctactcgcagtgcagaatcataagctgtacagcggccagatcaacgatttgggttcttttgcccaagggtgcggaaatattcagaaaacgaacctgtccgttatcggcaccggtactgctaagttcgactatatatgtcacggcgcctcacggaaagatattatcgtgagaaggtgctacaataacaattatgagagttgtaagttactcaaagaggaacctagcctgatttttagtgacaaccatgaaacaatcgaggtcgcaaatatacgccaccttctgggggaattgcagttcaagctcatgctgggagatctacgatacaagtctttcgcggagaacccagagctggaaattgaggccaaatgcgtgggctgtccctcgtgctttagctcatattcctgtaatttccggatcagttctagcatcgacaccgtttgcgctattgatgggccgtgcactatctttcataaccgtcttattatatcctcaacaaagcaagactacggaatcaaaatgtcttgtaaggaaaaacctaacagcgtggagaagttcaatatttgcaagagagtatatagtgtcctctttaccacgatcgataaaaacgacaagatcgaaattaatactggcgatcagacctccttcatacaggagaaagacgataggtgtaagacatggctgtgccgcgtgcgggacgagggtatcagcgtgatttttgaaccaatcaaagccttctttgggtcttacttctcaattgcattttacgtcgttatcggaataatcgctttgttcattatcatttatatctttctgcccatggtgttcaagttaaaggacatactcaaaaagaacgagctgctttacctgcaggaaatgaaatataagtga

SEQ ID NO: 10867 - RNA, 4305 nt, synthetic construct
  misc_feature 1..4305: note = derived and/or modified CDS sequence (opt3) from ANADV(EIV-16356Mg)__KT313736.1__GP
  source 1..4305: mol_type = other RNA
atgttcctgatcctcgtgcttctgattcccttttacataaccgccacacctgtcactacgagatgcttccacggcgggcagttgatcgctgagagcaagtccttaaccgcaatttctgaattttgtctgaaagacgatgtttcaacagtgaagagtgagatcacttatctcaaaaacgacaccggaattttcgcccatagcaaggtactaaggaattggatcataaaagattggaagaactgcaatccagtgccgacagcgggtggctccatcaacgtcattgaagtgaatgctgacctgtctctttcgaccaagacttacgtttgttcacgggattgcacaatcaccgtggacaaagaggatgcccaaattatctttcagacggacaagctgaaccacttcgaagtcagcgggactaccttgagttccggatggtttaaaacaaaggcatctgtgactctcgatcgcacctgtgagcatataaaagtaacatgcggcaagaagaccctgcagttccacgcctgttttaaacatcacatgagctgcattcgattctttcacaatacgatcctgcccggtactatggctgtttccatttgtcagaacatcgagctcatcattataacatcattaaccctgatcattttcatccttatggtgatattgactaagacatatatttgctacgtcctgatgcctctatttatgccagtggcatatctctacgggtgggcctataatcgtagttgtaaaaagtgcagctgctgtggactggcttaccatcccttcaccaactgcggctctcactgtgtgtgcggccttaaattcgaagcctccgacagaatgaggatccatcgggagtcagggctgtgtcaaggatacaagagcttgcgcgtcgcgagactcctgtgcaaaagtaagggttcttccttaatcattagcatcctgctctcggttcttattctgtcttttgtgacgcctatagaaggcaccttgacaaattatccagagtccaagaaatactcactagaggaaatcgcagatgtaattgaggggttcatcgccgaaaagggaatcaaagagtatattgtgctgtacacttccatatttggcgctctcctgcttctgatcgccttgattatcaccgtcagcctcaacaggattacagaatatctgactaatttaaacgtgatctactgtcacgagtgctccatgtatcactctaagaaaaatataaagtacatcggtgacttcaccaacaagtgtgggttttgcacatgtggagagctggaagatcaggagggcctaaacatgcataaagttagcaagaaatgcatttaccggtatcagctcacctggtcaaaggtgatcatgactattctggtctgccttttgatcgcacagaatacggtgctgatagtagctgccaacgacgactgttgggcgaaacaaagtctcgaaattgagtgcgttggccccctgcaacaggtggatgcctgtgaagacaagtccagccgctcttacaatggggaggcaaagaaacttgtcggaacatcaaaggtgaccgagctggatgctggtcaggtcaacttgctcggccagactatcgaaagtgccattatcgctatacgaaaacagagaacctatgccacaatgcacttcctggagagcgtgtttttagggaggcattgcgactactataaggttttcgaacacaattccggatactctcaggcaaaatggcggctgctagccaagaccaaccattttgatatctgttcgcgtcacagcactcaccatttctgccgctgtatgtccgacggcacaaagtgcgagaatggtaactgggattttgctggggaaatgaatacgacctatcactcaaaaagagacttctttaagcatgatttcaaactcttctgtactctgcttgagaacgcgtttcctggcacaaccgagagtttgtactaccaactgctctctaagaggaatacaactggagcaagcaaactgttaggcaagctgattaccaaattcgggaacaataacctttttgtgggaatctggaagttcggtcagtttttgctctccctgccatatgtaaataacacggaactatcagccctgcagagctctaagattctcgagtccccggaacccctgcttcggagtgctagcggccgacaggagtctttgtcctcagccacccctggggaggcaagtaaagaatgccgcaacgccaagaaaatcagctgtatatcgccaagattcggagtccccatggagaatctgacagcttgcggcgaatcccctaactacaagatttataaaactccaaccaggatctacaagtctaataacaagggtgagatctggtgcgccggggacgtgcactgttttcaagaatttacacccttactccaggaggttgtggataaactgaagaaaatgacttgctttcttaccgagccggaagcagaggaagacgcgttcagcattgctatcgccatgtgtaagattctggacaaaggcgtctgcacgataaattcagagcggtggaacatcattaagtgtgatagtggattgatgtattacacagaccagcgcgatggccaggacaccgggaatgattttggagaatattgcatctcccacaactgtaagactgagagattccctattaatccctctatcataagcgactgcatctgggagtaccattccaggaaatcacgttacattagcacactcaacctggaaagtctagaggaatttaagcgggcaatctctgagaaactgtcccacaccctcgtggtatatcaattcaagccaactagcaatctgcctcatatgaaacccgtgtacaagtatattaccgcccagggtgttgaaaactcggatggcatcgactcagctttcataacagcctctatgccagcacttagtgggacgtccattggatacaatgtcatgagcaaggataactttcccttgttcgacatcatcatttttataaaatctgctgtgatcaagaccacttataatcacatttacgatacaggccctaccatcggtattaacgtgatgcatgacgagcactgtacagggcagtgcccaatcgagataccgcacaaagaaaactggctgactttcagccaggagcgaacctccagatggggctgtgaagagtttggatgcttagccatcaatacgggctgcgtcttcgggtcatgtcaagatattatcaggcccgagacaaaggtttatcgcaaagcgattgaagagagtgtgctcctgaccgtgtgcgtaacttaccctggaaacaccttttgtacagaaatcaatgccatagagccaaagattactgacgaacttgagctgcagttcaaaaccgtcgacacaaagacgctacccaacctcctggctgtgcagaatcataagttgtacagcggccagatcaacgatctgggttcttttgcacaagggtgcggaaatatccagaaaaccaacttatccgttattggcactggtacagccaagttcgactatatctgtcacggcgcttcacggaaagatatagtggtcagaaggtgctacaataacaattatgagagttgtaagctcctgaaagaggaacctagccttatttttagtgacaaccatgaaaccatcgaggtggccaatattcgccacctgttgggggaactccagttcaagctgatgctaggagatctgcgatacaagtctttcgcagagaacccagagcttgaaatcgaggcgaaatgcgttggctgtccctcgtgctttagctcatattcctgtaatttccggataagttctagcattgacactgtgtgcgccatcgatgggccgtgcacaatctttcataaccgtctcattatctcctcaaccaagcaagactacggaattaaaatgtcttgtaaggaaaaacctaacccagtagagaagttcaatatatgcaagagagtctatagcgtgctgtttacgactatcgataaaaacgacaagattgaaatcaataccggcgatcagacaagtttcatccaggagaaagacgataggtgtaagacctggttgtgccgcgtgcgggacgagggtatttccgtcatatttgaacccatcaaggctttctttgggagctacttctctattgccttttacgttgtgatcggaattatcgcactgttcataactatctatattttcttacctatggtattcaaactcaaggacatcctgaaaaagaacgagcttctgtacttgcaggaaatgaaatataagtga

SEQ ID NO: 10868 - RNA, 4305 nt, synthetic construct
  misc_feature 1..4305: note = derived and/or modified CDS sequence (opt3) from ANADV(EIV-17769Yak)__KT313739.1__GP
  source 1..4305: mol_type = other RNA
atgttcctgatcctcgtgcttctgattcccttttacataaccgccacacctgtcgctactagatgcttccacggcgggcagttgatcgcagagagcaagtccttaacggccatttctgaattttgtctgaaagacgatgtttcaaccgtgaagagtgagatcacatatctcaaaaacgacactggaattttcgcgcatagcaaggtactaaggaattggatcataaaagattggaagaactgcaatccagtgccgaccgctggtggctccatcaacgtcattgaagtgaatgccgacctgtctctttcgacaaagacctacgtttgttcacgggattgcactatcacagtggacaaagaggatgcacaaattatctttcagaccgacaacctgaatcacttcgaagtcagcgggacgactttgagttccggatggtttaagaccaaagcctctgtgacactcgatcgcacttgtgagcatataaaggtaacctgcggcaaaaagacactgcagttccacgcttgttttaagcatcacatgagctgcattcgattctttcacaacaccatcctgcccggtacgatggcagtttccatttgtcagaatatcgagctcatcattataacttcattaacactgatcattttcatccttatggtgatattgaccaaaacttatatttgctacgtcctgatgcctctatttatgccagtggcctatctctacgggtgggcttataaccgtagttgtaagaaatgcagctgctgtggactggcctaccatcccttcacaaattgcggctctcactgtgtgtgcggccttaagttcgaagcgtccgacagaatgaggatccatcgggagtcagggctgtgtcaaggatacaagagcttgcgcgtcgcaagactcctgtgcaagagtaaaggttcttccttaatcattagcatcctgctctcggttcttattctgtcttttgtgacccctatagaaggcacgttgaccaactatccagagtccaagaagtactcactagaggaaatcgccgatgtaattgaggggttcatcgctgaaaaaggaatcaaggagtatattgtgctgtacacaagtatatttggcgccctcctgcttctgatcgcattgattatcactgtcagcctcaataggattaccgaatatctgacaaacttaaatgtgatctactgtcacgagtgctccatgtatcactctaaaaagaacataaaatacgttggtgacttcactaacaagtgtgggttttgcacctgtggagagctggaagatcaggagggcctaaatatgcataaggtgagcaaaaagtgcatctaccggtatcagctcacatggtcaaaagtcattatgaccatcctggtgtgccttttgattgctcagaacactgtactgatcgttgccgcgaatgacgactgttgggccaagcaaagtctcgaaatagagtgcgtgggccccctgcagcaggtcgatgcatgtgaagacaaatccagccgctcttacaacggggaggctaagaaacttgtgggaacgtcaaaagtcacagagctggatgccggtcaggtgaatttgctcggccaaaccattgaaagtgctatcattgccatccgaaagcagagaacttatgcaaccatgcacttcctggagagcgttttcttagggaggcattgcgactactataaagtgttcgaacacaactccggatactctcaggccaagtggcggctgctagctaaaacaaatcattttgatatatgttcgcgtcacagcacccaccatttctgccgctgtatgtccgacggcactaagtgcgagaacggtaatagagattttgcgggggaaatgaacacaacgtatcactcaaagagggacttctttaaacatgatttcaatctcttctgtaccctgcttgagaacgcatttcctggcactacagagagtttgtactaccaactgctctctaagcggaataccacaggagccagcaaactgttaggcaagctgatcactaaattcgggaacaataacctttttgtaggaatttggaagttcggtcagtttttgctctccctgccatatgtcaacaataccgaactatcagctctgcagagctctaaaatcctcgagtccccggaacccctgcttcgaagtgccagcggccgccaggagtctttgtcctcagcaacgcctggggaggccagtagagaatgcaggaacgctaagaagattagctgtatctcgccacggttcggagtgcccatggagaatctgaccgcctgcggcgaatcccctaactacaaaatatataagacaccaactcgcatttacaaatctaataacaagggtgagatctggtgcgcaggggacgttcactgttttcaagaatttacccccgtgttacaggaggtcgtggataaactcaagaagatgacatgctttctgactgagccggaagcggaggaagacgctttcagcatcgccattgcaatgtgtaaaatccttgacaagggcgtatgcaccattaattcagagagatggaacataatcaaatgtgatagtggactgatgtattacacggaccagagggatggccaggacacagggaatgattttggagaatattgcatttcccacaactgtaagaccgagcgtttccctatcaatccctctattatcagcgactgcatatgggagtaccattcccggaaatcacgatacatcagcactttgaacctcgaaagtctggaggaatttaagagagccatttctgagaagctatcccacacactggtggtttatcaattcaaaccaaccagcaatctccctcatatgaagcccgtctacaaatatatcactgctcagggtgtggaaaactcggatggcattgactcagccttcatcaccgcatctatgccagctctgagtgggacatccataggatacaatgtgatgagcaaggataactttccccttttcgacattatcatctttattaaatctgccgtcataaagacgacctataaccacatctacgatactggccctacaattggtatcaatgttatgcatgacgagcactgtaccgggcagtgcccaattgagatcccgcacaaggaaaactggttgacattcagccaggagaggacttcccgctggggctgtgaagagtttggatgcctggcgataaataccggctgcgtgttcgggtcatgtcaagatatcattcggcccgagacgaaagtgtatagaaaggccatcgaagagagtgtattactcacagtctgcgtgacctaccctggaaacactttttgtaccgaaattaatgctatcgagccaaaaataacagacgaactggagcttcagttcaagactgttgacaccaaaacactgcccaacctactcgcagtgcagaatcataagctgtacagcggccagattaacgatttgggttcttttgcccaagggtgcggaaatatccagaaaacgaacctgtccgtcatcggcaccggtactgctaagttcgactatatttgtcacggcgcctcaaggaaggatatcgtggttcgccgatgctacaataacaattatgagagttgtaaattactcaaggaggaacctagcctgatattttccgacaaccatgaaacaattgaggtggcaaatatccggcaccttctgggggaattgcagttcaaactcatgctgggagatctacgttacaagtctttcgcggagaacccagagctggaaattgaggccaaatgcgtaggctgtccctcgtgctttagctcatattcctgtaacttcagaatcagttctagcatagacaccgtctgcgctattgatgggccgtgcactatctttcataataggcttatcatttcctcaacaaagcaagactacggaatcaagatgtcttgtaaagaaaagcctaacccagtggagaaattcaatatttgcaagcgcgtgtatagcgtcctctttaccacgatagataaaaacgacaagatcgaaattgatactggcgaccagaccagtttcatccaggagaaggatgaccggtgtaaaacatggctgtgcagagttagggacgagggtatctccgtgatttttgaacccataaaggccttctttgggagctacttctctatcgcattttacgtagtgattggaatcattgctttgttcatcaccatatatatctttctgcctatggtcttcaaattaaaggatattctcaaaaagaatgagctgctttacctgcaggaaatgaagtataaatga

SEQ ID NO: 10869 - RNA, 4305 nt, synthetic construct
  misc_feature 1..4305: note = derived and/or modified CDS sequence (opt3) from ANADV(EIV-18098Yak)__KT313742.1__GP
  source 1..4305: mol_type = other RNA
atgttcctgatcctcgtgcttctgattcccttttacataaccgccacacctgtcactacgagatgcttccacggcgggcagttgatcgctgagagcaagtccttaaccgcaatttctgaattttgtctgaaagacgatgtttcaacagtgaagagtgagatcacttatctcaaaaacgacaccggaattttcgcccatagcaaggtactaaggaattggatcataaaagattggaagaactgcaatccagtgccgacagcgggtggctccatcaacgtcattgaagtgaatgctgacctgtctctttcgaccaagacttacgtttgttcacgggattgcacaatcaccgtggacaaagaggatgcccaaattatctttcagacggacaagctgaaccacttcgaagtcagcgggactaccttgagttccggatggtttaaaacaaaggcatctgtgactctcgatcgcacctgtgagcatataaaagtaacatgcggcaagaagaccctgcagttccacgcctgttttaaacatcacatgagctgcattcgattctttcacaatacgatcctgcccggtactatggctgtttccatttgtcagaacatcgagctcatcattataacatcattaaccctgatcattttcatccttatggtgatattgactaagacatatatttgctacgtcctgatgcctctatttatgccagtggcatatctctacgggtgggcctataatcgtagttgtaaaaagtgcagctgctgtggactggcttaccatcccttcaccaactgcggctctcactgtgtgtgcggccttaaattcgaagcctccgacagaatgaggatccatcgggagtcagggctgtgtcaaggatacaagagcttgcgcgtcgcgagactcctgtgcaaaagtaagggttcttccttaatcattagcatcctgctctcggttcttattctgtcttttgtgacgcctatagaaggcaccttgacaaattatccagagtccaagaaatactcactagaggaaatcgcagatgtaattgaggggttcatcgccgaaaagggaatcaaagagtatattgtgctgtacaccagtatatttggcgctctcctgcttctgatcgccttgattatcactgtcagcctcaacaggattacagaatatctgactaatttaaacgtgatctactgtcacgagtgctccatgtatcactctaagaaaaatataaagtacgttggtgacttcaccaacaagtgtgggttttgcacatgtggagagctggaagatcaggagggcctaaacatgcataaagtgagcaagaaatgcatctaccggtatcagctcacctggtcaaaggtcattatgactatcctggtgtgccttttgattgcacagaatacggtactgatcgttgctgccaacgacgactgttgggcgaaacaaagtctcgaaatagagtgcgtgggccccctgcagcaggtcgatgcctgtgaagacaagtccagccgctcttacaatggggaggcaaagaaacttgtgggaacatcaaaggtcaccgagctggatgctggtcaggtgaacttgctcggccaaactattgaaagtgccatcattgctatccgaaaacagagaacctatgccacaatgcacttcctggagagcgttttcttagggaggcattgcgactactataaggtgttcgaacacaattccggatactctcaggcaaaatggcggctgctagccaagaccaaccattttgatatatgttcgcgtcacagcactcaccatttctgccgctgtatgtccgacggcacaaagtgcgagaatggtaactgggattttgctggggaaatgaatacgacctatcactcaaaaagagacttctttaagcatgatttcaacctcttctgtactctgcttgagaatgcgtttcctggcacaaccgagagtttgtactaccaactgctctctaaaaggaacacaactggagcaagcaagctgttaggcaaactgatcaccaagttcgggaataacaatctttttgtaggaatttggaaattcggtcagtttttgctctccctgccatatgtcaacaacacggaactatcagccctgcagagctctaagatcctcgagtccccggaacccctgcttcggagtgctagcggccgacaggagtctttgtcctcagccacccctggggaggcaagtcgcgaatgcagaaatgccaagaaaattagctgtatctcgccaaggttcggagtgcccatggagaacctgacagcttgcggcgaatcccctaattacaagatatataaaactccagcccggatttacaagtctaacaataaaggtgagatctggtgcgcaggggacgttcactgttttcaagaatttacccccgtgttacaggaggtcgtggataagctcaagaaaatgacatgctttctgactgagccggaagcggaggaagacgctttcagcatcgccattgcaatgtgtaagatccttgacaaaggcgtatgcaccattaactcagagcgctggaatataatcaagtgtgatagtggactgatgtattacacggaccagagagatggccaggacacagggaacgattttggagaatattgcatttcccacaattgtaaaaccgagaggttccctatcaacccctctattatcagcgactgcatatgggagtaccattcccgtaagtcacggtacatcagcactttgaatctcgaaagtctggaggaatttaagcgagccatttctgagaaactatcccacacactggtggtttatcaattcaagccaaccagcaacctccctcatatgaaacccgtctacaagtatatcactgctcagggtgtggaaaattcggatggcattgactcagccttcatcaccgcatctatgccagctctgagtgggacatccataggatacaacgtgatgagcaaagataattttccccttttcgacattatcatctttattaagtctgccgtcataaagacgacctataaccacatctacgatactggccctacaattggtatcaacgttatgcatgacgagcactgtaccgggcagtgcccaattgagatcccgcacaaagaaaattggttgacattcagccaggagagaacttccaggtggggctgtgaagagtttggatgcctggcgataaacaccggctgcgtgttcgggtcatgtcaagatatcattcgccccgagacgaaggtgtatcggaaagccatcgaagagagtgtattactcacagtctgcgtgacctaccctggaaatactttttgtaccgaaattaacgctatcgagccaaagataacagacgaactggagcttcagttcaaaactgttgacaccaagacactgcccaatctactcgcagtgcagaaccataaactgtacagcggccagattaatgatttgggttcttttgcccaagggtgcggaaacatccagaagacgaatctgtccgtcatcggcaccggtactgctaagttcgactatatttgtcacggcgcctcaagaaaagatatcgtggttaggcgctgctacaacaataactatgagagttgtaagttactcaaagaggaacctagcctgatattttccgacaatcatgaaacaattgaggtggcaaacatccgacaccttctgggggaattgcagttcaagctcatgctgggagatctacggtacaaatctttcgcggagaatccagagctggaaattgaggccaagtgcgtaggctgtccctcgtgctttagctcatattcctgtaacttccgtatcagttctagcatagacaccgtctgcgctattgatgggccgtgcactgtgtttcataacagacttatcatctcctcaacaaagcaagactacggaattaaaatgtcttgtaaggaaaaacctaatccagtggagaagttcaacatctgcaaaagggtctatagcgttctctttaccacgattgataagaatgacaagatagaaatcaacactggcgatcagaccagtttcattcaggagaaagacgatcgctgtaagacatggctgtgccgggtgagagacgagggtatctccgtaatctttgaacccattaaagccttctttgggagctacttctctatagcattttacgtggtcatcggaattatcgctttgttcattaccatctatatatttctgcctatggtgttcaagttaaaagacatcctcaagaagaatgagctgctttacctgcaggaaatgaaatataagtga

SEQ ID NO: 10870 - RNA, 4305 nt, synthetic construct
  misc_feature 1..4305: note = derived and/or modified CDS sequence (opt3) from ANADV(EIV-18136Yak)__KT313745.1__GP
  source 1..4305: mol_type = other RNA
atgttcctgatcctcgtgcttctgattcccttttacataaccgccacacctgtcactacgagatgcttccacggcgggcagttgatcgctgagagcaagtccttaaccgcaatttctgaattttgtctgaaagacgatgtttcaacagtgaagagtgagatcacttatctcaaaaacgacaccggaattttcgcccatagcaaggtactaaggaattggatcataaaagattggaagaactgcaatccagtgccgacagcgggtggctccatcaacgtcattgaagtgaatgctgacctgtctctttcgaccaagacttacgtttgttcacgggattgcacaatcaccgtggacaaagaggatgcccaaattatctttcagacggacaagctgaaccacttcgaagtcagcgggactaccttgagttccggatggtttaaaacaaaggcatctgtgactctcgatcgcacctgtgagcatataaaagtaacatgcggcaagaagaccctgcagttccacgcctgttttaaacatcacatgagctgcattcgattctttcacaatacgatcctgcccggtactatggctgtttccatttgtcagaacatcgagctcatcattataacatcattaaccctgatcattttcatccttatggtgatattgactaagacatatatttgctacgtcctgatgcctctatttatgccagtggcatatctctacgggtgggcctataatcgtagttgtaaaaagtgcagctgctgtggactggcttaccatcccttcaccaactgcggctctcactgtgtgtgcggccttaaattcgaagcctccgacagaatgaggatccatcgggagtcagggctgtgtcaaggatacaagagcttgcgcgtcgcgagactcctgtgcaaaagtaagggttcttccttaatcattagcatcctgctctcggttcttattctgtcttttgtgacgcctatagaaggcaccttgacaaattatccagagtccaagaaatactcactagaggaaatcgcagatgtaattgaggggttcatcgccgaaaagggaatcaaagagtatattgtgctgtacacaagtatatttggcgctctcctgcttctgatcgccttgattatcaccgtcagcctcaacaggattacagaatatctgactaatttaaacgtgatctactgtcacgagtgctccatgtatcactctaagaaaaatataaagtacatcggtgacttcaccaacaagtgtgggttttgcacatgtggagagctggaagatcaggagggcctaaacatgcataaagttagcaagaaatgcatttaccggtatcagctcacctggtcaaaggtgatcatgactattctggtctgccttttgatcgcacagaatacggtgctgatagtagctgccaacgacgactgttgggcgaaacaaagtctcgaaattgagtgcgttggccccctgcaacaggtggatgcctgtgaagacaagtccagccgctcttacaatggggaggcaaagaaacttgtcggaacatcaaaggtgaccgagctggatgctggtcaggtcaacttgctcggccagactatcgaaagtgccattatcgctatacgaaaacagagaacctatgccacaatgcacttcctggagagcgtgtttttagggaggcattgcgactactataaggttttcgaacacaattccggatactctcaggcaaaatggcggctgctagccaagaccaaccattttgatatctgttcgcgtcacagcactcaccatttctgccgctgtatgtccgacggcacaaagtgcgagaatggtaactgggattttgctggggaaatgaatacgacctatcactcaaaaagagacttctttaagcatgatttcaaactcttctgtactctgcttgagaacgcgtttcctggcacaaccgagagtttgtactaccaactgctctctaagaggaatacaactggagcaagcaaactgttaggcaagctgattaccaaattcgggaacaataacctttttgtgggaatctggaagttcggtcagtttttgctctccctgccatatgtaaataacacggaactatcagccctgcagagctctaagattctcgagtccccggaacccctgcttcggagtgctagcggccgacaggagtctttgtcctcagccacccctggggaggcaagtaaagaatgccgcaacgccaagaaaatcagctgtatatcgccaagattcggagtccccatggagaatctgacagcttgcggcgaatcccctaactacaagatttataaaactccaaccaggatctacaagtctaataacaagggtgagatctggtgcgtgggggacgttcactgttttcaagagttcacacccgtgttacaggaggtcgtggataaactcaagaaaatgacttgctttctgaccgagccggaagccgaggaagacgcattcagcattgcgatcgctatgtgtaagattcttgacaaaggcgtatgcacgataaattcagagcggtggaacatcatgaagtgtgatagtggactgatgtattacacagaccagcgcgatggccaggacaccgggaatgattttggagaatattgcatttcccacaactgtaagactgagagattccctatcaatccctctattatcagcgactgcatatgggagtaccattccaggaaatcacgttacatcggtacattgaacctcgaaagcctggaggaatttaagcgggccattagtgagaaactatctcacaccctggtggtttatcaattcaagccaacttccaatctccctcatatgaaacccgtctacaagtatatcaccgcacagggcgtggaaaacagcgatgggattgactcggccttcatcacagcttcaatgccagccctgtctggaacgagtataggctacaatgtgatgtccaaggataactttccccttttcgacattatcatctttattaaaagcgcagtcataaagaccacttataatcacatctacgatacaggtcctaccattgggatcaacgttatgcatgacgagcactgtacaggccagtgcccaattgagatcccgcacaaagaaaactggttgactttctctcaggagcgaaccagcagatggggatgtgaagagtttggctgcctggctataaatacggggtgcgtgttcggatcctgtcaagatatcattaggcccgagacaaaggtgtatcgcaaagccatcgaagagtcagtattactcaccgtctgcgtgacttaccctggcaacaccttttgtacagaaattaatgcgatcgagccaaagataactgacgaactggagcttcagttcaaaaccgttgacacaaagacgctgcccaacctactcgccgtgcagaatcataagctgtacagtggtcagattaacgatttggggagctttgctcaaggatgcggcaatatccagaaaaccaacctgtctgtcatcggtactggcacagcaaagttcgactatatttgtcacggggcctcccggaaagatatcgtggttagaaggtgctacaataacaattatgagtcatgtaagttactcaaagaagaacctagtctgatatttagcgacaaccatgaaaccattgaggtggctaatatccgccaccttctgggagaattgcagttcaagctcatgctgggcgatctacgatacaagtccttcgccgagaacccagagctggaaattgaggcacggtgcgtagggtgtccctcttgcttttcgagctattcatgtaatttccgtatctccagttctatagacactgtctgcgcgattgatggaccgtgcacaatctttcataacagacttatcattagctccaccaaacaagactacggcatcaagatgtcatgtaaagaaaagcctaacccagtggagaaattcaatatttgcaagagggtgtattctgtcctctttacgactatagataagaacgacaaaatcgaaattaataccggtgatcagactagcttcatccaggagaaggacgatcgctgtaaaacctggctgtgccgggttagagacgaggggatcagtgtgatttttgaacccataaaggccttctttggatcctacttcagcatcgctttttacgtagtgattggcatcattgccttgttcatcataatctatatttttctgcctatggtcttcaaattaaaggacatcctcaagaaaaacgagctgctttacctgcaggaaatgaagtataaatga

SEQ ID NO: 10871 - RNA, 4305 nt, synthetic construct
  misc_feature 1..4305: note = derived and/or modified CDS sequence (opt3) from ANADV(EIV-18146Yak)__KT313748.1__GP
  source 1..4305: mol_type = other RNA
atgttcctgatcctcgtgcttctgattcccttttacataaccgccacacctgtcactacgagatgcttccacggcgggcagttgatcgctgagagcaagtccttaaccgcaatttctgaattttgtctgaaagacgatgtttcaacagtgaagagtgagatcatttatctcaaaaacgacactggaatcttcgcccatagcaaggtactaaggaattggataatcaaagattggaagaactgcaatccagtgccgaccgcgggtggctccattaacgtcatcgaagtgaatgctgacctgtctctttcgacaaagacctacgtttgttcacgggattgcactattacagtggacaaagaggatgcccaaatcatatttcagaccgacaagctgaaccacttcgaagtcagcgggacgactttgagttccggatggtttaaaaccaaggcatctgtgacactcgatcgcacttgtgagcatattaaagtaacctgcggcaagaagacactgcagctgcacgcctgtttcaaacatcacatgagctgcatccgatttttccacaataccattctccccggtacgatggctgtttccatctgtcagaacatcgagttaattataatcacttcactgacacttattatctttatattgatggtgattctgaccaagacttatatctgctacgtcctaatgcctctcttcatgccagtggcatatctgtacgggtgggcctataatcgtagttgtaaaaagtgcagctgctgtggacttgcttaccatccctttacaaactgcggctctcactgtgtgtgcggcctgaaattcgaagcctccgacagaatgaggatccatcgggagtcagggttgtgtcaaggatacaagagcctccgcgtcgcgagactgttatgcaaaagtaagggttcttccctgattgttagcatcctcctttcggtgctgattttgtctttcgtaacccctatagaaggcacgctaaccaattatccagagtccaagaaatactcactggaggaaatcgcagatgtgattgaggggtttatcgccgaaaagggaatcaaagagtatattgtcctctacacaagtatattcggcgctctgcttctgttgatcgccctcattatcactgtgagcctgaacaggattaccgaatatttaacaaatctgaacgttatctactgtcacgagtgctccatgtatcactctaagaaaaatataaagtacatcggtgactttactaacaagtgtgggttctgcacctgtggagagctagaagatcaggagggcctcaacatgcataaagtgagcaagaaatgcatttaccggtatcagctgacatggtcaaaggtcatcatgaccattcttgtgtgcttgctgatcgcacagaatactgtactcatagttgctgccaacgacgactgttgggcgaaacaaagtctggaaattgagtgcgtgggcccccttcagcaggtcgatgcctgtgaagacaagtccagccgctcttacaatgaggaggcaaagaaactggtggggacgtcaaaggtcacagaattggatgctggacaggtgaacctcctgggtcaaaccatcgagagtgccattatcgctatacgaaaacagagaacttatgccaccatgcactttttagaaagcgttttcctgggcaggcattgcgactactataaggtgtttgagcacaattccgggtactctcaggcaaaatggcggctactcgccaagacaaaccatttcgatatctgttcgcgtcacagcacccaccatttttgccgctgtatgtccgacggaactaagtgcgaaaatggcaactgggatttcgctggtgagatgaatacaacgtatcactcaaaaagagactttttcaagcatgattttaacctgttctgtacccttttggagaatgcgttccctgggactacagaaagtctgtactaccaactcctgtctaaaaggaacaccacaggcgcaagcaagttactgggaaaacttattactaagtttggcaataacaatttgttcgtagggatctggaaatttggacagttcctcctgtccctaccatatgtcaacaacaccgagctgtcagccctccagagctctaagattctggaatccccggagccccttttgcggagtgctagcggtcgacaggagtctctgtcctcagccacgcctggcgaagcaagtaaggagtgccgcaatgccaaaaagatcagctgtatatcgccaagatttggggtgcccatggaaaacttaaccgcttgcggagagtcccctaattacaaaatttataagacaccaactaggatctacaaatctaacaataagggcgaaatctggtgcgccggtgacgttcactgtttccaagagtttacccccgtgctccaggaggtcgtggataagctgaaaaagatgacatgcttccttactgaaccggaggcagaagaggacgcgtttagcattgctatcgccatgtgtaaaattctggacaagggggtatgcaccataaactcagaacggtggaatatcattaaatgtgatagtggcttgatgtattacacggaccagcgcgatggacaggacacaggcaacgatttcggggagtattgcatctcccacaattgtaagaccgagagatttcctattaacccctctatcataagcgactgcatctgggaataccattccaggaagtcacgttacattagcactctcaatctggagagtctagaagagttcaaacgggcaatctctgaaaagctgtcccacacactcattgtgtatcaatttaaaccaaccagcaacctgcctcatatgaagcccgtttacaaatatatcactgcccagggagtcgaaaattcggatggtatagactcagctttcattaccgcctctatgccagcacttagtggcacatccatcgggtacaacgtgatgagcaaggataatttccccttgtttgacatcattatattcatcaagtctgctgtgattaaaacgacctataaccacatctacgatactggacctacaattggcatcaacgtcatgcatgacgagcactgtaccggtcagtgcccaatagagatcccgcacaaggagaattggctgacatttagccaggaacgaacttccagatgggggtgtgaggagttcggctgcttagccattaacaccggatgcgtttttggctcatgtcaagatatcattaggcccgaaacgaaagtgtatcgcaaggcgatcgaggaaagtgtgctcctgacagtatgcgtcacctaccctgggaatactttctgtaccgagataaacgccattgaaccaaaaatcacagacgagcttgagctgcagtttaagactgtggacaccaaaacactacccaatctcctggctgttcagaaccataagttgtacagcggacagatcaatgatctgggctctttcgcacaaggttgcgggaacattcagaagacgaatttatccgtgatcggaaccggcactgccaaatttgactatatatgtcacggtgcttcacggaaggatattgtcgtgagaaggtgctacaacaataactatgaaagttgtaaactcctgaaggaggaacctagccttatcttctccgacaatcatgagacaattgaagttgccaacatccgccacctgttgggcgagctccagtttaaactgatgctaggggatctgcgatacaagtctttcgcagagaatccagaacttgagatagaagcgcggtgcgtgggatgtccctcgtgcttcagctcatattcctgtaactttcgtattagttctagcatcgacaccgtatgcgccatcgatggcccgtgcactattttccataacagactcatcatttcctcaacaaagcaagactacgggataaaaatgtcttgtaaggagaaacctaatccagtcgaaaagtttaacatctgcaaaagggtgtatagcgtgctgttcaccacgattgataagaatgacaagatcgagatcaacactggagatcagaccagttttattcaggagaaagacgatcgctgtaagacatggttgtgccgggtcagagacgaaggcatatccgttatcttcgagcccattaaagcctttttcggtagctacttttctatcgctttctacgtggtaattgggatcatagcactgtttatcattatctatattttcttacctatggtgtttaagctcaaagacatcctgaagaagaatgaacttctgtacttgcaggagatgaaatataagtga

SEQ ID NO: 10872 - RNA, 4305 nt, synthetic construct
  misc_feature 1..4305: note = derived and/or modified CDS sequence (opt3) from ANADV(EIV-18353Yak)__KT313751.1__GP
  source 1..4305: mol_type = other RNA
atgttcctgatcctcgtgcttctgattcccttttacataaccgccacacctgtcactacgagatgcttccacggcgggcagttgatcgctgagagcaagtccttaaccgcaatttctgaattttgtctgaaagacgatgtttcaacagtgaagagtgagatcatttatctcaaaaacgacactggaatcttcgcccatagcaaggtactaaggaattggataatcaaagattggaagaactgcaatccagtgccgaccgcgggtggctccattaacgtcatcgaagtgaatgctgacctgtctctttcgacaaagacctacgtttgttcacgggattgcactattacagtggacaaagaggatgcccaaatcatatttcagaccgacaagctgaaccacttcgaagtcagcgggacgactttgagttccggatggtttaaaaccaaggcatctgtgacactcgatcgcacttgtgagcatattaaagtaacctgcggcaagaagacactgcagttccacgcctgttttaaacatcacatgagctgcatccgattctttcacaataccattctgcccggtacgatggctgtttccatctgtcagaacatcgagctcattataatcacttcattaacactgattatcttcatacttatggtgattttgaccaagacttatatctgctacgtcctgatgcctctatttatgccagtggcatatctctacgggtgggcctataatcgtagttgtaaaaagtgcagctgctgtggactggcttaccatcccttcacaaactgcggctctcactgtgtgtgcggccttaaattcgaagcctccgacagaatgaggatccatcgggagtcagggctgtgtcaaggatacaagagcttgcgcgtcgcgagactcctgtgcaaaagtaagggttcttccttaattatcagcattctgctctcggttcttatactgtcttttgtgacccctatcgaaggcacgttgaccaattatccagagtccaagaaatactcactagaggaaattgcagatgtaatcgaggggttcatcgccgaaaagggaattaaagagtatatagtgctgtacacaagtatctttggcgctctcctgcttctgattgccttgatcattactgtcagcctcaacaggatcaccgaatatctgacaaatttaaacgtgatatactgtcacgagtgctccatgtatcactctaagaaaaatatcaagtacattggtgacttcactaacaagtgtgggttttgcacctgtggagagctggaagatcaggagggcctaaacatgcataaagttagcaagaaatgcatctaccggtatcagctcacatggtcaaaggtgattatgaccatcctggtctgccttttgatagcacagaatactgtgctgattgtagctgccaacgacgactgttgggcgaaacaaagtctcgaaatcgagtgcgttggccccctgcaacaggtggatgcctgtgaagacaagtccagccgctcttacaatgaggaggcaaagaaacttgtcgggacgtcaaaggtgacagaactggatgctggacaggtcaacttgctcggtcagaccattgagagtgccatcatagctatccgaaaacagagaacttatgccaccatgcacttcctggaaagcgtgtttttaggcaggcattgcgactactataaggttttcgagcacaattccgggtactctcaggcaaaatggcggctgctagccaagacaaaccattttgatatttgttcgcgtcacagcacccaccatttctgccgctgtatgtccgacggaactaagtgcgaaaatggcaactgggattttgctggtgagatgaatacaacgtatcactcaaaaagagacttctttaagcatgatttcaacctcttctgtaccctgcttgagaatgcgtttcctgggactacagaaagtttgtactaccaactgctctctaaaaggaacaccacaggcgcaagcaagctgttaggaaaactgatcactaagttcggcaataacaatctttttgtggggatttggaaattcggacagtttttgctctccctgccatatgtaaacaacaccgagctatcagccctgcagagctctaagatcctcgaatccccggagcccctgcttcggagtgctagcggtcgacaggagtctttgtcctcagccacgcctggcgaagcaagtaaggagtgccgcaatgccaaaaagataagctgtatttcgccaagattcggggtccccatggaaaacctgaccgcttgcggagagtcccctaattacaaaatctataagacaccaactaggatctacaaatctaacaataagggcgaaatttggtgcgccggtgacgtgcactgttttcaagagttcacccccgttttacaggaggtggtcgataagctcaaaaagatgacatgctttctgactgaaccggaggcagaagaggacgcgttcagcatcgctattgccatgtgtaaaatacttgacaagggggtgtgcaccatcaactcagaacggtggaatattatcaaatgtgatagtggcctgatgtattacacggaccagcgcgatggacaggacacaggcaacgattttggggagtattgcatttcccacaattgtaagaccgagagattccctatcaacccctctataatcagcgactgcatttgggaataccattccaggaagtcacgttacatcagcactttgaatctcgagagtctggaagagtttaaacgggcaatttctgaaaagctatcccacacactgatcgtatatcaattcaaaccaaccagcaacctccctcatatgaagcccgtgtacaaatatataactgcccagggagttgaaaattcggatggtattgactcagctttcatcaccgcctctatgccagcactgagtggcacatccatcgggtacaacgtcatgagcaaggataattttccccttttcgacattataatctttattaagtctgctgtgatcaaaacgacctataaccacatttacgatactggacctacaatcggcataaacgtgatgcatgacgagcactgtaccggtcagtgcccaatcgagattccgcacaaggagaattggttgacattcagccaggaacgaacttccagatgggggtgtgaggagtttggctgcctggccatcaacaccggatgcgtcttcggctcatgtcaagatattatcaggcccgaaacgaaagtttatcgcaaggcgatagaggaaagtgtgttactcacagtgtgcgtaacctaccctgggaatactttttgtaccgagattaacgccatcgaaccaaaaatcacagacgagctggagcttcagttcaagactgtcgacaccaaaacactgcccaatctactcgctgtgcagaaccataagctgtacagcggacagattaatgatttgggctcttttgcacaaggttgcgggaacatccagaagacgaatctgtccgttataggaaccggcactgccaaattcgactatatttgtcacggtgcttcacggaaggatatcgtggtcagaaggtgctacaacaataactatgaaagttgtaaattactcaaggaggaacctagcctgatcttttccgacaatcatgagacaattgaagtggccaacatacgccaccttctgggcgagttgcagttcaaactcatgctgggggatctacgatacaagtctttcgcagagaatccagaactggagattgaagcgcggtgcgttggatgtccctcgtgctttagctcatattcctgtaacttccgtatcagttctagcatcgacaccgtgtgcgccattgatggcccgtgcactatctttcataacagacttattatatcccctacaaagcaagactacgggatcaaaatgtcatgtaaggagaaaccaaatcccgtagaaaagttcaacatttgcaaaagggtctattctgtgctctttaccacgatcgataagaatgacaagatcgagattaacactggagatcagaccagcttcatacaggagaaagacgatcgctgtaagacatggctgtgccgggtgagagacgaaggcatcagtgtcatttttgagcctatcaaggctttctttggttcctacttcagcattgccttttacgttgtgatcgggataatcgcattgttcattatcatttatatctttctgcccatggtattcaaattaaaagacatactcaagaagaatgaactgctttacctgcaggagatgaaatataagtga

SEQ ID NO: 10873 - RNA, 4305 nt, synthetic construct
  misc_feature 1..4305: note = derived and/or modified CDS sequence (opt3) from ANADV(EIV-18560Yak)__KT313754.1__GP
  source 1..4305: mol_type = other RNA
atgttcctgatcctcgtgcttctgattcccttttacataaccgccacacctgtcactacgagatgcttccacggcgggcagttgatcgctgagagcaagtccttaaccgcaatttctgaattttgtctgaaagacgatgtttcaacagtgaagagtgagatcatttatctcaaaaacgacactggaatcttcgcccatagcaaggtactaaggaattggataatcaaagattggaagaactgcaatccagtgccgaccgcgggtggctccattaacgtcatcgaagtgaatgctgacctgtctctttcgacaaagacctacgtttgttcacgggattgcactattacagtggacaaagaggatgcccaaatcatatttcagaccgacaagctgaaccacttcgaagtcagcgggacgactttgagttccggatggtttaaaaccaaggcatctgtgacactcgatcgcacttgtgagcatattaaagtaacctgcggcaagaagacactgcagttccacgcctgttttaaacatcacatgagctgcatccgattctttcacaataccattctgcccggtacgatggctgtttccatctgtcagaacatcgagctcattataatcacttcattaacactgattatcttcatacttatggtgattttgaccaagacttatatctgctacgtcctgatgcctctatttatgccagtggcatatctctacgggtgggcctataatcgtagttgtaaaaagtgcagctgctgtggactggcttaccatcccttcacaaactgcggctctcactgtgtgtgcggccttaaattcgaagcctccgacagaatgaggatccatcgggagtcagggctgtgtcaaggatacaagagcttgcgcgtcgcgagactcctgtgcaaaagtaagggttcttccttaattatcagcattctgctctcggttcttatactgtcttttgtgacccctatcgaaggcacgttgaccaattatccagagtccaagaaatactcactagaggaaattgcagatgtaatcgaggggttcatcgccgaaaagggaattaaagagtatatagtgctgtacacaagtatctttggcgctctcctgcttctgattgccttgatcattactgtcagcctcaacaggatcaccgaatatctgacaaatttaaacgtgatatactgtcacgagtgctccatgtatcactctaagaaaaatatcaagtacattggtgacttcactaacaagtgtgggttttgcacctgtggagagctggaagatcaggagggcctaaacatgcataaagttagcaagaaatgcatctaccggtatcagctcacatggtcaaaggtgattatgaccatcctggtctgccttttgatagcacagaatactgtgctgattgtagctgccaacgacgactgttgggcgaaacaaagtctcgaaatcgagtgcgttggccccctgcaacaggtggatgcctgtgaagacaagtccagccgctcttacaatgaggaggcaaagaaacttgtcgggacgtcaaaggtgacagaactggatgctggacaggtcaacttgctcggtcagaccattgagagtgccatcatagctatccgaaaacagagaacttatgccaccatgcacttcctggaaagcgtgtttttaggcaggcattgcgactactataaggttttcgagcacaattccgggtactctcaggcaaaatggcggctgctagccaagacaaaccattttgatatttgttcgcgtcacagcacccaccatttctgccgctgtatgtccgacggaactaagtgcgaaaatggcaacagagattttgctggtgagatgaatacaacgtatcactcaaaaagggacttctttaagcatgatttcaacctcttctgtaccctgcttgagaatgcgtttcctgggactacagaaagtttgtactaccaactgctctctaaacggaacaccacaggcgcaagcaagctgttaggaaaactgatcactaagttcggcaataacaatctttttgtggggatttggaaattcggacagtttttgctctccctgccatatgtaaacaacaccgagctatcagccctgcagagctctaagatcctcgaatccccggagcccctgcttcgaagtgctagcggtcgccaggagtctttgtcctcagccacgcctggcgaagcaagtaaggagtgcagaaatgccaaaaagataagctgtatttcgccaaggttcggggtccccatggaaaacctgaccgcttgcggagagtcccctaattacaaaatctataagacaccaactcggatctacaaatctaacaataagggcgaaatttggtgcgccggtgacgtgcactgttttcaagagttcacccccgttttacaggaggtggtcgataagctcaaaaagatgacatgctttctgactgaaccggaggcagaagaggacgcgttcagcatcgctattgccatgtgtaaaatacttgacaagggggtgtgcaccatcaactcagaacgctggaatattatcaaatgtgatagtggcctgatgtattacacggaccagagagatggacaggacacaggcaacgattttggggagtattgcatttcccacaattgtaagaccgagaggttccctatcaacccctctataatcagcgactgcatttgggaataccattcccgtaagtcacggtacatcagcactttgaatctcgagagtctggaagagtttaaacgagcaatttctgaaaagctatcccacacactgatcgtatatcaattcaaaccaaccagcaacctccctcatatgaagcccgtgtacaaatatataactgcccagggagttgaaaattcggatggtattgactcagctttcatcaccgcctctatgccagcactgagtggcacatccatcgggtacaacgtcatgagcaaggataattttccccttttcgacattataatctttattaagtctgctgtgatcaaaacgacctataaccacatttacgatactggacctacaatcggcataaacgtgatgcatgacgagcactgtaccggtcagtgcccaatcgagattccgcacaaggagaattggttgacattcagccaggaaagaacttccaggtgggggtgtgaggagtttggctgcctggccatcaacaccggatgcgtcttcggctcatgtcaagatattatccgccccgaaacgaaagtttatcggaaggcgatagaggaaagtgtgttactcacagtgtgcgtaacctaccctgggaatactttttgtaccgagattaacgccatcgaaccaaaaatcacagacgagctggagcttcagttcaagactgtcgacaccaaaacactgcccaatctactcgctgtgcagaaccataagctgtacagcggacagattaatgatttgggctcttttgcacaaggttgcgggaacatccagaagacgaatctgtccgttataggaaccggcactgccaaattcgactatatttgtcacggtgcttcaagaaaggatatcgtggtcaggcgctgctacaacaataactatgaaagttgtaaattactcaaggaggaacctagcctgatcttttccgacaatcatgagacaattgaagtggccaacatacgacaccttctgggcgagttgcagttcaaactcatgctgggggatctacggtacaagtctttcgcagagaatccagaactggagattgaagcgcgttgcgttggatgtccctcgtgctttagctcatattcctgtaacttcagaatcagttctagcatcgacaccgtgtgcgccattgatggcccgtgcactatctttcataacaggcttattatatcccctacaaagcaagactacgggatcaaaatgtcatgtaaggagaaaccaaatcccgtagaaaagttcaacatttgcaaacgcgtctattctgtgctctttaccacgatcgataagaatgacaagatcgagattaacactggagatcagaccagcttcatacaggagaaagacgatcggtgtaagacatggctgtgcagagtgagggacgaaggcatcagtgtcatttttgagcctatcaaggctttctttggttcctacttcagcattgccttttacgttgtgatcgggataatcgcattgttcattatcatttatatctttctgcccatggtattcaaattaaaagacatactcaagaagaatgaactgctttacctgcaggagatgaaatataagtga

SEQ ID NO: 10874 - RNA, 4305 nt, synthetic construct
  misc_feature 1..4305: note = derived and/or modified CDS sequence (opt3) from ANADV(EIV-18715Yak)__KT313757.1__GP
  source 1..4305: mol_type = other RNA
atgttcctgatcctcgtgcttctgattcccttttacataaccgccacacctgtcactacgagatgcttccacggcgggcagttgatcgctgagagcaagtccttaaccgcaatttctgaattttgtctgaaagacgatgtttcaacagtgaagagtgagatcacttatctcaaaaacgacaccggaattttcgcccatagcaaggtactaaggaattggatcataaaagattggaagaactgcaatccagtgccgacagcgggtggctccatcaacgtcattgaagtgaatgctgacctgtctctttcgaccaagacttacgtttgttcacgggattgcacaatcaccgtggacaaagaggatgcccaaattatctttcagacggacaagctgaaccacttcgaagtcagcgggactaccttgagttccggatggtttaaaacaaaggcatctgtgactctcgatcgcacctgtgagcatataaaagtaacatgcggcaagaagaccctgcagttccacgcctgttttaaacatcacatgagctgcattcgattctttcacaatacgatcctgcccggtactatggctgtttccatttgtcagaacatcgagctcatcattataacatcattaaccctgatcattttcatccttatggtgatattgactaagacatatatttgctacgtcctgatgcctctatttatgccagtggcatatctctacgggtgggcctataatcgtagttgtaaaaagtgcccctgctgtggactggcttaccatcctttcaccaactgcggcagccactgtgtgtgcggccttaaattcgaagcctctgacagaatgaggatccatcgggagtccgggctgtgtcaaggatacaagtcattgcgcgtcgcgagactcctgtgcaaaagcaagggtagttctttaatcatttccatcctgctcagcgttcttattctgtcgtttgtgacgccaatagaaggcaccttgacaaattatcccgagtctaagaaatactccctagaggaaatcgcagatgtaattgaggggttcatcgccgaaaagggaatcaaagagtatattgtgctgtacacttcaatatttggcgctctcctgcttctgatcgccttgattatcaccgtcagtctcaacaggattacagaatatctgactaatttaaacgtgatctactgtcacgagtgcagcatgtatcactccaagaaaaatataaagtacatcggtgacttcaccaacaagtgtgggttttgcacatgtggagagctggaagatcaggagggcctaaacatgcataaagtttctaagaaatgcatttaccggtatcagctcacctggagcaaggtgatcatgactattctgatctgccttttgatagcacagaatacggtcctgattgtggctgccaacgacgactgttgggcgaaacaatcactcgaaatcgagtgcgtaggccctctgcagcaggttgatgcctgtgaagacaagagttcccgcagctacaatggggaggcaaagaaacttgtgggaacatctcgagtcaccgagctggatgctggtcaggtgaacttgctcggccaaactattgaatcagccatcatagctatcagaaagcagaggacctatgccacaatgcacttcctggagagtgtctttttagggcggcattgcgactactataaagtgttcgaacacaatagcggatactcccaggcaaagtggcgtctgctagccaaaaccaaccattttgatatttgttctcgccactcgactcaccatttctgcagatgtatgagcgacggcacaaagtgcgagaatggtaactgggattttgctggggaaatgaatacgacctatcactccaagagggacttctttaaacatgatttctcactcttctgtactctgcttgagaacgcgtttccaggcacaaccgagagtttgtactaccaactgctctctaagcggaatacaactggagcaagcaaactgttaggcaagctgatcaccaaattcgggaacaataacctttttgttggaatttggaagttcggtcagtttttgctctccctgccgtatgtgaataacacggaactatcagccctgcagagctctaaaatcctcgagtcccccgaacctctgcttcgaagtgctagcggccgccaggagtctttgtcctcagccaccccaggggaggcaagtaaggaatgcagaaacgccaagaaaataagctgtatttcgcccaggttcggagtacctatggagaatctgacagcttgcggcgaatccccaaactacaagatctataaaactcccacccggatctacaagtctaataacaaaggtgagatttggtgcgccggggacgtccactgttttcaagaatttacaccggtgttacaggaggttgtggataagctcaagaaaatgacttgctttctgaccgagcctgaagcagaggaagacgcgttcagcatcgctattgccatgtgtaagatacttgacaaaggcgtctgcacgatcaattcagagcgctggaacattatcaagtgtgatagtggactgatgtattacacagaccagagagatggccaggacaccgggaatgattttggagaatattgcatttcccacaactgtaaaactgagaggttccccatcaatccatctataatcagcgactgcgtgtgggagtaccattcccgtaagtcacggtacattagcacattgaacctcgaaagtctggaggaatttaagcgagcaatctctgagaaactatcccacaccctggtagtgtatcaattcaagcctactagcaatctcccccatatgaaaccagtttacaagtatattaccgcccagggtgtcgaaaactcggatggcatcgactcagctttcataacagcctctatgcccgcactgagtgggacgtccattggatacaatgtgatgagcaaagataactttcctcttttcgacatcatcatttttataaagtctgctgtgatcaagaccacttataatcacatttacgatacaggcccaaccatcggtattaacgtcatgcatgacgagcactgtacagggcagtgcccgatcgagataccccacaaagaaaactggttgactttcagccaggagagaacctccaggtggggctgtgaagagtttggatgcctggccatcaatacgggctgcgttttcgggtcatgtcaagatattatccgccctgagacaaaggtgtatcggaaagcgattgaagagagtgtgttactcaccgtatgcgtcacttacccaggaaacaccttttgtacagaaatcaatgccatagagcccaagattactgacgaactggagcttcagttcaaaaccgtggacacaaagacgctgcctaacctactcgctgttcagaatcataaactgtacagcggccagatcaacgatttgggttcttttgcacaagggtgcggaaatatccagaagaccaacctgtccgtgattggcactggtacagccaagttcgactatatctgtcacggcgcttcaagaaaagatatagtcgtgaggcgctgctacaataacaattatgagagttgtaagttactcaaagaggaaccaagcctgattttctccgacaaccatgaaaccatcgaggttgccaatattcgacaccttctgggggaattgcagttcaagctcatgctgggagatctacggtacaaatctttcgcagagaaccccgagctggaaatcgaggcgcgttgcgtgggctgtccgtcgtgctttagctcatattcctgtaatttcagaataagttctagcattgacactgtatgcgccatcgatgggccttgcacaatctttcattccaggcttattatctcatctaccaagcaagactacggaattaagatgagctgtaaagaaaagccaaaccccgtcgagaaattcaacatatgcaagcgcgtgtatagtgtgctctttacgactatcgataaaaatgacaagattgaaatcaacaccggcgatcagacatccttcatccaggagaaggacgatcggtgtaaaacctggctgtgcagagtcagggacgagggtattagcgttatatttgaacctatcaaggctttctttgggtcttacttctcaattgccttttacgtggtaatcggaattatcgcattgttcataatcatttatatctttctgcccatggtgttcaaattaaaggacattctcaaaaagaatgagctgctttacctgcaggaaatgaagtataaatga

SEQ ID NO: 10875 - RNA, 4305 nt, synthetic construct
  misc_feature 1..4305: note = derived and/or modified CDS sequence (opt3) from ANADV(EIV-23263Tyum)__KT313760.1__GP
  source 1..4305: mol_type = other RNA
atgttcctgatcctcgtgcttctgattcccttttacataaccgccacacctgtcactacgagatgcttccacggcgggcagttgatcgctgagagcaagtccttaaccgcaatttctgaattttgtctgaaagacgatgtttcaacagtgaagagtgagatcacttatctaaagaacgacaccggaattttcgcccatagcaaggtactcaggaattggatcataaaagattggaagaactgcaatccagtgccgacagcgggtggctccatcaacgtcattgaagtgaatgctgacctgtctctttcgaccaagacttacgtttgttcacgggattgcacaatcaccgtggacaaagaggatgcccaaattatctttcagacggacaagctgaaccacttcgaagtcagcgggactaccttgagttccggatggtttaaaacaaaggcatctgtgactctcgatcgcacctgtgagcatataaaagtaacatgcggcaagaagaccctgcagttccacgcctgttttaaacatcacatgagctgcattcgattctttcacaatacgatcctgcccggtactatggctgtttccatttgtcagaacatcgagctcatcattataacatcattaaccctgatcattttcatccttatggtgatattgactaagacatatatttgctacgtcctgatgcctctatttatgccagtggcatatctctacgggtgggcctataatcgtagttgtaaaaagtgcagctgctgtggactggcttaccatcccttcaccaactgcggctctcactgtgtgtgcggccttaaattcgaagcctccgacagaatgaggatccatcgggagtcagggctgtgtcaaggatacaagagcttgcgcgtcgcgagactcctgtgcaaaagtaagggttcttccttaatcattagcatcctgctctcggttcttattctgtcttttgtgacgcctatagaaggcaccttgacaaattatccagagtccaagaaatactcactagaggaaatcgcagatgtaattgaggggttcatcgccgaaaggggaatcaaggagtatattgtgctgtacaccagtatatttggcgctctcctgcttctgatcgccttgattatcactgtcagcctcaaccggattacagaatatctgactaatttaaacgtgatctactgtcacgagtgctccatgtatcactctaaaaagaatataaaatacatcggtgacttcaccaacaagtgtgggttttgcacatgtggagagctggaagatcaggagggcctaaacatgcataaggttagcaaaaagtgcatttaccgctatcagctcacctggtcaaaagtgatcatgactattctggtctgccttttgatcgcacagaatacggtgctgatagtagctgccaacgacgactgttgggcgaagcaaagtctcgaaattgagtgcgttggccccctgcaacaggtggatgcctgtgaagacaaatccagccgatcttacaatggggaggcaagaaaacttgtcggaacatcaaaggtgaccgagctggatgctggtcaggtcaacttgctcggccagactatcgaaagtgccattatcgctataaggaaacagcggacctatgccacaatgcacttcctggagagcgtgtttttagggcgtcattgcgactactataaggttttcgaacacaattccggatactctcaggcaaaatggcgcctgctagccaagaccaaccattttgatatctgttcgagacacagcactcaccatttctgtaggtgcatgtccgacggcacaaaatgcgagaatggtaactgggattttgctggggaaatgaatacgacctatcactcaaagcgggacttctttaagcatgatttcaaactcttctgtactctgcttgagaacgcgtttcctggcacaaccgagagtttgtactaccaactgctctctaagcgaaatacaactggagcaagcaaactgttaggcaagctgattaccaaattcgggaacaataacctttttgtgggaatctggaagttcggtcagtttttgctctccctgccatatgtaaataacacggaactatcagccctgcagagctctaaaattctcgagtccccggaacccctgcttcgcagtgctagcggcagacaggagtctttgtcctcagccacccctggggaggcaagtaaggaatgcaggaacgccaagaaaatcagctgtatatcgccacggttcggagtccccatggagaatctgacagcttgcggcgaatcccctaactacaagatttttaaaactccaacccgcatctataagtctaataacaaaggtgagatctggtgcgccggggacgtgcactgtttccaagaatttacacccattttacaggaggttgtggataagctcaagaaaatgacttgcttcctgaccgagccggaagcagaggaagacgcgtttagcatcgctattgccatgtgtaagatacttgacaaaggcgtctgcacgatcaattcagagagatggaacattatcaagtgtgatagtggactgatgtactatacagaccagagggatggccaggacaccgggaatgatttcggagaatactgcatttcccacaactgtaaaactgagcgttttcctatcaatccctctataatcagcgactgcatttgggagtatcattcccggaagtcacgatacatcagcacattgaacctcgaaagtctggaggagttcaagagagcaatttctgagaaactatcccacaccctggtggtataccaattcaagccaactagcaatctccctcatatgaaacccgtgtataagtacatcaccgcccagggtgttgaaaactcggatggcatagactcagcttttattacagcctctatgccagcactgagtgggacgtccatcggatataatgtcatgagcaaagataacttccccctttttgacatcattatattcatcaagtctgctgtgattaagaccacttacaatcacatctatgatacaggccctaccattggtatcaacgtgatgcatgacgagcactgtacagggcagtgcccaatagagatcccgcacaaagaaaactggttgacttttagccaggagaggacctcccgctggggctgtgaagagttcggatgcctggccattaatacgggctgcgtctttgggtcatgtcaagatatcattcggcccgagacaaaggtttacagaaaagcgatcgaagagagtgtgttactcaccgtgtgcgtaacttatcctggaaacaccttctgtacagaaataaatgccattgagccaaagatcactgacgaactggagcttcagtttaaaaccgtcgacacaaagacgctgcccaacctactcgctgtgcagaatcataaactgtacagcggccagatcaacgatttgggttctttcgcacaagggtgcggaaatattcagaagaccaacctgtccgttatcggcactggtacagccaagtttgactacatatgtcacggcgcttcaaggaaagatattgtggtccgccgatgctataataacaattacgagagttgtaagttactcaaagaagaacctagcctgatcttctccgacaaccatgaaaccattgaggtggccaatatccggcaccttctgggggaattgcagttcaagctcatgctgggagatctacgttataaatcttttgcagagaacccagagctggaaatagaggcgagatgcgttggctgtccctcgtgcttcagctcatactcctgtaattttaggattagttctagcatcgacactgtgtgcgccatcgatgggccgtgcacaattttccataaccgccttatcatttcctcaaccaagcaagactatggaataaagatgtcttgtaaagaaaagcctaacccagtagagaaatttaatatctgcaagcgggtctacagcgtgctctttacgactattgataaaaacgacaagatcgaaatcaataccggcgatcagacaagttttattcaggagaaggacgatagatgtaaaacctggctgtgcagggtgcgagacgagggtatatccgtcatcttcgaacccattaaggctttcttcgggagctatttttctatcgccttctacgttgtgattggaatcatagcattgtttatcattatctacattttcctgcctatgggcttcaaattaaaggacatcctcaaaaagaacgagctgctttatctgcaggaaatgaagtacaaatga

SEQ ID NO: 10876 - RNA, 4305 nt, synthetic construct
  misc_feature 1..4305: note = derived and/or modified CDS sequence (opt3) from BATV(804992)__FJ436801.1__GP
  source 1..4305: mol_type = other RNA
atgctgctccttctggtgttgttaatcccctgctgtgtcagcgcctcccctgttattaccagatgcttccacggcgggcagctgatagctgagaggaagtctcaagcagccatctcagaattttgtctaaaagacgatgtgagtacaattaagagcgagatcatttacgaaaagaacgacactggactcttcgcgcataataaggtactgcggaactggatcataaaagattggaagaattgcaacccagtgccgacggctggtggctccatcaatgtcattgaggtgaacaccgacctttctctgacaactaagacctatgtttgttcgcgcgattgcacaatcaccgtggacaaagaagatgcccagattatctttcagactgagaagttgaatcacttcgaggtctcagggacaaccctcagcagtggatggtttaaaacgaaggcatccgtgactctggaccgaacctgtgaacatataaaagtaacatgcggcaagaagactctgcagttccacgcctgttttaaacatcacatgtcttgcattcgtttctttcacggtaccatcctccccgggacaatggctaccagcatttgtcaaaacatcgagttaatcattataatctccctgacgcttattatcttcatattgatggttattctgactaagacatacatctgctatctactcatgcctctgtttatgccaatcgcatacttctatggatggtcatacaataaaagttgcaagaaatgtccctgctgtggccttgcctatcatccttttaccaactgcggcagccactgtgtgtgcgggctgaagttcgaggcttctgatagaatgaggattcatcgggaatccggattgtgtcagggttacaaatcactccgcgtcgccagactgttatgcaagagcaagggcagttctctgatcatttccatactccttagcatgctgatcttgtcgttcgtgactccaattgaggggacactaaccaattaccccgaatctaggaaatatgacctggaggaaatcgcggatgtgctcgagggatttgtcgttgaaaagggcatcaaagagtacgtggtattctatacgtccatttttggtgcactgttccttctgatggccttgatagtgatcattgctctcaaccgggtcaccgagtacctgacaaatatcaacgtgttatattgtcacgaatgctcaatgtaccacagtaagaaaaatattaagtatatcggggactttactaacaagtgtggattctgtacctgcggcgagctggaagatcaggagggcctaaaaatacataaggttagccgcaaatgcatctacaagtaccagctcacatggtccaaagtgattatgatgatcctggtctgccttttgattgcccaaaacactatcctgatagtggcagcttctgacgactgttggaccaaaaagagcctcgaaatggagtgcattgggcctctgcagcaggtagatacatgtgacgataaaacctcacgaagttattccggagaggccaagaaacttgttagagcgagcaagatctctgacctggatgccgcacaggtgggtttgctcggctcaactattgaaagtgctatcgccagcataaggcggcaacgtacgtactccacaatgcacctgttagagtctgtctttctggggaaacattgcgactattacaaggtgttcgaacacaattcgggatatagccaggctaagtggcgcctaaccgccaaaactcatcactttgatatctgttccagacactcaacccatcacttctgtaggtgcattagtgacggcacaaagtgccagaacggtgattgggactttgcaggggagatgaactctatctaccaaagcaaaaaggatttctttaaacatgacttcaaactcttctgtaccctggtcgaaaatgcctttccaggcactacagagtcccttttctatgagatgttgtcaaagaagaatacgaccggaattactaagctgctcgacaaactgacaaagaaatttggcaacaataacatgttcgtggggatctggaagtttggacagtacttaatgagcctgccgtacgttaatgaaacctctctttcccccatacagttggctaaagtgctcgaggtaacagatcagcaccaccggagtgtcagcggtcgacaagaatctctggcgtccgcaactcctggctcaaagagtagcgagtgcgaccatgccaagaaagtgtcgtgcatttccccacgcttcggggctcccatggagggactaatggcctgtggcaactctcctaattataagatctacaaaaccccagcaaagctgtataaaagcaacaataagggtgaagtttggtgctcaggggatgtgcactgttttcaggagctcacgcccgccagtcaggaatccgtcgacagaatcaagcagatgacctgcttcctgacagagccggaagtgaacgatgacgtattttctattgctatcgccatgtgtaaagtgcaagataagggcgtttgcactattaatgaggacaggtggaacataatcaaatgtgatagcggacttatttactataccgaccagcgggagggccaggatacagggaacgacttcggagaatactgcttgtcccattcatgtcgcatcgagagatttcctattaatcccgcaatcataagcgattgcctgtgggaatatcacagtaggaagtctaaatacatcacttccttagacctcgagagcctggaagagttcaagcgtgcgatttcggagaaactttcacataccctggtcgtgtacaactttaaaccaacggctaatttgcctcacatcaagcccgtgtataaatacattacagtccagggtgttgaaaactctgacggcgtggatagtgcctatatcaccgcatccatgccagccctcagcgggacttctataggatacaatattatgagccgggacaacttccccctgttcgatatcatcatttttataaagtccgctatcattaaagccacatataatcacatctacgacaccggccctactattggtatcaacgtgatgcatgatgagcactgtaccgggcaatgcccaacagacataccgcataaggaaaattggatcacgttcgcacaggagcgaacctcaagatggggctgcgaagagtttggatgtctagctgtaaacactggctgcgtcttcgggagttgtcaggatattatcaggcccgagacaaaagtgtatcgcaaggccgttgaagagagcgtgctgctcaccgtctgcattacataccctggaaagactttttgtaccgaaatcaatgcgatagagccaaaaattacggacgagctggaacttcagttcaagacagtggataccaaaactttgcccaacatcctggccgttcaaaatcacaagttatactctggccagatcaacgacctcggttccttttcacaggggtgcggaaatattcaaaagaccaacagtagcatcataggcacaggtactgctaagttcgattatgtgtgtcatggcgcatcccggaaggacattatcgtaagaaggtgctacaacaataactatgagtcttgtaaactgcttaaggaggaacagtcgctgatgtttgccgataatcacgaaaccattgacgtcgctaacgtgcgccacctactcggggacctgcagttcaaattgatgctgggagatttacgatacaagagctttgccgagaatcctgacctcgagatcgaagcaaaatgcgtgggctgtccatcatgcttcacatcctatagttgctctttcaagatagtcagcaacattgatacggtttgttccatcgaggggccctgcaccacttttcataatcggctgatgatcacatcaaccaagcaggactacggaattaaaatgtcttgtaagactaaaccgggccttacagaagagttccaaatctgcaagaaaacctatacggtgctgtttgcgactgtagaaaagaacgataagattgagataagcaccggtgaccagacaagtttcatccaggagcgtgatgacagatgtaaaacctggttgtgcagggtgcgcgatgaagggatttccgtcatctttgagcctatccgggccttctttggaagctacttctctattgctttttacatagtgatcggcattatcgttctcttcctggtgatttatatctttctaccaatgatgttcaagctgagagacgtccttaaaaggaatgaatacctctatctgcaggagataaagcacaaatga

SEQ ID NO: 10877 - RNA, 4305 nt, synthetic construct
  misc_feature 1..4305: note = derived and/or modified CDS sequence (opt3) from BATV(8627-11)__FJ436799.1__GP
  source 1..4305: mol_type = other RNA
atgctgctccttctggtgttgttaatcccctgctgtgtcagcgcctcccctgttattaccagatgcttccacggcgggcagctgatagctgagaggaagtctcaagcagccatctcagaattttgtctaaaagacgatgtgagtacaattaagagcgagatcatttacgaaaagaacgacactggactcttcgcgcataataaggtactgcggaactggatcataaaagattggaagaattgcaacccagtgccgacggctggtggctccatcaatgtcattgaggtgaacaccgacctttctctgacaactaagacctatgtttgttcgcgcgattgcacaatcaccgtggacaaagaagatgcccagattatctttcagactgagaagttgaatcacttcgaggtctcagggacaaccctcagcagtggatggtttaaaacgaaggcatccgtgactctggaccgaacctgtgaacatataaaagtaacatgcggcaagaagactctgcagttccacgcctgttttaaacatcacatgtcttgcattcgtttctttcacggtaccatcctccccgggacaatggctaccagcatttgtcaaaacatcgagttaatcattataatctccctgacgcttattatcttcatattgatggttattctgactaagacatacatctgctatctactcatgcctctgtttatgccaatcgcatacttctatggatggtcatacaataaaagttgcaagaaatgtccctgctgtggccttgcctatcatccttttaccaactgcggcagccactgtgtgtgcgggctgaagttcgaggcttctgatagaatgaggattcatcgggaatccggattgtgtcagggttacaaatcactccgcgtcgccagactgttatgcaagagcaagggcagttctctgatcatttccatactccttagcatgctgatcttgtcgttcgtgactccaattgaggggacactaaccaattaccccgaatctaggaaatatgacctggaggaaatcgcggatgtgctcgagggatttgtcgttgaaaagggcatcaaagagtacgtggtattctatacgtccatttttggtgcactgttccttctgatggccttgatagtgatcattgctctcaaccgggtcaccgagtacctgacaaatatcaacgtgttatattgtcacgaatgctcaatgtaccacagtaagaaaaatattaagtatatcggggactttactaacaagtgtggattctgtacctgcggcgagctggaagatcaggagggcctaaaaatacataaggttagccgcaaatgcatctacaagtaccagctcacatggtccaaagtgattatgatgatcctggtctgccttttgattgcccaaaacactatcctgatagtggcagcttctgacgactgttggaccaagcgaagcctcgaaatggagtgcattgggcctctgcagcaggtagatacatgtgacgataagacctcaagaagttattccggagaggccaaaaagctggttagggcgagcaaaatctctgaccttgatgccgcacaggtgggtttgctcggctcaactattgaaagtgctatcgccagcatacggcgtcaacgcacgtactccacaatgcacctgttagagtctgtctttctggggaagcattgcgactattacaaagtgttcgaacacaattcgggatatagccaggctaagtggagactaaccgccaagactcatcactttgatatctgttccaggcactcaacccatcacttctgccggtgtattagtgacggcacaaaatgccagaacggtgattgggactttgcaggggagatgaactctacctaccaaagcaagaaagatttctttgaacatgacttcaaactcttctgtactctggtcgagaatgcctttccaggcacaacggagtcccttttctatgaaatgttgtcaaagaagaataccactggaatcacaaaactgctcgacaagctgaccaagaaatttggcaacaataacatgttcgtggggatttggaagtttggacagtacttaatgagcctgccgtacgttaatgagacatctctttcccccactcagttggctaaagtgctcgaagtaaccgatcagcaccaccgaagtgtcagcggtcgccaagagtctctggcgtccgcaacgcctggctcaaagagtagcgagtgcgaccatgccaaaaaggtgtcgtgcatctccccaagattcggggttcccatggaaggactaatggcttgtggcaactctcctaattataagatatacaaaaccccagccaagctgtataaaagcaacaataagggtgaggtgtggtgctcagggaacgtccactgttttcaggaactcaatcccgcaagtcaggagtccgtggataggattaaacagatgacatgcttcctgactgaaccggaggtaaacgacgatgtgttttctatcgccatcgctatgtgtaaggttcaagacaagggcgtctgcaccattaacaaagatcggtggaatatcattaagtgtgacagcggacttatatactatacagatcagcgcgagggccaggacactgggaacgatttcggagaatactgcttgtcccattcatgtagaatcgagaggtttcctattaatcccgccatcattagcgactgcctgtgggaatatcacagtcgtaaatctaagtacatcacctccttagatctcgagagcctggaagagttcaaacgggcaatatcggagaaactttcacatacgctggtggtgtacaactttaagccaacagcgaatttgcctcacatcaaacccgtctatgaatacattaccgttcagggtgtggagaactctgacggcgtggacagtgcttatatcactgcctccatgccagcactcagcgggacatctattggatacaatatcatgagccgagataacttccccctgttcgacataattatctttatcaagtccgccattataaaagctacctataatcacatctacgatactggccctaccattggtatcaacgtaatgcatgacgaacactgtacagggcaatgcccaacggatattccgcataaggagaattggatcaccttcgcccaggaaagaacttcaaggtggggctgcgaggagtttggatgtctagcagtcaacacaggctgcgtgttcgggagttgtcaggacataatccgccccgaaaccaaagtttatcggaaggctgtggaggaaagcgtcctgctcacagtgtgcattacttaccctggaaaaaccttttgtacggagatcaatgccattgagccaaagatcacagatgaactggagcttcagttcaagaccgttgacactaaaaccttgcccaacatactggcggtgcaaaatcacaagttatactctggccagattaacgatctcggttccttttcacaggggtgcggaaacatccagaaaacaaatagtagcatcattggcactggtaccgccaagttcgactatgtatgtcatggcgcttccagaaaagatatcatagtcaggcgctgctacaacaataactatgaatcttgtaagctgcttaaggaggaacaatcgctgatgtttgcagacaatcacgagacaattgatgtggccaacgtgcgacacctactcggggacctgcagttcaaattgatgctgggagacttacggtacaagagctttgctgagaatcctgatctcgaaatcgaggccaaatgcgtcggctgtccatcatgcttcacgtcctatagttgctctttcaagattgttagcaacatcgacaccgtgtgttccatagaagggccctgcactacatttcataatcgtctgatgattacctcaactagacaggattacggaatcaaaatgtcttgtaagacaaagccgggccttaccgaggaatttcaaatctgcaaaaagacgtatactgtactgttcgcaaccgtggagaaaaacgacaagattgagatcagcacaggtgatcagaccagtttcattcaggaaagggacgatcgctgtaaaacttggttgtgccgggtcagagacgaggggatatccgtgatctttgaacctattagggcgttctttggaagctacttctctatcgccttttacatcgttattggcataatcgtcctcttcctggtgatttatatctttctaccaatgatgttcaagctgcgagatgtgcttaagcgcaatgagtacctctatctgcaggaaattaaacacaagtga

SEQ ID NO: 10878 - RNA, 4305 nt, synthetic construct
  misc_feature 1..4305: note = derived and/or modified CDS sequence (opt3) from BATV(Chittoor/IG-20217)__JX846599.1__GP
  source 1..4305: mol_type = other RNA
atgctgctccttctggtgttgttaatcccctgctgtgtcagcgcctcccctgttattaccagatgcttccacggcgggcagctgatagctgagaggaagtctcaagcagccatctcagaattttgtctaaaagacgatgtgagtacaattaagagcgagatcatttacgaaaagaacgacactggactcttcgcgcataataaggtactgcggaactggatcataaaagattggaagaattgcaacccagtgccgacggctggtggctccatcaatgtcattgaggtgaacaccgacctttctctgacaactaagacctatgtttgttcgcgcgattgcacaatcaccgtggacaaagaagatgcccagattatctttcagactgagaagttgaatcacttcgaggtctcagggacaaccctcagcagtggatggtttaaaacgaaggcatccgtgactctggaccgaacctgtgaacatataaaagtaacatgcggcaagaagactctgcagttccacgcctgttttaaacatcacatgtcttgcattcgtttctttcacggtaccatcctccccgggacaatggctaccagcatttgtcaaaacatcgagttaatcattataatctccctgacgcttattatcttcatattgatgattatcctgactaagacatacatctgctatctactcatgcctctgtttatgccaattgcatacttctatggatggtcatacaataaaagttgcaagaaatgtccctgctgtggccttgcctatcatccttttaccaactgcggcagccactgtgtttgcgggctgaagttcgaggcttctgatagaatgaggatccatcgggaatccggattgtgtcagggttacaaatcactccgcgtggccagactgttatgcaagagcaagggcagttctctgattatatccatcctccttagcatgctgattttgtcgttcgtcactccaatcgaggggacactaaccaattaccccgaatctaggaaatatgacctggaggaaatcgcggatgtgctcgagggatttgtggtcgaaaagggcattaaagagtacgttgtgttctatacgtccatatttggtgcactgttccttctgatggccttgatcgtaattatcgctctcaaccgggtgaccgagtacctgacaaatattaacgtcttatattgtcacgaatgctcaatgtaccacagtaagaaaaatatcaagtatataggggactttactaacaagtgtggattctgtacctgcggcgagctggaagatcaggagggcctaaaaatccataaggtgagccgcaaatgcatttacaagtaccagctcacatggtccaaagttatcatgatgattctggtgtgccttttgatcgcccaaaacactatactgattgtcgcagcttctgacgactgttggaccaaaaagagcctcgaaatggagtgcatcgggcctctgcaacaggtggatacatgtgacgataaaacctcacgaagttattccggagaggccaagaaacttgtaagagcgagcaagatttctgacctggatgccgcacaggttggtttgctcggctcaactatcgaaagtgctatagccagcatcaggcggcagcgtacgtactccacaatgcacctgttagagtctgtgtttctggggaaacattgcgactattacaaggtcttcgaacacaattcgggatatagccaggctaagtggcgcctaaccgccaaaactcatcactttgatatttgttccagacactcaacccatcacttctgtaggtgcatcagtgacggcacaaagtgccagaacggtgattgggactttgcaggggagatgaactctacctaccaaagcaaacgggatttctttgaacatgacttcaaactcttctgtactctgattgagaatgcctttccaggcacaacggagtcccttttctatgaaatgttgtcaaagaagaataccactggaatcacaaaactgctcgacaagctgaccaagaaatttggcaacaataacatgttcgtggggatatggaagtttggacagtacttaattagcctgccgtacgtcaatgagacatctctttcccccactcagttggctaaagtgctcgaagttaccgatcagcaccaccgaagtatcagcggtcgccaagagtctctggcgtccgcaacgcctggctcaaagagtagcgagtgcgaccatgccaaaaaggcttcgtgcatctccccaagattcggggtgcccatggaaggactaatggcctgtggcaactctcctaattataagatttacaaaaccccagcaaagctgtataaaagcaacaataagggtgaggtatggtgctcagggaactttcactgtttccaggaactcatccccgccagtcaggagtccgtcgataggattaaacagatgacatgctttctgactgaaccggaggtgaatgacgatgttttctctatagctatcgccatgtgtaaggtgcaagacaagggcgtctgcaccattaacaaagatcggtggaacgtgatcaagtgtgacagcggacttatttactatacagatcagcgcgagggccaggacactgggaatgattttggagaatactgcttgtcccattcatgtagaatcgagaggttccctataaaccccgcaatcattagcgactgcctgtgggaatatcacagtcgtaaatctaagtacatcacctccttagatctcgagagcctggaagagtttaaacgggcgatttcggagaaactttcacatacgctgatcgtatacaatttcaagccaacagctaacttgcctcacataaaacccgtgtataagtacattaccgttcagggtgtcgaaaattctgacggcgtggacagtgcctatatcactgcatccatgccagccctcagcgggacatctatcggatacaacattatgagccgagataatttccccctgtttgacataatcattttcatcaaatccgctattatcaaggccacctataaccacatatacgatactggccctaccatcggtattaatgtgatgcatgacgagcactgtacagggcaatgcccaacggatatcccgcataaagaaaactggattacctttgcacaggagagaacttcaaggtggggctgcgaagagttcggatgtctagctgtcaatacaggctgcgtttttgggagttgtcaggacatcatacgccccgagaccaaggtgtatcggaaagccgtggaagagagcgtactgctcacagtctgcattacttaccctggaaagaccttctgtacggaaatcaacgcgatcgagccaaagattacagatgagctggaacttcagtttaaaaccgtggacatcaagactttgcccaatatactggccgttcaaaaccacaaattatactctggccagattaatgatctcggttccttctcacaggggtgcggaaacatccaaaagaccaacagtagcattatcggcacaggtactgctaaatttgactatgtgtgtcatggcgcatccagaaaggatataattgtcaggcgctgctacaataacaattatgagtcttgtaagctgcttaaagaggaacagtcgctgatgttcgccgacaaccacgaaaccatcgatgtggctaatgttcgacacctactcggggacctgcagtttaagttgatgctgggagacttacggtacaagagcttcgccgagaaccctgatctcgagatcgaagcaaagtgcgtgggctgtccatcatgcttcacatcctatagttgctcttttaaaattgtaagcaatatcgacacggtctgttccattgaggggccctgcaccactttccataaccgtctgatgataacatcaaccaagcaggattacggaatcaagatgtcttgtaaaactaagccgggccttacagaagagtttcaaatttgcaaaaagacctatacggtgctgttcgcgactgtggagaaaaatgacaagatcgaaatcagcaccggtgatcagacaagttttattcaggagagagacgataggtgtaagacctggttgtgccgcgtccgggacgaagggatatccgttatcttcgagcctattagagcctttttcggaagctacttttctatcgctttctacattgtgatcggcataatcgtactctttctggtgatttatatcttcctaccaatgatgtttaaactgagggatgtccttaagcgaaacgaatacctctatctgcaggagattaaacacaagtga

SEQ ID NO: 10879 - RNA, 4305 nt, synthetic construct
  misc_feature 1..4305: note = derived and/or modified CDS sequence (opt3) from BATV(41.3)__KM507322.1__GP
  source 1..4305: mol_type = other RNA
atgttactcttccttatcctgttgattccctgctacgccagcgcttcccctgtggtcaccagatgttttcacggcgggcagttaatagcagagtctaggtcaccaacagccgttagtgaattttgcctgaaggacgatgtgagcactatcaaatccgagattatctatgtaaagaacgacacgggactatttgcgcataataaagtgctccggaactggattatcaaggattggaaaaattgtaacccggtccccaccgctggtggctctataaatgtgatcgaagttaacacagacctgtcgctttcaactaagacctacgtgtgcagccgcgattgtacaattaccgtcgacaaggaggatgcccaaatcattttccagactgaaaaactgaatcactttgaggtgagtgggacaaccttgtcctctggatggttcaagacgaaagcaagcgtaactctcgaccgaacctgcgagcatatcaaggttacatgtggcaaaaagactctgcagtttcacgcctgcttcaagcatcacatgtcctgtatacgtttcttccactcaaccattctgcctggtacaatggctaccagtatctgccagaacattgaactcatcatcattataagcctgacgctgcttatctttattttgatggcaatcctgactaaaacatatatatgttacctactcatgccactgttcatgcccattgcctatctttacgggtggtcttataatagatcctgcaagaaatgctcatgttgcggactggcttaccatccttttaccaactgtggcagccactgcgtgtgtggcttgaagttcgaggccagtgataggatgcggatccatcgcgaatctgggctctgccaaggatacaaatccctgagagtcgcgaggttactgtgtaagagcaaaggttcgtctctcatcatttccatccttctgtcaatgttgattctaagtttcgtgactccaatagagggcacactgaccaattatcccgagagccggaagtacgacctcgaagagatcgcagatgtgctggaagggtttattacggagaagggaatcaaagaatatgtcgttttctacacctccatctttggcggtcttttcctgttgctcgccctgattataatcattgctttaaaccgcgtgacagagtatctgactaatatcaacgtattttactgccacgagtgttctatgtatcacagcaagaaaaatattaagtacatcggggacttcaccaacaaatgcggattttgtacatgcggcgaactagaggatcaggaaggcctcaagatacataaggtgtcacgaaaatgcatctacaagtatcagctgacttggagtaaaattatcatgattatccttgtctgtttgctgatagcccagaacaccattctcatcgtggcagcttccaatgactgctgggccaagaaaagcctggagatggaatgtattgggcctcttcaacaggttgagtcttgcgacgataaggcgtcaagaagttacagcggagaggccaagaaactggtgagggcatccaagatctctgacttggatgctgcccaggtcggtctcctgggctcgacaatagaaagcgctatcgcctccattcggaaacagcgtacctatccaactatgcacttactggagtcagtgttcctagcaaagcattgtgactactataaaagttttgaacacaactctgggtacagccaagccaagtggcgcctcacggctaagacacatcacttcgatatctgctccagacactcaacccatcacttttgtaggtgcattagcgacggaactaaatgtcagaatggcgattgggacttcgcgggtgagatgaactctacctatcagtccaagaaagatttcttcgaacatgacttcaagctgttttgcacacttttggagaatgcattcccggggaccactgagagtttttactaccaaatgctgcagaaaaagaacacaacgggcgtagttaaactcctggatgaattaaccaagaagttcggaaataacaatatgtttgtgggcatctggaaattcgggcagtatctgatgagccttccctacataaacgagacttctttgacacctctccagctgtccaagattctagaagcctcaaatcaacaccaccggagtatcagcggacgacaggagtcgctggctaacgccgcatccggtggcaaatctaaggagtgtgaccatgccaaaaaggtcagctgcatctcaccacgctttggggtgcccatggaaggactcattgcttgcggcagttcccctaattataagatctacaaaatgccaaccaagctgtataaatctaacaataagggtgaggtctggtgtagcggggacgtgcactgcttccaggaacttaaccccgcctcccaggagtcagttgatagaattaaacaaatgacatgctttttgactgaaccggagaccaacgaggacgtgttcagcatagcaatcagtatgtgtaaggtacaggataagggcgtctgtacgattaatgaagagaggtggaacgtgatcaaatgcgactctggactgatttactataccgatcagcgggacggccaggatacagggaatgactttggagaatactgtttatcccataactgccgcatcgagagattccctataaatcccactatcattaacgattgtctctgggaataccacagcaggaagtcgaaatatatcacctcactggaccttgagtctctggaggaatttaagcgtgcgattagtgagaaattgtcccatacactcatcgtttacaatttcaagccaactgctaacctgcctcacataaagcccgtgtataaatacattaccgtccaaggtgtggaaaatagcgatggcgtagactctgcctatatcacggcaagcatgccagccctatccgggacatcaatcggatacaacattatgagtaaggataatttccccctgtttgacataatcattttcatcaaaagcgctgtgattaaggccacctataaccacatctacgacactggccctacaataggtatcaatgttatgcatgatgagcactgcaccgggcagtgtccaactgacattccgcataaagaaaactggatcaccttttctcaggagcggacatcccgatggggctgcgaggaatttggatgcctcgcagtcaatacgggctgtgtgtttgggtcatgccaggatattatcagacccgagaccaaggtgtacaggaaagctatagaagagagtgtcctgcttactgtttgtattacatatcctggaaagaccttctgcacagagatcaacgccatcgaaccaaagattactgacgagttggaactgcaatttaaaaccgtggatacgaagacattacccaacatcctcgcggtgcagaatcacaaactgtacagcggccagataaacgaccttggttccttctctcaagggtgtggaaatattcagaagaccaactcgagcatcattggcactggtaccgccaaatttgattatgtatgccatggcgcttcacgcaaggacatcatagtccggagatgttacaataacaattatgagtcctgcaggctgctaaaggaggaacagagtctcatgttcgcagataaccacgagacaattgacgtggccaatgttcgccacctgttgggggatctgcagtttaaattaatgctcggagacctgcgatacaagtctttcgctgaagatcctgaccttgagatcgaagccaaatgtgtgggctgcccaagctgtttcacttcctattcatgcaactttcggatcgtctctaatattgacaccgtgtgcagcatcgaggggccctgtacaacgttccataaccgtctgatgattaccagtactaagcaagattacggaataaaaatgtcctgcaagggcaagccgggtagcacagaagagtttcagatctgtaaaaagacctacactgttttgttcacaaccgtggagaaaaatgacaagattgaaatcaacacgggggatcagacttcttttatccaggagagagacgataggtgcaaaacctggctctgtcgcgtacgggacgaaggaatttcagtcatattcgagcctatcagagcatttttcggctcctattttagtattgcgttctacatcgtggtgggtattatcgtcctgtttctaatgatatatatcttcctgccaatggcctttaaacttagggatgttctcaagcgaaatgaatacctgtatttgcaagagattaagcacaagtga

SEQ ID NO: 10880 - RNA, 4305 nt, synthetic construct
  misc_feature 1..4305: note = derived and/or modified CDS sequence (opt3) from BATV(EIV-1217Astr)__KT313699.1__GP
  source 1..4305: mol_type = other RNA
atgcttctcttccttatcctgttgattccctgctacgccagcgcttcccctgtggtcaccagatgttttcacggcgggcagttaatagcagagtctaggtcaccaacagccgttagtgaattttgcctgaaggacgatgtgagcactatcaaatccgagattatctatgtaaagaacgacacgggactatttgcgcataataaagtgctccggaactggattatcaaggattggaaaaattgtaacccggtccccaccgctggtggctctataaatgtgatcgaagttaacacagacctgtcgctttcaactaagacctacgtgtgcagccgcgattgtacaattaccgtcgacaaggaggatgcccaaatcattttccagactgaaaaactgaatcactttgaggtgagtgggacaaccttgtcctctggatggttcaagacgaaagcaagcgtaactctcgaccgaacctgcgagcatatcaaggttacatgtggcaaaaagactctgcagtttcacgcctgcttcaagcatcacatgtcctgtatacgtttcttccacggtaccattctgcctgggacaatggctacctcaatctgccagaacattgaactcatcatcattataagtttaacgctgcttatctttattttgatggcaatcctgactaaaacatatatatgttacctactcatgccactgttcatgcccattgcctatctttacggatggagctataatagatcttgcaagaaatgctcctgttgcggcctggcttaccatccttttaccaactgtggctcacactgcgtgtgtgggttgaagttcgaggccagcgataggatgcggatccatcgcgaaagtggactctgccaaggttacaaatctctgagagtcgcgaggttactgtgtaagtccaaaggcagctcgctcatcatttctatccttctgtccatgttgattctatcattcgtgactccaatagaggggacactgaccaattatcccgagagtcggaagtacgacctcgaagagatcgcagatgtgctggaaggatttgtcacggagaagggcattaaagaatatgttgtgttctacaccagcatctttggtgggcttttcctgttgctcgccctgatcattataatcgctttaaaccgcgtaacagagtatctgactaatattaacgtgttttactgccacgagtgttccatgtatcactctaagaaaaatatcaagtacattggagacttcaccaacaaatgcggcttttgtacatgcggcgaactagaggatcaggaagggctcaagatccataaggtcagccgaaaatgcatatacaagtatcagctgacttggtcaaaaatcattatgatcattcttgtgtgtttgctgatcgcccagaacaccatactcattgttgcagctagtaatgactgctgggccaagaaatccctggagatggaatgtatcggacctcttcaacagatggagagctgcgacgataaggcgtctagatcatacagtggtgaggccaagaaactggtgagggcaagcaagatttccgacttggatgctgcccaggtcggcctcctggggtctacaatcgaatcggctatagccagcatccggaaacagcgtacctatccaactatgcacttactggagtccgtgttcctagcaaagcattgtgactactataaatcatttgaacacaacagtggatactctcaagccaagtggcgcctcacggctaagacacatcacttcgatatttgcagcagacactccacccatcacttttgtaggtgcatctcagacggcactaaatgtcagaatggtgattgggacttcgcgggggagatgaacagcacctatcagtctaagaaagactttttcaagcatgatttcaaactgttttgcacacttttggaaaatgcattcccgggcaccactgagtccttttactaccaaatgctgcagaagaaaaacacaacgggagtagttaagctcctggatgagttaaccaagaaattcggcaataacaatatgtttgtggggatttggaagttcggacagtatctgatgagtcttccctacatcaacgaaactagcttgacacctctccagctgtctaaaatactagaggcctccgaccaacaccaccggtcaattagtggtcgacaggaaagcctggctaatgccgcatcgggcgggaagtccaaagagtgtgaccatgccaagaaggtctcttgcatcagcccacgctttggagtgcccatggagggcctcatcgcttgcggtgggtcacctaactataaaatttacaagatgccaaccaaactgtataagagtaataacaaaggcgaagtctggtgttccggagatgtgcactgcttccaggagcttaatcccgccttgcaggaatctgttgacagaatcaagcaaatgacatgttttctgactgagccggaaaccaacgaggatgtgttcagcattgcaatatccatgtgcaaggtacaggacaaaggcgtctgtacgatcaacgaggaaaggtggaatgtgattaagtgcgattcagggttaatctactataccgaccagcgggatggacaggacacaggtaacgattttggcgagtactgtctcagccataattgccgcattgaaagattccctatcaaccccactataatcaatgactgtctgtgggagtaccacagtaggaaatctaagtatattacctcccttgatctggaaagtttggaggagtttaaacgtgcgatctcggaaaagctctcacatacactgattgtttacaacttcaagccaactgctaatctacctcacatcaaacccgtgtataagtacataaccgtccaaggggtggagaactctgacggagtagatagtgcctatattacggcatccatgccagccctgagcggcacatctatcggttacaatatcatgagcaaagacaacttccccctctttgacattataatcttcattaagtccgctgtgatcaaagccacctataatcacatttacgatactgggcctacaatcggcataaacgttatgcatgacgaacactgcaccggacagtgtccaactgatatcccgcataaggagaattggattaccttttcacaggaacggacaagtcgatggggctgcgaggagttcgggtgcctggcagtcaacacgggatgtgtgtttggcagctgccaggacatcattagacccgaaaccaaagtgtacaggaaggctatcgaggaatctgtccttttgactgtttgtataacatatcctggtaagaccttctgcacagagattaatgccatcgagccaaaaatcactgatgaactggagttacaatttaagaccgtggacacgaaaacactccccaacattctggcggtgcagaaccacaagctgtactccgggcagatcaatgatctgggatcattcagtcaaggctgtggtaacatacagaaaaccaatagctccattatcggcactgggaccgccaagtttgactatgtatgccatggagcttctcgcaaggatattatcgtccggagatgttacaacaataactatgaatcgtgcaggctactcaaagaggaacagagcctgatgttcgcagacaatcacgagacaatagatgtggccaacgttcgccacttgctgggcgacttacagtttaagctcatgctgggggatcttcgatacaaatcattcgctgaggaccctgacctggaaattgaggccaagtgtgtgggatgcccatcctgtttcactagctattcttgcaattttcggatcgtcagcaacatcgataccgtgtgctccattgaaggcccctgtacaacgttccataatcgtttgatgatcacctcaactaaacaagactacggtattaagatgtcttgcaaggggaaaccgggaagcacagaggaatttcagatatgtaagaaaacctacactgttctcttcacaaccgtggagaagaacgataaaatcgagattaatacgggcgaccagaccagttttatccaggaaagagatgacaggtgcaagacttggctgtgtcgcgtacgggatgagggtatctccgtcgtgttcgaacctattagagcatttttcggcagctatttttctatagcgttctacatcgtggtcgggattatcgttctatttctggtgatttatatcttccttccaatggcctttaagctcagggacgtactgaaacgaaacgagtacttgtatctgcaagaaataaagcacaaatga

SEQ ID NO: 10881 - RNA, 4305 nt, synthetic construct
  misc_feature 1..4305: note = derived and/or modified CDS sequence (opt3) from BATV(EIV-12497Bl)__KT313692.1__GP
  source 1..4305: mol_type = other RNA
atgctcctcttccttatcctgttgattccctgctacgccagcgcttcccctgtggtcaccagatgttttcacggcgggcagttaatagcagagtctaggtcaccaacagccgttagtgaattttgcctgaaggacgatgtgagcactatcaaatccgagattatctatgtaaagaacgacacgggactatttgcgcataataaagtgctccggaactggattatcaaggattggaaaaattgtaacccggtccccaccgctggtggctctataaatgtgatcgaagttaacacagacctgtcgctttcaactaagacctacgtgtgcagccgcgattgtacaattaccgtcgacaaggaggatgcccaaatcattttccagactgaaaaactgaatcactttgaggtgagtgggacaaccttgtcctctggatggttcaagacgaaagcaagcgtaactctcgaccgaacctgcgagcatatcaaggttacatgtggcaaaaagactctgcagtttcacgcctgcttcaagcatcacatgtcctgtatacgtttcttccacggtaccattctgcctgggacaatggctacctcaatctgccagaacattgaactcatcatcattacgagtttaactctgcttatatttatcttgatggcaattctgacaaaaacctatatctgttacctactcatgccactgttcatgcccatagcctatctttacggatggagctataatagatcttgcaagaaatgctcctgttgcggcctggcttaccatccttttactaactgtggctcacactgcgtgtgtgggttgaagttcgaggccagcgataggatgcggattcatcgcgaaagtggactctgccaaggttacaaatctctgagagtcgcgaggttactgtgtaagtccaaaggcagctcgctcatcatctctattcttctgtccatgttgatcctatcattcgtgacaccaattgaggggaccctgacgaattatcccgagagtcggaagtacgacctcgaagagatagcagatgtgctggaaggatttatcaccgagaagggcattaaagaatatgtcgttttctacacaagcatctttggtgggcttttcctgttgctcgccctgatcattataatcgctttaaaccgcgtgactgagtatctgaccaatattaacgtattttactgccacgagtgttccatgtatcactctaagaaaaatatcaagtacattggagacttcacaaacaaatgcggcttttgtacttgcggcgaactagaggatcaggaagggctcaagatccataaggtgagccgaaaatgcatatacaagtatcagctgacctggtcaaaaatcattatgatcattcttgtctgtttgctgatcgcccagaacacaatactcattgtggcagctagtaatgactgctgggccaagaaatccctggagatggaatgtatcggacctcttcaacaggttgagagctgcgacgataaggcgtctagatcatacagtggtgaggccaagaaactggtgagggcaagcaagatttccgacttggatgctgcccaggctggcctcctggggtctaccatcgaatcggccatagcaagcatccggaaacagcgtacttatccaacgatgcacttactggagtccgtcttcctagccaagcattgtgactactataaatcatttgaacacaacagtggatactctcaagctaagtggcgcctcacagcgaagacccatcacttcgatatttgcagcagacactccactcatcacttttgtaggtgcatctcagacggcaccaaatgtcagaatggtgattgggacttcgcaggggagatgaacagcacatatcagtctaagaaagatttcttcgaacatgacttcaagctgttttgcacccttttggagaatgccttcccgggcactacagagtccttttactaccaactgctccagaaaaagaacacgaccggagtggtaaaactgttagatgaactgactaagaagttcggcaataacaatatgtttgttgggatttggaaattcggacagtatcttatgagtttgccctacatcaacgagacaagcctcacccctctgcagctatctaagatactggaggcttccgaccaacaccaccggtcaattagtggtcgacaggaaagcctcgcctcggcagcctccggcgggaaatctaaggagtgtgaccatgctaaaaaggtgagctgcatctcaccacgctttagtgtccccatggaaggactgatcgcctgcggctcctctcctaattataagatttacagaatgccaacaaaactttataagagcaacaataaaggtgaggtgtggtgttccggggatgtccactgcttccaggaattgaaccccgcatcacaggagagcgtggacaggatcaagcaaatgatttgttttctgactgaaccggaggttaatgaggatgtgttcagtatagcgatctctatgtgcaaagtacaggacaagggcgtctgtaccattaacgaggaacggtggaacgtgatcaagtgcgattccggattaatttactatacggaccagcgcgatggccaggacaccgggaatgattttggagaatactgtctcagccataactgcagaatcgagaggttccctataaatcccacaatcattaacgactgtctgtgggaataccactcgcgtaaatcaaagtatatcacttctcttgatctggagagtttggaggaatttaaacgggctatttccgagaagctcagccataccctgatcgtttacaatttcaaaccaacagccaacctacctcacataaagcccgtgtataagtacattactgtccaaggtgtggaaaattctgacggcgtagatagcgcatatatcaccgcctccatgccagctctgtcagggacgagtatcggatacaacattatgagccgagacaatttccccctctttgacataatcattttcatcaaatctgccgtgattaaggcaacatataaccacatctacgataccggccctactataggtatcaatgttatgcatgacgagcactgcacagggcagtgtccaaccgatattccgcataaagaaaactggatcactttttcccaggagagaacctcaaggtggggctgcgaggaatttggatgcctggctgtcaatacaggctgtgtgtttgggagttgccaggacattatccgccccgagacgaaggtgtaccggaaagccgtcgaagagagcgttcttttgaccgtgtgtataacttatcctggaaagacattctgcaccgagattaacgcgatcgaaccaaaaatcacagatgagctggaattacaatttaagactgtggacaccaagacgctccccaatattctggccgtacagaaccacaaactttactccggccagatcaacgatctgggttctttctcgcaagggtgtggaaatatacagaagacaaacagctcaattatcggcaccggtactgctaaatttgactatgtctgccatggcgcatccagaaaggatattatcgtgaggcgctgttacaataacaattatgagagttgccgactactcaaagaggaacagtctctgatgttcgccgacaaccacgagaccatagatgttgctaatgtgcggcacttgctgggggacttacagtttaagctcatgctgggagatcttcgttacaagagcttcgccgaagaccctggcctggagattgaagcaaaatgtgtcgggtgcccatcctgtttcacatcatattcttgcaactttagaatcgtgagcaatatcgacactgtttgcagtattgagggaccctgtaccacattccataacaggttgatgatcacgtccaccaagcaagattacggcattaaaatgagctgcaagggtaaaccggggtctactgaagagtttcagatatgtaagaagacatacaccgtgctgttcactacaatcgagaaaaatgacaagattgaaatcaacaccggagatcagacgtcatttgtacaggagcgcgacgatcggtgcaaaacttggctgtgtagagtcagggacgaaggcatctccgtgattttcgagcctatacgagcgtttttcggtagttattttagcatcgccttctacattgtggtcggcatcattgttctatttctggtgatctatatattccttccaatggcttttaagctccgcgatgtactgaaacggaatgaatacttgtatctgcaagagatcaagcacaagtga

SEQ ID NO: 10882 - RNA, 4305 nt, synthetic construct
  misc_feature 1..4305: note = derived and/or modified CDS sequence (opt3) from BATV(EIV-12845Ms)__KT313690.1__GP
  source 1..4305: mol_type = other RNA
atgcttctcttccttatcctgttgattccctgctacgccagcgcttcccctgtggtcaccagatgttttcacggcgggcagttaatagcagagaacaggtctccaacagccgtttcagaattttgcctgaaggacgatgtgagtactatcaaaagcgagattatctatgtaaagaatgacacgggactatttgcgcataacaaagtgctccggaattggattatcaaggattggaaaaactgtaatccggtccccaccgctggtggctccataaacgtgatcgaagttaatacagacctgtctctttcgactaagacctacgtgtgctcacgcgattgtacaattaccgtcgacaaggaggatgcccaaatcattttccagactgaaaaactgaaccactttgaggtgagcgggacaaccttgagttccggatggttcaagacgaaagcatctgtaactctcgaccgaacctgcgagcatatcaaggttacatgtggcaaaaagactctgcagtttcacgcctgcttcaagcatcacatgagctgtatacgtttcttccactccaccattctgcctggtacaatggctacctcaatctgccagaatattgaactcatcatcattataagtttaacgctgcttatctttattttgatggcaatcctgactaaaacatatatatgttacctactcatgccactgttcatgcccattgcctatctttacgggtggagctataacagatcttgcaagaaatgctcctgttgcggactggcttaccatccttttaccaattgtggctcacactgcgtgtgtggcttgaagttcgaggccagcgataggatgcggatccatcgcgaaagtgggctctgccaaggatacaaatctctgagagtcgcgaggttactgtgtaagtccaaaggtagctcgctcatcatttctatccttctgtccatgttgattctatcattcgtgactccaatagagggcacactgaccaactatcccgagagtcggaagtacgacctcgaagagatcgcagatgtgctggaagggtttattacggagaagggaatcaaagaatatgtcgttttctacaccagcatctttggcggtcttttcctgttgctcgccctgattataatcattgctttaaatcgcgtgacagagtatctgactaacatcaatgtattttactgccacgagtgttccatgtatcactctaagaaaaacattaagtacatcggggacttcaccaacaaatgcggattttgtacatgcggcgaactagaggatcaggaaggcctcaagatacataaggtgagccgaaaatgcatctacaagtatcagctgacttggtcaaaaattatcatgattatccttgtctgtttgctgatagcccagaataccattctcatcgtggcagctagtaacgactgctgggccaagaaatccctggagatggaatgtattgggcctcttcaacaggttgagagctgcgacgataaggcgtctagatcatacagtggagaggccaagaaactggtgagggcaagcaagatctccgacttggatgctgcccaggtcggtctcctgggctctacaatagaatcggctatcgccagcattcggaaacagcgtacctatccaactatgcacttactggagtccgtgttcctagcaaagcattgtgactactataaatcatttgaacacaatagtgggtactctcaagccaagtggcgcctcacggctaagacacatcacttcgatatctgcagcagacactccacccatcacttttgtaggtgcatttcagacggaactaaatgtcagaacggcgattgggacttcgcgggtgagatgaatagcacctatcagtctaagaaagatttcttcgaacatgacttcaagctgttttgcacacttttggagaacgcattcccggggaccactgagtccttttactaccaaatgctgcagaaaaagaatacaacgggcgtagttaaactcctggatgaattaaccaagaagttcggaaacaataacatgtttgtgggcatctggaaattcgggcagtatctgatgagtcttccctacataaatgagactagcttgacacctctccagctgtctaagattctagaagcctccgaccaacaccaccggtcaatcagtggacgacaggagagcctggctaacgccgcatcgggttccaaatctaaggagtgtgaccatgccaaaaaggtcagctgcatctcaccacgctttggcgtgcccatggaagggctcattgcttgcggaagttcccctaattataagatctacaaaatgccaaccaagctgtataaatctaacaataagggcgaggtctggtgtagcggtgatgtgcactgcttccaggaacttaaccccgcctcccaggagtcagttgacagaattaaacaaatgacatgctttttgactgaaccggagaccaacgaggatgtgttcagcatagcaatcagtatgtgtaaggtacaggacaagggggtctgtacgattaatgaagagaggtggaacgtgatcaaatgcgattctggcctgatttactataccgaccagcgggatggacaggacacaggcaatgattttggggaatactgtttatcccataactgccgcatcgagagattccctataaatcccactatcattaacgactgtctctgggaataccacagcaggaagtcgaaatatatcacctcactggatcttgagtctctggaggaatttaagcgtgcgattagtgagaaattgtcccatacactcatcgtttacaatttcaagccaactgctaacctgcctcacataaagcccgtgtataaatacattaccgtccaaggagtggaaaatagcgacggtgtagattctgcctatatcacggcaagcatgccagccctatccggcacatcaatcgggtacaacattatgagtaaggacaatttccccctgtttgacataatcattttcatcaaaagcgctgtgattaaggccacctataaccacatctacgatactggacctacaataggcatcaatgttatgcatgacgagcactgcaccggtcagtgtccaactgatattccgcataaagaaaactggatcaccttttctcaggagcggacatcccgatgggggtgcgaggaatttggctgcctcgcagtcaatacgggatgtgtgtttggctcatgccaggacattatcagacccgagaccaaggtgtacaggaaagctatagaagagagtgtcctgcttactgtttgtattacatatcctgggaagaccttctgcacagagatcaacgccatcgaaccaaagattactgatgagttggaactgcaatttaaaaccgtggacacgaagacattacccaacatcctcgcggtgcagaattacaaactgtatagcggacagataaacgatcttggctccttctctcaaggttgtgggaatattcagaagaccaactcgagcatcattggaactggcaccgccaaatttgactacgtatgccacggtgcttcacgcaaggatatcatagtccggagatgttataataacaattacgagtcctgcaggctgctaaaggaggaacagagtctcatgttcgcagacaaccatgagacaattgatgtggccaatgttcgccacctgttgggcgacctgcagtttaaattaatgctcggggatctgcgatataagtctttcgctgaagaccctgaccttgagatcgaagccaaatgtgtgggatgcccaagctgtttcacttcctactcatgcaactttcggatcgtctctaatattgataccgtgtgcagcatcgagggcccctgtacaacgttccacaaccgtctgatgattaccagtactaagcaagactacgggataaaaatgtcctgcaagggaaagccgggcagcacagaagagtttcagatctgtaaaaagacctatactgttttgttcacaaccgtggagaaaaatgataagattgaaatcaacacgggtgaccagacttcttttatccaggagagagatgacaggtgcaaaacctggctctgtcgcgtacgggatgaagggatttcagtcatattcgagcctatcagagcatttttcggatcctactttagtattgcgttctatatcgtggtgggcattatcgtcctgtttctagttatatacatcttcctgccaatggcctttaagctgagggacgtgctcaagcgaaatgaatatctgtacttgcaagagattaaacataagtga

SEQ ID NO: 10883 - RNA, 4305 nt, synthetic construct
  misc_feature 1..4305: note = derived and/or modified CDS sequence (opt3) from BATV(EIV-2077Astr)__KT313702.1__GP
  source 1..4305: mol_type = other RNA
atgctcctgttccttatcctgttgattccctgctacgccagcgcttcccctgtggtcaccagatgttttcacggcgggcagttaatagcagagtctaggtcaccaacagccgttagtgaattttgcctgaaggacgatgtgagcactatcaaatccgagattatctatgtaaagaacgacacgggactatttgcgcataataaagtgctccggaactggattatcaaggattggaaaaattgtaacccggtccccaccgctggtggctctataaatgtgatcgaagttaacacagacctgtcgctttcaactaagacctacgtgtgcagccgcgattgtacaattaccgtcgacaaggaggatgcccaaatcattttccagactgaaaaactgaatcactttgaggtgagtgggacaaccttgtcctctggatggttcaagacgaaagcaagcgtaactctcgaccgaacctgcgagcatatcaaggttacatgtggcaaaaagactctgcagtttcacgcctgcttcaagcatcacatgtcctgtatacgtttcttccacggtaccattctgcctgggacaatggctacctcaatctgccagaacattgaactcatcatcattataagtttaacgctgcttatctttattttgatggcaatcctgactaaaacatatatatgttacctactcatgccactgttcatgcccattgcctatctttacggatggagctataatagatcttgcaagaaatgctcctgttgcggcctggcttaccatccttttaccaactgtggctcacactgcgtgtgtgggttgaagttcgaggccagcgataggatgcggatccatcgcgaaagtggactctgccaaggttacaaatctctgagagtcgcgaggttactgtgtaagtccaaaggcagctcgctcatcatttctatccttctgtccatgttgattctatcattcgtgactccaatagaggggacactgaccaattatcccgagagtcggaagtacgacctcgaagagatcgcagatgtgctggaaggatttgtcacggagaagggcattaaagaatatgttgtgttctacaccagcatctttggtgggcttttcctgttgctcgccctgatcattataatcgctttaaaccgcgtaacagagtatctgactaatattaacgtgttttactgccacgagtgttccatgtatcactctaagaaaaatatcaagtacattggagacttcaccaacaaatgcggcttttgtacatgcggcgaactagaggatcaggaagggctcaagatccataaggtcagccgaaaatgcatatacaagtatcagctgacttggtcaaaaatcattatgatcattcttgtgtgtttgctgatcgcccagaacaccatactcattgttgcagctagtaatgactgctgggccaagaaatccctggagatggaatgtatcggacctcttcaacagatggagagctgcgacgataaggcgtctagatcatacagtggtgaggccaagaaactggtgagggcaagcaagatttccgacttggatgctgcccaggtcggcctcctggggtctacaatcgaatcggctatagccagcatccggaaacagcgtacctatccaactatgcacttactggagtccgtgttcctagcaaagcattgtgactactataaatcatttgaacacaacagtggatactctcaagccaagtggcgcctcacggctaagacacatcacttcgatatttgcagcagacactccacccatcacttttgtaggtgcatctcagacggcactaaatgtcagaatggtgattgggacttcgcgggggagatgaacagcacctatcagtctaagaaagatttcttcgaacatgacttcaagctgttttgcacacttttggagaatgcattcccgggcaccactgagtccttttactaccaaatgctgcagaaaaagaacacaacgggagtagttaaactcctggatgaattaaccaagaagttcggcaataacaatatgtttgtggggatttggaaattcggacagtatctgatgagtcttccctacatcaacgagactagcttgacacctctccagctgtctaagatactagaagcctccgaccaacaccaccggtcaattagtggtcgacaggagagcctggctaatgccgcatcgggcgggaaatccaaggagtgtgaccatgccaaaaaggtctcttgcatcagcccacgctttggagtgcccatggaaggcctcatcgcttgcggtgggtcacctaactataagatttacaaaatgccaaccaagctgtataaaagtaataacaagggcgaggtctggtgttccggagatgtgcactgcttccaggaacttaatcccgccttgcaggagtctgttgacagaatcaaacaaatgacatgttttctgactgaaccggagaccaacgaggatgtgttcagcattgcaatatccatgtgcaaggtacaggacaagggcgtctgtacgatcaacgaagagaggtggaatgtgattaaatgcgattcagggttaatctactataccgaccagcgggatggacaggacacaggtaacgattttggcgaatactgtctcagccataattgccgcattgagagattccctatcaaccccactataatcaatgactgtctgtgggaataccacagtaggaagtctaaatatattacctcccttgatctggagagcttggaggaatttaagcgtgcgatctcggagaaactctcacatacactgattgtttacaacttcaagccaactgctaatctacctcacatcaagcccgtgtataaatacataaccgtccaaggggtggaaaactctgacggagtagatagtgcctatattacggcatccatgccagccctgagcggcacatctatcggttacaatatcatgagcaaggacaacttccccctctttgacattataatcttcattaaatccgctgtgatcaaggccacctataatcacatttacgatactgggcctacaatcggcataaacgttatgcatgacgagcactgcaccggacagtgtccaactgatatcccgcataaagaaaattggattaccttttcacaggagcggacaagtcgatggggctgcgaggaatttgggtgcctggcagtcaacacgggatgtgtgtttggcagctgccaggacatcattagacccgagaccaaggtgtacaggaaagctatcgaagagtctgtccttttgactgtttgtataacatatcctggtaagaccttctgcacagagattaatgccatcgaaccaaagatcactgatgagctggaattacaatttaaaaccgtggacacgaagacactccccaacattctggcggtgcagaaccacaaactttactccgggcagatcaatgatctgggatcattcagtcaaggctgtggtaacatacagaagaccaatagctccattatcggcactgggaccgccaaatttgactatgtatgccatggagcttctcgcaaggatattatcgtccggagatgttacaacaataactatgagtcgtgcaggctactcaaggaggaacagagcctgatgttcgcagacaatcacgagacaatagatgtggccaacgttcgccacttgctgggcgacttacagtttaaactcatgctgggggatcttcgatacaagtcattcgctgaagaccctgacctggagattgaagccaaatgtgtgggatgcccatcctgtttcaccagttattcttgcaattttcggatcgtcagcaacatcgatactgtgtgctccattgagggcccctgtacaacgttccataatcgtttgatgatcacctcaactaagcaagactacggtattaaaatgtcttgcaaggggaagccgggaagcacagaagagtttcagatatgtaaaaagacctacactgttctcttcacaaccgtggagaaaaacgataagatcgaaattaatacgggcgaccagaccagttttatccaggagagagatgacaggtgcaaaacttggctgtgtcgcgtacgggatgaaggtatctccgtcgtgttcgagcctattagagcatttttcggcagctatttttctatagcgttctacatcgtggtcgggattatcgttctatttctggtgatttatatcttccttccaatggcctttaagctcagggacgtactgaagcgaaacgaatacttgtatctgcaagagataaaacacaagtga

SEQ ID NO: 10884 - RNA, 4305 nt, synthetic construct
  misc_feature 1..4305: note = derived and/or modified CDS sequence (opt3) from BATV(Italy-2009)__KC168047.1__GP
  source 1..4305: mol_type = other RNA
atgttactcttccttatcctgttgattccctgctacgccagcgcttcccctgtggtcaccagatgttttcacggcgggcagttaatagcagagtctaggtcaccaacagccgttagtgaattttgcctgaaggacgatgtgagcactatcaaatccgagattatctatgtaaagaacgacacgggactatttgcgcataataaagtgctccggaactggattatcaaggattggaaaaattgtaacccggtccccaccgctggtggctctataaatgtgatcgaagttaacacagacctgtcgctttcaactaagacctacgtgtgcagccgcgattgtacaattaccgtcgacaaggaggatgcccaaatcattttccagactgaaaaactgaatcactttgaggtgagtgggacaaccttgtcctctggatggttcaagacgaaagcaagcgtaactctcgaccgaacctgcgagcatatcaaggttacatgtggcaaaaagactctgcagtttcacgcctgcttcaagcatcacatgtcctgtatacgtttcttccactcaaccattctgcctggtacaatggctaccagtatctgccagaacattgaactcatcatcattataagcctgacgctgcttatctttattttgatggcaatcctgactaaaacatatatatgttacctactcatgccactgttcatgcccattgcctatctttacgggtggtcttataatagatcctgcaagaaatgctcatgttgcggactggcttaccatccttttaccaactgtggcagccactgcgtgtgtggcttgaagttcgaggccagtgataggatgcggatccatcgcgaatctgggctctgccaaggatacaaatccctgagagtcgcgaggttactgtgtaagagcaaaggttcgtctctcatcatttccatccttctgtcaatgttgattctaagtttcgtgactccaatagagggcacactgaccaattatcccgagagccggaagtacgacctcgaagagatcgcagatgtgctggaagggtttattacggagaagggaatcaaagaatatgtcgttttctacacctccatctttggcggtcttttcctgttgctcgccctgattataatcattgctttaaaccgcgtgacagagtatctgactaatatcaacgtattttactgccacgagtgttctatgtatcacagcaagaaaaatattaagtacatcggggacttcaccaacaaatgcggattttgtacatgcggcgaactagaggatcaggaaggcctcaagatacataaggtgtcacgaaaatgcatctacaagtatcagctgacttggagtaaaattatcatgattatccttgtctgtttgctgatagcccagaacaccattctcatcgtggcagcttccaatgactgctgggccaagaaaagcctggagatggaatgtattgggcctcttcaaagagttgagtcttgcgacgataaggcgtcaaggagttacagcggagaggccaagaaactggtgcgggcatccaagatctctgacttggatgctgcccaggtcggtctcctgggctcgacaatagaaagcgctatcgcctccattcgtaaacagcgcacctatccaactatgcacttactggagtcagtgttcctagcaaagcattgtgactactataaaagttttgaacacaactctgggtacagccaggccaagtggagactcacggctaagacacatcacttcgatatctgctccaggcactcaacccatcacttttgtcggtgcattagcgacggaactaaatgtcaaaatggcgattgggacttcgcgggtgagatgaactctacctatcagtccaagaaagactttttcgaacatgatttcaagctgttttgcacacttttggagaatgcattcccggggaccactgagagtttttactaccagatgctgcagaaaaagaacacaacgggcgtagttaaactcctggatgaattaaccaagaagttcggaaataacaatatgtttgtgggcatctggaaattcgggcaatatctgatgagccttccctacataaacgagacttctttgacacctctccagctgtccaagattctagaagcctcaaatcagcaccaccgaagtatcagcggacgccaagagtcgctggctaacgccgcatccggtggcaaatctaaggagtgtgacaatgccaaaaaggtcagctgcatctcaccaagatttggggtgcccatggaaggactcattgcttgcggcagttcccctaactataagatctacaaaatgccaaccaagctgtataaatctaataacaagggtgaggtctggtgtagcggggacgtgcattgcttccaggaacttaaccccgcctcccaggagtcagttgataggattaaacagatgacatgctttttgactgaaccggagaccaatgaggacgtgttcagcatagcaatcagtatgtgtaaggtacgggataagggcgtctgtacgattaacgaggaacgctggaatgtgatcaaatgcgactctggactgatttactataccgatcaaagagacggccaggatacagggaacgactttggagaatactgtttatcccacaattgcaggatcgagcgtttccctataaaccccgcgatcattaatgattgtctctgggaataccatagccggcgatcgaagtatatcacttcactggaccttgagtctctggaggaatttaaaagagctattagtgagaagttgtcccacaccctcatcgtttacaacttcaaaccaacagccaatctgcctcatataaagcccgtgtataagtacattactgtccagggtgtggaaaacagcgatggcgtagactctgcatatatcaccgccagcatgccagctctatccgggacgtcaatcggatacaatattatgagtaaagataacttccccctgtttgacataatcattttcatcaagagcgccgtgattaaagcaacatataatcacatctacgacaccggccctactataggtatcaacgttatgcacgatgagcattgcacagggcagtgtccaaccgacattccgcacaaggaaaattggatcactttttctcaagagaggacctcccgctggggctgcgaggagttcggatgcctcgctgtcaacacaggctgtgtgtttgggtcatgccaggatattatccggcccgaaacgaaagtgtacagaaaggccatagaagagaacgtcctgcttaccgtttgtattacttatcctggaaaaacattctgcaccgagatcaatgcgatcgaaccaaagattacagacgagttggaactgcagtttaagactgtggataccaaaacgttacccaacatcctcgccgtgcagaatcataagctgtacagtggccaaataaacgaccttggtagcttctcccaggggtgtggaaatattcagaaaacaaactcttcgatcattggcaccggtactgctaagtttgattatgtatgccacggcgcaagcaggaaagacatcatagtccgccgatgttacaataacaattatgagtcatgccggctgctaaaggaggaacaatccctcatgttcgccgataaccatgagaccattgacgtggctaatgttcgtcacctgttgggggatctgcagtttaagttaatgctcggagacctgagatacaaaagtttcgccgaagatcctgaccttgagatcgaagcaaagtgtgtgggctgcccatcttgtttcacaagctattcctgcaactttaggatcgtctcaaatattgacactgtgtgctctatcgaggggccctgtaccacattccacaaccgcctgatgattacgagcaccaaacaggattacggaataaagatgagttgcaaaggcaagccgggttccactgaagagtttcagatctgtaagaaaacatacaccgttttgttcactacagtggagaagaatgacaaaattgaaatcaacaccggggatcaaacgagctttatccaggagcgggacgatagatgcaagacttggctctgtagggtacgagacgaaggaatttctgtcatattcgagcctatccgcgcgtttttcggctcatatttttccattgccttctacatcgtggtgggtattatcgtcctgtttctaatgatatatatcttcctgccaatggcttttaaacttcgggatgttctcaagagaaacgaatacctgtatttgcaggagattaagcataaatga

SEQ ID NO: 10885 - RNA, 4305 nt, synthetic construct
  misc_feature 1..4305: note = derived and/or modified CDS sequence (opt3) from BATV(MM2222)__AB257763.1__GP
  source 1..4305: mol_type = other RNA
atgctgctccttctggtgttgttaatcagctgctgtgtctccgcctctcccgttattaccagatgcttccacggcgggcagctgatagctgagaggaagtcacaaacagcaatcagtgaattttgtctaaaagacgatgtgagcactattaagtccgagatcatttacgaaaagaacgacacgggactcttcgcccataataaggtactgcggaactggatcataaaagattggaagaattgcaaccctgtgccaaccgcgggtggctctatcaatgtcattgaggtgaacacagacctttcgctgactaccaagacatatgtttgttcacgcgattgcaccatcactgtggacaaagaagatgctcagattgtctttcagacagagaagttgaatcacttcgaggtgagcgggaccacgctcagttccggatggtttaaaactaaggcctctgtaaccctggaccgaacatgtgaacatatcaaagttacttgcggcaagaagaccctgcagttccacgcatgttttaaacatcacatgagctgcatacgtttctttcacggtacaattctcccggggaccatggccacgtccatctgtcaaaacattgagttaatcatcattatatcactgactcttatcattttcatcttgatggtgatactgacaaagacctacatttgctatctactcatgcccctgtttatgcctatcgcttacttctatggatggagttacaataaaagctgcaagaaatgtccatgctgtggccttgcatatcatccctttactaactgcggctctcactgtgtctgcgggctgaagttcgaagcctccgatagaatgaggatccatcgggagtcaggattgtgtcagggttacaaaagcctccgcgtggctagactgttatgcaagagtaagggcagttccctgattatcagcattctcctttcgatgctgatattgtctttcgtgacacctatcgaggggaccctaacgaattacccagaatccaggaaatataacctggaggaaattgccgacgtcctcgagggatttgttgtggaaaagggcatcaaagagtacgtagtgttctatacctcaatctttggtgcgctgttccttctgatggcattgattgtcataatcgccctcaatcgggtgacagagtacctgactaacattaatgttttatattgtcacgaatgcagtatgtaccacagcaagaaaaacatcaagtatattggggattttaccaacaagtgtggattctgcacatgcggcgagctggaagaccaggagggcctaaaaatccataaggtgtcccgcaaatgtatatacaagtaccagctcacttggtctaaaatcattatgatgatcctggtctgccttttgattgctcaaaataccatcctgatagtggccgcaagcgatgactgttggacaaagaagtcactcgaaatggagtgcattgggcccctgcagcaggtagacacctgtgaggataaaacttctcgatcctatagcggagaagctaagaaacttgttagagcctctaagatctcagacctggatgcggcccaggtgggtttgctcggcagtacgattgagagcgcaatcgcttccataaggcggcaacgtacatactctaccatgcacctgttagaatcggtctttctggggaaacattgcgactattacaaggtgttcgagcacaacagcggatattcccaggccaagtggcgcctaactgctaaaacccatcactttgatatctgttcaagacacagtacacatcacttctgtaggtgcatttctgacggcaccaagtgccagaatggtgattgggactttgccggggaaatgaacagcatctaccaatccaaacgggatttctttaagcatgacttcaaactcttctgtactctgattgaggatgcatttcctggcacaacggagtcacttttctatgaaatgttgagcaagaaaaataccactggaatcacaaagctgctcgacaagctgaccaaaaagtttggcaacaataacatgttcgtcgggatatggaaatttggacagtacttaatgtctctgccatacgtgaatgagacatcccttagtccgactcagttggccaaggttctcgaagtgaccgaccaccaccatcgaagcatttctggtcgccaggagtccctggcttcagcgacgagtggcagcaaatcgtccgagtgcgatcacgcaaagaaggtatcttgcatcagccccagattcggggtccctatggaaggactaatcgcctgtggcaactcaccaaattataaaatttacaagacccccgctaaactgtataagagtaacaataaaggtgaggtgtggtgctccggggacgttcattgttttcaagaactcatccctgcctctcaggagagcgtggataggattaagcagatgacatgcttcctgactgaaccagaggtcaacgacgatgtgttttccatagcaatctcaatgtgtaaggtacaggacaaaggcgtgtgcaccattaatgaggatcggtggaacgttatcaagtgtgacagcggacttatttactatacagatcaacgcgaaggccaggacactgggaacgatttcggagagtactgcttgagtcactcttgtagaatcgaaaggtttcccataaatccgaccatcatttccgactgcctgtgggagtatcatagccgtaaatcgaagtacatcacgtcattagatctcgaatctctggaggagttcaaacgggccattagtgaaaaactttcccacacactgatcgtctacaactttaagcctaccgctaatttgccccacataaaaccagtgtataagtacattactgtgcagggtgtcgagaacagcgacggcgttgactctgcctatatcacagcaagcatgcctgcgctctccgggacctcaatcggatacaatattatgagtcgagataacttccccctgttcgacataatcatttttatcaaaagcgctattatcaaggccacttataatcatatatacgataccggcccaacaatcggtattaacgtgatgcacgacgaacattgtacggggcagtgccccaccgatatccctcacaaagagaattggattactttcgcacaagaaagaacatctaggtggggctgcgaggagtttggatgtctagccgtgaacaccggctgcgtattcgggtcctgtcaggacatcatacgcccagaaacaaaggtctatcggaaagctgtggaggaatcagttctgctcactgtgtgcattacctacccgggaaagacgttttgtacagagatcaatgccatcgagcccaagattaccgatgaactggagcttcagttcaaaactgtcgacaccaagacattgcctaacatcctggcagtgcagaatcataaattatacagtggccaaataaacgatctcggtagcttttcccaggggtgcggaaatattcagaagactaactcttcgatcattggcaccggtacagctaaattcgactatgtttgtcacggcgccagcagaaaggatatcatagtgaggcgctgctacaacaataactatgaatcatgtaagctgcttaaagaggaacaatccctgatgtttgcggacaatcacgagacgattgatgtagccaacgtccgacatctactcggggacctgcagttcaagttgatgctgggagacttacggtacaaaagttttgctgagaatccagatctcgaaatcgaggcaaagtgcgtgggctgtccctcttgcttcaccagctattcctgctcattcaaaatcgtgtctaacattgacactgtctgtagcatcgaagggccttgcacaacctttcacaatcgtctgatgattacaagtactaagcaggattacggaataaagatgtcctgtaaaaccaagccaggccccatcgaggaatttcagatttgcaaaaagacgtatactatccttttcaccacagttgagaaaaacgacaagatcgagattagcaccggtgatcaaacttctttcatacaggaaaaggacgatagatgtaaaacatggctgtgcagggtgcgcgacgaggggatctcagtaatttttgaaccgatccgggccttctttggatcctacttcagtattgctttttacatcgtgataggcatcattgtcttgttcctcgtgatctatatttttctgcctatgatgttcaagctaagagatgttctgaaaaggaatgagtacctttatctccaggaaatcaagcataaatga

SEQ ID NO: 10886 - RNA, 4305 nt, synthetic construct
  misc_feature 1..4305: note = derived and/or modified CDS sequence (opt3) from BATV(MM2222)__AY772534.1__GP
  source 1..4305: mol_type = other RNA
atgctgctccttctggtgttgttaatcagctgctgtgtctccgcctctcccgttattaccagatgcttccacggcgggcagctgatagctgagaggaagtcacaaacagcaatcagtgaattttgtctaaaagacgatgtgagcactattaagtccgagatcatttacgaaaagaacgacacgggactcttcgcccataataaggtactgcggaactggatcataaaagattggaagaattgcaaccctgtgccaaccgcgggtggctctatcaatgtcattgaggtgaacacagacctttcgctgactaccaagacatatgtttgttcacgcgattgcaccatcactgtggacaaagaagatgctcagattgtctttcagacagagaagttgaatcacttcgaggtgagcgggaccacgctcagttccggatggtttaaaactaaggcctctgtaaccctggaccgaacatgtgaacatatcaaagttacttgcggcaagaagaccctgcagttccacgcatgttttaaacatcacatgagctgcatacgtttctttcacggtacaattctcccggggaccatggccacgtccatctgtcaaaacattgagttaatcatcattatatcactgactcttatcattttcatcttgatggtgatactgacaaagacctacatttgctatctactcatgcccctgtttatgcctatcgcttacttctatggatggagttacaataaaagctgcaagaaatgtccatgctgtggccttgcatatcatccctttactaactgcggctctcactgtgtctgcgggctgaagttcgaagcctccgatagaatgaggatccatcgggagtcaggattgtgtcagggttacaaaagcctccgcgtggctagactgttatgcaagagtaagggcagttccctgattatcagcattctcctttcgatgctgatattgtctttcgtgacacctatcgaggggaccctaacgaattacccagaatccaggaaatataacctggaggaaattgccgacgtcctcgagggatttgttgtggaaaagggcatcaaagagtacgtagtgttctatacctcaatctttggtgcgctgttccttctgatggcattgattgtcataatcgccctcaatcgggtgacagagtacctgactaacattaatgttttatattgtcacgaatgcagtatgtaccacagcaagaaaaacatcaagtatattggggattttaccaacaagtgtggattctgcacatgcggcgagctggaagaccaggagggcctaaaaatccataaggtgtcccgcaaatgtatatacaagtaccagctcacttggtctaaaatcattatgatgatcctggtctgccttttgattgctcaaaataccatcctgatagtggccgcaagcgatgactgttggacaaagaagtcactcgaaatggagtgcattgggcccctgcagcaggtagacacctgtgaggataaaacttctcgatcctatagcggagaagctaagaaacttgttagagcctctaagatctcagacctggatgcggcccaggtgggtttgctcggcagtacgattgagagcgcaatcgcttccataaggcggcaacgtacatactctaccatgcacctgttagaatcggtctttctggggaaacattgcgactattacaaggtgttcgagcacaacagcggatattcccaggccaagtggcgcctaactgctaaaacccatcactttgatatctgttcaagacacagtacacatcacttctgtaggtgcatttctgacggcaccaagtgccagaatggtgattgggactttgccggggaaatgaacagcatctaccaatccaaacgggatttctttaagcatgacttcaaactcttctgtactctgattgaggatgcatttcctggcacaacggagtcacttttctatgaaatgttgagcaagaaaaataccactggaatcacaaagctgctcgacaagctgaccaaaaagtttggcaacaataacatgttcgtcgggatatggaaatttggacagtacttaatgtctctgccatacgtgaatgagacatcccttagtccgactcagttggccaaggttctcgaagtgaccgaccaccaccatcgaagcatttctggtcgccaggagtccctggcttcagcgacgagtggcagcaaatcgtccgagtgcgatcacgcaaagaaggtatcttgcatcagccccagattcggggtccctatggaaggactaatcgcctgtggcaactcaccaaattataaaatttacaagacccccgctaaactgtataagagtaacaataaaggtgaggtgtggtgctccggggacgttcattgttttcaagaactcatccctgcctctcaggagagcgtggataggattaagcagatgacatgcttcctgactgaaccagaggtcaacgacgatgtgttttccatagcaatctcaatgtgtaaggtacaggacaaaggcgtgtgcaccattagcgaggatcggtggaatgttatcaagtgtgacagtggacttatttactatacagatcaacgcgaaggccaggacactgggaacgatttcggagagtactgcttgtctcactcctgtagaatcgaaaggtttcccataaacccgaccatcattagcgactgcctgtgggagtatcattcgcgtaaatcaaagtacatcacgtctttagatctcgaaagtctggaggagttcaaacgggccatttccgaaaaacttagccacacactgatcgtctacaattttaagcctaccgctaacttgccccacataaaaccagtgtataagtacattactgtgcagggtgtcgaaaattctgacggcgttgacagcgcctatatcacagcatccatgcctgcgctctcagggaccagtatcggatacaacattatgagccgagataatttccccctgttcgacataatcatttttatcaaatctgctattatcaaggccacttataaccatatatacgataccggcccaacaatcggtattaatgtgatgcacgacgaacattgtacggggcagtgccccaccgatatccctcacaaagagaactggattactttcgcacaagaaagaacatccaggtggggctgcgaggagtttggatgtctagccgtgaataccggctgcgtattcgggtcatgtcaggacatcatacgcccagaaacaaaggtctatcggaaagctgtggaggaaagtgttctgctcactgtgtgcattacctacccgggaaagacgttttgtacagagatcaacgccatcgagcccaagattaccgatgaactggagcttcagttcaaaactgtcgacaccaagacattgcctaatatcctggcagtgcagaaccataaattatacagcggccaaataaatgatctcggttccttttctcaggggtgcggaaacattcagaagactaattcgagcatcattggcaccggtacagctaaattcgactatgtttgtcacggcgcctcaagaaaggatatcatagtgaggcgctgctacaacaacaattatgaatcctgtaagctgcttaaagaggaacaaagtctgatgtttgcggacaaccacgagacgattgatgtagccaatgtccgacatctactcggggacctgcagttcaagttgatgctgggagacttacggtacaaatcttttgctgagaacccagatctcgaaatcgaggcaaagtgcgtgggctgtcccagctgcttcacctcctattcatgctctttcaaaatcgtgagcaatattgacactgtctgtagtatcgaagggccttgcacaacctttcacaaccgtctgatgattacttccacaaagcaggattacggaataaagatgagctgtaaaaccaagccaggccccatcgaggagttccagatttgcaaaaagacgtatactatcctttttaccacagttgagaaaaatgacaagatcgagatttctaccggtgatcaaacttcattcatacaggaaaaggacgatagatgtaaaacatggctgtgcagggtgcgcgacgaggggatctccgtaatttttgaaccgatccgggccttctttggaagttacttcagcattgctttttacatcgtgataggcatcattgtcttgttcctcgtgatctatatttttctgcctatgatgttcaagctaagagatgttctgaaaaggaacgagtacctttatctccaggaaatcaagcataaatga

SEQ ID NO: 10887 - RNA, 4305 nt, synthetic construct
  misc_feature 1..4305: note = derived and/or modified CDS sequence (opt3) from BATV(MM2222)__JX846596.1__GP
  source 1..4305: mol_type = other RNA
atgctgctccttctggtgttgttaatcagctgctgtgtctccgcctctcccgttattaccagatgcttccacggcgggcagctgatagctgagaggaagtcacaaacagcaatcagtgaattttgtctaaaagacgatgtgagcactattaagtccgagatcatttacgagaaaaacgacacgggactcttcgcccataataaggtactgcggaactggatcataaaagattggaagaattgcaaccctgtgccaaccgcgggtggctctatcaatgtcattgaagtgaacacagacctttcgctgactaccaagacatatgtttgttcacgcgattgcaccatcactgtggacaaagaagatgctcagattgtctttcagacagagaagttgaatcacttcgaggtgagcgggaccacgctcagttccggatggtttaaaactaaggcctctgtaaccctggaccgaacatgtgaacatatcaaagttacttgcggcaagaagaccctgcagttccacgcatgttttaaacatcacatgagctgcatacgtttctttcacggtacaattctcccggggaccatggccacgtccatctgtcaaaacattgagttaatcatcattatatcactgactcttatcattttcatcttgatggtgatactgacaaagacctacatttgctatctactcatgcccctgtttatgcctatcgcttacttctatggatggagttacaataaaagctgcaagaaatgtccatgctgtggccttgcatatcatccctttactaactgcggctctcactgtgtctgcgggctgaagttcgaagcctccgatagaatgaggatccatcgggagtcaggattgtgtcagggttacaaaagcctccgcgtggctagactgttatgcaagagtaagggcagttccctgattatcagcattctcctttcgatgctgatattgtctttcgtgacacctatcgaggggaccctaacgaattacccagaatccaggaaatataacctggaggaaattgccgacgtcctcgagggatttgttgtggaaaagggcatcaaagagtacgtagtgttctatacctcaatctttggtgcgctgttccttctgatggcattgattgtcataatcgccctcaatcgggtgacagagtacctgactaacattaatgttttatattgtcacgaatgcagtatgtaccacagcaagaaaaacatcaagtatattggggattttaccaacaagtgtggattctgcacatgcggcgagctggaagaccaggagggcctaaaaatccataaggtgtcccgcaaatgtatatacaagtaccagctcacttggtctaaaatcattatgatgatcctggtctgccttttgattgctcaaaataccatcctgatagtggccgcaagcgatgactgttggacaaagaagtcactcgaaatggagtgcattgggcccctgcagcaggtagacacctgtgaggataaaacttctcgatcctatagcggagaagctaagaaacttgttagagcctctaagatctcagacctggatgcggcccaggtgggtttgctcggcagtacgattgagagcgcaatcgcttccataaggcggcaacgtacatactctaccatgcacctgttagaatcggtctttctggggaaacattgcgactattacaaggtgttcgagcacaacagcggatattcccaggccaagtggcgcctaactgctaaaacccatcactttgatatctgttcaagacacagtacacatcacttctgtaggtgcatttctgacggcaccaagtgccagaatggtgattgggactttgccggggaaatgaacagcatctaccaatccaaacgggatttctttaagcatgacttcaaactcttctgtactctgattgaggatgcatttcctggcacaacggagtcacttttctatgaaatgttgagcaagaaaaataccactggaatcacagagctgctcgacaagctgaccaagaaatttggcaacaataacatgttcgtcgggatatggaagtttggacagtacttaatgtctctgccatacgtgaatgaaacatcccttagtccgactcagttggccaaagttctcgaggtgaccgaccaccaccatcgaagcatttctggtcgccaggagtccctggcttcagcgacgagtggcagcaagtcgtccgaatgcgatcacgccaaaaaggtatcttgcatcagccccagattcggggtccctatggagggactaatcgcatgtggcaactcaccaaattataagatttacaaaacccccgctaagctgtataaaagtaacaataagggtgaagtgtggtgctccggggacgttcattgttttcaagagctcatccctgcctctcaggaaagcgtggataggattaaacagatgacatgcttcctgactgagccagaggtcaacgacgatgtgttttccatagcaatctcaatgtgtaaggtacaggacaagggcgtgtgcaccattaatgaagatcggtggaacgttatcaaatgtgacagcggacttatttactatacagatcaacgcgagggccaggacactgggaacgatttcggagaatactgcttgagtcactcttgtagaatcgagaggtttcccataaatccgaccatcatttccgactgcctgtgggaatatcatagccgtaagtcgaaatacatcacgtcattagatctcgagtctctggaggagttcaagcgggccattagtgaaaaactttcccacacactgatcgtctacaactttaagcctaccgctaatttgccccacataaagccagtgtataaatacattactgtgcagggtgtcgaaaacagcgacggcgttgactctgcctatatcacagcaagcatgcctgcgctctccgggacctcaatcggatacaatattatgagtcgagataacttccccctgttcgacataatcatttttatcaagagcgctattatcaaagccacttataatcatatatacgataccggcccaacaatcggtattaacgtgatgcacgacgagcattgtacggggcagtgccccaccgatatccctcacaaggaaaattggattactttcgcacaagagagaacatctaggtggggctgcgaggaatttggatgtctagccgtgaacaccggctgcgtattcgggtcctgtcaggacatcatacgcccagagacaaaagtctatcggaaggctgtggaagagtcagttctgctcactgtgtgcattacctacccgggaaaaacgttttgtacagagatcaatgccatcgaacccaagattaccgatgagctggaacttcagttcaagactgtcgacaccaaaacattgcctaacatcctggcagtgcagaatcataagttatacagtggccaaataaacgatctcggtagcttttcccaggggtgcggaaatattcagaaaactaactcttcgatcattggcaccggtacagctaagttcgactatgtttgtcacggcgccagcagaaaagatatcatagtgaggcgctgctacaacaataactatgagtcatgtaagctgcttaaggaggaacaatccctgatgtttgcggacaatcacgagacgattgatgtagccaacgtccgacatctactcggggacctgcagttcaaattgatgctgggagacttacggtacaagagttttgctgaaaatccagatctcgagatcgaagcaaaatgcgtgggctgtccctcttgcttcaccagctattcctgctcattcaagatcgtgtctaacattgacactgtctgtagcatcgaggggccttgcacaacctttcacaatcgtctgatgattacaagtactaaacaggattacggaataaagatgtcctgtaagaccaaaccaggccccatcgaagagttccagatttgcaagaaaacgtatactatcctttttaccacagttgagaagaacgacaaaatcgaaattagcaccggtgatcaaacttctttcatacaggagaaggacgatagatgtaagacatggctgtgcagggtgcgcgacgaagggatctcagtaatttttgagccgatccgggccttctttggatcctacttcagtattgctttttacatcgtgataggcatcattgtcttgttcctcgtgatctatatttttctgcctatgatgttcaaactaagagatgttctgaagaggaatgaatacctttatctccaggagatcaaacataagtga

SEQ ID NO: 10888 - RNA, 4305 nt, synthetic construct
  misc_feature 1..4305: note = derived and/or modified CDS sequence (opt3) from BATV(MS50)__JX846605.1__GP
  source 1..4305: mol_type = other RNA
atgaagatgctgaccctcatcattatagtgagctgctgggtcgccacacttcagaaccccctgatctccagatgtttccacggcgggcaattgattgctgagaaaaagtctttaacttcaatcagtgaattttgcattaaagacgatgttagcatgctgaagtccgaggtgatctaccagaaaaatgacacgggaatatatggtcattctaaggtattcaggcactggaccatcgcagattggaagtactgtaaccctgtgccaacagccggcgggtcgattaatgtcatcgaactagacaaaaacctcaatctgattgcgaagaactatgtgtgcactcgggattgtaccatcacagttgacaaagagaatgctcagatagtgtttcagaccgataagttgaaccatttcgaagtcactggaacaaccatttcaacgggctggtttaaaactaaggccagcgtggcactggaccgaacctgcgagcacatcaaggtaagttgtggtaaaaagacattgcaattccatgcctgctttaaacagcacatgtcctgtgttcgcttcctccaccgttctatgctgccggggagcatggctaattccatttgccagaacatcgagctgatcattataatcactctcaccttagtgatttttatcctgatgcttatagcaacaagattctacatttgttatttgctgatccccgtctttatgcctatcgcctacgcttatggatgggcctacaataggtcatgcaagaaatgcagttgttgcggcctagcgtaccatccattcaccaactgtggcagctattgcgtgtgtggggcacggtttgaaacgtctgatcgcatgagactccacagggagtccggactgtgccagggtttcaagtcacttcggatggcccgccgactgtgtaaaagcaagggcagttctttggtgatttccatcctcctggctactttaattctgagcttcgtcacacccatagaagggaccatgactaattaccctacaaacgagaagtattcgctcgacgagatcgccgatgttcttaaatggaaggaacaagagtctgaatacaaatattacgcaattctgtatgcttccatcatcggagcctgctttaccgtgttgttcgcgggcacggccctagcactgaatattgtactcgagctgcttaccaagataaacgtgatctactgtgaagagtgctcaatgtaccatagtaaaagcaacattaagtatatcggtgactttacaaataagtgtgggttctgcacttgcggactgttggaggatccagacggcgtcgtggttcacaaagtgaagagatcctgtacctaccagtataaactcacatgggtcaagactattatgatcgtgctgtctatattatttctgctacagaacatcattgtaatcgttgctgccgacagcgattgctggaccaatgaggaactcaaacccgaatgtgtgggccctctgattgctccagccgactgcacagagaaggataagaaaacctaccttactgaagcagccgctttggtcaagacgaaaaagatctcacaggtggacgcggataacgtcgagatactggggaaaacaattgagagtgcaatcaaggccattgaaaagcaaaagacctatcacaggatgcatctcctggaggctgtgttccttaataagcactgtgactactataaactgtttgaacataactccggatacagccaggttaagtggcggatgttggccaaaactcagcacttcgatatctgcgcatttgccaaggagtctaaattctgtaagtgcatggctggtggcgcctgtgcagaagactcatgggattttgacaccacaatgaatagtacctacactagcaagggggataacttcaaacatgacatgtccctctttctgaagatattcgaggcggctttcccgggaacatcttatgtgtacatgttaaataaaatcaaggagaaaaagccctatcaatcggtaacgatgattgacaagatcaaaaccaagtaccctaacaataaaatgctggtcgcctatctagaatttggcaagtgcctcatgggtgtggggcacgcaagcactttcgagctgcagcagtcccagcttgaacgtttgtaccaaccagccgagctgtcacgcagtgttggccagctcacatctctgagcaacgctcaggtgggaaccattacaaaagagtgttccaagtataaggatatctcatgcttaagccccagatttggcatacctatggaaaatatggtcgcctgcggggactctccaaactacaaaatttacaagaaacccatcaaggtgtataaagcacacgatagggtagagacttggtgtatcaaggaccagcattgcctggtggattacaccccggctgaagccgacgttgtcaagaaacttaagacgatgaaatgttggttgaatgatcctggaaccgagacagacgcgtatactaccgccattaagtcctgccggatcatggataaaggtgtgtgtacagtgaacggccaaaagtggagtattataaaatgcgacagcgatctcctgtactatactgaccacatcgaaggggaggataccggaaacgacattggccattactgtatctctgtcggttgcaagacggaccgatatcccattaatccagatatcgttacagactgtacctgggagttcaagtcccgcaaatcaagttacatagggaagatcagcatgcagtcgctagaagattacaaaaaggctctgactgacaaactcacacacaccctggagacttattcctttgcacctaccgccgatcttccccacattaagccaatctacaagtatattacagctcagggcgtggaaaactctgacggaatcgagggcgcctacataacggcaaccattcccgcgcttgggggaactagcatcggttattcagtgcagagtaaagatggcttccctctgttagacctcatcatttacataaaggccgctgtaatcagatccacatatattcatctgtacgataccgggccaacaatctctattaatactaaacacgacgaaaagtgcaccggacaatgtccggccgagatcgagcatgaagcaaactggcttacgtttagccaggagaggacatcccggtggggctgcgaagagttcggttgcctggctataaataccgggtgtgtctttggctcatgccaggatgtgatccgccccgaaactaaagtttacagaaagagcgtggaggaggaagtcgtgttgaccgtttgtattaactatcctggaaatacattctgcactgagatcaacgccattgaaccaaagatcaccgaggaggtggaactccagtttaaaacagtagacacgaagaccctgcccactctactggcagtcacaaatcacaaactcttcagtggccaaataaacgatctggggacctttggacagatgtgtggcaatgtgcagaagactaactcttccattcttggtagcgggacacctaaattcgactatacctgccatggagcctcgaggaaggacatcatcgtgcgtaagtgttacaataacaattacgattcatgcaaattgctgaaggaggaaaaacaattagtcttcaacgacgatcacgagacgattactgttgtgaacaatcggcacctcgtaggcgaactggctatcaaacttatactgggtgacattcagtataaactatttaccgagaagctcgatctgcagatcgacgcgaagtgtgtgggctgcccagattgtttcgagtcttacgcctgcaactttcagattgtcagtaatatcgacacagtgtgcgcaataaacgggccctgtgatattttccataatcgaatctccatcagaagcacccaacagaactatggagttaaaatgtcttgcaagaggactccggaccagaatgaaaaatttgtgatttgtggccgcgagtacagcgtcttctttcacacagtgcagaagaacgataaaatcgaaattaataccggggaccaaacatcctacataaaggagatggacactcggtgcaaaacctggttgtgtagagttagggatgaaggactgtcagtgatcttcgagcctattaaggcctttttcggcagttattttagcatcgctttctacatcgtcttattcattataatcgcctttctcgtaatttatatcttcatgccaatgtttatgaagctgcgcgacattcttaaacagaacgagaagctgtacttgcaggaaatcaaacagaagtga

SEQ ID NO: 10889 - RNA, 4305 nt, synthetic construct
  misc_feature 1..4305: note = derived and/or modified CDS sequence (opt3) from BATV(NM/12)__KJ187039.1__GP
  source 1..4305: mol_type = other RNA
atgctgctccttctggtgttgttaatcccctgctgtgtcagcgcctcccctgctattaccagatgcttccacggcgggcagctgatagcagagaggaagtctcaaacagccatctcagaattttgtctaaaagacgatgttagtactattaagagcgagatcatttacgaaaagaacgacacgggactcttcgcgcataataaggtgctgcggaactggatcataaaagattggaagaattgcaacccagtaccgaccgctggtggctccatcaatgtgattgaggtcaacacagacctttctctgactaccaagacatatgtgtgttcgcgcgattgcaccatcactgttgacaaagaagatgcccagattatctttcgaacagagaagttgaatcacttcgaggtgtcagggaccacgctcagcagtggatggtttaaaactaaggcatccgtcaccctggaccgtacatgtgaacatataaaagtgacttgcggcaagaagaccctgcagttccacgcctgttttaaacatcacatgtcttgcattagattctttcacggtacaatcctccccgggaccatggctacgagcatttgtcagaacatcgagttaatcattataatctccctgactcttattatcttcatattgatggtaattctgacaaggacctacatctgctatctactcatgcctctgtttatgccaatcgcatacttctatggatggtcatacaataagagttgcaaaaagtgtcaatgctgtggccttgcctatcatccctttactaactgcggcagccactgtgtttgcgggctgaaattcgaagcctctgatcggatgcgcattcatagagagtccggattgtgtcagggttacaagtcactcagggtggcccggctgttatgcaaaagcaagggcagttctctgatcatttccatactccttagcatgctgatcttgtcgttcgtcacacctattgaggggaccctaacgaattacccagaatctcgcaagtatgacctggaggaaatcgcggatgtgctcgagggatttgtggtcgaaaaaggcatcaaggagtacgttgtgttctatacctccatttttggtgcactgttccttctgatggccttgataatcattatcgctctcaaccgagtaacagagtacctgactaatattaacgtgttttattgtcacgaatgctcaatgtaccacagtaaaaagaatatcaaatatataggggacttcaccaacaagtgtggattttgcacatgcggcgagttagaagatcaggagggcctgaagatccataaagtcagcagaaagtgtatttacaaataccagctaacttggtccaagatcattatgatgatcctcgtgtgcctgcttatagcccaaaacaccattttgatcgttgcagcttctgacgactgttggacaaaaaggagcctggaaatggggtgcattggacccctccaacaggtggatacctgtgacgataagacttcacggagttattccggtgaggccaagaaactggtccgtgcgagcaagatctctgaccttgatgccgcacaggtgggcctgttggggtcaacgatagagagtgctatcgccagcattcgcaaacaaagaacatactccaccatgcacctcctggaatctgtattcttaggaaagcattgcgactattacaaagtttttgagcacaattcgggctatagccaggctaagtggaggctgactgccaagacccatcacttcgatatctgttcccggcactcaacacatcacttttgccgatgtattagtgacggtaccaaatgccagaacggggattgggacttcgcatctgaaatgaatagcacttaccaatccaagcgcgactttttcgagcatgatttcaaacagttttgtacactaatcgaaaacgccttccctggcacgaccgagtcactcttttatgagatgctgagcaagaaaaatactacaggaataaccaaacttttggacaaactgacaaagaagttcggcaacaataacatgtttgtggggatttggaaattcggacagtacctcatgtctctgccatacgtcaatgaaacttccttaagtccgacccagctggctaaggtgcttgaggtcacggatcaccaccatagaagcatctctggtaggcaagaatccttggcgtcagcagcccccggcagtaaaagctcggagtgcgaccacgctcggcgcgtgtcctgcatctctcctagatttggggttccaattgagggactcaccgcctgtggcagctcacccaactataagatctacaaaactcctgcaaagctgtataagagtaataacaaaggtgaagtgtggtgctccggggatgtacattgtctacaggagctgattccagctccccaggaatctgtcgacaggataaagcagatgacatgcttcctcaccgagccgggcgtgaatgatgacatctttagcattgctatctccatgtgtaaagttcaagataagggagtgtgcacaattaacgaagaccgttggaatgtcgtgaaatgtgatcggggcctgatctactatactgaccagcgagaggggcaggataccggaaacgacttcggtaagtactgcctttcacacagctgtagaatagagaggtttcctatcaaccccgccattatcaatgattgcttgtgggaatatcatagtcgcaagtctaaatacattacgtccctggacttagagagcctcgaagagttcaagcgggcaatctcggaaaaactgtcacacacacttatagtacacaactttaagccaaccgcgaatctgcctcatattaaacccgtgtacaagtatatcactgttcagggcgtcgagaactctgacggggtggatagtgcttacatcacagcctccatgccagcattgagcggaacctctattggctataatataatgagcagagacaacttccccctcttcgatatcattatctttattaagtccgccatcataaaagctacttacaatcacatctatgacaccggtcctacaattgggatcaacgtgattcatgatgagcactgtacgggccaatgcccaaccgacatcccgcataaggaaaattggataactttcgcccaggagaggacatcacgctggggatgcgaagagtttggctgtctggcaattaacaccgggtgcgtcttcggaagttgtcaggatatcatccgacccgaaacaaaagtttaccggaaggctgtggaggagagcgtgctactgactgtatgcattacctatcctggcaaaacgttttgtacagaaatcaatgccatagagccaaagattaccgacgaactcgagctgcagttcaaaactgtcgataccaagacacttcccaacatcttggcggtgcaaaatcacaagctgtactctggtcagattaacgacttagggtccttttcacagggatgcggcaatatccagaaaactaacagtagcataattggtaccggcacagccaagttcgattacgtttgtcacggggcttcccgtaaagacatcatcgtgagaaggtgctataacaataactacgagtcttgtaagctcctgaaagaggaacagtcgcttatgtttgcagataatcatgaaacgattgacgtcgccaacgtgcgccatctgctaggagacctccagttcaagctgatgttgggcgatctgcggtataagagctttgctgagaatcctgacttagaaatcgaggccaaatgcgttgggtgtccatcatgcttcacctcctacagttgctctttcaagattgtgagcaacatagatactgtatgttccatcgagggaccctgcacaatttttcactcaagactcatgatcacctctactaaacaggactatggcatcaagatgagctgtaaaacaaagccgggtcctaccgaagagttccaaatttgcaagaaaacgtacactatactgtttaccacaatcgaaaagaatgataaaattgagatcagtaccggggaccagacttccttcattcaggaaagggatgaccgatgtcgcacatggctttgccgggtcagagatgagggaatcggcgtgatatttgagccaatcagggcattctttggtagctatttctctattgcgttttacatcgtgattggcatcataattctgttcttggtcatctacatttttctccccatggttttcaagctgcgtgacgtgctaaaacgcaacgaatatctgtaccttcaggagatcaagcacaagtga

SEQ ID NO: 10890 - RNA, 4305 nt, synthetic construct
  misc_feature 1..4305: note = derived and/or modified CDS sequence (opt3) from BATV(ON-1/E/94)__AB257764.1__GP
  source 1..4305: mol_type = other RNA
atgctcctgttccttgtgctgttgatcagctgctacgtctccgcctctcccgttattaccagatgttttcacggcgggcagttaatagctgagaggaagtcacaaacagcaatcagtgaattttgcctgaaagacgatgtgagcactattaagtccgagatcatttatgagaaaaacgacacgggactatttgcccattctaaggtactccggaattggatcataaaagattggaagaactgtaatcctgtgccaaccgcgggtggctcgatcaacgtcattgaagtgaatgctgacctgtcacttgccacaaagacttacgtttgcagccgcgattgtaccatcacagtggacaaagaagatgcacagattgtcttccagaccgagaagctgaaccactttgaggtgagtgggactacattgtcctctggatggttcaaaaccaaggccagcgtaacgctcgaccgaacttgcgaacatatcaaagttacctgtggcaagaagacactgcagtttcacgcttgcttcaaacatcacatgtcctgtatacgtttcttccacggtactattctgccggggaccatggcaacatcaatctgccaaaatattgagctcatcatcattataagtttaaccctgatcatttttatccttatggtgatattgacgaagacttatatttgttacctgctaatgcccctcttcatgcctatcgcctatttttacggatggagctataacaaatcttgcaagaaatgctcctgttgcggcctggcttaccatccattcacaaattgtggctcacactgcgtctgtgggcttaagttcgaagccagcgatagaatgaggatccatcgggagagtggactgtgccagggttacaaatctttgcgcgtggcgagactcctgtgtaagtccaagggcagctcgttaattatctctattctgctctccatgcttatactgtcatttgtgacccccatcgaggggactttgacaaactatcctgaaagtaggaaatacgacctagaggaaattgcagatgtcctggagggattcgttgtggaaaagggcatcaaagagtatgtagtgttttacaccagcatcttcggtgccctctttctgcttatggctctgattgtcataatcgccttgaatcgggtgacggagtatctcaccaacattaatgttctgtactgccacgaatgttccatgtatcactctaagaaaaacatcaagtacattggggacttcacaaataagtgcggattttgtacttgcggcgagttagaagatcaggagggcctgaaaatccataaggtgagccgcaaatgcatatacaagtatcagctaacctggtcaaaaatcattatgatcattctcgtctgtctgcttatcgcacaaaacacaatattgattgtggctgccagtgacgactgctggactaagaagtccctggaaatggagtgtgtagggccactccagcaggttgatacctgcgaggacaaaacaagccgatcttactcaggagaagcgaagaaactggtgagagccagtaagatcagcgatcttgacgcagctcaggtcggtctgttgggctccaccattgagtctgccatcgcttcgataaggaaacaacggacttatagcacgatgcacctcctggaatccgtgttcttagggaagcattgtgattactataaggtctttgagcacaactcaggatacagtcaggccaaatggcgtctgacagcaaagacccatcacttcgacatctgctctcgccacagcactcatcacttttgtagatgcatttccgatggcaccaaatgtcagaatggtgactgggatttcgccggggaaatgaactcaacatatcaaagcaagagggactttttcgagcatgatttcaaactattttgcaccctcatcgagaatgctttccccggcactacagaatctctgttttacgagatgctttccaagaaaaacacgaccggaattactaagttgctggacaagctcaccaaaaagttcggcaataacaatatgtttgtggggatctggaaattcggacagtacctgatgagtttaccttatgttaacgaaacaagcctgtctccaacacagcttgcgaaggtgttggaggtaactgaccacctccaccggtccatatcaggtcgacaggagctgctaaccagtgcaacgccgggcagcaaatcgtccgaatgtgatcatgccaagaaggtctcttgcattagcccccgctttggggtgcctatggagggactgatcgcttgcggcaattcaccaagttacaaaatctataagacccccacaaaactctacaagtccaacaataaaggtgaagtttggtgttctggggacgtgcactgcttccaagagctgattcctgccagccaggaatccgtcgatagaatcaagcagatgacttgttttcttaccgagccagaggtgtcagacgatgtattcagcattgcaataagtatgtgcaaggtgcaggacaaaggcgtttgtacaatcaacgaagataggtggaatgtcattaagtgcgactctggattgatctattacactgatcaacgggagggccaggacaccgggaacgatctgggagaatattgtttatcccatagctgccgcattgagagatttcccatcaatccgataatcatttcggactgtctctgggaataccactcaaggaaatctaagtacatcacgagtctggatcttgagtccctggaggagttcaaacgtgccattagcgaaaagttgtctcatacactcatcgtgtataactttaagcctaccgctaacctgccccacataaaaccagtgtacaagtatattactgtccagggtgttgaaaatagcgacggcgtggactccgcctacatcacagcatcaatgcctgcgctaagtgggaccagcatcggatataacattatgtctcgggataatttccccctgttcgacataatcatttttatcaaatccgctattatcaaggccacttacaaccacatatatgataccggcccaacaatcggtattaatgtgatgcatgacgagcactgcacggggcagtgtcccaccgatatccctcataaagaaaactggattactttcgcacaagagcgaacatcaagatggggctgcgaggaatttggatgcctcgccgtaaataccggctgtgtcttcgggagttgccaggacatcataaggccagagacaaaggtgtaccgcaaagctgttgaagagagcgtgctgcttactgtctgtattacctacccgggaaagacgttttgcacagagatcaacgccatcgaacccaagattaccgatgagttggaactgcagttcaaaactgtggacaccaagacattacctaatatcctcgcagttcagaaccacaaactgtattccggccaaataaatgatcttggttctttttcgcaggggtgtggaaacattcagaagactaatagctcaatcattggcaccggtacagctaaattcgactacgtgtgccatggcgcctcccggaaggatatcgtagtcagaaggtgttataacaataactacgagagttgcaagctgctaaaagaggaacaatctctcatgtttgcggacaaccacgagacgatagatgtggccaatgtgcgccacctgttgggggacctgcagttcaagttaatgctcggagacctgcgatataagagctttgctgaaaacccagatcttgagattgaagcaaagtgtgtcggctgcccctcctgtttcacctcatactcttgcagcttcaaaatcgttagtaatatcgacactgtgtgctccattgaggggccttgtacaacctttcataaccggctgatgatcactagcacaaagcaggattatggaattaagatgtcttgcaaaaccaagccaggccccacggaagagttccagatatgtaaaaagacttacaccatcttgtttacaaccgtagagaaaaatgacaagattgaaatctcaactggtgatcaaacatccttcatccaggagaaggacgatcgttgcaaaacctggctctgtagagtgagggacgaagggattagtgtcatatttgagccgatccgcgccttctttggaagctacttctcgattgctttttatatcgtgattggcatcatagttctgttcctagtgatctacatttttctgcctatgatcttcaaacttcgggatgtcctcaaaagaaacgaatatctgtacttgcaggagattaagcacaaatga

SEQ ID NO: 10891 - RNA, 4305 nt, synthetic construct
  misc_feature 1..4305: note = derived and/or modified CDS sequence (opt3) from BATV(ON-7/B/01)__AB257765.1__GP
  source 1..4305: mol_type = other RNA
atgctgctccttctggtgttgttaatcccctgctgtgtcagcgcctcccctgttattaccagatgcttccacggcgggcagctgatagctgagaggaagtctcaagcagccatctcagaattttgtctaaaagacgatgtgagtacaattaagagcgagatcatttacgaaaagaacgacactggactcttcgcgcataataaggtactgcggaactggatcataaaagattggaagaattgcaacccagtgccgacggctggtggctccatcaatgtcattgaggtgaacaccgacctttctctgacaactaagacctatgtttgttcgcgcgattgcacaatcaccgtggacaaagaagatgcccagattatctttcagactgagaagttgaatcacttcgaggtctcagggacaaccctcagcagtggatggtttaaaacgaaggcatccgtgactctggaccgaacctgtgaacatataaaagtaacatgcggcaagaagactctgcagttccacgcctgttttaaacatcacatgtcttgcattcgtttctttcacggtaccatcctccccgggacaatggctaccagcatttgtcaaaacatcgagttaatcattataatctccctgacgcttattatcttcatattgatggttattctgactaagacatacatctgctatctactcatgcctctgtttatgccaatcgcatacttctatggatggtcatacaataaaagttgcaagaaatgtccctgctgtggccttgcctatcatccttttaccaactgcggcagccactgtgtgtgcgggctgaagttcgaggcttctgatagaatgaggattcatcgggagtccggattgtgtcagggttacaaatcactccgcgtcgccagactgttatgcaagagcaagggcagttctctgatcatttccatactccttagcatgctgatcttgtcgttcgtgactccaattgaggggacactaaccaattaccccgaatctaggaaatatgacctggaggaaatcgcggatgtgctcgagggatttatcgtcgaaaagggcattaaagagtacgttgtgttctatacgtccatatttggtgcactgttccttctgatcgccttgattgtaatcattgctctcaaccgggtgaccgagtacctgacaaatatcaacgtcttatattgtcacgaatgctcaatgtaccacagtaagaaaaatataaagtatatcggggactttactaacaagtgtggattctgtacctgcggcgagctggaagatcaggagggcctaaaaattcataaggtgagccgcaaatgcatctacaagtaccagctcacatggtccaaagttattatgatgatcctggtgtgccttttgatagcccaaaacactattctgatcgtcgcagcttctgacgactgttggaccaaaaagagcctcgaaatggggtgcattggacctctgcaacaggtggatacatgtgacgataaagcctcacgaagttattccggtgaggcgaagaaacttgtaagagccagcaagatctctgacctggatgcagctcaggttggccagttggggtcaaccatagagagtgccatcgctagcattaggcggcagcgtacttactccacgatgcacctcctggaatctgtgtttttaggaaaacattgcgactattacaaggtcttcgagcacaattcgggctatagccaggccaagtggcgcctgacagcaaaaacccatcactttgatatctgttccagacactcaactcatcacttctgtaggtgcattagtgacggtaccaagtgccaaaacggggattgggactttgccggcgaaatgaactctacataccagagcaaacgggatttctttgagcatgacttcaatctattctgtaccctcatcgaaaatgcttttccaggaactacagagtccctgttctatgagatgctttcaaagaaaaacacgaccggcataactaagttgctggacaaactcacaaagaagtttgggaataacaatatgttcgtgggaatttggaaatttggtcagtacctgatcagcttaccgtacgtcaacgaaacctctctgtcccccacacagcttgcgaaggtgttggttgtgactgatcaacaccaccgaagtatcagcggccgccaggagtctctcgcatccgccacccctgggtcaaaaagtagcgaatgcggacatgctaagaaagtatcgtgcatttccccaagattcggcgtccccatggagggtctgatggcctgtgggtctagccctaattataagatctacaagacgccagcaaaactatataagtcaaacaataaaggcgaggtgtggtgcagtggagacgttcactgttttcaggatctgattcccgcctcccaggaatctgtggacaggataaagcaaatgacctgcttcctcacagagccggaagtcaacgatgacgtgtttagcatcgctattgccatgtgtaaagtacaggataagggcgtgtgcactatcaatgaggaccggtggaacctgattaagtgtgattccgggcttatctactataccgaccagcgcgaaggacaggatacaggtaacgacttcggcgagtactgcttgtcacataattgtaaaatggagagatttcctataaaccccgcaatcattagcgattgcctgtgggaatatcacagtaggaagtctaaatacatcacttccttagacctcgagagcctggaagagttcaagcgtgcgatttcggaaaaactttcacataccctggttgtctacaattttaagccaacggctaacttgcctcacatcaagcccgtgtataaatacataacagtgcaaggggtcgaaaattctgacggagttgatagtgcctatattaccgcatccatgccagccctcagcggcacttctatcggttacaacatcatgagccgggacaatttccccctgttcgatattataatctttattaagtccgctatcattaaagccacatataaccacatctacgacaccgggcctactataggcatcaatgtgatgcatgatgagcactgtaccggacagtgcccaacagacattccgcataaggaaaactggatcacgttcgcacaggagcgaacctcaagatggggctgcgaagagtttgggtgtctagctgtgaatactggatgcgtattcggcagttgtcaggatattatcaggcccgaaacaaaagtctatcgcaaggccgtggaggagagcgttctgctcaccgtgtgcataacataccctggtaaaactttttgtaccgaaattaacgcgatcgagccaaagatcacggacgaactggagcttcaattcaagacagtcgataccaaaactttgcccaatattctggccgtgcagaaccacaagttatactctgggcagatcaatgacctcggatccttttcacaaggctgcggtaacatacagaaaaccaacctgagtattatcggcacagggactgctaagttcgattatgtttgtcatggagcaagccggaaagacattatcgtgagaaggtgctacaataacaattatgagtcctgtaaacttctgaaggaggaacagtctctaatgtttgccgataaccacgaaaccatagacgtagctaatgtccgccacctcctgggcgacttgcagttcaagctgatgttaggggatctccgatacaagtcgtttgccgagaaccctgacctggaaattgaggcaaaatgcgtgggatgtccaagctgcttcacatcatattcctgcaatttcaagatcgtgagtaacatcgatacggtctgttctattgagggcccctgcaccacttttcataatcggcttatgatcacaagcgcgaaacaagactacggtattaagatgtcctgtaagaccaaaccggggctgactgaagagttccagatatgcaagaaaacatataccgttttgtttgccacggtggaaaagaacgatgagatcgaaatttcaactggagaccagacctctttcatccaggagcgtgatgacagatgtaaaacatggctctgcagggtacgcgatgagggcatcagcgtgatttttgaacctatacgggctttctttggtagttacttctccatcgccttttacattgtcatcggcattatcgtgctgttcctagttatatatatctttctgccaatggtgttcaaacttagagacgtcctcaagaggaatgagtacctgtatttgcaagaaattaagcacaagtga

SEQ ID NO: 10892 - RNA, 4305 nt, synthetic construct
  misc_feature 1..4305: note = derived and/or modified CDS sequence (opt3) from BATV(UgMP-6830)__DQ436460.1__GP
  source 1..4305: mol_type = other RNA
atgctgctccttctggtgttgttaatcccctgctacgtcagcgcctcccctgttgtgaccagatgtttccacggcgggcagctgattgctgagaagaaatctcaaacagcagtatcagaattttgcctaaaggacgatgtgagtactataaaaagcgagatcacgtatgaaaagaacaataccggactcttcgcccataacaaagtcctgaggaattggattatcaaggactggaagaactgtaatccagtgccgacagcgggtggctccattaacgttatcgaggtgaatactgatctttctctgaccacaaaaacctacgtctgctcgcgggactgtactataacagtggataaggaagacgctcagatcatttttcagaccgagaaattgaaccacttcgaggtatcagggacgactctcagcagtggatggtttaagaccaaagcctccgttacactggatcgcacttgcgaacatatcaaggtgacctgtggcaagaaaacactgcagttccacgcatgctttaagcatcacatgtcttgtattcgattctttcacggtaccatcctccccgggacgatggccactagcatatgccaaaatattgagttaatcattatcatctccctgacacttattatattcatcttgatggtcattctgaccaaaacttatatctgttacctactcatgcctctgtttatgccaatagcttatttctacggatggtcatataacaagagttgcaaaaagtgcagctgttgcggccttgcataccatccctttacaaattgtggctctcactgcgtgtgtgggctgaaattcgaagcctccgaccgtatgaggattcatagagagtcaggattgtgccagggttacaagagcctccgggtggctcgcctgttatgtaagagtaaaggcagctccctgatcatcagcattctcctttcgatgctgatcttgtctttcgtcacccctattgaggggacgctaaccaactatccagaatccagaaagtacgatctggaggaaatagccgacgttctcgagggatttatcgtggaaaaaggcattaaggagtatgtagtgttctacacatcaatctttggtgcgctgttccttctgatggcattggtcatcattatagccctcaataaagtgactgagtatctgaccaacatcaatgttttatactgccacgaatgtagtatgtatcacagcaagaagaacattaaatacatcggggattttacaaacaagtgcggattctgtacttgcggcgagctggaagaccaggagggcctaaaaattcataaggtgtccaggaaatgcatctacaagtatcagctcacctggtctaagataatcatgatgattctggtctgtcttttgatcgctcaaaatacaattctgatcgtggccgcaagcgatgactgctggaccaaaaagtcactcgaaatggagtgtatagggcccctgcagcaggtagacacttgcgatgacaaaagttcccggagctactctggagaggctaagaaacttgttcgcgcctcaaagattagtgatctgaacgcggcccaggtgggtttgctcggcagcacgatcgaatccgcaattgcttctatccgaaagcaaagaacatattcgaccatgcacctgttagagagcgtctttctggggaaacattgtgactactataaggccttcgaacacaattccggatactcacaggctaaatggaggctaactgccaagacccatcactttgatatatgcagtcggcactctacacatcacttctgtcgttgcatcagcgacggcaccaaatgtcagaacggtgattgggactttgcaggggagatgaactccacttatcaatcaaagaaagatttctttgaacatgacctcaagctgttctgcacacttgtggagaatgccttccctggcacgaccgagagcttgttttacgaaatgctgtctaagaaaaatactacaggagtcaagaaactcctggataagttaaccaaaaagttcggcaacaataacatgtttgtggggatttggaagttcggacagtacctgatgtcccttccatatgttaatgagacaagtttgactccggctcagctcgcgaaaatcctggaagtgaccgaccagcaccaccgcagcatttctggtagacaagagtccctagcatcagccacgcccggcagtaagagcaaagagtgtgggcatgctaagaaagtatcgtgcatctcccctaggtttggagtcccaatggaaggcctgctcgcctgcggtgactctcccaactacaagatatataagacccctgcaaaactgtacaagagcaataacaaaggggaggtgtggtgttcaggcgatgttcactgcagtcaggaactttccccagcctctcaggagagcgtggaccggattaagcagatcacatgtttcttgactgaacccgaggtctccgatgacgtgttttcaatcgctatttctacctgcaaagtacaagataagggagtgtgtacagttaatgaggaccgatggaacgtcatcaagtgcgatagtggcctgatttattacactgaccagcgcgatgggcaggacaccggaaacgatttcggtgaatattgtttatctcattcctgcagaatagagaggtttccgatcaatcctgccattatcagcgactgtctctgggaataccactcgcggaaatcaaagtacattacgtctctggatcttgagagtctggaagagttcaaacgcgcaatctccgagaagttgagccatacactcatagtgtataactttaaacccaccgcgaatctgccacacatcaagcctatttacaaatatatcactgtgcagggcgtcgaaaactctgacggggttgacagcgcttacattacagcctccatgcccgcactatcaggaaccagtatcggctataatataatgagcagagataacttcccactgtttgacattatcatcttcattaagtctgccataatcaaggctacttacaatcacatttatgataccggtcccacaatcgggattaacgtgatgcatgacgagcactgcacgggccaatgtcctaccgatatcccacataaagaaaattggataactttcgcccaggagaggacatcccgttggggatgcgaagagtttggctgcctcgcagtgaacaccgggtgtgtattcggatcatgccaggacatcattcggccggagacaaaggtctaccgaaaagctgtggaagagagtgttctgcttactgtgtgtatcacctaccccggcaagacgttttgcacagaaattaatgccatcgagcctaaaataaccgatgagttggaactgcagttcaagactgtcgacaccaagacattaccaaacattctcgcggtgcaaaatcacaaactgtatagcggtcagatcaacgatcttgggtccttttctcagggatgtggcaatatccaaaagactaactcgagcattatcggtaccggcacagccaaattcgactacgtttgccatggggcttcaagaaaggatataattgtgaggcgctgttataacaataactacgagtcctgcaaactgctaaaggaggaacagagtctcatgtttgcagacaatcacgaaacgatcgatgtagccaacgtccggcacctgttgggagacctgcagttcaagttaatgctcggcgacctgagatataaatcttttgctgagaatcccgatcttgagattgaagccaagtgtgtggggtgccctagctgtttcacctcctactcatgctcttttaaaatcgtgagcaacatagacactgtctgcagtattgagggaccatgtacaaccttccataataggctgatgatcacttccacaaagcaggattatggcatcaaaatgagctgcaagaccaagcccgaagagacggaagagttccaaatttgtaaaaagacttacaccgttttgtttacaaccgtggagaaaaacgacaagatcgaaatttctactggtgatcagacatcattcatacaggagcgcgacgatcgatgcaaaacctggctctgtcgggtacgtgacgaagggatctccgtgatttttgagccgatcagagcattctttggaagttacttcagcatcgcgttttatgtcgtggtttcgattatagtgctgttcctagccatctacatttttctgcctatggtcttcaaacttagggatgtgctcaagaagaatgaatatctgtacttgcaggagatcaagcacaaatga

SEQ ID NO: 10893 - RNA, 4305 nt, synthetic construct
  misc_feature 1..4305: note = derived and/or modified CDS sequence (opt3) from BATV(ZJ2014)__KU746870.1__GP
  source 1..4305: mol_type = other RNA
atgctggtgctccttgtcctgttgatcccctgctgtgttagcgcctcccctgctattaccagatgcttccacggcgggcagttaatagcagagaggaagtctcaaacagccatctcagaattttgtctgaaagacgatgtgagtactattaagagcgagatcatttacgagaaaaacgacacgggactattcgcgcataataaggtactccggaactggatcataaaagattggaagaattgcaacccagtgccgaccgctggtggctccatcaatgtcattgaggtgaacacagacctgtctcttactaccaagacatatgtttgttcgcgcgattgcaccatcactgtggacaaagaagatgcccagattatctttcagacagagaagctgaatcacttcgaggtctcagggaccacgttgagcagtggatggtttaaaactaaggcatccgtgaccctcgaccgaacatgtgaacatataaaagtaacttgcggcaagaagaccctgcagttccacgcctgttttaaacatcacatgtcttgcattcgtttctttcacggtacaatcctgcccgggaccatggctacgagcatttgtcaaaacatcgagctcatcattataatctccttaactctgattatcttcatacttatggttattttgacaagaacctacatctgctatctgctaatgcctctctttatgccaatcgcatacttctatggatggtcatacaataagagttgcaaaaagtgtcagtgctgtggcctggcctatcatccctttactaactgcggcagccactgtgtgtgcgggcttaaattcgaggcttctgataggatgcggattcatcgcgaatccggactgtgtcagggttacaagtcattgagagtcgccaggctcctgtgcaaaagcaagggcagttctttaatcatttccatactgctcagcatgcttatcctgtcgttcgtgacacctattgaggggaccttgacgaattacccagaatctcggaagtatgacctagaggaaatcgcggatgtgctggagggatttgtcgttgaaaaaggcatcaaggagtacgtggtattctatacctccatttttggtgcactcttcctgcttatggccctgatagtgatcattgctttgaaccgcgtcacagagtacctcactaatatcaacgtgttttattgtcacgaatgctcaatgtaccacagtaaaaagaatattaaatatatcggggacttcaccaacaagtgtggattttgcacatgcggcgagctggaagatcaggagggcttaaagatacataaagttagccgaaagtgtatctacaaataccaactgacttggtccaagattatcatgatgattctagtgtgcctcctgatcgcccagaacaccatacttattgtcgcagcttctgacgactgttggaccaaaaagagcttggaaatggggtgcatcggacccctgcaacaggtggatacatgtgacgataagacttcaagaagttattccggtgaggccaaaaagctcgtaagggcgagcaaaatttctgacctggatgccgcacaggttggccttctggggtcaacgatcgagagtgctatagccagcatccggaagcagcgtacatactccaccatgcacttgctcgaatctgtgttcctgggaaaatattgcgactactataaggtctttgagcataattcgggctacagccaggctaagtggcgcttaactgccaaaacccaccatttcgatatttgttccagacactcaacacaccatttttgtaggtgcatcagtgacggtaccaagtgccaaaacggggattgggacttcgcatctgaaatgaatagcacttatcagtccaaacgggatttcttcgagcacgacttcaaggtgttttgtacactgattgaaaacgccttccctggcacgaccgagtcactattttacgagatgctcagcaaaaagaatactacaggaatcaccaaactgcttgacaagttgacaaagaaattcggcaacaataacatgtttgtcgggatatggaagttcggacagtacctgatgtctctcccatatgtgaatgaaacttccctgagtccgacccagttagctaaagttctggaggtgacggatcatcaccaccgaagcatttctggtcgccaagaatcccttgcgtcagcagcccccggcagtaagagctcggagtgcgaccatgctaaaaaggtatcctgcatctctcctagatttggggtcccaatcgagggattgaccgcctgtggcagctcacccaactacaagatttataaaactcctgcaaagctctacaaaagtaattccaagggtgaagtgtggtgctctggggatgttcactgtctgcaggagctaatcccagccagccaggaatccgtggacaggattaaacagatgacatgcttcctgaccgagcccggcgtcaacgatgacatattttcaatcgctattagcatgtgtaaggtgcaagataagggagtatgcacaatcaatgaagaccggtggaacgtggttaaatgtgatagtggcctcatttattacactgaccagcgcgaggggcaggataccggaaatgacttcggtgagtattgcctgtctcattcctgtagaatcaagaggtttccgataaaccctgccatcattaacgattgcctttgggaataccacagccgtaaatcgaagtacatcacgtcattggacctggagtctttagaagagttcaaacgggcaattagtgaaaagctctcccatacactgatcgtctataattttaagcccaccgcgaaccttccacacataaaacctgtgtacaagtatattactgtgcagggcgtcgagaatagcgacggggttgattctgcttacatcacagccagcatgcccgcactgtccggaacctcaatcggctataacattatgagtcgagacaatttcccattgttcgatataatcatttttatcaaaagcgccattatcaaggctacttacaaccacatatatgacaccggtcccacaatcgggattaatgtgatccatgatgagcactgtacgggccaatgccctaccgacattccacataaagaaaactggatcactttcgcccaggagagaacatctaggtggggatgcgaagagtttggctgtctcgcaataaataccgggtgcgtgttcggatcctgtcaggatattatccgcccggaaacaaaggtataccggaaagctgtcgaggagtcagtgctgctaactgtttgcatcacctaccccggcaagacgttttgtacagaaattaacgccatcgagcctaagataaccgacgaactggagctccagttcaaaactgtggataccaagacactgccaaatattcttgcggtccaaaaccacaaattgtatagtggtcagatcaatgacctggggagcttttcccagggatgcggcaacattcaaaagactaattcttcgatcataggtaccggcacagccaaattcgattacgtgtgtcatggggctagcagaaaggacattatcgttaggcgctgctataacaacaattacgagtcatgtaagttactcaaagaagaacagtccctgatgtttgcagataaccacgaaacgatcgacgtggccaatgtacgacaccttctgggagacctacagttcaagctcatgctgggcgatttgcggtataaaagttttgctgagaaccccgacctggaaattgaggccaagtgcgtcgggtgtccttcttgcttcaccagctactcctgctcattcaaaatcgtgtctaatattgatactgtgtgtagcatagacggaccatgcacaatctttcataaccgtttaatgattaccagtactaagcaggattatggcatcaagatgtcctgtaaaacaaagcccggtccgaccgaggaatttcaaatctgcaaaaagacgtacactattctctttaccacaatagagaaaaatgacaagatcgaaattagcaccggggatcagacttctttcatccaggagagagacgataggtgtcgcacatggctgtgccgggtcagagacgaaggaatttcagttatctttgagcctataagggcattctttggctcctacttcagtatcgcgttttatattgtgatcggtattatcatacttttcctggtaatttacatctttttgccaatggtgttcaagctccgagatgtcctgaaacgcaacgagtatctatacctgcaggaaattaagcacaaatga

SEQ ID NO: 10894 - RNA, 4305 nt, synthetic construct
  misc_feature 1..4305: note = derived and/or modified CDS sequence (opt3) from CVV__AF082576.1__GP
  source 1..4305: mol_type = other RNA
atgctgttcctccttatcctggcctttttgggcttcagcacctccaaccccattgctacaagatgctttcacgggggacagttaatagcagagtctaagtcagccacttccatcagcgagttctgtctgaaagacgatgtgtccatgctaaagtctgaagtcgtttacattaaaaatgacacgggtctctttggccataacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagcgcaaattatctttcagacagataaattgaaccacttcgaggtcagtggcaccacgctctcctctggttggtttaagagcaaagcctccgtgactctggaccgcacctgtgagcatgttaaggtgacatgcgggaagaaatcactgcagttccacgcatgttttaagcatcacatgagttgcgtccgattctttcacaatactatactcccgggaaacatgattaccagcatgtgtcagaatatcgaattaattatcatcctgggccttacattggccattttcatactgatggtgatgctaaccaaaacgtacatctgctatctcctgatgcccattttcatgcctatcgcttacctttatggctgggcatacaacaagtcttgtaaaaagtgcaattgctgtgggctggcctatcatccatttactaactgcggatcccactgtgtatgcggtttgaaattcgaggcttcagatcgtatgagaatacatagggaaagcggcctctgtcaagggtacaagagtctgcggattgcccgcttactgtgcaagtctaaaggatccagcctcgttatctcgggccttctgtctatgttgatcctatcctttgtgacacccattgagggtaccatcacttcataccctgagagtagaaagtatacactggaagagattaccgacgtcgtggaagggctcgtgagcgagcagaatataaaagaatacatcgtcttctatacgtccctgtttggatctcttattctgttgctcgcgttcatcatgagcatcaccctgtcaaagattacaagtatattagcaaaaaggaacgttatctactgtgaggagtgctccatgtatcacagcaagcggggcattaagtacaatggcgattttactaacaaatgtgggttctgcacctgtaacgaacaggaggacacagaaggactggtgatccacaaggtatctaaacgctgcacttataagtaccagctaaaatgggccaaggtgctcatgattaccctggtccttttgctgatcgctcaaaatacaatactcatcgtggccgcagagaccgattgctggactaagaaatcactggacattgactgtatcggtccaatgcttgatattggcagttgcacgaacaagaatacacgaagctacgacgctgaagcccagaaactggtttcccagtctaagatctcgcagttggatgcggaccaagccagcctcctggggaactccatagattcagcaattaaagctatcagagcccagaagacctatcccactatgcatttactggagaccatttttctaatgaagaattgtgactactatacaagtttcaaccacaattctggatacagccaggctaaatggaggctcatcgccaagaccggccattttgatatatgctcccggcactcaactcatcacttctgtcaatgcatcaacgacggtacaaaatgtcagaatggggattgggactttgcaggcgagatgaacgaaacgtataatagcaagaacgatttctactctcacgacctgaatcttttctataccatttttgagaacgccttccctggaactacagaatccttgttttaccagctgatccagaaaaagaataccacaggcgctagtaaagtgctcgggaagctgattactaagtacggaaacaacaatatgttcgtcggtatctggaaatttggccaatatttactgacccttccatacataaacaatacggagttgagccagaaccgtcgcctcaccattctggcgacacaggaactactgtctagatcccattcagggaggcaggagagtatgagcaatgcaatccaaggatcgatcactaaggagtgccacaacgccaaaggcgtgggttgtatttccccgcagttcgggatccccattggcaatctcaccgcttgcggagactctcctaactataagatatacaaaacaccagaaaagctgtataagagcaataacaaaggcgaggtatggtgttcaaatgatgttcattgccttaacgactttgaacccgccgatgaggaggtggtcaataagatcaaaaagttgacttgcttcctgaccgacgtgagtgtcgaagtggatatttttagtgttgcagcctctacgtgtaaaatggctgacaagggggtgtgcacagtaaacggagccaagtggaatatcattaaatgtgatagcggtttatactatttcaccgaccaccgggagggccaggatactgggaacgactttggagaatactgcatctcccactcatgtaacacagagcgattccctataaatccagataccctcaaggactgcacttgggaatttcatagccgcaaaagtaagtacatctctaccatttccctggagagccttgaggagttcagaagggcaatggcggaaaaactgtcgcacacattgacgatctataacttcaagcccaccgctaatctcccgcatattcggcctacttacaagtttatcacagccaacggcgtcgaaaattcagatggtatagagtctgcatatattctgagttccatccccgccctagggggcatcagcgtgggatacaacgttcagaccaaagacaatttcccactgctcgacattatagtgtttatcaagtctgctgtcattcgcacaacttataaccacatctacgataccggccctacgattgggatcaatacacaacatgacgaacactgtaccggaccctgcccagccgtggtaccccacaaagagaactggatgactttcagccaggagagaacctccaggtggggctgtgaagagtttggttgcctggcaataaatacagggtgtgtgttcggatcatgccaggatatcattcatcctgaaactaaggtttatcgtaaagctgtcgaggaagaggtggtgcttaccgtctgcatcaactttccaggcaataactactgtacagagattaatgccatcgaaccgaagataacggacgagattgaattgcagttcaaaaccgttgatactaagacactgcccaacttactcgcggtgcaaaaccacaagctgtacagtggtcagatcaatgaccttggcagcttttctcaggggtgcggaaacgtgcagaaaaccaatcattccatcctgggcatggggactgtaaagttcgattatgtctgtcacggagcctcacggaaagacgtgattgttcgaagatgctacaacaataactttgatagttgtaagctactcaaagaggagacaagcctgatcttcgctgacaatcatgaaaccttggaggtggcacacacgaagcacctgataggcgaattacaattcaagattatgctcggtgatatcaggtataaatcctttgccgagtctcctgaactggagattgacgctaagtgcgtcgggtgtccatcgtgcttcgagagctactcatgtaactttcagatcgtgtccaatatagatactgtttgcagtgtggaaggaccctgtacccttttccataaccgcattatcatctctgccaataaacagagctatggcctgaagatgtcctgccaaacaaaacctaaccagaatgaggaatttattatctgcaaccggaagtactcagtattgttcaccactattgacaagaatgacaaaatagaggtcaacacaggtgatcagacctcttatatctacgaaaaggacagcagatgtaaaacatggctctgcagggtgcgcgatgagggcattagtgtgctgtttgagccactaaaggcattctttgggtcctacttcagcatcatcttttatgtcgttgtgggaattatagtactgttccttatcatttacatctttctccccatgttcttcaaactgaaggacgtgttgaagcgaaatgaatatctgtacttacaggagctcaaacacaagtga

SEQ ID NO: 10895 - RNA, 4305 nt, synthetic construct
  misc_feature 1..4305: note = derived and/or modified CDS sequence (opt3) from CVV(Montgomery County/VA/2015 4b)__KX583998.1__GP
  source 1..4305: mol_type = other RNA
atgctgttcctccttatcctggcctttttgggcttcagcacctccaaccccattgctacaagatgctttcacgggggacagttaatagcagagtctaagtcagccacgagtatcagcgaattttgtctgaaagacgatgtgtccatgctaaagtctgaggtcgtttacactaaaaatgacaccggtctctttggccataacaaggtgttcaggtcgtggacaattaaagattggaagctgtgcaatcctatcccaactgctgggggaaccattaacgtaatcgaagtgaataaggacctttcactgatgacaaaaacctatatatgtagccgggattgcactatcacaattgacaaggaggaagcgcaaatcatttttcagaccgataaattgaaccacttcgaggtcagtggcacgactctcaattccggttggtttaagtctaaagccagcgtgaccctggaccgcacatgtgagcatgttaaggtgacttgcgggaagaaatccctgcagttccacgcatgttttaagcatcacatgtcatgcgtccgattctttcacaacaccatcctcccgggaaatatgataaacagtatgtgtcagaatattgaattaatcattatcctgggccttacattggccatcttcattctgatggtgatgctaaccaaaacgtacatatgctatctcctgatgcccatcttcatgcctattgcttacctttatggctgggcatacaacaagagctgtaaaaagtgcaattgctgtgggctggcctatcatccatttactaactgcggatctcactgtgtatgcggtttgaaattcgaggcttccgatcgtatgagaatccatagggaatcaggcctctgtcaagggtacaagagcctgcggatagcccgcttactgtgcaagagtaaaggatcttccctcgttattagcggccttctgtcgatgttgatcctatcttttgtgacacccatcgagggtaccattacttcctaccctgagtcaagaaagtatacactggaagagatcaccgacgtcgtggaagggctcgtgagtgagcagaatattaaagaatacatagtcttctatacgagcctgtttggatcccttatcctgttgctcgcgttcattatgtctatcaccctgagcaagatcacatcaattttagcaaggcggaacgttatatactgtgaggagtgcagtatgtatcactccaaacgcggcatcaagtacaacggcgattttactaataagtgtgggttctgcacctgtaacgaacaggaggacgccgaaggactggtgattcacaaagtaagcaagcgatgcacatataaataccagctaaagtgggctaaagtgctcatggtcactctggtgcttttgctgatcgcccaaaataccattctcatcgttgcagctggtacagattgctgggccaagaagtctctggacatggactgtataggcccaatgcttgatatcgggtcatgcaccaacaaaaatactagaaactacgacacggaggcgcagaagctggtgagtcagagcaaagtctcccagttggatgccgaccaagcatctctcctgggaaattcgattgatagcgctatcaaggccattagggctcagaaaacatatcccaccatgcatttactggaaactatctttctaatgaagaactgtgactactatacctccttcaatcacaactcaggctacagtcaggccaagtggcggctcatagcaaaaacaggtcattttgatatttgctctcgtcacagcacccatcacttctgtcgctgcatcaatgacgggactaagtgtcaaaacggcgattgggactttgccggagagatgaatgagacatataactccaaaaatgatttctactcacacgacctgaaccttttctatacgatttttgaaaacgctttccctggcaccactgagagcttgttttaccagctgatccagaagaaaaatacaaccggggcgtctaagatactcggaaaactgatcacaaagtacggtaacaataacatgttcgtgggcgtatggaagtttgggcagtatttactgactcttccatacattaataacaccgaattgtcccaaaatagaaggcagacgatcctcgcaacccaggagagtctgagccggtctcattccggacgacaggaatcaatgagtagcgccattcaaggctcggttacaaaagagtgccacaacgctaaggacgtgggttgtatctccccgcgcttcgggatacccattggcaatctaactgcctgcggagattctcctaactataaaatctacaagaccccagagaaactgtataagagcaataacaagggcgaagtctggtgttcaaatgacgtgcattgcctcaacgattttgagcccgcagacgaagaggtcgtgaataaagttaagaaactgacatgcttccttactgatgtgagtgtaaagaccgacatcttttccgtcgccgtgtctacgtgtaaaatggctgataaggggacatgcaccgttaaggacgccaaatggaacattatcaagtgtgatagcggattgtactatttcactgaccacagagagggtcaggatacaggcaacgactttggggaatactgcatttcccactcatgtaataccgagaggttccctataaacccagatatcctgaaagactgcacttgggaatttcatagccggaagagtaaatacatttctaccatctccttagagagcctcgaagagttccgcagagcaatgacagagaagctgtcgcacacgcttaccatttataatttcaagcccactgcgaacctgccgcatatcaggcctacatacaaatttataaccgctaatggagtggaaaactcagacggcatcgagtctgcctatattttgagttccatccccgcactcggtgggattagcgtcggctacaatgtgcagacaaaggataacttcccactgctagacatcatagtatttattaaatctgccgtgatccgtactacctataatcacatctacgatacgggacctacaattggcataaacacccagcatgacgaacactgtactgggccctgcccagctgttgtcccccacaaggagaattggatcaccttcagccaagaacggacatcccgatggggatgtgaggagtttggctgcctggccattaacactggttgtgtgttcgggtcatgccaggatatcattcatcctgaaaccaaagtgtatagaaaggcagtcgaggaagaggttgtgctcacagtgtgcatcaattttccaggaaacaattactgtacggaaataaacgctgtagagccgaaaatcaccgacgagattgaactgcagttcaagactgtcgatacaaagacccttcccaacttgctggccgtgcagaataggaaattatacagtggccaaatcaacgacctcggtagcttttctcagggctgcgggaatgttcagaagactaaccactccattctgggaatgggcacagcgaaattcgattatgtgtgtcatggggcctcacgcaaggacgtcatcgtgcggagatgctacaataacaattttgatagttgtaggcttctgaaagaggaaaccagcctaatattcgctgacaaccacgagacgctcgaggttgcacatactaagcacctgattggagaattgcaattcaagatcatgctgggcgatatccgctataaatcctttgccgagtctcctgaattagagattgacgctaagtgcgtgggttgtccatcgtgcttcgaaagctactcatgtaattttcagatcgtaaccaacatagacacagtctgctccgtggaggggccctgtaccctcttccacaatcgaattatcattagtgccaacaaacagtcttatggactgaagatgagctgccagactaaacctaatcaaaacgaggaatttatcatatgcaatcggaagtactccgtgcttttcacaaccattgataagaacgacaaaatcgaggtcaatacaggcgatcagacttcatatatctacgaaaaggactctcgttgtaaaacctggctgtgcagagttagggatgagggtattagcgtgttgtttgaaccactcaaggcattctttggcagttacttctccatcattttctatgtagtggtcgggataatcgtgctgttcctaattatctacatctttctgcccatgttcttcaaacttaaggacgttctcaagcgcaacgagtatctgtacttgcaggagctgaaacataagtga

SEQ ID NO: 10896 - RNA, 4305 nt, synthetic construct
  misc_feature 1..4305: note = derived and/or modified CDS sequence (opt3) from CVV(Montgomery County/VA/2015 K)__KX583999.1__GP
  source 1..4305: mol_type = other RNA
atgctgttcctccttatcctggcctttttgggcttcagcacctccaaccccattgctacaagatgctttcacgggggacagttaatagcagagtctaagtcagccacgagtatcagcgaattttgtctgaaagacgatgtgtccatgctaaagtctgaggtcgtttacactaaaaatgacaccggtctctttggccataacaaggtgttcaggtcgtggacaattaaagattggaagctgtgcaatcctatcccaactgctgggggaaccattaacgtaatcgaagtgaataaggacctttcactgatgacaaaaacctatatatgtagccgggattgcactatcacaattgacaaggaggaagcgcaaatcatttttcagaccgataaattgaaccacttcgaggtcagtggcacgactctcaattccggttggtttaagtctaaagccagcgtgaccctggaccgcacatgtgagcatgttaaggtgacttgcgggaagaaatccctgcagttccacgcatgttttaagcatcacatgtcatgcgtccgattctttcacaacaccatcctcccgggaaatatgataaacagtatgtgtcagaatattgaattaatcattatcctgggccttacattggccatcttcattctgatggtgatgctaaccaaaacgtacatatgctatctcctgatgcccatcttcatgcctattgcttacctttatggctgggcatacaacaagagctgtaaaaagtgcaattgctgtgggctggcctatcatccatttactaactgcggatctcactgtgtatgcggtttgaaattcgaggcttccgatcgtatgagaatccatagggaatcaggcctctgtcaagggtacaagagcctgcggatagcccgcttactgtgcaagagtaaaggatcttccctcgttattagcggccttctgtcgatgttgatcctatcttttgtgacacccatcgagggtaccattacttcctaccctgagtcaagaaagtatacactggaagagatcaccgacgtcgtggaagggctcgtgagtgagcagaatattaaagaatacatagtcttctatacgagcctgtttggatcccttatcctgttgctcgcgttcattatgtctatcaccctgagcaagatcacatcaattttagcaaggcggaacgttatatactgtgaggagtgcagtatgtatcactccaaacgcggcatcaagtacaacggcgattttactaataagtgtgggttctgcacctgtaacgaacaggaggacgccgaaggactggtgattcacaaagtaagcaagcgatgcacatataaataccagctaaagtgggctaaagtgctcatggtcactctggtgcttttgctgatcgcccaaaataccattctcatcgttgcagctggtacagattgctgggccaagaagtctctggacatggactgtataggcccaatgcttgatatcgggtcatgcaccaacaaaaatactagaaactacgacacggaggcgcagaagctggtgagtcagagcaaagtctcccagttggatgccgaccaagcatctctcctgggaaattcgattgatagcgctatcaaggccattagggctcagaaaacatatcccaccatgcatttactggaaactatctttctaatgaagaactgtgactactatacctccttcaatcacaactcaggctacagtcaggccaagtggcggctcatagcaaaaacaggtcattttgatatttgctctcgtcacagcacccatcacttctgtcgctgcatcaatgacgggactaagtgtcaaaacggcgattgggactttgccggagagatgaatgagacatataactccaaaaatgatttctactcacacgacctgaaccttttctatacgatttttgaaaacgctttccctggcaccactgagagcttgttttaccagctgatccagaagaaaaatacaaccggggcgtctaagatactcggaaaactgatcacaaagtacggtaacaataacatgttcgtgggcgtatggaagtttgggcagtatttactgactcttccatacattaataacaccgaattgtcccaaaatagaaggcagacgatcctcgcaacccaggagagtctgagccggtctcattccggacgacaggaatcaatgagtagcgccattcaaggctcggttacaaaagagtgccacaacgctaaggacgtgggttgtatctccccgcgcttcgggatacccattggcaatctaactgcctgcggagattctcctaactataaaatctacaagaccccagagaaactgtataagagcaataacaagggcgaagtctggtgttcaaatgacgtgcattgcctcaacgattttgagcccgcagacgaagaggtcgtgaataaagttaagaaactgacatgcttccttactgatgtgagtgtaaagaccgacatcttttccgtcgccgcttctacgtgtaaaatggccgataaggggacatgcaccgtgaacgacgcaaagtggaacattatcaaatgtgatagcggattgtactatttcactgaccacagagagggtcaggatacaggcaatgactttggggaatactgcatttcccactcatgtaacaccgagaggttccctataaatccagatatcctgaaggactgcacttgggaatttcatagccggaaaagtaagtacatttctaccatctccttagagagcctcgaagagttccgcagagcgatgacagagaaactgtcgcacacgcttaccatttataacttcaagcccactgctaatctgccgcatatcaggcctacatacaagtttataaccgccaacggagttgaaaattcagacggcatcgagtctgcatatattttgagttccatccccgccctcggtgggattagcgtgggctacaacgtccagacaaaagataatttcccactgctagacatcatagtgtttattaagtctgctgtaatccgtactacctataaccacatctacgatacgggacctacaattggcataaatacccagcatgacgaacactgtactgggccctgcccagccgtggttccccacaaagagaactggatcaccttcagccaagaacggacatcccgatggggatgtgaggagtttggctgcctggcaattaatactggttgtgtcttcgggtcatgccaggatatcattcatcctgaaaccaaggtgtatagaaaagctgtggaggaagaggtcgttctcacagtgtgcatcaactttccaggaaataactactgtacggaaataaacgccgtggagccgaagatcaccgacgagattgaactgcagttcaaaactgtagatacaaagacccttcccaatttgctggcggtccagaaccacaagttatacagtggccaaatcaatgacctcggtagcttttctcagggctgcgggaacgtgcagaaaactaatcattccattctgggaatgggcacagccaagttcgattatgtttgtcacggggcttcaaggaaagacgtgatcgtccgccggtgctacaacaataactttgatagttgtagacttctgaaggaggaaaccagcctaatattcgcagacaatcatgagacgctcgaggtggcccacactaaacacctgattggagaattgcaattcaagatcatgctgggcgatatcaggtataagtcctttgctgagtctcctgaattagagattgacgccaaatgcgttggttgtccatcgtgcttcgaaagctactcatgtaactttcagatcgtgaccaatatagacacagtatgctccgtcgaggggccctgtaccctcttccataaccgcattatcattagtgcaaataagcagtcttatggactgaaaatgagctgccagactaagcctaaccaaaatgaggaatttatcatatgcaaccgaaaatactccgtgcttttcacaaccattgataagaatgacaagatcgaggtgaacacaggcgatcagacttcatatatctacgaaaaagactctcggtgtaagacctggctgtgccgtgtcagagatgagggtattagcgttttgtttgaaccactcaaagcgttctttggcagttacttctccatcattttctatgtggtagtggggataatcgtcctgttcctaattatctacatctttctgcccatgttcttcaaacttaaggacgtgctcaagaggaacgagtatctgtacttgcaggagctgaagcacaaatga

SEQ ID NO: 10897 - RNA, 4305 nt, synthetic construct
  misc_feature 1..4305: note = derived and/or modified CDS sequence (opt3) from CVV(1156)__EU583730.1__GP
  source 1..4305: mol_type = other RNA
atgctgttcctccttatcctggcctttttgggcttcagcacctccaaccccattgctacaagatgctttcacgggggacagttaatagcagagtctaagtcagccacgagtatcagcgagttctgtctgaaagacgatgtgtccatgctaaagtctgaagtcgtttacattaaaaatgacactggtctctttggccataacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagcgcaaattatctttcagacagataaattgaaccacttcgaggtcagtggcaccacgctctcctctggttggtttaagagcaaagcctccgtgactctggaccgcacctgtgagcatgttaaggtgacatgcgggaagaaatcactgcagttccacgcatgttttaagcatcacatgagttgcgtccgattctttcacaatactatactcccgggaaacatgattaccagcatgtgtcagaatatcgaattaattatcatcctgggccttacattggccattttcatactgatggtgatcctaaccaaaacgtacatttgctatctcctgatgcccatcttcatgcctatagcttacctttatggctgggcatacaacaagtcttgtaaaaagtgcaattgctgtgggctggcctatcatccatttactaactgcggatcccactgtgtatgcggtttgaaattcgaggcttcagatcgtatgaggattcatagagaaagcggcctctgtcaagggtacaagagtctgcggatcgcccgcttactgtgcaagtctaaaggatccagcctcgttatctcgggccttctgtctatgttgattctatcctttgtgacacccatcgagggtaccattacttcataccctgagagtagaaagtatacactggaagagataaccgacgtcgtggaagggctcgtgagcgagcagaatatcaaagaatacattgtcttctatacgtccctgtttggatctcttatcctgttgctcgcgttcatcatgagcattaccctgtcaaagataacaagtatcttagcaaaaaggaacgttatttactgtgaggagtgctccatgtatcacagcaagcggggcatcaagtacaatggcgattttactaacaaatgtgggttctgcacctgtaacgaacaggaggacacagaaggactggtgattcacaagatctctaaacgctgcacttataagtaccagctaaaatgggccaaggtactcatgataaccctggtgcttttgctgatcgctcaaaatacaattctcatcgtcgccgcagagaccgattgctggactaagaaatcactggacattgactgtatcggtccaatgcttgatataggcagttgcacgaacaagaatacacgaagctacgacgctgaagcccagaaactggtgtcccagtctaagatttcgcagttggatgcggaccaagttagcctcctggggaactccatcgattcagccattaaagcaatcagagctcagaagacctatcccactatgcatttactggagaccatatttctaatgaagaattgtgactactatacaagtttcaaccacaattctggatacagccaggccaaatggaggctcatcgctaagaccggccattttgatatttgctcccggcactcaactcatcacttctgtcgttgcatcaacgacggtacaaaatgtcaaaatggggattgggactttgccggcgagatgaacgaaacgtataatagcaagaacgatttctactctcacgacctgaatcttttctataccatttttgagaacgcattccctggaactacagaatccttgttttaccagctgatccagaaaaagaataccacaggcgccagtaaagtgctcgggaagctgataactaagtacggaaacaacaatatgttcgtcggtgtgtggaaatttggccagtatttactgacccttccatacattaacaatacggagttgagccaaaaccgcagactcaccatcctgacaactcaggaactactgtctaggtcccattcagggcggcaggagagtatgagcaatgctatccagggatcgattaccaaggagtgccacaacgcgaaaggcgtaggttgtatctccccgcgattcgggattcccataggcaatctcacagcatgcggagactctcctaactataagatctacaaaactccagaaaagctgtataagagcaataacaaaggcgaggtttggtgttcaaatgatgtgcattgccttaacgactttgaacccgccgatgaggaggtcgtgaataagattaaaaagttgacctgcttcctgacggacgtcagtgtggaagttgatatcttttccgtggctgcctctacatgtaaaatggcagacaagggggtatgcaccgtcaacggagccaagtggaatattatcaaatgtgatagcggtttatactatttcactgaccaccgcgagggccaagatacagggaacgactttggagaatactgcatatcccactcatgtaacaccgagagattccctatcaatccagatattctcaaggactgcacttgggaatttcatagcaggaaaagtaagtacatctctaccatttccctggagagccttgaggagttccggcgcgctatggccgaaaaactgtcgcacacattgacgatctataacttcaagcccaccgcaaatctcccgcatataagacctacttacaagtttattacagcgaacggcgtggaaaattcagatggtatcgagtctgcttatatcctgagttccattcccgccctagggggcataagcgttggatacaacgtgcagaccaaagacaatttcccactgctcgacatcattgtctttatcaagtctgcagtgattaggacaacttataaccacatctacgataccggccctacgatagggatcaatacacagcatgacgaacactgtaccggaccctgcccagccgtagtgccccacaaagagaactggatgactttcagccaggagcgtacctcccggtggggctgtgaagagtttggttgcctggctattaatacagggtgtgttttcggatcatgccaagatatcattcatcctgaaactaaggtctatcgaaaagccgtggaggaagaggtggtccttaccgtttgcatcaactttccaggcaataactactgtacagagataaatgcaattgaaccgaagatcacggacgagatcgaattgcagttcaaaaccgtggatactaagacactgcccaacttactcgctgtgcagaaccacaagctgtacagtggtcagattaatgaccttggcagcttttctcaagggtgcggaaacgtacagaaaaccaatcattccatcctgggcatggggactgtcaagttcgattatgtgtgtcacggagcctcaagaaaagacgttatagtgaggcgctgctacaacaataactttgatagttgtaagctactcaaagaggagacaagcctgattttcgcggacaatcatgaaaccttggaggtcgcccacacgaagcacctgatcggcgaattacagttcaagattatgctcggtgatatccggtataaatcctttgctgagtctcctgaactggagatagacgcaaagtgcgtggggtgtccatcgtgcttcgagagctactcatgtaactttcaaattgttactaatatcgataccgtgtgctccgtagaaggaccctgtacacttttccataacagaatcattatcagtgccaataaacagtcttatggcctgaagatgagctgccagaccaaacctaaccagaatgaggaatttattatatgcaacaggaagtactccgtcttgttcactacaatcgacaagaatgacaaaattgaggtgaacaccggtgatcaaacatcatatatctacgaaaaggactctcgctgtaaaacttggctctgccgagtgcgggatgagggcatcagcgtcctgtttgagccactaaaggctttctttgggagttacttctccattatattttatgttgtgatcggaattatcgtactgttccttattatctacatatttctccccatgttcttcaaactgaaggacgtgttgaagcgtaatgaatatctgtacttacaggagctcaaacacaagtga

SEQ ID NO: 10898 - RNA, 4305 nt, synthetic construct
  misc_feature 1..4305: note = derived and/or modified CDS sequence (opt3) from CVV(6V633)__KX100134.1__GP
  source 1..4305: mol_type = other RNA
atgctgttcctccttatcctggcctttttgggcttcagcacctccaaccccattgctacaagatgctttcacgggggacagttaatagcagagtctaagtcagccacttccatcagcgagttctgtctgaaagacgatgtgtccatgctaaagtctgaagtcgtttacattaaaaatgacacgggtctctttggccataacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagcgcaaattatctttcagacagataaattgaaccacttcgaggtcagtggcaccacgctctcctctggttggtttaagagcaaagcctccgtgactctggaccgcacctgtgagcatgttaaggtgacatgcgggaagaaatcactgcagttccacgcatgttttaagcatcacatgagttgcgtccgattctttcacaatactatactcccgggaaacatgattaccagcatgtgtcagaatatcgaattaattatcatcctgggccttacattggccattttcatactgatggtgatgctaaccaaaacgtacatctgctatctcctgatgcccattttcatgcctatcgcttacctttatggctgggcatacaacaagtcttgtaaaaagtgcaattgctgtgggctggcctatcatccatttactaactgcggatcccactgtgtatgcggtttgaaattcgaggcttcagatcgtatgagaatacatagggaaagcggcctctgtcaagggtacaagagtctgcggattgcccgcttactgtgcaagtctaaaggatccagcctcgttatctcgggccttctgtctatgttgatcctatcctttgtgacacccattgagggtaccatcacttcataccctgagagtagaaagtatacactggaagagattaccgacgtcgtggaagggctcgtgagcgagcagaatataaaagaatacatcgtcttctatacgtccctgtttggatctcttattctgttgctcgcgttcatcatgagcatcaccctgtcaaagattacaagtatattagcaaaaaggaacgttatctactgtgaggagtgctccatgtatcacagcaagcggggcattaagtacaatggcgattttactaacaaatgtgggttctgcacctgtaacgaacaggaggacacagaaggactggtgatccacaaggtatctaaacgctgcacttataagtaccagctaaaatgggccaaggtgctcatgattaccctggtccttttgctgatcgctcaaaatacaatactcatcgtggccgcagagaccgattgctggactaagaaatcactggacattgactgtatcggtccaatgcttgatattggcagttgcacgaacaagaatacacgaagctacgacgctgaagcccagaaactggtttcccagtctaagatctcgcagttggatgcggaccaagccagcctcctggggaactccatagattcagcaattaaagctatcagagcccagaagacctatcccactatgcatttactggagaccatttttctaatgaagaattgtgactactatacaagtttcaaccacaattctggatacagccaggctaaatggaggctcatcgccaagaccggccattttgatatatgctcccggcactcaactcatcacttctgtcgttgcatcaacgacggtacaaaatgtcaaaatggggattgggactttgcaggcgagatgaacgaaacgtataatagcaagaacgatttctactctcacgacctgaatcttttctataccatttttgagaacgccttccctggaactacagaatccttgttttaccagctgatccagaaaaagaataccacaggcgctagtaaagtgctcgggaagctgattactaagtacggaaacaacaatatgttcgtcggtatctggaaatttggccagtatttactgacccttccatacataaacaatacggagttgagccaaaaccgcagactcaccattctggcgacacaggaactactgtctaggtcccattcagggcggcaggagagtatgagcaatgcaatccagggatcgatcactaaggagtgccacaacgccaaaggcgtgggttgtatttccccgcgattcgggatccccattggcaatctcaccgcttgcggagactctcctaactataagatatacaaaacaccagaaaagctgtataagagcaataacaaaggcgaggtatggtgttcaaatgatgttcattgccttaacgactttgaacccgccgatgaggaggtggtcaataagatcaaaaagttgacttgcttcctgaccgacgtgagtgtcgaagtggatatttttagtgttgcagcctctacgtgtaaaatggctgacaagggggtgtgcacagtaaacggagccaagtggaatatcattaaatgtgatagcggtttatactatttcaccgaccaccgcgagggccaagatactgggaacgactttggagaatactgcatctcccactcatgtaacacagagagattccctataaatccagataccctcaaggactgcacttgggaatttcatagcaggaaaagtaagtacatctctaccatttccctggagagccttgaggagttccggcgcgcaatggcggaaaaactgtcgcacacattgacgatctataacttcaagcccaccgctaatctcccgcatattagacctacttacaagtttatcacagccaacggcgtcgaaaattcagatggtatagagtctgcatatattctgagttccatccccgccctagggggcatcagcgtgggatacaacgttcagaccaaagacaatttcccactgctcgacattatagtgtttatcaagtctgctgtcattaggacaacttataaccacatctacgataccggccctacgattgggatcaatacacagcatgacgaacactgtaccggaccctgcccagccgtggtaccccacaaagagaactggatgactttcagccaggagcgtacctcccggtggggctgtgaagagtttggttgcctggcaataaatacagggtgtgtgttcggatcatgccaagatatcattcatcctgaaactaaggtttatcgaaaagctgtcgaggaagaggtggtgcttaccgtctgcatcaactttccaggcaataactactgtacagagattaatgccatcgaaccgaagataacggacgagattgaattgcagttcaaaaccgttgatactaagacactgcccaacttactcgcggtgcagaaccacaagctgtacagtggtcagatcaatgaccttggcagcttttctcaagggtgcggaaacgtgcagaaaaccaatcattccatcctgggcatggggactgtaaagttcgattatgtctgtcacggagcctcaagaaaagacgtgattgttaggcgctgctacaacaataactttgatagttgtaagctactcaaagaggagacaagcctgatcttcgctgacaatcatgaaaccttggaggtggcacacacgaagcacctgataggcgaattacagttcaagattatgctcggtgatatccggtataaatcctttgccgagtctcctgaactggagattgacgctaagtgcgtcgggtgtccatcgtgcttcgagagctactcatgtaactttcaaatcgtgactaatatagataccgtttgctccgtggaaggaccctgtacacttttccataacagaattatcatcagtgccaataaacagtcttatggcctgaagatgagctgccagaccaaacctaaccagaatgaggaatttattatctgcaacaggaagtactccgtattgttcactacaattgacaagaatgacaaaatagaggtcaacaccggtgatcaaacatcatatatctacgaaaaggactctcgctgtaaaacttggctctgccgagtgcgggatgagggcattagcgtgctgtttgagccactaaaggcattctttgggagttacttctccatcatcttttatgtcgttgtgggaattatagtactgttccttatcatttacatctttctccccatgttcttcaaactgaaggacgtgttgaagcgtaatgaatatctgtacttacaggagctcaaacacaagtga

SEQ ID NO: 10899 - RNA, 4305 nt, synthetic construct
  misc_feature 1..4305: note = derived and/or modified CDS sequence (opt3) from CVV(807270)__AF186243.1__GP
  source 1..4305: mol_type = other RNA
atgctgttcctccttatcctggcctttttgggcttcagcacctccaaccccattgctacaagatgctttcacgggggacagttaatagcagagtctaagtcagccacttccatcagcgaattttgtctgaaagacgatgtgtccatgctaaagtctgaggtcgtttacattaaaaatgacacgggtctctttggccataacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagcgcaaattatctttcagacagataaattgaaccacttcgaggtcagtggcaccacgctctcctctggttggtttaagagcaaagcctccgtgactctggaccgcacctgtgagcatgttaaggtgacatgcgggaagaaatcactgcagttccacgcatgttttaagcatcacatgagttgcgtccgattctttcacaatactatactcccgggaaacatgattaccagcatgtgtcagaatatcgaattaattatcatcctgggccttacattggccattttcatactgatggtgatcctaaccaaaacgtacatttgctatctcctgatgcccatcttcatgcctatagcttacctttatggctgggcatacaacaagtcttgtaaaaagtgcaattgctgtgggctggcctatcatccatttactaactgcggatcccactgtgtatgcggtttgaaattcgaggcttcagatcgtatgaggattcatagagaaagcggcctctgtcaagggtacaagagtctgcggatcgcccgcttactgtgcaagtctaaaggatccagcctcgttatctcgggccttctgtctatgttgattctatcctttgtgacacccatcgagggtaccattacttcataccctgagagtagaaagtatacactggaagagataaccgacgtcgtggaagggctcgtgagcgagcagaatatcaaagaatacattgtcttctatacgtccctgtttggatctcttatcctgttgctcgcgttcatcatgagcattaccctgtcaaagataacaagtatcttagcaaaaaggaacgttatttactgtgaggagtgctccatgtatcacagcaagcggggcatcaagtacaatggcgattttactaacaaatgtgggttctgcacctgtaacgaacaggaggacacagaaggactggtgattcacaaggtatctaaacgctgcacttataagtaccagctaaaatgggccaaggtgctcatgatcaccctggtccttttgctgatagctcaaaatacaatcctcattgtggccgcagagaccgattgctggactaagaaatcactggacatcgactgtattggtccaatgcttgatatcggcagttgcacgaacaagaatacacgaagctacgacgctgaagcccagaaactggtttcccagtctaagatatcgcagttggatgcggaccaagtgagcctcctggggaactccattgattcagccatcaaagcaattagagctcagaagacctatcccactatgcatttactggagaccatctttctaatgaagaattgtgactactatacaagtttcaaccacaattctggatacagccaggccaaatggaggctcatagctaagaccggccattttgatatctgctcccggcactcaactcatcacttctgtcaatgcattaacgacggtacaaaatgtcagaatggggattgggactttgccggcgagatgaacgaaacgtataatagcaagaacgatttctactctcacgacctgaatcttttctataccatctttgagaacgcattccctggaactacagaatccttgttttaccagctgattcagaaaaagaataccacaggcgccagtaaagtcctcgggaagctgatcactaagtacggaaacaacaatatgttcgtgggtgtatggaaatttggccaatatttactgacccttccatacataaacaatacggagttgagccagaaccgtcgcctcaccattctggctacacaggaactactgtctagatcccattcagggaggcaggagagtatgagcaatgcgatccaaggatcgatcactaaggagtgccacaacgcaaaaggcgttggttgtatttccccgcggttcgggatccccattggcaatctcaccgcctgcggagactctcctaactataagatatacaaaacaccagaaaagctgtataagagcaataacaaaggcgaggtgtggtgttcaaatgatgtccattgccttaacgactttgaacccgctgatgaggaggtggtcaataagatcaaaaagttgacttgcttcctgaccgacgtgagtgttgaagtggatatttttagtgtagccgcatctacgtgtaaaatggccgacaagggggtctgcacagtgaacggagctaagtggaatatcattaaatgtgatagcggtttatactatttcaccgaccaccgagagggccaggatactgggaacgactttggagaatactgcatctcccactcatgtaacacagagcgcttccctataaatccagatatcctcaaggactgcacctgggaatttcatagcagaaaaagtaagtacatttctactatctccctggagagccttgaggagttcaggcgggccatggcagaaaaactgtcgcacaccttgacaatttataacttcaagcccacggcgaatctcccgcatatccgccctacctacaagtttataactgctaacggcgttgaaaattcagatggtattgagtctgcctatatcctgagttccatccccgcactagggggcattagcgtgggatacaacgtccagacaaaagacaatttcccactgctcgacataatcgtgtttattaagtctgccgtaatcagaaccacatataaccacatttacgatactggccctaccatcgggataaatacgcagcatgacgaacactgtacaggaccctgcccagctgtggttccccacaaagagaactggatgaccttcagccaagagaggacttcccgttggggctgtgaagagtttggttgcctggccatcaataccgggtgtgtcttcggatcatgccaggatattatccatcctgaaacaaaggtgtatcggaaagcagtggaggaagaggtcgttcttactgtgtgcattaactttccaggcaataactactgtaccgagatcaatgctatagaaccgaagattacagacgagatcgaattgcagttcaaaacggtggataccaagactctgcccaacttactcgccgtacagaaccacaagctgtacagtggtcaaatcaatgaccttggcagcttttctcaggggtgcggaaacgtccagaaaacaaatcattccattctgggcatggggaccgtgaagttcgattatgtttgtcacggagcgtcacgaaaagacgtgatcgtcagaaggtgctacaacaataactttgatagttgtaagctactcaaagaggagactagcctgatattcgccgacaatcatgaaacattggaggtggctcacaccaagcacctgattggcgaattacaattcaagatcatgctcggtgatattcgctataaatcctttgcagagtctcctgaactggagatcgacgccaagtgcgttgggtgtccatcgtgcttcgagagctactcatgtaactttcagatagtgacgaatattgatactgtatgctccgtcgaaggaccctgtacccttttccataaccggatcatcattagtgctaataaacagtcttatggcctgaagatgagctgccagacaaaacctaaccaaaatgaggaatttatcatttgcaacagaaagtactccgtgttgttcaccactatagacaagaatgacaaaatcgaggtgaacacaggtgatcagacctcatatatttacgaaaaggactctaggtgtaaaacatggctctgccgcgtccgagatgagggcatcagcgttctgtttgagccactaaaggccttctttgggagttacttctccatcattttctatgtggtagtgggaataatcgtcctgttccttattatctacatttttctccccatgttcttcaaactgaaggacgtgttgaagcggaatgaatatctgtacttacaggagctcaaacacaagtga

SEQ ID NO: 10900 - RNA, 4305 nt, synthetic construct
  misc_feature 1..4305: note = derived and/or modified CDS sequence (opt3) from CVV(856 clone 1)__EU583732.1__GP
  source 1..4305: mol_type = other RNA
atgctgttcctccttatcctggcctttttgggcttcagcacctccaaccccattgctacaagatgctttcacgggggacagttaatagcagagtctaagtcagccacgagtatcagcgagttctgtctgaaagacgatgtgtccatgctaaagtctgaagtcgtttacattaaaaatgacactggtctctttggccataacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagcgcaaattatctttcagacagataaattgaaccacttcgaggtcagtggcaccacgctctcctctggttggtttaagagcaaagcctccgtgactctggaccgcacctgtgagcatgttaaggtgacatgcgggaagaaatcactgcagttccacgcatgttttaagcatcacatgagttgcgtccgattctttcacaatactatactcccgggaaacatgattgccagcatgtgtcagaatatcgaattaattatcatcctgggccttaccttggctattttcatactgatggtgatcctaacaaaaacctacatttgctatctcctgatgcccatcttcatgcctatagcatacctttatggctgggcctacaacaagtcttgtaaaaagtgcaattgctgtgggctggcttatcatccatttacgaactgcggatcccactgtgtatgcggtttgaaattcgaggcctcagatcgtatgaggattcatagagaaagcggcctctgtcaagggtacaagagtctgcggatcgcgcgcttactgtgcaagtctaaaggatccagcctcgttatctcgggccttctgtctatgttgattctatcctttgtgactcccatcgagggtacaattacctcataccctgagagtagaaagtatactctggaagagataacagacgtcgtggaagggctcgtgagcgagcagaatatcaaagaatacattgtcttctatacctccctgtttggatctcttatcctgttgctcgcattcatcatgagcattacgctgtcaaagataaccagtatcttagccaaaaggaacgttatttactgtgaggagtgctccatgtatcacagcaagcggggcatcaagtacaatggcgattttacaaacaaatgtgggttctgcacttgtaacgaacaggaggacaccgaaggactggtgattcacaaggtatctaaacgctgcacatataagtaccagctaaaatgggctaaggtgctcatgatcactctggtccttttgctgatagcccaaaataccatcctcattgtggcagctgagacagattgctggatcaagaaatcactggacattgactgtatcggtccaatgcttgatataggcagttgcaccaacaagaatactcgaagctacgacgccgaagcgcagaaactggtttcccagtctaagatttcgcagttggatgccgaccaagtgagcctcctggggaactccatcgattcagcaattaaagctatcagagcccagaagacgtatcccacaatgcatttactggagaccatatttctaatgaagaattgtgactactataccagtttcaaccacaattctggatacagccaggctaaatggaggctcatcgccaagactggccattttgatatttgctcccggcactcaacacatcacttctgtcgttgcatcaacgacggtaccaaatgtcaaaatggggattgggactttgcaggcgagatgaacgaaacttataatagcaagaacgatttctactctcacgacctgaatcttttctatacaatttttgagaacgccttccctggaacgaccgaatccttgttttaccagctgatccagcgcaaaaatactacaggcgctagtaaggtcctcgggaaactgataaccaagtacggaaacaacaatatgttcgtgggtgtatggaagtttggccagtatttactgacacttccatacattaacaatactgagttgagccaaaacagaaggctcaccatcctgacgacccaggaactactgtctcggtcccattcagggcgacaggagagtatgagcaatgcgatccagggatcgattacaaaagagtgccacaacgcaaagggcgttggttgtatctccccgcgcttcgggattcccataggcaatctcactgcctgcggagactctcctaactataaaatctacaagaccccagaaaaactgtataagagcaataacaagggcgaggtgtggtgttcaaatgatgtccattgccttaacgactttgaacccgctgatgaggaggtggtcaataaaattaagaaattgacatgcttcctgactgacgtgagtgttgaagtggatatcttttccgtagccgcatctacctgtaagatggccgacaaaggggtctgcacggtgaacggagctaagtggaatattatcaagtgtgatagcggtttatactatttcacagaccacagagagggccaagataccgggaacgactttggagaatactgcatatcccactcatgtaacactgagaggttccctatcaatccagatattctcaaagactgcacatgggaatttcatagccggaagagtaaatacatctctaccatttccctggagagccttgaggagttccgcagagccatggcagaaaagctgtcgcacactttgaccatctataacttcaaacccacagcgaatctcccgcatataaggcctacgtacaagtttattaccgctaacggcgttgaaaattcagatggtatcgagtctgcctatatcctgagttccattcccgcactagggggcataagcgtgggatacaacgtccagactaaggacaatttcccactgctcgacatcattgtgtttatcaaatctgccgtaattcgtacaacctataaccacatctacgatacaggccctactatagggatcaatacccagcatgacgaacactgtacgggaccctgcccagctgtggttccccacaaggagaactggatgacattcagccaggagcggacctcccgatggggctgtgaagagtttggttgcctggccattaatactgggtgtgtcttcggatcatgccaagatatcattcatcctgaaaccaaagtgtatagaaaggcagtggaggaagaggtcgttcttacagtgtgcatcaactttccaggcaataactactgtactgagataaatgctattgaaccgaaaatcaccgacgagatcgaattgcagttcaagacagtggatacgaaaaccctgcccaacttactcgccgtacagaaccacaagctgtacagtggtcagattaatgaccttggcagcttttctcaagggtgcggaaacgtccagaagactaatcattccatcctgggcatggggacagtgaaattcgattatgtttgtcacggagcgtcaaggaaggacgtgatagtccgccggtgctacaacaataactttgatagttgtaaactactcaaggaggagaccagcctgattttcgccgacaatcatgaaactttggaggtggctcacacaaaacacctgatcggcgaattacagttcaagattatgctcggtgatatcagatataagtcctttgcagagtctcctgaactggagatagacgccaaatgcgttgggtgtccatcgtgcttcgagagctactcatgtaactttcaaattgtgaccaatatcgatacggtatgctccgtcgaaggaccctgtactcttttccataacaggatcattatcagtgctaataagcagtcttatggcctgaaaatgagctgccagaccaagcctaaccagaatgaggaatttattatatgcaaccgcaaatactccgtgttgttcacaaccatcgacaagaatgacaagattgaggtgaacactggtgatcaaacatcatatatctacgaaaaagactctcgatgtaagacctggctctgccgggtccgtgatgagggcatcagcgttctgtttgagccactaaaagccttctttgggagttacttctccattatattttatgtggtaatcggaattatcgtgctgttccttattatctacatatttctccccatgttcttcaagctgaaagacgtcttgaagagaaatgaatatctgtacttacaggagctcaagcacaaatga

SEQ ID NO: 10901 - RNA, 4305 nt, synthetic construct
  misc_feature 1..4305: note = derived and/or modified CDS sequence (opt3) from CVV(856 clone 3)__EU583731.1__GP
  source 1..4305: mol_type = other RNA
atgctgttcctccttatcctggcctttttgggcttcagcacctccaaccccattgctacaagatgctttcacgggggacagttaatagcagagtctaagtcagccacgagtatcagcgagttctgtctgaaagacgatgtgtccatgctaaagtctgaagtcgtttacattaaaaatgacactggtctctttggccataacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagcgcaaattatctttcagacagataaattgaaccacttcgaggtcagtggcaccacgctctcctctggttggtttaagagcaaagcctccgtgactctggaccgcacctgtgagcatgttaaggtgacatgcgggaagaaatcactgcagttccacgcatgttttaagcatcacatgagttgcgtccgattctttcacaatactatactcccgggaaacatgattgccagcatgtgtcagaatatcgaattaattatcatcctgggccttaccttggctattttcatactgatggtgatcctaacaaaaacctacatttgctatctcctgatgcccatcttcatgcctatagcatacctttatggctgggcctacaacaagtcttgtaaaaagtgcaattgctgtgggctggcttatcatccatttacgaactgcggatcccactgtgtatgcggtttgaaattcgaggcctcagatcgtatgaggattcatagagaaagcggcctctgtcaagggtacaagagtctgcggatcgcgcgcttactgtgcaagtctaaaggatccagcctcgttatctcgggccttctgtctatgttgattctatcctttgtgactcccatcgagggtacaattacctcataccctgagagtagaaagtatactctggaagagataacagacgtcgtggaagggctcgtgagcgagcagaatatcaaagaatacattgtcttctatacctccctgtttggatctcttatcctgttgctcgcattcatcatgagcattacgctgtcaaagataaccagtatcttagccaaaaggaacgttatttactgtgaggagtgctccatgtatcacagcaagcggggcatcaagtacaatggcgattttacaaacaaatgtgggttctgcacttgtaacgaacaggaggacaccgaaggactggtgattcacaaggtatctaaacgctgcacatataagtaccagctaaaatgggctaaggtgctcatgatcactctggtccttttgctgatagcccaaaataccatcctcattgtggcagctgagacagattgctggatcaagaaatcactggacattgactgtatcggtccaatgcttgatataggcagttgcaccaacaagaatactcgaagctacgacgccgaagcgcagaaactggtttcccagtctaagatttcgcagttggatgccgaccaagtgagcctcctggggaactccatcgattcagcaattaaagctatcagagcccagaagacgtatcccacaatgcatttactggagaccatatttctaatgaagaattgtgactactataccagtttcaaccacaattctggatacagccaggctaaatggaggctcatcgccaagactggccattttgatatttgctcccggcactcaacacatcacttctgtcgttgcatcaacgacggtaccaaatgtcaaaatggggattgggactttgcaggcgagatgaacgaaacttataatagcaagaacgatttctactctcacgacctgaatcttttctatacaatttttgagaacgccttccctggaacgaccgaatccttgttttaccagctgatccagcgcaaaaatactacaggcgctagtaaggtcctcgggaaactgataaccaagtacggaaacaacaatatgttcgtgggtgtatggaagtttggccagtatttactgacacttccatacattaacaatactgagttgagccaaaacagaaggctcaccatcctgacgacccatgaactactgtctcggtcccactcagggcgacaggagagtatgagcaatgcgatccagggatcgattacaaaagagtgccataacgcaaagggcgttggttgtatctccccgcgcttcgggattcccataggcaatctcactgcctgcggagactctcctaactataaaatctacaagaccccagaaaaactgtataagagcaataacaagggcgaggtgtggtgttcaaatgatgtccactgccttaacgactttgaacccgctgatgaggaggtggtcaataaaattaagaaattgacatgcttcctgactgacgtgagtgttgaagtggatatcttttccgtagccgcatctacctgtaagatggccgacaaaggggtctgcacggtgaacggagctaagtggaatattatcaagtgtgatagcggtttatactatttcacagaccacagagagggccaggataccgggaacgactttggagaatactgcatatcccattcatgtaacactgagaggttccctatcaatccagatattctcaaagactgcacatgggaatttcacagccggaagagtaaatacatctctaccatttccctggagagccttgaggagttccgcagagccatggcagaaaagctgtcgcatactttgaccatctataacttcaaacccacagcgaatctcccgcacataaggcctacgtacaagtttattaccgctaacggcgttgaaaattcagatggtatcgagtctgcctatatcctgagttccattcccgcactagggggcataagcgtgggatacaacgtccaaactaaggacaatttcccactgctcgacatcattgtgtttatcaaatctgccgtaattcgtacaacctataaccatatctacgatacaggccctactatagggatcaatacccagcacgacgaacactgtacgggaccctgcccagctgtggttccccataaggagaactggatgacattcagccaggagcggacctcccgatggggctgtgaagagtttggttgcctggccattaatactgggtgtgtcttcggatcatgccaggatatcattcaccctgaaaccaaagtgtatagaaaggcagtggaggaagaggtcgttcttacagtgtgcatcaactttccaggcaataactactgtactgagataaatgctattgaaccgaaaatcaccgacgagatcgaattgcaattcaagacagtggatacgaaaaccctgcccaacttactcgccgtacagaaccataagctgtacagtggtcagattaatgaccttggcagcttttctcaggggtgcggaaacgtccaaaagactaatcactccatcctgggcatggggacagtgaaattcgattatgtttgtcatggagcgtcaaggaaggacgtgatagtccgccggtgctacaacaataactttgatagttgtaaactactcaaggaggagaccagcctgattttcgccgacaatcacgaaactttggaggtggctcacacaaaacatctgatcggcgaattacagttcaagattatgctcggtgatatcagatataagtcctttgcagagtctcctgaactggagatagacgccaaatgcgttgggtgtccatcgtgcttcgagagctactcatgtaactttcagattgtgaccaatatcgatacggtatgctccgtcgaaggaccctgtactcttttccacaacaggatcattatcagtgctaataagcaatcttatggcctgaaaatgagctgccagaccaagcctaaccagaatgaggaatttattatatgcaaccgcaaatactccgtgttgttcacaaccatcgacaagaatgacaagattgaggtgaacactggtgatcagacatcatatatctacgaaaaagactctcgatgtaagacctggctctgccgggtccgtgatgagggcatcagcgttctgtttgagccactaaaagccttctttgggagttacttctccattatattttatgtggtaatcggaattatcgtgctgttccttattatctacatatttctccccatgttcttcaagctgaaagacgtcttgaagagaaatgaatatctgtacttacaagagctcaagcataaatga

SEQ ID NO: 10902 - RNA, 4305 nt, synthetic construct
  misc_feature 1..4305: note = derived and/or modified CDS sequence (opt3) from CVV(CK102)__AF186242.1__GP
  source 1..4305: mol_type = other RNA
atgctgttcctccttatcctggcctttttgggcttcagcacctccaaccccattgctacaagatgctttcacgggggacagttaatagcagagtctaagtcagccacaagtatcagcgagttctgtctgaaagacgatgtgtccatgctaaagtctgaagtcgtttacattaaaaatgacacgggtctctttggccataacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagcgcaaattatctttcagacagataaattgaaccacttcgaggtcagtggcaccacgctctcctctggttggtttaagagcaaagcctccgtgactctggaccgcacctgtgagcatgttaaggtgacatgcgggaagaaatcactgcagttccacgcatgttttaagcatcacatgagttgcgtccgattctttcacaatactatactcccgggaaacatgattaccagcatgtgtcagaatatcgaattaattatcatcctgggccttacattggccattttcatactgatggtgatcctaaccaaaacgtacatttgctatctcctgatgcccatcttcatgcctatagcttacctttatggctgggcatacaacaagtcttgtaaaaagtgcaattgctgtgggctggcctatcatccatttactaactgcggatcccactgtgtatgcggtttgaaattcgaggcttcagatcgtatgaggattcatagagaaagcggcctctgtcaagggtacaagagtctgcggatcgcccgcttactgtgcaagtctaaaggatccagcctcgttgtgtcgggccttctgtctatgttgatcctatcctttgtcacacccattgagggtaccatcacttcataccctgagagtagaaagtatacactggaagagattaccgacgtggtggaagggctcgtcagcgagcagaatataaaagaatacatcgttttctatacgtccctgtttggatctcttattctgttgctcgcgttcatcatgagcatcaccctgtcaaagattacaagtatattagcaaaaaggaacgtgatctactgtgaggagtgctccatgtatcacagcaagcggggcattaagtacaatggcgattttactaacaaatgtgggttctgcacctgtaacgaacaggaggacacagaaggactggtaatccacaaggtgtctaaacgctgcacttataagtaccagctaaaatgggccaaggtcctcatgattaccctggtgcttttgctgatcgctcaaaatacaatactcatcgttgccgcagagaccgattgctggactaagaaatcactggacattgactgtatcggtccaatgcttgatattggcagttgcacgaacaagaatacacgaagctacgacaccgaagctcagaaactggtgtcccagtctaagatctcgcagttggatgccgaccaagtcagcctcctggggaactccatagattcagcgattaaagccatcagagcacagaagacttatcccaccatgcatttactggagacaatttttctaatgaagaattgtgactactataccagtttcaaccacaattctggatacagccaggctaaatggaggctcatcgccaagactggccattttgatatatgctcccggcactcaacacatcacttctgtcgttgcatcaacgacggtacgaaatgtcaaaatggggattgggactttgctggcgagatgaacgaaacctataatagcaagaacgatttctactctcacgacctgaatcttttctatactatttttgagaacgccttccctggaacaaccgaatccttgttttaccagctgatccagaaaaagaatacaactggcgcaagtaaagtgctcgggaagctgattaccaagtacggaaacaacaatatgttcgtaggtgtttggaaatttggccagtatttactgacgcttccatacatcaacaataccgagttgagccaaaaccgcagactcacaatactggccactcaggaactactgtctaggtcccattcagggcggcaggagagtatgagcaatgctattcagggatcgatcaccaaggagtgccacaacgcgaaaggcgtgggttgtatctccccgcgattcgggattcccatcggcaatctcacagcatgcggagactctcctaactataagatttacaaaactccagaaaagctgtataagagcaataacaaaggcgaggtctggtgttcaaatgatgtgcattgccttaacgactttgaacccgccgatgaggaggtcgtgaataagataaagaagttgacctgcttcctgacggacgttagtgtggaagtagatatcttttccgtcgctgcctctacatgtaaaatggcagacaagggggtgtgcaccgttaacggagccaagtggaatattatcaaatgtgatagcggtttatactatttcactgaccaccgcgagggccaagatacagggaacgactttggagaatactgcatttcccactcatgtaacaccgagagattccctatcaatccagatatactcaaggactgcacttgggaatttcatagcaggaaaagtaagtacatctctaccatttccctggagagccttgaggagttccggcgcgctatggccgaaaaactgtcgcacacattgacgatctataacttcaagcccaccgcaaatctcccgcatattagacctacttacaagtttatcacagcgaacggcgtggaaaattcagatggtatagagtctgcttatattctgagttccatccccgccctagggggcatcagcgtcggatacaacgtgcagaccaaagacaatctgccactcctggacattatagtattcatcaagtctgcagtgattaggacaacttataaccacatctacgataccggccctacgattgggatcaatacacagcatgacgaacactgtaccggaccctgcccagccgttgtcccccacaaagagaactggatgacttttagccaggagcgtacctcccggtggggctgtgaagagttcggttgccttgctataaatacagggtgtgtgtttggatcatgccaagatatcattcatcctgaaactaaggtgtatcgaaaagccgtcgaggaagaggttgtgttgaccgtgtgcatcaacttcccaggcaataactactgtacagagattaatgcaatcgaaccgaagataacggacgagattgaactgcagtttaaaaccgtagatactaagacattacccaacctcctggctgtccagaaccacaaactttacagtggtcagatcaatgacctgggcagcttctctcaagggtgcggaaacgtgcagaaaaccaatcattccatcctaggcatggggactgttaagtttgattatgtgtgtcacggagcctcaagaaaagacgtcattgtgaggcgctgctacaacaataacttcgatagttgtaagctcctgaaagaggagactagcttgatctttgcggacaatcatgaaaccctggaggttgcccacacgaagcacttaataggcgaactccagttcaagattatgctgggtgatatccggtataaatccttcgctgagtctcctgaacttgagattgacgcaaagtgcgtggggtgtccatcgtgctttgagagctactcatgtaacttccaaatcgtaactaatatagataccgtctgctccgtggaaggaccctgtacactgtttcataacagaattatcatcagtgccaataaacagtcttatggcttgaagatgagctgccagaccaaacctaaccagaatgaggagttcattatctgcaacaggaagtactccgtgctctttactacaattgacaagaatgacaaaatagaagtcaacaccggtgatcaaacatcatatatctacgaaaaggactctcgctgtaaaacttggctgtgccgagttcgggatgagggcattagcgtgctattcgagccactgaaggcttttagtgggtcctacttcagcatcatcttttatgtagtggtcggaattatagtgcttttcctcatcatttacatctttctgcccatgttctttaaattgaaggacgttctgaagcgtaatgaatatttatacctccaggagctgaaacacaagtga

SEQ ID NO: 10903 - RNA, 4305 nt, synthetic construct
  misc_feature 1..4305: note = derived and/or modified CDS sequence (opt3) from CVV(CK-102)__KX100146.1__GP
  source 1..4305: mol_type = other RNA
atgctgttcctccttatcctggcctttttgggcttcagcacctccaaccccattgctacaagatgctttcacgggggacagttaatagcagagtctaagtcagccacaagtatcagcgagttctgtctgaaagacgatgtgtccatgctaaagtctgaggtcgtttacattaaaaatgacacgggtctctttggccataacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagctcaaattatctttcagacagataaattgaaccacttcgaggtcagtggcaccacgctctcctctggttggtttaagagcaaagcctccgtgactctggaccgcacctgtgagcatgttaaggtgacatgcgggaagaaatcactgcagttccacgcatgttttaagcatcacatgagttgcgtccgattctttcacaatactatactcccgggaaacatgattaccagcatgtgtcagaatatcgaattaattatcatcctgggccttacattggccattttcatactgatggtgatcctaaccaaaacgtacatttgctatctcctgatgcccatcttcatgcctatagcttacctttatggctgggcatacaacaagtcttgtaaaaagtgcaattgctgtgggctggcctatcatccatttactaactgcggatcccactgtgtatgcggtttgaaattcgaggcttcagatcgtatgaggattcatagagaaagcggcctctgtcaagggtacaagagtctgcggatcgcccgcttactgtgcaagtctaaaggatccagcctcgttgtgtcgggccttctgtctatgttgatcctatcctttgtcacacccattgagggtaccatcacttcataccctgagagtagaaagtatacactggaagagattaccgacgtggtggaagggctcgtcagcgagcagaatataaaagaatacatcgttttctatacgtccctgtttggatctcttattctgttgctcgcgttcatcatgagcatcaccctgtcaaagattacaagtatattagcaaaaaggaacgtgatctactgtgaggagtgctccatgtatcacagcaagcggggcattaagtacaatggcgattttactaacaaatgtgggttctgcacctgtaacgaacaggaggacacagaaggactggtaatccacaaggtgtctaaacgctgcacttataagtaccagctaaaatgggccaaggtcctcatgattaccctggtgcttttgctgatcgctcaaaatacaatactcatcgttgccgcagagaccgattgctggactaagaaatcactggacattgactgtatcggtccaatgcttgatattggcagttgcacgaacaagaatacacgaagctacgacaccgaagctcagaaactggtgtcccagtctaagatctcgcagttggatgccgaccaagtcagcctcctggggaactccatagattcagcgattaaagccatcagagcacagaagacttatcccaccatgcatttactggagacaatttttctaatgaagaattgtgactactataccagtttcaaccacaattctggatacagccaggctaaatggaggctcatcgccaagactggccattttgatatatgctcccggcactcaacacatcacttctgtcgttgcatcaacgacggtacgaaatgtcaaaatggggattgggactttgctggcgagatgaacgaaacctataatagcaagaacgatttctactctcacgacctgaatcttttctatactatttttgagaacgccttccctggaacaaccgaatccttgttttaccagctgatccagaaaaagaatacaactggcgcaagtaaagtgctcgggaagctgattaccaagtacggaaacaacaatatgttcgtaggtgtttggaaatttggccagtatttactgacgcttccatacatcaacaataccgagttgagccaaaaccgcagactcacaatactggccactcaggaactactgtctaggtcccattcagggcggcaggagagtatgagcaatgctattcagggatcgatcaccaaggagtgccacaacgcgaaaggcgtggaatgtatctccccgcgattcggtattcccatcgggaatctcacagcatgcggcgactctcctaactataagatttacaaaactccagagaagctgtataagagcaataacaaaggagaagtctggtgttcaaatgatgtgcattgccttaacgactttgagcccgccgatgaggaagtcgtgaataagataaagaagttgacctgcttcctgacggacgttagtgtggaggtagatatcttttccgtcgctgcctctacatgtaaaatggcagacaagggcgtgtgcaccgttaacggggccaagtggaatattatcaaatgtgatagcggattatactatttcactgaccaccgcgaaggtcaagatacaggcaacgactttggggagtactgcatttcccactcatgtaacaccgaaagattccctatcaatccagatatactcaaggactgcacttgggagtttcatagcaggaaaagtaagtacatctctaccatttccctggagagccttgaagagttccggcgcgctatggccgaaaaactgtcgcacacattgacgatctataacttcaagcccaccgcaaatctcccgcatattagacctacttacaagtttatcacagcgaacggagtggaaaattcagatggcatagaatctgcttatattctgagttccatccccgccctaggtgggatcagcgtcggctacaacgtgcagaccaaagacaatctgccactcctggacattatagtattcatcaagtctgcagtgattaggacaacttataaccacatctacgataccggacctacgattggcatcaatacacagcatgacgagcactgtaccgggccctgcccagccgttgtcccccacaaagagaactggatgacttttagccaggaacgtacctcccggtggggatgtgaggagttcggctgccttgctataaatacaggttgtgtgtttgggtcatgccaagatatcattcatcctgaaactaaggtgtatcgaaaagccgtcgaagaggaggttgtgttgaccgtgtgcatcaacttcccaggaaataactactgtacagaaattaatgcaatcgagccgaagataacggacgaaattgagctgcagtttaaaaccgtagatactaagacattacccaacctcctggctgtccagaaccacaaactttacagtggccagatcaatgacctgggtagcttctctcaaggctgcgggaacgtgcagaaaaccaatcattccatcctaggaatgggcactgttaagtttgattatgtgtgtcacggggcctcaagaaaagacgtcattgtgaggcgctgctacaacaataacttcgatagttgtaagctcctgaaagaggaaactagcttgatctttgcggacaatcatgagaccctggaagttgcccacacgaagcacttaataggagagctccagttcaagattatgctgggcgatatccggtataaatccttcgctgaatctcctgagcttgagattgacgcaaagtgcgtgggttgtccatcgtgctttgaaagctactcatgtaacttccaaatcgtaactaatatagataccgtctgctccgtggaggggccctgtacactgtttcataacagaattatcatcagtgccaataaacagtcttatggattgaagatgagctgccagaccaaacctaaccagaatgaagagttcattatctgcaacaggaagtactccgtgctctttactacaattgacaagaatgacaaaatagaagtcaacaccggcgatcaaacatcatatatctacgagaaggactctcgctgtaaaacttggctgtgccgagttcgggatgagggtattagcgtgctattcgaaccactgaaggcgtttttcggcagttacttttccatcatcttctatgtagtggtcgggattatagtgctttttctcatcatttacatcttcctgcccatgtttttcaaattgaaggacgttctgaagcgtaatgagtatttatacctccaggaactgaaacacaagtga

SEQ ID NO: 10904 - RNA, 4305 nt, synthetic construct
  misc_feature 1..4305: note = derived and/or modified CDS sequence (opt3) from CVV(MI80-1-450)__AF186241.1__GP
  source 1..4305: mol_type = other RNA
atgctgttcctccttatcctggcctttttgggcttcagcacctccaaccccattgctacaagatgctttcacgggggacatttaatagcagagtctaagtcagccacttccatcagcgaattttgtctgaaagacgatgtgtccatgctaaagtctgaggtcgtttacattaaaaatgacacgggtctctttggccacaacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagcgcagattatctttcaaacagataaattgaaccatttcgaggtcagtggcaccacgctctcctctggttggtttaagagcaaagcctccgtgactctggaccgcacctgtgagcacgttaaggtgacatgcgggaagaaatcactgcagttccatgcatgttttaagcaccacatgagttgcgtccgattctttcataatactatactcccgggaaacatgattaccagcatgtgtcagaatatcgaattaattatcatcctgggccttacattggccattttcatactgatggtgatcctaaccaaaacgtacatttgctatctcctgatgcccatcttcatgcctatagcttacctttatggctgggcatacaacaagtcttgtaaaaagtgcaattgctgtgggctggcctatcacccatttactaactgcggatcccattgtgtatgcggtttgaaattcgaggcttcagatcgtatgaggattcacagagaaagcggcctctgtcaggggtacaagagtctgcggatcgcccgcttactgtgcaagtctaaaggatccagcctcgttatctcgggccttctgtctatgttgattctatcctttgtgacacccatcgagggtaccattacttcataccctgagagtagaaagtatacactggaagagataaccgacgtcgtggaagggctcgtgagcgagcaaaatatcaaagaatacattgtcttctatacgtccctgtttggatctcttatcctgttgctcgcgttcatcatgagcattaccctgtcaaagataacaagtatcttagcaaaaaggaacgttatttactgtgaggagtgctccatgtatcacagcaagcggggcatcaagtacaatggcgattttactaacaaatgtgggttctgcacctgtaacgaacaggaggacacagaaggactggtgattcataaggtatctaaacgctgcacttataagtaccagctaaaatgggccaaggtgctcatgatcaccctggtccttttgctgatagctcagaatacaatcctcattgtggccgcagagaccgattgctggactaagaaatcactggacatcgactgtattggtccaatgcttgatatcggcagttgcacgaacaagaatacacgaagctacgacgctgaagcccaaaaactggtttcccagtctaagatatcgcagttggatgcggaccaggtgagcctcctggggaactccattgattcagccatcaaagcaattagagctcaaaagacctatcccactatgcacttactggagaccatctttctaatgaagaattgtgactactatacaagtttcaaccataattctggatacagccaggccaaatggaggctcatagctaagaccggccactttgatatctgctcccggcattcaactcaccacttctgtcgttgcattaacgacggtacaaaatgtcagaatgggaactgggattttgccggcgagatgaatgaaacgtataacagcaagaatgacttctactctcatgatctgaaccttttctataccatctttgagaatgcattccctggaactacagaatccttgttttaccaactgattcagaaaaagaacaccacaggcgccagtcaggtcctcgggaaactgatcactaagtacggaaacaataacatgttcgtgggtgtatggaagtttggccagtatttactgacccttccatacataaataacacggagttgagccaaaatcgcagactcaccattctggctacacaggaactactgtctaggtcccactcagggcggcaggagagtatgagcaacgcgatccagggatcgatcactaaagagtgccataatgcaaagggcgttggttgtatttccccgcgattcgggatccccattggcaacctcaccgcctgcggagactctcctaattataaaatatacaagacaccagaaaaactgtataagagcaacaataagggcgaggtgtggtgttcaaacgacgtccactgccttaatgattttgaacccgctgacgaggaggtggtcaacaaaatcaagaaattgacttgcttcctgaccgatgtgagtgttgaagtggacatttttagtgtagccgcatctacgtgtaagatggccgataaaggggtctgcacagtgaatggagctaagtggaacatcattaagtgtgacagcggtttatactatttcaccgatcaccgcgagggccaagacactgggaacgattttggagaatactgcatctcccattcatgtaatacagagagattccctataaacccagacatcctcaaagattgcacctgggaatttcacagcaggaagagtaaatacatttctactatctccctggagagccttgaggagttccggcgcgccatggcagaaaagctgtcgcataccttgacaatttataatttcaaacccacggcgaacctcccgcacatcagacctacctacaagtttataactgctaatggcgttgaaaactcagacggtattgagtctgcctatatcctgagttccatccccgcactagggggcattagcgtgggatacaatgtccagacaaaggataacttcccactgctcgacataatcgtgtttattaaatctgccgtaatcaggaccacatataatcatatttacgacactggccctaccatcgggataaacacgcagcacgatgaacactgtacaggaccctgcccagctgtggttccccataaggagaattggatgaccttcagccaggagcgtacttcccggtggggctgtgaagagtttggttgcctggccatcaacaccgggtgtgtcttcggatcatgccaagacattatccaccctgaaacaaaagtgtatcgaaaggcagtggaggaagaggtcgttcttactgtgtgcattaattttccaggcaacaattactgtaccgagatcaacgctatagaaccgaaaattacagatgagatcgaattgcagttcaagacggtggacaccaaaactctgcccaacttactcgccgtacagaatcataagctgtacagtggtcagatcaacgatcttggcagcttttctcaagggtgcggaaatgtccagaagacaaaccactccattctgggcatggggaccgtgaaattcgactatgtttgtcatggagcgtcaagaaaggatgtgatcgtcaggcgctgctacaataacaattttgacagttgtaaactactcaaggaggagactagcctgatattcgccgataaccacgaaacattggaggtggctcacaccaaacatctgattggcgaattacagttcaagatcatgctcggtgacattcggtataagtcctttgcagagtctcctgaactggagatcgatgccaaatgcgttgggtgtccatcgtgcttcgagagctactcatgtaattttcaaatagtgacgaacattgacactgtatgctccgtcgaaggaccctgtacccttttccacaatagaatcatcattagtgctaacaagcagtcttatggcctgaaaatgagctgccagacaaagcctaatcagaacgaggaatttatcatttgcaataggaaatactccgtgttgttcaccactatagataagaacgacaagatcgaggtgaatacaggtgaccaaacctcatatatttacgaaaaagattctcgctgtaagacatggctctgccgagtccgggacgagggcatcagcgttctgtttgagccactaaaagccttctttgggagttacttctccatcattttctatgtggtagtgggaataatcgtcctgttccttattatctacatttttctccccatgttcttcaagctgaaagatgtgttgaagcgtaacgaatatctgtacttacaggagctcaagcataaatga

SEQ ID NO: 10905 - RNA, 4305 nt, synthetic construct
  misc_feature 1..4305: note = derived and/or modified CDS sequence (opt3) from CVV(MI80-1-450)__KX100149.1__GP
  source 1..4305: mol_type = other RNA
atgctgttcctccttatcctggcctttttgggcttcagcacctccaaccccattgctacaagatgctttcacgggggacagttaatagcagagtctaagtcagccacttccatcagcgaattttgtctgaaagacgatgtgtccatgctaaagtctgaggtcgtttacattaaaaatgacacgggtctctttggccataacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagcgcaaattatctttcagacagataaattgaaccacttcgaggtcagtggcaccacgctctcctctggttggtttaagagcaaagcctccgtgactctggaccgcacctgtgagcatgttaaggtgacatgcgggaagaaatcactgcagttccacgcatgttttaagcatcacatgagttgcgtccgattctttcacaatactatactcccgggaaacatgattaccagcatgtgtcagaatatcgaattaattatcatcctgggccttacattggccattttcatactgatggtgatcctaaccaaaacgtacatttgctatctcctgatgcccatcttcatgcctatagcttacctttatggctgggcatacaacaagtcttgtaaaaagtgcaattgctgtgggctggcctatcatccatttactaactgcggatcccactgtgtatgcggtttgaaattcgaggcttcagatcgtatgaggattcatagagaaagcggcctctgtcaagggtacaagagtctgcggatcgcccgcttactgtgcaagtctaaaggatccagcctcgttatctcgggccttctgtctatgttgattctatcctttgtgacacccatcgagggtaccattacttcataccctgagagtagaaagtatacactggaagagataaccgacgtcgtggaagggctcgtgagcgagcagaatatcaaagaatacattgtcttctatacgtccctgtttggatctcttatcctgttgctcgcgttcatcatgagcattaccctgtcaaagataacaagtatcttagcaaaaaggaacgttatttactgtgaggagtgctccatgtatcacagcaagcggggcatcaagtacaatggcgattttactaacaaatgtgggttctgcacctgtaacgaacaggaggacacagaaggactggtgattcacaaggtatctaaacgctgcacttataagtaccagctaaaatgggccaaggtgctcatgatcaccctggtccttttgctgatagctcaaaatacaatcctcattgtggccgcagagaccgattgctggactaagaaatcactggacatcgactgtattggtccaatgcttgatatcggcagttgcacgaacaagaatacacgaagctacgacgctgaagcccagaaactggtttcccagtctaagatatcgcagttggatgcggaccaagtgagcctcctggggaactccattgattcagccatcaaagcaattagagctcagaagacctatcccactatgcatttactggagaccatctttctaatgaagaattgtgactactatacaagtttcaaccacaattctggatacagccaggccaaatggaggctcatagctaagaccggccattttgatatctgctcccggcactcaactcatcacttctgtcgttgcattaacgacggtacaaaatgtcaaaatgggaactgggattttgccggcgagatgaatgaaacgtataacagcaagaatgacttctactctcacgatctgaaccttttctataccatctttgagaatgcattccctggaactacagaatccttgttttaccagctgattcagaaaaagaacaccacaggcgccagtcaggtcctcgggaaactgatcactaagtacggaaacaataacatgttcgtgggtgtatggaagtttggccaatatttactgacccttccatacataaataacacggagttgagccagaatcgcagactcaccattctggctacacaggaactactgtctaggtcccattcagggcggcaggagagtatgagcaacgcgatccaaggatcgatcactaaagagtgccacaatgcaaagggcgttggttgtatttccccgcgattcgggatccccattggcaacctcaccgcctgcggagactctcctaattataaaatatacaagacaccagaaaaactgtataagagcaacaataagggcgaggtgtggtgttcaaacgacgtccattgccttaatgattttgaacccgctgacgaggaggtggtcaacaaaatcaagaaattgacttgcttcctgaccgatgtgagtgttgaagtggacatttttagtgtagccgcatctacgtgtaagatggccgataaaggggtctgcacagtgaatggagctaagtggaacatcattaagtgtgacagcggtttatactatttcaccgatcaccgcgagggccaggacactgggaacgattttggagaatactgcatctcccactcatgtaatacagagagattccctataaacccagacatcctcaaagattgcacctgggaatttcatagcaggaagagtaaatacatttctactatctccctggagagccttgaggagttccggcgcgccatggcagaaaagctgtcgcacaccttgacaatttataatttcaaacccacggcgaacctcccgcatatcagacctacctacaagtttataactgctaatggcgttgaaaactcagacggtattgagtctgcctatatcctgagttccatccccgcactagggggcattagcgtgggatacaatgtccagacaaaggataacttcccactgctcgacataatcgtgtttattaaatctgccgtaatcaggaccacatataatcacatttacgacactggccctaccatcgggataaacacgcagcatgatgaacactgtacaggaccctgcccagctgtggttccccacaaggagaattggatgaccttcagccaagagcgtacttcccggtggggctgtgaagagtttggttgcctggccatcaacaccgggtgtgtcttcggatcatgccaggacattatccatcctgaaacaaaagtgtatcgaaaggcagtggaggaagaggtcgttcttactgtgtgcattaattttccaggcaacaattactgtaccgagatcaacgctatagaaccgaaaattacagatgagatcgaattgcagttcaagacggtggacaccaaaactctgcccaacttactcgccgtacagaatcacaagctgtacagtggtcaaatcaacgatcttggcagcttttctcaggggtgcggaaatgtccagaagacaaaccattccattctgggcatggggaccgtgaaattcgactatgtttgtcacggagcgtcaagaaaggatgtgatcgtcaggcgctgctacaataacaattttgacagttgtaaactactcaaggaggagactagcctgatattcgccgataaccatgaaacattggaggtggctcacaccaaacacctgattggcgaattacaattcaagatcatgctcggtgacattcggtataagtcctttgcagagtctcctgaactggagatcgatgccaaatgcgttgggtgtccatcgtgcttcgagagctactcatgtaattttcagatagtgacgaacattgacactgtatgctccgtcgaaggaccctgtacccttttccataatagaatcatcattagtgctaacaagcagtcttatggcctgaaaatgagctgccagacaaagcctaatcaaaacgaggaatttatcatttgcaataggaaatactccgtgttgttcaccactatagataagaacgacaagatcgaggtgaatacaggtgaccagacctcatatatttacgaaaaagattctcgctgtaagacatggctctgccgagtccgggacgagggcatcagcgttctgtttgagccactaaaagccttctttgggagttacttctccatcattttctatgtggtagtgggaataatcgtcctgttccttattatctacatttttctccccatgttcttcaagctgaaagatgtgttgaagcgtaacgaatatctgtacttacaggagctcaagcacaaatga

SEQ ID NO: 10906 - RNA, 4305 nt, synthetic construct
  misc_feature 1..4305: note = derived and/or modified CDS sequence (opt3) from CVV(MNZ-92011)__KC436107.1__GP
  source 1..4305: mol_type = other RNA
atgctgttcctccttatcctggcctttttgggcttcagcacctccaaccccattgctacaagatgctttcacgggggacagttaatagcagagtctaagtcagccacgagtatcagcgagttctgtctgaaagacgatgtgtccatgctaaagtctgaagtcgtttacactaaaaatgacaccggtctctttggccataacaaggtgttcaggtcgtggacaattaaagattggaagctgtgcaatcctatcccaactgctgggggaaccattaacgtaatcgaagtgaataaggacctttcactgatgacaaaaacctatatatgtagccgggattgcactatcacaattgacaaggaggaagcgcaaatcatttttcagaccgataaattgaaccacttcgaggtcagtggcacgactctcaattccggttggtttaagtctaaagccagcgtgaccctggaccgcacatgtgagcatgttaaggtgacttgcgggaagaaatccctgcagttccacgcatgttttaagcatcacatgtcatgcgtccgattctttcacaacaccatcctcccgggaaatatgataaacagtatgtgtcagaatattgaattaatcattatcctgggccttacattggccatcttcattctgatggtgatgctaaccaaaacgtacatatgctatctcctgatgcccatcttcatgcctattgcttacctttatggctgggcatacaacaagagctgtaaaaagtgcaattgctgtgggctggcctatcatccatttactaactgcggatctcactgtgtatgcggtttgaaattcgaggcttccgatcgtatgagaatccatagggaatcaggcctctgtcaagggtacaagagcctgcggatagcccgcttactgtgcaagagtaaaggatcttccctcgttattagcggccttctgtcgatgttgatcctatcttttgtgacacccatcgagggtaccattacttcctaccctgagtcaagaaagtatacactggaagagatcaccgacgtcgtggaagggctcgtgagtgagcagaatattaaagaatacatagtcttctatacgagcctgtttggatcccttatcctgttgctcgcgttcattatgtctatcaccctgagcaagatcacatcaattttagcaaggcggaacgttatatactgtgaggagtgcagtatgtatcactccaaacgcggcatcaagtacaacggcgattttactaataagtgtgggttctgcacctgtaacgaacaggaggacgccgaaggactggtgattcacaaagtaagcaagcgatgcacatataaataccagctaaagtgggctaaagtgctcatggtcactctggtgcttttgctgatcgcccaaaataccattctcatcgttgcagctggtacagattgctgggccaagaagtctctggacatggactgtataggcccaatgcttgatatcgggtcatgcaccaacaaaaatactagaaactacgacacggaggcgcagaagctggtgagtcagagcaaagtctcccagttggatgccgaccaagcatctctcctgggaaattcgattgatagcgctatcaaggccattagggctcagaaaacatatcccaccatgcatttactggaaactatctttctaatgaagaactgtgactactatacctccttcaatcacaactcaggctacagtcaggccaagtggcggctcatagcaaaaacaggtcattttgatatttgctctcgtcacagcacccatcacttctgtcgctgcatcaatgacgggactaagtgtcaaaacggcgattgggactttgccggagagatgaatgagacatataactccaaaaatgatttctactcacacgacctgaaccttttctatacgatttttgaaaacgctttccctggcaccactgagagcttgttttaccagctgatccagaagaaaaatacagcgggggcatctaagatactcggaaaactgatcaccaagtacggtaacaataacatgttcgtgggcgtatggaagtttgggcagtatttactgacacttccatacattaataacactgaattgtcccaaaatagaaggcagaccatcctcgccacgcaggagagtctgagccggtctcattccggacgacaggaatcaatgagtagcgctattcaaggctcggttaccaaagagtgccacaacgccaaggacgtgggttgtatctccccgcgcttcgggatacccattggcaatctaacagcatgcggagattctcctaactataaaatctacaagactccagagaaactgtataagagcaataacaagggcgaagtctggtgttcaaatgacgtgcattgcctcaacgattttgagcccgccgacgaagaggtcgtgaataaagttaagaaactgacctgcttccttacagatgtgagtgtaaagactgacatcttttccgtcgctgcctctacctgtaaaatggcagataaggggatttgcacggtgaacgacgcgaagtggaacatcattaaatgtgatagcggattgtactatttcacagaccacagagagggtcaggataccggcaatgactttggggaatactgcatatcccactcatgtaacactgagaggttccctatcaatccagatattctgaaggactgcacatgggaatttcatagccggaaaagtaagtacatctctaccatttccttagagagcctcgaagagttccgcagagctatgactgagaaactgtcgcacacccttacaatctataacttcaagcccacggccaatctgccgcatataaggcctacctacaagtttatcactgcaaacggagttgaaaattcagacggcattgagtctgcctatatcttgagttccattcccgctctcggtgggatcagcgtgggctacaacgtccagacaaaagataatttcccactgctagacataattgtgtttatcaagtctgccgtaatccgtaccacatataaccacatttacgatactggacctaccataggcatcaatacgcagcatgacgaacactgtacagggccctgcccagcagtggttccccacaaagagaactggattaccttcagccaagaacggacttcccgatggggatgtgaggagtttggctgcctggctatcaataccggttgtgtcttcgggtcatgccaggatattatccatcctgaaacaaaggtgtatagaaaagccgtggaggaagaggtcgttctcactgtgtgcataaactttccaggaaataactactgtaccgaaatcaacgcggtggagccgaagattacagacgagatcgaactgcagttcaaaacggtagataccaagactcttcccaatttgctggccgtccagaaccacaagttatacagtggccaaattaatgacctcggtagcttttctcagggctgcgggaacgtgcagaaaacaaatcattccatcctgggaatgggcaccgctaagttcgattatgtttgtcacggggcatcaaggaaagacgtgatagtccgccggtgctacaacaataactttgatagttgtagacttctgaaggaggaaactagcctaattttcgccgacaatcatgagacactcgaggtggctcacaccaaacacctgatcggagaattgcaattcaagatcatgctgggcgatattaggtataagtcctttgccgagtctcctgaattagagatcgacgcaaaatgcgttggttgtccatcgtgcttcgaaagctactcatgtaactttcagatagtgacgaatattgacactgtatgctccgtcgaggggccctgtaccctcttccataaccgcatcattatcagtgcgaataagcagtcttatggactgaaaatgagctgccagacaaagcctaaccaaaatgaggaatttataatttgcaaccgaaaatactccgtgcttttcaccactatcgataagaatgacaagatcgaggtgaacacaggcgatcagacctcatatatttacgaaaaagactctcggtgtaagacatggctgtgccgtgtcagagatgagggtatcagcgttttgtttgaaccactcaaagccttctttggcagttacttctccattatattttatgtggtagtggggatcattgtcctgttcctaatcatctacatttttctgcccatgttcttcaaacttaaggacgtgctcaagaggaacgagtatctgtacttgcaggagctgaagcacaaatga

SEQ ID NO: 10907 - RNA, 4305 nt, synthetic construct
  misc_feature 1..4305: note = derived and/or modified CDS sequence (opt3) from CVV(MPB1-1551)__KX100143.1__GP
  source 1..4305: mol_type = other RNA
atgctgttcctccttatcctggcctttttgggcttcagcacctccaaccccattgctacaagatgctttcacgggggacagttaatagcagagtctaagtcagccacgagtatcagcgaattttgtctgaaagacgatgtgtccatgctaaagtctgaggtcgtttacattaaaaatgacactggtctctttggccataacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagcgcaaattatctttcagacagataaattgaaccacttcgaggtcagtggcaccacgctctcctctggttggtttaagagcaaagcctccgtgactctggaccgcacctgtgagcatgttaaggtgacatgcgggaagaaatcactgcagttccacgcatgttttaagcatcacatgagttgcgtccgattctttcacaatactatactcccgggaaacatgattaccagcatgtgtcagaatatcgaattaattatcatcctgggccttacattggccattttcatactgatggtgatgctaaccaaaacgtacatctgctatctcctgatgcccattttcatgcctatcgcttacctttatggctgggcatacaacaagtcttgtaaaaagtgcaattgctgtgggctggcctatcatccatttactaactgcggatcccactgtgtatgcggtttgaaattcgaggcttcagatcgtatgagaatacatagggaaagcggcctctgtcaagggtacaagagtctgcggattgcccgcttactgtgcaagtctaaaggatccagcctcgttatctcgggccttctgtctatgttgatcctatcctttgtgacacccattgagggtaccatcacttcataccctgagagtagaaagtatacactggaagagattaccgacgtcgtggaagggctcgtgagcgagcagaatataaaagaatacatcgtcttctatacgtccctgtttggatctcttattctgttgctcgcgttcatcatgagcatcaccctgtcaaagattacaagtatattagcaaaaaggaacgttatctactgtgaggagtgctccatgtatcacagcaagcggggcattaagtacaatggcgattttactaacaaatgtgggttctgcacctgtaacgaacaggaggacacagaaggactggtgatccacaaggtatctaaacgctgcacttataagtaccagctaaaatgggccaaggtgctcatgattaccctggtccttttgctgatcgctcaaaatacaatactcatcgtggccgcagagaccgattgctggactaagaaatcactggacattgactgtatcggtccaatgcttgatattggcagttgcacgaacaagaatacacgaagctacgacgctgaagcccagaaactggtttcccagtctaagatctcgcagttggatgcggaccaagccagcctcctggggaactccatagattcagcaattaaagctatcagagcccagaagacctatcccactatgcatttactggagaccatttttctaatgaagaattgtgactactatacaagtttcaaccacaattctggatacagccaggctaaatggaggctcatcgccaagaccggccattttgatatatgctcccggcactcaactcatcacttctgtcgttgcatcaacgacggtacaaaatgtcaaaatggggattgggactttgcaggcgagatgaacgaaacgtataatagcaagaacgatttctactctcacgacctgaatcttttctataccatttttgagaacgccttccctggaactacagaatccttgttttaccagctgatccagaaaaagaataccacaggcgctagtaaagtgctcgggaagctgattactaagtacggaaacaacaatatgttcgtcggtgtgtggaaatttggccagtatttactgacccttccatacatcaacaatacggagttgagccaaaaccgcagactcaccatactggcgacacaggaaattctatctaggtcccattcagggcggcaggagagtatgagcaatgcaatccagggatcgatcactaaggagtgccacaacgccaaaggcgtaggttgtatttccccgcgattcgggatccccattggcaatctgaccgcttgcggagactctcctaactataagatatacaaaacaccagaaaagctctataagagcaataacaaaggcgaggtttggtgttcaaatgatgtgcattgcctgaacgactttgaacccgccgatgaggaggtcatcaataagattaaaaagctgacttgcttcttgaccgacgtgagtgtcgaagtggatatcttttccgttgcagcctctacgtgtaaaatggctgacaagggggtgtgcacagtaaacggagccaagtggaatattatcaaatgtgatagcggtctgtactatttcaccgaccaccgcgagggccaagatactgggaacgactttggagaatactgcatatcccactcatgtaacacagagagattccctatcaatccagataccttaaaggactgcacttgggaatttcatagcaggaaaagtaagtacatttctaccatctccctcgagagcctggaggagttccggcgcgcaatggcggaaaaactttcgcacacactgacgatttataacttcaagcccaccgctaatttgccgcatatcagacctacttacaagtttataacagccaacggcgtcgaaaattcagatggtattgagtctgcatatatcctcagttccatccccgcccttgggggcattagcgtgggatacaacgttcagaccaaagacaatttcccactactggacataatcgtgtttattaagtctgctgtcatcaggacaacttataaccacatttacgataccggccctacgatcgggataaatacacagcatgacgaacactgtaccggaccctgcccagccgtggtaccccacaaagagaactggatgactttcagccaggagcgtacctcccggtggggctgtgaagagtttggttgcctcgcaatcaatacagggtgtgtgttcggatcatgccaagatattatccatcctgaaactaaggtttatcgaaaagctgtcgaggaagaggtggtgctgaccgtctgcattaactttccaggcaatagttactgtacagagatcaacgccatagaaccgaagattacggacgagatcgaacttcagttcaaaaccgttgatactaagacattgcccaatctgttagcggtgcagaaccacaagctctacagcggtcagatcaacgacctgggctctttttcccaagggtgcggaaatgtgcagaaaaccaaccattcaattcttggcatggggactgtaaagttcgattatgtctgtcacggagccagtagaaaagacgtgatcgttaggcgctgctacaataacaattttgatagctgtaagctgctaaaagaggagacatccctcatattcgctgacaaccatgaaaccctggaggtggcacacacgaagcacttgattggcgaactgcagttcaagatcatgttaggtgatattcggtataaatcttttgccgagtcgcctgaactcgagatcgacgctaagtgcgtcgggtgtccaagctgcttcgagtcatactcctgtaattttcaaatagtgactaacattgataccgtttgcagtgtggaaggaccctgtacactgttccataatagaatcatcatttctgccaacaaacagagctatggccttaagatgtcctgccagaccaaacctaatcagaacgaggaatttatcatttgcaataggaagtactcagtactgttcactacaatagacaagaacgacaaaatcgaggtcaataccggtgatcaaacatcttatatttacgaaaaggacagccgctgtaaaacttggttgtgccgagtgcgggatgagggcatcagtgtgctctttgagccactgaaggcattctttgggtcctacttcagcatcattttctatgtcgttgtgggaataatcgtactattcctgattatctacatttttcttcccatgttcttcaaactcaaggacgtgctgaagcgtaacgaatatttgtacctgcaggagttaaaacacaagtga

SEQ ID NO: 10908 - RNA, 4305 nt, synthetic construct
  misc_feature 1..4305: note = derived and/or modified CDS sequence (opt3) from CVV(W308-67)__KX100140.1__GP
  source 1..4305: mol_type = other RNA
atgctgttcctccttatcctggcctttttgggcttcagcacctccaaccccattgctacaagatgctttcacgggggacagttaatagcagagtctaagtcagccacgagtatcagcgaattttgtctgaaagacgatgtgtccatgctaaagtctgaggtcgtttacattaaaaatgacactggtctctttggccataacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagcgcaaattatctttcagacagataaattgaaccacttcgaggtcagtggcaccacgctctcctctggttggtttaagagcaaagcctccgtgactctggaccgcacctgtgagcatgttaaggtgacatgcgggaagaaatcactgcagttccacgcatgttttaagcatcacatgagttgcgtccgattctttcacaatactatactcccgggaaacatgattaccagcatgtgtcagaatatcgaattaattatcatcctgggccttacattggccattttcatactgatggtgaccctaacgaaaacttacatctgctatctcctgatgcccattttcatgcctatcgcttacctttatggctgggcatacaacaagtcttgtaaaaagtgcaattgctgtgggctggcctatcatccatttacaaactgcggatcccactgtgtatgcggtttgaaattcgaggcttcagatcgtatgagaatacatagggaaagcggcctctgtcaagggtacaagagtctgcggattgcccgcttactgtgcaagtctaaaggatccagcctcgttatctcgggccttctgtctatgttgatcctatcctttgtgacccccattgagggtactatcacatcataccctgagagtagaaagtataccctggaagagattacggacgtcgtggaagggctcgtgagcgagcagaatataaaagaatacatcgtcttctatacctccctgtttggatctcttattctgttgctcgcgttcatcatgagcatcacactgtcaaagattaccagtatattagcaaaaaggaacgttatctactgtgaggagtgctccatgtatcacagcaagcggggcattaagtacaatggcgattttactaacaaatgtgggttctgcacatgtaacgaacaggaggacactgaaggactggtgatccacaaggtatctaaacgctgcacctataagtaccagctaaaatgggccaaggtgctcatgattacactggtccttttgctgatcgctcaaaataccatactcatcgtggccgcagagactgattgctggacgaagaaatcactggacattgactgtatcggtccaatgcttgatattggcagttgcacaaacaagaatacccgaagctacgacgctgaagcccagaaactggtttcccagtctaagatctcgcagttggatgcggaccaagccagcctcctggggaactccatagattcagcaattaaagctatcagagcccagaagacttatcccaccatgcatttactggagacaatttttctaatgaagaattgtgactactataccagtttcaaccacaattctggatacagccaggctaaatggaggctcatcgccaagactggccattttgatatatgctcccggcactcaacacatcacttctgtcgttgcatcaacgacgagacgaaatgtcaaaatggtgattgggactttgcaggggaaatgaacgagacctataagagcaaaaatgatttctactctcacgacctgaaccttttctatactatttttgaaaatgccttccctggcacaaccgagtccttgttttaccagctgatccagaagaaaaacacaactggagctagtaaggtgctcggcaagctgattaccaaatacgggaataacaacatgttcgtcggagtgtggaagtttggtcagtatttactgacgcttccatacatcaataacaccgaattgagccaaaatcgcagactcacaatactggcgactcaggagattctatctaggtcctattcaggccggcaggagagtatgagcaacgcaatccaggggtcgatcaccaaagaatgccataatgccaagggagtaggctgtatttccccgcgattcggtatccccattgggaacctgacagcttgcggcgactctcctaattacaaaatatataagactccagagaagctctacaaaagcaacaataagggagaagtttggtgttcaaacgatgtgcactgcctgaatgactttgagcccgccgatgaggaagtcatcaacaaaattaagaaacttacctgcttcttgacggacgtgagtgtcgaggtggatatcttttccgttgcagcctctacatgtaagatggctgacaagggcgtgtgcaccgtaaatggggccaaatggaacattatcaagtgtgatagcggactgtattacttcactgaccatcgcgaaggtcaagatacaggcaatgactttggggagtactgcatatcccactcatgtaacaccgaaagattccctatcaacccagatactttaaaagactgcacctgggagtttcacagcaggaagagtaaatatatttctacaatctccctcgagagcctggaagagttccggcgcgcaatggcggaaaaactttcgcatacgctgaccatttacaatttcaagcccactgctaacttgccgcacatcagacctacatataagtttataaccgccaatggagtcgagaactcagatggcattgaatctgcatacatcctcagttccatccccgccctgggtgggattagcgtgggctataatgttcagacaaaggacaacttcccactactggacataatcgtgtttattaaatctgctgtcatcaggactacctacaatcatatttatgatacgggacctacaatcggcataaacacccagcacgacgagcattgtactgggccctgcccagccgtggtaccccacaaggagaattggatgaccttcagccaggaacgtacatcccggtggggatgtgaggaatttggctgcctcgcaatcaacactggttgtgtgttcgggtcatgccaagatattatccaccctgagaccaaagtttaccgaaaggctgtcgaagaggaggtggtgctgacagtctgcattaattttccaggaaacaattactgtacggaaatcaacgccatagagccgaaaattaccgacgaaatcgagcttcagttcaagactgttgatacaaagaccttgcccaatctgttagcggtgcagaaccataaactctatagtggccagatcaacgacctgggtagcttttctcaaggctgcgggaatgtgcagaagactaaccactccattcttggaatgggcacagtaaaattcgattacgtctgtcatggggcctcaagaaaggacgtgatcgttaggcgctgctataataacaattttgatagttgtaaactgctaaaggaggaaaccagcctcatattcgctgacaaccacgagacgctggaagtggcacatactaagcacttgattggagagctgcagttcaaaatcatgttaggcgatattcggtacaagtcctttgccgaatctcctgagctcgagatcgacgctaaatgcgtcggttgtccatcgtgcttcgaaagctattcatgttactttcaaatagtgaccaatattgatacagtttgctccgtggaggggccctgtaccctgttccacaacagaatcatcattagtgccaataagcagtcttatggacttaaaatgagctgccagactaagcctaaccagaatgaagagtttatcatttgcaacaggaagtactccgtactgttcacaaccatagacaaaaatgacaagatcgaagtcaacacaggcgatcaaacttcatacatttatgagaaagactctcgctgtaagacctggttgtgccgagtgcgggatgagggtatcagcgtgctctttgaaccactgaaagcattctttggcagttacttctccatcattttctatgtcgttgtggggataatcgtactattcctgattatctacatttttcttcccatgttcttcaagctcaaggacgtgctgaaacgtaatgagtatttgtacctgcaggaattaaagcataaatga

SEQ ID NO: 10909 - RNA, 4305 nt, synthetic construct
  misc_feature 1..4305: note = derived and/or modified CDS sequence (opt3) from CVV(W728-67)__KX100137.1__GP
  source 1..4305: mol_type = other RNA
atgctgttcctccttatcctggcctttttgggcttcagcacctccaaccccattgctacaagatgctttcacgggggacagttaatagcagagtctaagtcagccacgagtatcagcgagttctgtctgaaagacgatgtgtccatgctaaagtctgaagtcgtttacattaaaaatgacactggtctctttggccataacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagcgcaaattatctttcagacagataaattgaaccacttcgaggtcagtggcaccacgctctcctctggttggtttaagagcaaagcctccgtgactctggaccgcacctgtgagcatgttaaggtgacatgcgggaagaaatcactgcagttccacgcatgttttaagcatcacatgagttgcgtccgattctttcacaatactatactcccgggaaacatgattaccagcatgtgtcagaatatcgaattaattatcatcctgggccttacattggccattttcatactgatggtgatgctaaccaaaacgtacatctgctatctcctgatgcccattttcatgcctatcgcttacctttatggctgggcatacaacaagtcttgtaaaaagtgcaattgctgtgggctggcctatcatccatttactaactgcggatcccactgtgtatgcggtttgaaattcgaggcttcagatcgtatgagaatacatagggaaagcggcctctgtcaagggtacaagagtctgcggattgcccgcttactgtgcaagtctaaaggatccagcctcgttatctcgggccttctgtctatgttgatcctatcctttgtgacacccattgagggtaccatcacttcataccctgagagtagaaagtatacactggaagagattaccgacgtcgtggaagggctcgtgagcgagcagaatataaaagaatacatcgtcttctatacgtccctgtttggatctcttattctgttgctcgcgttcatcatgagcatcaccctgtcaaagattacaagtatattagcaaaaaggaacgttatctactgtgaggagtgctccatgtatcacagcaagcggggcattaagtacaatggcgattttactaacaaatgtgggttctgcacctgtaacgaacaggaggacacagaaggactggtgatccacaaggtatctaaacgctgcacttataagtaccagctaaaatgggccaaggtgctcatgattaccctggtccttttgctgatcgctcaaaatacaatactcatcgtggccgcagagaccgattgctggactaagaaatcactggacattgactgtatcggtccaatgcttgatattggcagttgcacgaacaagaatacacgaagctacgacgctgaagcccagaaactggtttcccagtctaagatctcgcagttggatgcggaccaagccagcctcctggggaactccatagattcagcaattaaagctatcagagcccagaagacctatcccactatgcatttactggagaccatttttctaatgaagaattgtgactactatacaagtttcaaccacaattctggatacagccaggctaaatggaggctcatcgccaagaccggccattttgatatatgctcccggcactcaactcatcacttctgtcgttgcatcaacgacggtacaaaatgtcaaaatggggattgggactttgcaggcgagatgaacgaaacgtataatagcaagaacgatttctactctcacgacctgaatcttttctataccatttttgagaacgccttccctggaactacagaatccttgttttaccagctgatccagaaaaagaataccacaggcgctagtaaaattctcgggaagctgatcactaagtacggaaacaacaatatggtggtcggtgtgtggaaattcggccagtatttactgacccttccatacataaacaatacggagttgagccaaaaccgcagactcaccattctggcgacacaggaactactgtctaggtcccattcagggcggcaggagagtatgagcaatgcaatccagggatcgatcactaaggagtgccacaacgccaaaggcgtaggttgtatttccccgcgatttgggatccccattggcaatctcaccgcttgcggagactctcctaactataagatatacaaaacaccagaaaagctgtataagagcaataacaaaggcgaggtttggtgttcaaatgatgtgcattgccttaacgacttcgaacccgccgatgaggaggtcgtgaataagatcaaaaagttgacttgctttctgaccgacgtcagtgtggaagttgatattttctccgtggcagcctctacgtgtaaaatggctgacaagggggtatgcacagtcaacggagccaagtggaatatcattaaatgtgatagcggtttatactattttaccgaccaccgcgagggccaagatactgggaacgacttcggagaatactgcatctcccactcatgtaacacagagagatttcctataaatccagataccctcaaggactgcacttgggagttccatagcaggaaaagtaagtacatctctaccatttccctggaaagccttgaggaatttcggcgcgcaatggcggagaaactgtcgcacacattgacgatctataacttcaagcccaccgctaatctcccgcatattagacctacttacaagttcatcacagccaacggcgtggaaaattcagatggtatagagtctgcatatattctgagttccatccccgccctagggggcatcagcgttggatacaacgtgcagaccaaagacaattttccactgctcgacattatagtcttcatcaagtctgctgtgattaggacaacttataaccacatctacgataccggccctacgattgggatcaatacacagcatgacgaacactgtaccggaccctgcccagccgtagtgccccacaaagagaactggatgacttttagccaggagcgtacctcccggtggggctgtgaagagttcggttgcctggcaataaatacagggtgtgtttttggatcatgccaagatatcattcatcctgaaactaaggtctatcgaaaagctgtggaggaagaggtggtccttaccgtttgcatcaacttcccaggcaataactactgtacagagattaatgccatcgaaccgaagataacggacgagattgaattgcagtttaaaaccgtggatactaagacactgcccaacttactcgcggtgcagaaccacaagctgtacagtggtcagatcaatgaccttggcagcttctctcaagggtgcggaaacgtacagaaaaccaatcattccatcctgggcatggggactgtcaagtttgattatgtgtgtcacggagcctcaagaaaagacgttattgtgaggcgctgctacaacaataacttcgatagttgtaagctactcaaagaggagacaagcctgatctttgctgacaatcatgaaaccttggaggtcgcacacacgaagcacctgataggcgaattacagttcaagattatgctcggtgatatccggtataaatccttcgccgagtctcctgaactggagattgacgctaagtgcgtggggtgtccatcgtgctttgagagctactcatgtaacttccaaatcgttactaatatagataccgtgtgctccgtagaaggaccctgtacactttttcataacagaattatcatcagtgccaataaacagtcttatggcctgaagatgagctgccagaccaaacctaaccagaatgaggagttcattatctgcaacaggaagtactccgtcttgtttactacaattgacaagaatgacaaaatagaagtgaacaccggtgatcaaacatcatatatctacgaaaaggactctcgctgtaaaacttggctctgccgagtgcgggatgagggcattagcgtcctgttcgagccactaaaggcatttttcgggagttacttttccatcatcttctatgttgtggtaggaattatagtgctgtttcttatcatttacatcttcctccccatgtttttcaaactgaaggacgtcttgaagcgtaatgaatatctgtacttacaggagctcaaacacaagtga

SEQ ID NO: 10910 - RNA, 4305 nt, synthetic construct
  misc_feature 1..4305: note = derived and/or modified CDS sequence (opt3) from CVV(WI-03BS7669)__KX100152.1__GP
  source 1..4305: mol_type = other RNA
atgctgttcctccttatcctggcctttttgggcttcagcacctccaaccccattgctacaagatgctttcacgggggacagttaatagcagagtctaagtcagccacgagtatcagcgagttctgtctgaaagacgatgtgtccatgctaaagtctgaagtcgtttacattaaaaatgacactggtctctttggccataacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagcgcaaattatctttcagacagataaattgaaccacttcgaggtcagtggcaccacgctctcctctggttggtttaagagcaaagcctccgtgactctggaccgcacctgtgagcatgttaaggtgacatgcgggaagaaatcactgcagttccacgcatgttttaagcatcacatgagttgcgtccgattctttcacaatactatactcccgggaaacatgattaccagcatgtgtcagaatatcgaattaattatcatcctgggccttacattggccattttcatactgatggtgatcctaaccaaaacgtacatttgctatctcctgatgcccatcttcatgcctatagcttacctttatggctgggcatacaacaagtcttgtaaaaagtgcaattgctgtgggctggcctatcatccatttactaactgcggatcccactgtgtatgcggtttgaaattcgaggcttcagatcgtatgaggattcatagagaaagcggcctctgtcaagggtacaagagtctgcggatcgcccgcttactgtgcaagtctaaaggatccagcctcgttatctcgggccttctgtctatgttgattctatcctttgtgacacccatcgagggtaccattacttcataccctgagagtagaaagtatacactggaagagataaccgacgtcgtggaagggctcgtgagcgagcagaatatcaaagaatacattgtcttctatacgtccctgtttggatctcttatcctgttgctcgcgttcatcatgagcattaccctgtcaaagataacaagtatcttagcaaaaaggaacgttatttactgtgaggagtgctccatgtatcacagcaagcggggcatcaagtacaatggcgattttactaacaaatgtgggttctgcacctgtaacgaacaggaggacacagaaggactggtgattcacaaggtatctaaacgctgcacttataagtaccagctaaaatgggccaaggtgctcatgatcaccctggtccttttgctgatagctcaaaatacaatcctcattgtggccgcagagaccgattgctggatcaagaaatcactggacattgactgtatcggtccaatgcttgatataggcagttgcactaacaagaatacgcgaagctacgacacagaagctcagaaactggtttcccagtctaagatttcgcagttggatgccgaccaagtgagcctcctggggaactccatcgattcagcgattaaagccatcagagcacagaagacctatagtactatgcatttactggagaccatatttctaatgaagaattgtgactactatacatctttcaaccacaatagcggatactcccaggctaaatggaggctcatcgccaagaccggccattttgatatttgctcacggcacagcactcatcacttctgtcgttgcatcaacgacggtacaaaatgtcaaaatggggattgggactttgctggcgagatgaacgaaacgtataattctaagaacgatttctactcccacgacctgaatcttttctataccatttttgagaacgccttccccggaactacagaaagtttgttttaccagctgatccagaaaaagaataccacaggcgcaagcaaagtcctcgggaagctgataactaagtacggaaacaacaatatgttcgtgggtgtatggaaatttggccagtatttactgacccttccttacattaacaatacggagttgtctcaaaaccgcagactcaccatcctgacaactcaggaactactgtccaggtcacatagtgggcggcaggagagcatgtcgaatgccatccagggatccattaccaaggagtgccacaacgctaaaggcgttggttgtatctctccacgattcgggattccgataggcaatctcacagcgtgcggagacagccccaactataagatctacaaaactcctgaaaagctgtataagtcaaataacaaaggcgaggtgtggtgtagtaatgatgtccattgccttaacgactttgaaccagcagatgaggaggtggtcaataagattaaaaagttgacctgcttcctgacggacgtgtccgttgaagtggatatcttttctgtagccgctagcacatgtaaaatggccgacaagggggtctgcaccgtgaacggagcaaagtggaatattatcaaatgtgattccggtttatactatttcactgaccaccgcgagggccaagatacagggaacgactttggagaatactgcatatcacacagctgtaacaccgagagattccccatcaatcctgatattctcaaggactgcacttgggaatttcatagtaggaaatctaagtacatctccaccattagcctggagtcgcttgaggagttccggcgcgccatggctgaaaaactgtcacacacattgacgatctataacttcaagccaaccgccaatctcccccatataagaccgacttacaagtttattacagcaaacggcgttgaaaattctgatggtatcgagagtgcgtatatcctgtccagcattcctgctctagggggcatatctgtgggatacaacgtccagaccaaagacaatttccccctgctcgacatcattgtgtttatcaagagcgccgtaattaggacaacttataaccacatctacgataccggcccaacgatagggatcaatacacagcatgacgaacactgtaccggaccttgccccgcagtggttccacacaaagagaactggatgactttctcccaggagcgtacctcacggtggggctgtgaagagtttggttgcctggccattaatacagggtgtgtcttcggaagttgccaagatatcattcatcccgaaactaaggtgtatcgaaaagctgtggaggaagaggtcgttcttaccgtgtgcatcaactttcctggcaataactactgtacagagataaatgccattgaaccaaagatcacggacgagatcgaattgcagttcaaaaccgtggatactaagacactgccgaacttactcgcagtacagaaccacaagctgtacagcggtcagattaatgaccttggctctttttcccaagggtgcggaaacgtccagaaaaccaatcattcaatcctgggcatggggactgtgaagttcgattatgtttgtcacggagctagtagaaaagacgtgatagtcaggcgctgctacaacaataactttgatagctgtaagctactcaaagaggagacatccctgattttcgccgacaatcatgaaaccttggaggtggcgcacacgaagcacctgatcggcgaattacagttcaagattatgctcggtgatatccggtataaatcttttgccgagtcgcccgaactggagatagacgctaagtgcgttgggtgtcctagctgcttcgagtcatactcctgtaactttcaaattgtgactaatatcgataccgtatgcagtgtcgaaggaccatgtacacttttccataacagaatcattatctctgcaaataaacagagctatggcctgaagatgtcctgccagaccaaacccaaccagaatgaggaatttattatatgcaacaggaagtactcagtgttgttcactacaatcgacaagaatgacaaaattgaggtgaacaccggtgatcaaacatcttatatctacgaaaaggacagccgctgtaaaacttggctctgccgagtccgggatgagggcatcagtgttctgtttgagcctctaaaggccttctttgggtcctacttcagcattatattttatgtggtagtgggaatcattgtcctgttccttatcatttacatctttctcccaatgttcttcaaactgaaggacgtgttgaagcgtaatgaatatctgtacttacaggagctcaaacacaagtga

SEQ ID NO: 10911 - RNA, 4317 nt, synthetic construct
  misc_feature 1..4317: note = derived and/or modified CDS sequence (opt3) from CHLV(CHLV-Mex07)__JN808310.1__GP
  source 1..4317: mol_type = other RNA
atggagcccagcatcaagctgttcctcattcttgccatagctgcagccgcggtgcactccctgcctgcttctagatgcttttcagaaggcatcgtcattaaagagaagcaggacagtaaagccgttagcgagttctgtttgaaggatgacgtgtccatgatcaaatctcatgtagtgtactcgaagaacgaatcagggatttttgcaaatagccaaatcttaaggaagtggataatcaaagattggaagctgtgcagtccactaccgaccgccggaggtcagattaacgtcatcgaaattaatcacgacctcacactgtccactaaaacgtatgtgtgtaccacagattgcactatcggcatagacaaggagaacgctcagattaccttccagacaaataaacttaactactttgaggtttctgggaccactatcagctccggatggttcaagtcaaagacaagtgtgagcctggatcaaacctgtgaacatttgaaagtctcttgcggcaagaaatccatgcagtttcacgcatgtttcaagcagcatatgtcatgcattcggtatctccaccgcacggccctgcccggttacatggctgccagcatctgtagtaatatcgagctgattataatgactaccctcacattagcgatctttattctgctttgcatcataactaaaacctatatttgttacttgctgatgcctctattcatgccaatcgcatatatctacgggtggctctacaacaagtcttgcaaaaagtgcaattgttgcggactgtcctatcacccctttacaaactgtggcagctactgcgtgtgtggcgccaagttcgaaacctcggaccgaatgcgtattcatagagagtctgggctttgccagggatataaatccctgagggtagctcggaagttgtgtaaatcaaagggtagtagcctcgttatctccattacgctgtctgtgtttatattcagcttcatcactcctattggcggggccatcatcaatgataaattatcagaggaaaagtacagtattaaccaaatgatggacgcaatagtcgatctggagaatttttcccacaacgtgagcggaacacaacaggtgatctctgtcattttcctccttatctcatgcctgtttttgctactgacctatcatctcaataagattatccagcacctggctcgcttcggccttctgttttgtgaagagtgcagtatgtaccacagcaaaaaggacataaaatataacggtgatttcactaacaagtgtgggttttgcacatgcggacaaccagaagaccccgagggcttgaatctccatatcctgtcccagaactgtacctacaaacagcaattcaagtgggttaagattatcatttctatcttactgtcgctaataattatcgagaatagcatgattctcgccgcggccgaaacggactgcttttccgagaaacagatctcagagttctgtctgggccctcttttgagtatatctagctgcgaagataagaactccagaacctttaaaggggaagcacagaagctggtggctctcaaaaagatcacatcagacgaggccatgctgattgagagcatgggagctaatgtagaaggtgcccttgagatgatccaggcacaaaagtctccagattccatgtacactatggaatatgtgttcctgaacacctactgtgactattacagtttgtttgagcacaatagcggctattctcaggtcaaatggaggtacattctcaagacacatcagttcgatgcctgcgctcggcactccaactcacatttctgtcgctgcatgagtgacgggatgcactgtccgagctcggattgggacatcgcggatgaactggacaatacttatataaccaaacccaactttttcaagcacgattacaatttactgctagacgtgattacagcagcctttcctggaaccggcgctgttttcgtgatcgacgcctgcaaaaaggcaaacgccactgctatcaaaacgttttccaataacattatcgcccgattcccatacaataacctcctgaagggtgtcatgaagtttcttcagtatatttctaaacatcccagcttcaagaaataccaacctgatacaagacactatgacttgataccagtggcacccaccgcgagggggcggtcactgggccgtagtaactcctacaataacgctcagatcggatctccgactaaggattgtcagatgctcaaagaggtaggctgcctgagccctaagtttgggttacccctggagtccattatctcatgcggaagcagtccaaattataagttatacaaaaagcctcagaaatattacaagtctaacaataaagaaaacacctggtgttccaaggacgttcattgcttgcacgatttcgagcccattacagaagacgtgctcgagaaggtcaaagtgatgacctgttgggagatcgaaccaggtactatagaggatatctttacaattgccagcgaaacgtgcaagatcaatgaccgcggcgtctgtgaggtgaacgcagccaaatggaagattgttaaatgcgaaaccgggctgtactattacactgatcacagagagggagacgatacaggctcggacctaggtcattattgtctgacccacaagtgcgctgggggcaggtaccccatcaatcctgagatactccaaaactgtgtgtgggagttccattcacagaagtctcagtatattaatcaggtagatctggaacaaatcgaagagtacaaaaaggcccttacagaaaaattgactcacaccctgaaccattataattttcttccaacgaagaacctcccgcacatcagtcccaattacaaatacgtcaccctgaacggacaggagacatccgacggcattgagaacagctatatagtgtctgaaatccctgcaattgctgggactagcatcggacttaaggttcagaccaaaacaaatgacgatattttcgacctgatcatatacgtgaagcgggccgatatcattgcgtcctataaccacatctacgacactggtccaaccattggccataatgtcgagcacgaagagttgtgcacggggcaatgtccccagcatatccctgccaaggctaactggctcacattctcacaggaacgaaccagtcgctggggatgcgaggagtttggctgcctggcaataaatactggttgtgtgtatgggagctgccaggatattatcaaaccagtagccaaggtgtacagaaaatctacagaagagaaggttgaactagagctgtgtatcgtcctccccgacaaaaacttctgcaccactctgaatgctcttgagccgaagattaccgaagagatcgaattgcaatttaagacaatagatcagatgtccctgcctaacattgtgttactcagggaccacaaactgttcaagggccagatcaatgatcttggaacgtttggccagaactgtgggaatgtgcaaaagaccaaccagtcaattctgggagccggcactgtccggttcgactatctatgccatagtgcaagccgcaaggatatcataattagaaggtgttacaataacaattacgactcctgcaaccacctccagctggcggagtctttgatctttctggataaccacgaaacattagaggttcgtaaaccaaatcatatcctcggtaccctgtcgatgaaacttatgctgggggacttccagtataagacatttgccaaagacattgagttggatttcactggacggtgtgtgggctgcatcggttgttttgaaggcttcgtgtgcgagatgcacattaccacgacagtagaagctacctgcaacctcgaggccagctgtcaattctttcataatcagctgcacataaagcccgacgtcctaaaatactatactaagatgacctgccagacagatgaatacatcccttcaaaaattaagatctgtaacaaggagtataaaatcactgtggggaaggttcagaaaaatgacaagattgagatagataactccgaccagaccagttacatcaaagaaaaggatgagcgatgcaagacatggctgtgtagagtgagggacgaaggaatttctgtcatcttcgagccccttctcaatatttttggcaactatgggcgcatcgcagtggctgttataagcgccatcctggcattgattatcctggtgtacattttaatgccaatctgcatgcggataagagatattctcaaaacgaatgaaagggagttcctgatcgagtccaagtacaaatga

SEQ ID NO: 10912 - RNA, 4305 nt, synthetic construct
  misc_feature 1..4305: note = derived and/or modified CDS sequence (opt3) from FSV(86MSP18)__KX100131.1__GP
  source 1..4305: mol_type = other RNA
atgctgagcctccttatcctggccttgttaggcctgtccacctctaaccccattgctacaagatgcttccacgggggacagctaatagcagagtcaaagagtgccactagcatctccgaattttgtctcaaagacgatgtgtctatgctgaagtcggaggtcatttacacgaaaaatgacaccggtcttttcggccataacaaggtttttaggtcatggacaatcaaagattggaagctgtgcaatcctattccaactgctgggggaaccatcaacgtgatagaagtaaataaggacttgagcctcatgacaaaaacctatatctgtagtcgggattgcactattacaatcgacaaggaggaagctcaaattatcttccagaccgataaactgaaccactttgaggtgtccggcacgactctgtctagcggttggttcaagtccaaagcctcagtcaccctcgaccgcacatgtgagcatgtgaaggttacttgcgggaagaaaagtttacagtttcacgcatgtttcaagcatcacatgagctgcgtgcgatttttccacaataccatactgccgggaaacatgattacatctatgtgtcagaatatcgaacttattatcatcttgggcctgaccctagccatttttatactcatggtcatgatcacgaaaacttacatttgctatctgcttatgcccatcttcatgcctatagcttacctgtatggctgggcatacaacaagtcctgtaaaaagtgcaattgctgtgggttggcctatcatccatttacaaactgcggatcacactgtgtgtgcggtctcaaattcgaggctagcgatcgtatgaggattcatagagaaagtggcctgtgtcaagggtacaagtctttacggatcgcccgcctgctctgcaagtccaaaggaagctcgcttgtaatctctggcctgttgtccatgctaattctgtcattcgttacccccatcgagggtactattacaaattaccctgacagtagaaagtataccctcgaggaaataacggatgtggtcgaggggctgatcagcgaacagaacattaaagagtacatcgtgttttatacctcccttttcggatctctgatcttgctcctggcgtttattatgagcataacattatcaaagatcaccagtattctggcaaggcggaatgtgatctactgtgaagagtgctccatgtatcacagcaaacgcggcattaagtacaacggcgacttcactaacaagtgtgggttttgcacatgtaatgagcaggaagatgccgagggagtcgttatccacaaagtgtctaagcgatgcacttataaataccagctaaagtgggctaaagtactcatgataaccctggtgcttttgctgatcgcccaaaacacaattctcatcgtcgcagctgaaaccgactgctgggccaagaagtcactggacattaattgtatcggtccaatgcttaacataggcagttgcactaataaaaacacgagaagctacgatacagaggcgcagaagctggtgtcccagtctaaagtttcgcagttggacgccgatcaagcaagcctcctggggtcctcaattgacagtgctatcaaggccattagggctcagaaaacctatcccgccatgcatttactggaaactatcttcctaatgaagaattgtgattactatacctcttttaaccacaatagcggatactcccaggcaaagtggcggctcatagccaaaacaggccatttcgacatctgctcacgtcacagcacccatcacttttgtcgctgcattaacgatggtactaagtgtcaaaatggggactgggatttcgctggcgagatgaacgagacatataattctaaaaacgacttttacctgcacgatcttaatttgttctatacgatctttgaaaacgcgttccctggaaccactgagtccctgttctaccagctcattcagaagagaaacacaatcggcgcaagtaaagtgctggggaagttaataaccaaatacggagacaataacatgtttgtcggtgtgtggaagttcggccagtatctgcttacattgccatacattaataacactgaactcagccaaaataggcggcagaccatcctggccgctcaggagctatcttcccgatcacatccggggcgccaggaaagtatgagctcggccatccaaggatccgtaacgaaggagtgccacaacgcaaaagacgttggctgtatttctcccagatttggtatccctattgggaatctgaccgcctgcggcgatagcccaaactataagatatacaaaacacccgagaagctctataaatcaaataacaagggagaagtgtggtgtagtaatgacgtccattgcctgaacgatttcgagcctgctgacgaagaggtggtcaataaggtgaaaaagctcacttgctttttgaccgatgtttccgtgaaaacagacatcttctctgtagccgcaagcacttgtaagatggcggataaaggcgtctgcaccgtgaacgacgctaagtggaatattatcaagtgtgattccgggctgtactattttacggaccacagggagggacaggatacaggtaacgacttcggcgaatactgcatttcacacagctgtaacaccgagcggtttccaatcaatcccgatatattaaaagactgcacttgggagttccatagtcgcaagtctaaatacatctccacaattagcctcgaatcgctggaagagtttagaagggccatgaccgagaaactttcacacactctgaccatctataacttcaagccgacagcaaatttgcctcatattcgtcccacgtacaagtttatcaccgccaacggggttgaaaattctgacggaatagagagtgcttatattctctccagcatcccagccctgggcggtatctctgtggggtacaacgtccagactaaggataatttccctctactggacattatagtgttcgtaaaaagcgcagtgatccggacaacctataaccacatttacgatacaggccccactatcggaattaatacccagcatgacgaacactgtacgggcccatgccccgctgttgtccctcacaaggagaactggatcacattttcccaagaacgaacctcaagatgggggtgtgaggagttcggatgcctcgccataaatactggctgtgtgtttggtagttgccaggatatcattcatccagaaaccaaagtgtataggaaggcggtcgaggaagaggttgtgctgacagtgtgcatcaacttcccggggaataactactgtactgaaattaatgccatcgagcccaaaataaccgacgagattgaacttcagtttaagacagtagatacgaaaaccttgcctaacctgttagctgtccagaaccacaagctctacagcggacaaatcaatgacctgggctctttctcccagggttgcggcaacgtgcagaagactaatcattcaatccttgggatgggaacagcaaaatttgattatgtttgtcacggcgccagtcgcaaggacgtgattgtccggagatgctacaacaataacttcgatagctgtaaactgctaaaggaggaaacctccctcgtgtttgctgacaatcatgagactctggaggttgcccacacaaaacacttgatcggggaactgcaattcaagataatgttaggagatattaggtataagtcttttgcagagtcgccagaactcgagatcgacgcgaaatgcgtgggctgtcccagctgcttcgaatcatactcctgtaacttccagattgtaaccaatatcgacacggtctgcagtgtggagggtccttgtactctgtttcataaccgcataattatctctgccagcaagcagtcctatgggcttaaaatgtcatgccagaccaagccatctcaaaatgaggagttcatcatttgcaaccgaaaatacagcgtgctgtttacaaccatcgataagaatgacaagattgaagtcaacactggagatcagacaagttatatatacgaaaaagactcccggtgtaagacctggttgtgcaaagttcgtgatgagggcatcagcgtgcttttcgaacccctgaaggcgtttttcggttcttacttttcaattatcttctatgtagtggtcggcatcattgtgctatttctggttatatacatcttccttccgatgtttttcaaactcaaggacgtgctgaagaaaaatgagtatttgtacctgcaggagttaaagcacagatga

SEQ ID NO: 10913 - RNA, 4314 nt, synthetic construct
  misc_feature 1..4314: note = derived and/or modified CDS sequence (opt3) from GERV__M21951.1__GP
  source 1..4314: mol_type = other RNA
atggccatcagcacctccctgctcattgtggcacttctgataaagttgtgcttagtcaacacagctccccctatctctaaatgtttccaggacggcattctgatcgccgagctaaagtcaagtagcgggatttccgaattttgcatcaaagatgacatatctatcctcaagtcggagattacttactcaaagaatgatacgggaatcttcatgcacagcaaggtttttagacattggaccgtggcggactggaagcaatgtaaccacacaagtgctggtggctccactaatgtactggaagtggataaaaaccttaatctggtcgccaagaactatatgtgcaccaggccatgtgtgattacaatcgacaaagagaatgcacagctcttgttccagaccgaacagctgaaccaatttgaggttactgggacaaccatatctacgggatggttcaagagcaaaacttccgtgtcactggataatacctgcgagcatattaaggtcacatgtggcaagaaaagtctccagtttcacgcctgcttcaagcagcatatgagctgtgtgcggtttttacaccgctctgtactgccgggttacatggcttcctcaatctgccagaacattgaacttatcatcattataatcttgactctggcaattttcatctttatgtgtataattacccgaacatatatctgctacctaatgctccccctgttcgcccctatcgcttatctttacgggtggctgtataatcgtagctgcaaaaagtgtatttgctgtggattggcctaccacccatttaccaactgcggcagttactgtgtttgcggctctagattcgagacgtccgacaggatgcggctccatcgcgaaagcgggctgtgtcaaggattcaaatcgttaagagtggcgaggtctctgtgcaagtccaaaggttcaagtctcgtcatcagcattcttactgcaatgctgatattgtcctttatcacacccctagaggccatgaccactaattatcctgatgacaagaagttcacactgaaagaggtgaacgatattgtgctcggccgggacatggaacaggagctgaagtctagcatccttatcctgatgtcaatttgtgggataggaatcattttgatctttttcggcctcaccgtcctgttagaaattgttctggagctaatcgctaaacgcagtacgatattttgcaaggaatgtaatctcatccacgataaaaagtccatgacctaccgaggtgacttcacaaacaagtgcgggttttgcccatgtggagagctggaggaccccgaaggccttgtgattcatactaccagaaaaagctgcacatattacatcaagattaggaacttgaaactgatcatgctcatattctctattgtaatcctgatgcagaatgccactatgcttgtggtcgcaggcgagaactgttggaccaatacagaaattaaggctgattgcgtggggcctctgatcggaccatcagcctgtaccaacaaaggtagtaagacttataagacggttgcgcaggagttggtgacagccagcaaaataacccaactcgacgcagataagtacgtcctgttaggcgacactatcgaatccgctctggatgccattacctctcagaaacactattcggctatgcacctactcgagacaatgtttctgatgaagcattgcgactactacaaagtgtatgagcacaatagcgggtactcccagaccaagtggcggcttatcgccattgcaaactcattcgatatctgtactaatacaccgacgcccaacttttgcaagtgtttgagtgactctagctgctccaccactacactgaatttcgccacctcaatgaacgctacatatactagcaaagtagaatttttcaatcatgatttcaccctctttctggacatattcgaggcggcatttcctggatctgccacggctttcttatttaagaaaattaaggagaaaaacccataccaagccttcgaaatgatgggcaagatcgcaaataaatatcccaacaataagctgcttgttgtgatcttgaagtacggtcagtatatggtcgggctctcccacgccagtacctaccagctgaaacaggaatgggtggctaagagcctatctctgacacgtgcccaacgcactggcctcaaaatgtccatggcaaacgcggagcctggaccagctaccaaggagtgttcagatgccaaaacaattgcatgcctgactcccaagtttcaggtcgaagtgaacaatcttatgagttgcggcgccagcccgaacttcaagatctacgttaaaaccggggagttgtataaggctcatgacagaaattcggtgtggtgtctgaacgacatgcactgcttaacgccttacacacccgccaatgcagaaattataaccactatgaaaaagatggattgttggcaggacaacccaaaacagcctacagatgagtatgctatccccaagaggtcctgccaaatgaaggaccggggactctgtaattctggtgccgataaatggaagattatcaaatgcgacaaccacaagctgttttacaccgatgcgcttgagcgacgcgacccagccagcattgtaggctcaaatcattgtttcagtgaaaaatgccagatcgagagatatcccataaaccctacttccctgaccaattgtgaatggttgtacagggctgtccggccagagtatatcaagaagctctctctgcagacaattgaagagtacaaaaaggcaatcgccgataaactaacgcacaccctgcagctctaccattttgctccgctgcttgagaacttgccccacattaagcctacttataaatacatcacagcccaagggacctatacagcagacggaatagaaggcgcgagcattactacctccatcccagccctgtcaggtacgagcgtggggttcaagatcaatgctaaagatggcacagacttactcgatattgttgtgtacataaaggccagtgtcgtgaagtctatctataaccacatttacgacaccggacccactatcaatattaactccaaacatgacgagctgtgcaccggccagtgtcctaagaaaatcccagcagatcccaactggcttacatttagccaggaacgcacttcgagatgggggtgcgaggaatttggatgcctggctataaataccggttgtgtatatggctcatgccaggacgtgatcaggacagagacgaaggtttaccgtaaagccaacgaggaaaccgtcatgctaactgtgtgtattacatacccggggcacaccttctgcactgatgtgaatgcacatgagcctaagatcacagacgaactcgagctgcaatttaagaccattgatatcaaatctttgccaaacctggtcgccgttacgaatcacaagttatatactggacagataaacgacctcggcaccttcggtcagatgtgtgggaatgtgcagaaaacaaacaccagtcatactggcgctggaacacccaagtttgattatacctgctactccgcgagccggaaagacattatcatccgaagatgttacaataacaattatgattcttgcaggctgcttaaccaagaaagcgacctgttgttcgatgacaatcacgagacactcgtggtatacaacaataagcgcctgaacggcgagctagccctgaaacttctcctgggggatattcagtataaattgtacactgaaaacatggagctggaattagaggcaaagtgtgtcggatgcgtgggctgttttgagtcctaccagtgcaatctccaaatcacctcaagtctggacgaaacggctctttatctggttcctgtgagccacttccatgaccggatacagattaaaacaaccaagaaagattacgccatgaagatctcttgcactagagaccccggtgataaggcctcctttagggtctgtgggaaatcatatgacttcaactttcacaccgtgccaaagaatgataaaattgaggttaacgtgggagacgaaacaagttacatcaaggagaaagataatcgctgcggccgatggttgtgtcgggtacgtgacgaaggtctcagcgtcatattcgagcctctgaacaatttcttcggcaactatctaaatatgttcctgtacattcttgggggaatcatcctcctgtttttggctttatatattctgatgcccatgtgcgcaagactcagggatgagctgaagcgcaacgaacggcttcatcagatggagatgaagaaaagatga

SEQ ID NO: 10914 - RNA, 4260 nt, synthetic construct
  misc_feature 1..4260: note = derived and/or modified CDS sequence (opt3) from IACOV(BeAn314206)__JN572066.1__GP
  source 1..4260: mol_type = other RNA
atgagagtgatcgccctgttccacctcgtcatggttattaccgctaaccccgtgtttcataggtgcttccagggcgggcaacttatactggagaagaaaagccacgtatccatgtctgaattttgtttgaaggacgatgtgtcaatggtcaaaagtgtggttgagtacgaaaagacaaataacagcatcgtgggaactaataaagtctatcggcagtgggtggtatccgactggaagttatgccatcctattaaggcagagggtggcgggatcaacattatcgaagttgagaaagatctgacgataaagtctaatacctacatctgtacaactgactgcaccattacagtggataaagagaacgcccagatcattttccagacctcgaagctaaatcactttgaagtcactggaacaaccctctcaacgggctggttcaaaactaaggcggctgtgaccctggaccaaacatgtgagcatatccgcgtgagctgcggtaagaaaagtatacagtttcacgcctgtttccgacagcacatgacttgcgtccgttttcttcatagatccctgttgccagggtctatggcaaacagcatttgtcagaatgttgaactcatcattatcatcgtgctgaccctgctcattttcatagtattaaacatcattgccaagacatatatctgctacctgatgcttccgatatttatgcccattgcttatatctacggatggatctataataggtcctgtaaaaagtgcgtgaactgcggcttggcataccaccctttctcaaattgtggcagtcattgcgtctgtggggccatttttcaaaccagcgatcggatgcgcatgcacagagagtctggactgtgctccggtttcaaatcactaagggtggctcgggttctctgtaagagcaaaagttcttccctggtgatcgccattcttagctcgctgttgatactctctttcgtcacgccaatcgagggcctggacttagaagagaagaagtactccctgtcagatctccccgacatttatactaaagaacttaacacactgagtgagaagatcgcgatcaatttttacattagcataaccaacatgttgatcactattatcctactgattgtggcattctgctcccactgtatcacaaacaaaatagtaaagtataaagcctttctctgcaccgaatgtgatatgtaccatacgtataagaatatccgctacaacggggacttctgcaataagtgtggatcttgtacctgcggcacaatggaggatcctaactatactaccatgcacaaagttagcgacctgtgccttgctgagccaaagcgaattatccagaaaaagctgatgattatcttgataatttttgtgatcattgaaaatggtgcctgcctcgcatcagctgaggaaaaatgtttcaaggagcatgactacaacatcgaatgcatagggcccctgatcacaatgagaccttgtactaagaaaaccattcaggaggtcgccaggacattagtgaccgataagcagatcgcgcaagaggacactgaaaagattgagctgctaccagatagtatcgtccaggcctggaatatgatagacaaccagctcaattacgatcaaatgtttctgatggaatatgcattccttaagcgggagtgctcctttttcgaagagtttgagcacaacagcggagtgaatcagattatgtggcgtacgatcgctaaaacaggccatttcgacatctgtgccattagatcttcacagcgcttttgcaagtgtatgagtgaaagcgtttactgcaaggatgctaactgggacatcgccaatgagatgaacgatacctattccttcaaaccgttgttctacaggcacgacgtgaagctgtattctaaaatttttaaggcagccttccagggcactaccctcaaaacatacgaaaagtttctgaatgctaaaaacaagaccgagcttataaacatgctgaagaaattggggaagcggttcccctataataacctcctgatgggatttttaaaattcggtgagctgctatttgatctcactctgttcgacgcgcttcctaaggacaaaacatcgcgaacgagctccaccactgcaaagcgcgaatacgagaatttgcaagatgccaaggtaggcgaaccaacatcagagtgtaaagacatgaagctgctccagtgcatcagtcccagataccaggtctctgtggggagcgttattaaatgcggagataccgaaaagaaaatctatgactttcacacacctgtgtacaagctggctactgatgagaccaagtggtgtaggttcgacaaacattgcttacacgagtgggtcccaattgataacgcccggctggaaatgcttaagaaattgaattgttggtatacggaccccaccgagatggtggatatctacacaacttcccgcaagtcatgcagaatgataaacaaaggcacctgtaatatcaagaacgcaccgatgacagtaatgcagtgcgacgatgacctcattttctatactgatcataggagctctgccgacacccaaggtgacatcggggaatactgtctgtcccagaattgcgatgtgagtcgttatcctattaacgttatggacggcatgacgtgtacatgggagtacaataccgtcaagcccaaatacctaagcaagactgaactgaaaacactcgaggagtataagcggaccctgcaggataaactttctcacaacttggaagtgtaccacttccatatgactgctaattttccacacatcaagcctgtgtataaatacataaccgccggaggcgtcgagacatccgacgggattgaaggagcattcatcctggttgatttacccgcgctctcaggtacgagtgtgggcctgaccgtgcttagcaaggacgatgtaccactgatggacgtcatcatttatataaagtcggctgtgatcaaagccacttacaaccatatttatgatacagggcccaccatcggaattaatgttaagcacgaggaattgtgcacaggcccttgtccacagaacatcccgcatcaagagcagtggctcactttctcccaggagcgaacctctagatggggttgcgaagagtttgggtgcctggcagtgggcgaaggatgtgtctacggcagctgccaggacataatcaaaaaggagacgagggtgtacaaaaaggtttcagaggaaattaacgagatcacattctgtattatctttcaaaccaatacttattgccagaccatgaacgccatagaaccccagattacacctagtctagaggtgcaactggaagggctcgatactaagatcctgccaaatatccttgctttgcagaaccacaaactgtactccggacagattaatgacttaggttctttcggcctcgcctgtgggaacgtacagcaagtcaataagaccatctatggagcaggccagcccaaatttgattacctgtgccacggtgctaagcgcaaagacataattgtgcggaagtgttataacaataacttcgggagctgcaaacttctgacaatcgaggacaatctaattgtggaggataactacaatacgatcaacgtcataaataccaaacatctcattggcactgttaagtccaaactgaacttgggagacatcagatataagctgtttaacaaaaagcctgaatttgagttagaagcccactgtgtgggctgcgtagggtgttttgcgaattacaactgcgagatcaagattgaatcaacaatcgatatgacctgcccaattagcggaccctgtgagttctttcataataacatattcatccaggccgagcacactaaatacgctatgaagatgatttgcaaaaagcagccggaccaaacaaccgagttcacgatctgtgataaaaagtatcattttatcattgacactgtggaaaagcacgatcagatagaaatcgacgtcggcgatcagaccagttacattctcgagaaagacaataggtgcggtacatggatgtgtaaggtgctggatgaagggctttctgttatcttcgagcctctgaaattgctcctgggaaactattttcacatggcaattgtgatcataatcggcctaattgccctggctgtcatcatttacatccttctcccaatgttcatgaagctgcgcgacaccttgaaagccaatgagatagcatatcagaaggaaatgaaaattaagtga

SEQ ID NO: 10915 - RNA, 4305 nt, synthetic construct
  misc_feature 1..4305: note = derived and/or modified CDS sequence (opt3) from ILEV(KO/2)__AY859372.1__GP
  source 1..4305: mol_type = other RNA
atgctgttccccatcattctccttatgatacagctggtgagctccacccctttgtctacaagatgctttcacgagggcactttagtcaaggaaaagatctcaacgaccagtattagcgagttctgtctgaaggacgatgtttccatgatcaaatctgaaattacataccaaaagaacgacactggggtgtatggacattcgaaaatctacaggaattggatagtaaaggagtggaaggcctgcaacccagtgccgtcagctggtggcagcatcaatgtcattgaagtgaacgaggatatgagtctagcaaccaaaaattatatctgtacacgggactgcgttattaccgtggataaggaggacgcccagatcgtctttcagactgataacctcaatcacttcgaagtgtccgggacaaccctgtctagcggatggtttaaaacgaaggcgtccgtaactcttgaccgcacctgtgagcatataaaagtttcatgcggcaagaagacagtgcagttccacgcttgttttcgaaaccatatgagttgcgtccgtttctttcacaatactattctgcccggttacatggccaccagcatctgtcaaaacattgaattgatcatcattatagtgctcacaatcgcaattttcatcatgctggtgatactgaccaaaacgtatatttgctacctcttaatgcctctgtttatgccaatcgcctattgttacgggtgggcttacaataagtcttgcaaaaagtgcaactgttgcggacttgcatatcaccccttcactaattgtggctccttttgcgtctgtggcttgaaattcgaggcctcagatagaatgaggatccatcgggagagcgggctgtgccagggatacaagagtctacgcgttgctagaaggctctgtaaatctaagggttccagcttcgtgatttcgatcctgctttctctgtttattttgtccttcgtaacacctatagaaggcaccatgactaactatccagaggaacggaagtacacactcgaggaaatcgccgacgtgattgaggggttttatcaggaggcgaaaatcaaggaatacatcgtcttctattcaagtatttttgggagcttcatactgatctcctctatgttaattctgtacaaactccagaatatcacctactttcttagcaagttcaacgtgatgtattgctcagagtgtagtatgtaccactccaaaaagaacattaagtatctgggcgattttacgaataaatgcggtttctgtacctgcggggaattggaggacgcagaaggactaagcatccataaggttacaaaacgctgcacttacgcctatcaaatgacctggacaaagataatcctggctactctcctgattcttctgatcggccagaacaccttgctcgtggtctctgcccaggcagattgttgggagaaaacagagattaccatcgactgcataggccccatttttgctcctaatacttgtatcaagcaggaagagaagacgtacgccaaagaagcgcaaacactggtggaccagaacaagatttcacaggccgatgcaaaacaagtagacatgttaggggctaccatcgatgacgccataaaggctatccgaagtcagaaaacttataccacaatgcacatgctggaggccattttcctaagcaagtactgcgattactattccctctttgaacacaattctggatactcgcagggtaagtggagactgatcgcaaaaaccgagagcttcgacatttgttccaggcatactacacaccatttctgccggtgtatgtcagatgagacgaagtgcaaaaacggcgactgggattttgccggggaaatgaatagtacctatcactctaagagcaacttccttttgcatgacctgcgtctcttttacaaaatctattccgctgcgttcccaggactgtcagaggcaatgctttacaagtttctgagcgaaaaagatactacaaatgccataaagttgctcgagaagctgttcaccaaatattcttacaacaatttactggttggcattctacgctttggtaagttcctcttttccatgagtatcttcaacacaactgagctgggaggcgctcagaaagccatgatccttagaccgaccgacgaattgaggacgacctacagcggaaagcaagagtctctgtccaattcagtggtcggcgaacagacaagtgactgtgtgaacatgaaaaagattagctgcatctcgccccggtttaatattcctctctcctctatgatagcatgtgggaaccagccaaactatcagatctacaaggagcccagcaaatattacaagtcaaataacaaacctaatacttggtgcaacaaggatattcactgcctgaatgacttcgaaagtatcgatcaatccgccttagaccgactgaaaaccatgacatgttttcttattgatccaatcactaccgaggacgtctattctatagctatccacagctgcaaggtgaaggataaaggacagtgtacgattcgcgacaagaaatggaacatcattaagtgcgattccgagttgctctactatacagaccatagagaaggtgaggataccggcaatgaaatcgggcactactgtctgtcacataaatgcggaactgacaggtaccccataaacccggagattatcaaggattgtatctgggagttccggagccgcaagagtgaatatattaatagagttgacctagagtctctggaagagttcaaaagggccctctccgacaagctgacacacacccttactatatacaactttaaacctaccgcaaatttgccccacatcaagccaatttataaatacatcacagcgctgggcgtggaaaacagcgatggtttagaggctgcctatattctcacgtcgatccctgcacttgggggcacctcaataggatacaatatcatgactaaggacaacttccccgtaatggatgtcattatctatgtgaaatctgccgttattcagacaacctacaatcatatctacgacacaggcccaactatagggattaacagtaagcacgatgaaaagtgcaccggatcctgtccccagaacatcacgcatgaccaaaattggctgacatttagccaggagcgtgcttctcggtggggttgcgaggagttcggctgtctggccatcaacaccgggtgcgtgtttggaagctgccaggatatgattcgatccgacactaaagtctataagaaagcattggaagaaaccgtggtactcacagtgtgtatcaattaccctggcaacactttctgcaccgaggttaattcagtcgagacaaagatgacggatgacgtggaactgcagtttaaaaccgtggatactaagacactaccaaacctgctcgctgtcaccaatcacaagctgtatagtggtcaaataaacgaccttgggagcttctctcagatgtgtggcaatgttcagaaaactaactccacagtgatgggagccggcaccgtgaagtttgattacatttgccatggggcgtcaagaaaagacatcattatcaggcgctgttatatgaataactacgccagttgcagcttgctgaaggaggaaaaagacttaatattcgctgataatcacgagacgattactgtatccaactctaagcacctcgtcggagaactgcaaatcaaacttatgctgggcgacatccggtataaactatttgcagagagaccggagctcgaagtggatgccaagtgtgttggttgcccctcgtgtttcgagagctactcatgcaatttccagattgtgaccaacatcgacacagtctgtaccctggaagggccttgcactatttttcataacaggataatcatttccagtacaaaacagtcttacggaatcaagatgagctgcccaaccaaacccaatcacatcgagaagttcaagatttgtaaccatgaatatgatatattgtttgacacagtggctaaaaatgataagatcgagattgacactggcgatcagaccctgttcgttcgcgagaaagacacgcgatgcaagacatggttatgtcgggtgaaagatgaaggtatctccgtaatttttgagcctctccgtgccttctttggctcatacttctctatcatattttatatcattctggcagcgatccttattttcgtcggggtgtacatctttctgccaatgttcatgagattgagggacgtgctcaagcgcaacgaacacctgtatctacaagagataaagcataaatga

SEQ ID NO: 10916 - RNA, 4305 nt, synthetic construct
  misc_feature 1..4305: note = derived and/or modified CDS sequence (opt3) from ILEV(R5964)__KF234074.1__GP
  source 1..4305: mol_type = other RNA
atgctgttccccatcattctccttatgatacagctggtgagctccacccctttgtctacaagatgctttcacgagggcactttagtcaaggaaaagatctcaacgaccagtattagcgagttctgtctgaaggacgatgtttccatgatcaaatctgaaattacataccaaaagaacgacactggggtgtatggacattcgaaaatctacaggaattggatagtaaaggagtggaaggcctgcaacccagtgccgtcagctggtggcagcatcaatgtcattgaagtgaacgaggatatgagtctagcaaccaaaaattatatctgtacacgggactgcgttattaccgtggataaggaggacgcccagatcatatttcagactgataacctcaatcacttcgaagtctccgggacaaccctgtctagcggatggtttaaaacgaaggcgtccgtgactcttgaccgcacctgtgagcatattaaagtatcatgcggcaagaagacagttcagttccacgcttgttttcgaaaccatatgagttgcgtgcgtttctttcacaatactatcctgcccggttacatggccaccagcatttgtcaaaacatcgaattgatcattataatcgtcctcacaattgcaatcttcataatgctggtgattctgaccaaaacgtatatctgctacctcttaatgcctctgtttatgccaatcgcctattgttacgggtgggcttacaataagtcttgcaaaaagtgcaactgttgcggacttgcatatcaccccttcactaattgtggctccttttgcgtgtgtggcttgaaattcgaggcctcagatagaatgaggattcatcgggagagcgggctgtgccagggatacaagagtctacgcgtcgctagaaggctctgtaaatctaagggttccagcttcgttatctcgattctgctttctctgtttatattgtccttcgtgacacctatcgaaggcaccatgactaactatccagaggaacggaagtacacactcgaggaaattgccgacgtaatcgaggggttttatcaggaggcgaaaatcaaggaatacattgtgttctattcaagtatatttgggagcttcatcctgatttcctctatgttaatcctgtacaaactccagaatattacctactttcttagcaagttcaacgtcatgtattgctcagagtgtagtatgtaccactccaaaaagaacatcaagtatctgggcgattttacgaataaatgcggtttctgtacctgcggggaattggaggacgcagaaggactaagcatacataaggtgacaaaacgctgcacttacgcctatcaaatgacctggacaaagatcattctggctactctcctgatccttctgattggccagaacaccttgctcgttgtgtctgcccaggcagattgttgggagaaaacagagatcaccatagactgcattggccccatctttgctcctaatacttgtattaagcaggaagagaagacgtacgccaaagaagcgcaaacactggtcgaccagaacaagatctcacaggccgatgcagagcaagtggacatgttaggggctaccatagatgacgccatcaaagctattcgaagtcagaagacttataccacaatgcacatgctggaagccatcttcctaagcaaatactgcgattactattccctctttgagcacaattctggatactcgcagggtaagtggagactgattgcaaagaccgagagcttcgacatctgttccaggcatactacacaccatttctgccggtgtatgtcagatgaaacgaaatgcaagaacggcgactgggattttgccggggagatgaatagtacctatcactctaaaagcaacttccttttgcatgacctgcgtctcttttacaagatatattccgctgcgttcccaggactgtcagaagcaatgctttacaaatttctgagcgagaaggatactacaaatgccattaaattgctcgagaagctgttcaccaagtattcttacaacaatttactggtaggcatcctacgctttggtaaattcctcttttccatgagtatcttcaacacaactgaactgggaggcgctcagaaggccatgattcttagaccgaccgacgagttgaggacgacctacagcggaaaacaagaatctctgtccaattcagttgtgggcgagcagacaagtgactgtgtcaacatgaagaaaatcagctgcatttcgccccggtttaatatacctctctcctctatgatcgcatgtgggaaccagccaaactatcagatttacaaggaacccagcaagtattacaaatcaaataacaagcctaatacttggtgcaacaaagatatccactgcctgaatgacttcgagagtattgatcaatccgccttagaccgactgaagaccatgacatgttttcttatcgatccaataactaccgaggacgtgtattctatcgctattcacagctgcaaagtcaaggataagggacagtgtacgatccgcgacaaaaagtggaacattatcaaatgcgattccgaattgctctactatacagaccatagagagggtgaagataccggcaatgagatagggcactactgtctgtcacataagtgcggaactgacaggtaccccattaacccggaaatcatcaaagattgtatttgggagttccggagccgcaagagtgagtatataaatagagtggacctagaatctctggaggagttcaagagggccctctccgacaaactgacacacacccttactatctacaactttaagcctaccgcaaatttgccccacattaaaccaatctataagtacattacagcgctgggcgttgaaaacagcgatggtttagaagctgcctatatcctcacgtcgatacctgcacttgggggcacctcaatcggatacaatattatgactaaagacaacttccccgtgatggatgtaatcatttatgtcaagtctgccgtgatccagacaacctacaatcatatatacgacacaggcccaactattgggatcaacagtaaacacgatgagaagtgcaccggatcctgtccccagaacatcacgcatgaccaaaattggctgacatttagccaggagcgtacctctcggtggggttgcgaagagttcggctgtctggctattaacactgggtgcgtttttggaagctgccaggatatgatccgatccgacaccaaggtgtataaaaaggccttggaagagacagtcgtgctcactgtatgtataaattaccctggcaacaccttctgcacagaggttaattcagtggaaacgaaaatgaccgatgacgtcgagctgcagtttaagactgtggatacaaaaaccctaccaaacctgctcgcagtgactaatcacaagctgtatagtggtcaaattaacgaccttgggagcttctctcagatgtgtggcaatgtccagaagacaaactccaccgttatgggagctggcacggtgaaatttgattacatctgccatggggcctcaagaaaggacattatcataaggcgctgttatatgaataactacgcgagttgcagcttgctgaaagaagagaaggacttaattttcgccgataatcacgaaactatcaccgtgtccaactctaaacacctcgtaggagagctgcaaatcaaacttatgctgggcgacattcggtataagctatttgctgagagaccggaactcgaggtcgatgcaaaatgtgtgggttgcccctcgtgtttcgaaagctactcatgcaatttccagatcgttacaaacattgacaccgtgtgtactctggaggggccttgcacaatatttcataacaggatcattatctccagtaccaagcagtcttacggaatcaaaatgagctgcccaacaaagcccaatcacattgaaaaattcaagatatgtaaccatgagtatgatatcttgtttgacactgtcgccaagaatgataaaattgagatcgacaccggcgatcagacgctgttcgtgcgcgaaaaggacacacgatgcaaaacctggttatgtcgggttaaggatgagggtatttccgtgatctttgaacctctccgtgctttctttggctcatacttctctataatcttttatattatcctggccgcaattcttatcttcgtaggggtctacatatttctgccaatgttcatgagattgagggacgtgctcaaacgcaacgagcacctgtatctacaagaaattaagcataagtga
